United States Patent 7,834,146 (RECOMBINANT POLYPEPTIDES ASSOCIATED WITH PLANTS) - sequence listing, part 10

SEQ ID NO: 42330 - protein, 200 aa, Sorghum bicolor
  Clone ID: SORBI-28MAY03-C37293_1.pep
ARGTFLYVDILDTTGSLYTMARFAGFVDDVTGEFEGQYFAFMSDATAIVFGSLLGTSPVTAFIESSTGIREGGRTGLAALTTAAYFAAALFITPVLASIPSWAVGPPLVLVGVMMMRAVAEVDWDDMRQAVPAFLTLALMPLTYSIAYGLVGGIASYMLLHSWDWACHATKRLGCRKKIGGGAERTNCGGEEQRKDMESA

SEQ ID NO: 42331 - protein, 171 aa, Sorghum bicolor
  Clone ID: SORBI-28MAY03-C37350_1.pep
YVMLVGAYPFEDPDDPKNIRKTIQQIMQVQYKIPDYVHISTECQQLLARIFVANPMRRITMKEIKSHPWFLKNLPRELTETAQGMYYRRDNRVPSYSDQSSEEIMKIVQDARTMPKSSRSGYGWSTEYSDEEEEKEEEHRPEEHEEQEDEYDRRVKEVHASGELRLDALHI

SEQ ID NO: 42332 - protein, 277 aa, Sorghum bicolor
  Clone ID: SORBI-28MAY03-C37356_1.pep
ARGCDGTGDGPASLAFAGCLAGLLALELRACRAVADRVLLLAADHCRTLTSLLVYDGGSSEALHRFIQQRAAGLHTLDLRLPLDLHNDHLLAIGAGSVQHGQDATHGLAALRLQSCVLITGHGLRSLARTATGAGIEELALVSCDVVEREPGLLTFLSQSMPRLRRLNLSYNETLNDKVIGAMLSSCRNLIEIRLRGCRGLTGGSLISLLRHCGQSLEILDISRCPGIAVGNVELFAQRATRLNHMIIEESAMSEELKAIAQRKGMKVGSLPCEGPF

SEQ ID NO: 42333 - protein, 127 aa, Sorghum bicolor
  Clone ID: SORBI-28MAY03-C39582_1.pep
STALPRTAQETQNFGGDLWRRRAEIPPFSLWQLGSGGRQQCSRLAARKGKTFSWMASRSKFLRLRGSREEFFQLKNRSRIPSANCYHSSSFSLSAPQELQISLLPLYAVDFCFRLPALPLSTLQCAK

SEQ ID NO: 42334 - protein, 196 aa, Sorghum bicolor
  Clone ID: SORBI-28MAY03-C39598_1.pep
MKVEVVETTLVPPSEATPRHALWLSNLDLAVPKTHTPLVYYYPRPPDPDPEPDADAPAGEGSFFDPARLREALASALVAFYPLAGRLVVGQGGRIEIDCTGEGALFVVARADFTGDDMFRDFEPSPEARRLLVPFAESGDPPCVLAMVQVTFLKCGGVAVGTGMHHVTMDGAGAIQFIRAWTALARGESPTWAPTY

SEQ ID NO: 42335 - protein, 217 aa, Sorghum bicolor
  Clone ID: SORBI-28MAY03-C39624_1.pep
MDPTSPSPAARRAAAVARHLAGATAPFPASTPLEPSCCLSYVPPESTERPAAFAPGDLRLLLDGHDLPARDWLFRAMEESPLFRSPSARTGSRVFVGADLNDGKEGQREATMRRIAYLKQRGVFRGWLTKDGADAELRKLALLDCIAIYDHSLAIKIGVHFFLWGSAIKFLGTKRHHDKWLVATENYDIMGCFAMTELGHGSNVRGIETIATYDSET

SEQ ID NO: 42336 - protein, 264 aa, Sorghum bicolor
  Clone ID: SORBI-28MAY03-C38313_1.pep
ARGRDRRPVMSMPDRARRLPPPERAYDRRPPAPVYPKRSPRREYGRRDELPPPRSRATIDYSPRVPVDRRPSLRDDYSPRGSGYSDLRPRSAPRLSDRRAYADDSYGGKFDRPLPSYREGRGRDYDTISGSKRPYADLDDVPRYQEIGVRQSKARLDYDIGGSSARYGDTYSERSGRPHVGYSSSRSIPGHDSAYGSSRHGMSYGGSASSADAGGMYPPSYSGSYGSRGSDVGGSSYSSLYSSSRNLGSSNGGYYGGSGSGSYY

SEQ ID NO: 42337 - protein, 182 aa, Sorghum bicolor
  Clone ID: SORBI-28MAY03-C38408_1.pep
ELTVQHIKDIPLDKVLAKQQMDLLTAKSWLMENKELERKVVKLSIQNSLPSEYTRMVLLQTSLDKIDPAQQAKNKPTKQSSPDELPAMPLGGLALGFGDVAATRENLTTGFGDMKAPEKFVIFEKAVGCCSRVADCCCCMCFIKACSKMNDQCAIVMAQACAALACLGCFECCSELCCGGSN

SEQ ID NO: 42338 - protein, 389 aa, Sorghum bicolor
  unsure (1)..(389): unsure at all Xaa locations
  Clone ID: SORBI-28MAY03-C38434_1.pep
LTRQILAPNFDRSYARPAELLVSTSGKNSKQEKGENSGAYIIRLPFGPKDKYXAKEHLWPFIQEFVDGALSHIVRMSKAIGEETGRVHPVWPAVIHGHYASAGIAAALLSGALNLPMAFTGHFLGKDKLEGLLKQGRQTREQINMTYKIMCRIEAEELSLDASEIVIASTRQEIEEQWNLYDGFEVILARKLRARVKRGANCYGRFMPRMVIIPPGVEFGHIIHDFDMDGEEENPSPASEDPPIWSQIMRFFTNPRKPMILAVARPYPEKNITTLVKAFGECRPLRELANLTLIMGNREAISKMHNMSAAVLTSVLTLIDEYDLYGQVAYPKHHXHSEVPDIYRLAARTKGAFVNVAYFEQFGVTLIEAAMNGLPIIATKNGAPVEINQ

SEQ ID NO: 42339 - protein, 97 aa, Sorghum bicolor
  unsure (1)..(97): unsure at all Xaa locations
  Clone ID: SORBI-28MAY03-C38461_1.pep
HGSGTTSCCAARRRPTSRRPTPPAAGPCASRASAPPASTTAAPAXTPPPEAPSPAGEPPAPPPTSGGTAAAPEVSSSAHSWSSDSEVGRTNPPDPKP

SEQ ID NO: 42340 - protein, 168 aa, Sorghum bicolor
  Clone ID: SORBI-28MAY03-C3847_1.pep
VRLYLKISSFLSMETAALTSHSLQCPAAAAAAAVHGKRRRGGGAAALPRRRQTFAGRIRALPSAEVISEILHPKLVPGSPSDTGDVSSLVPVSALMLLFYFVSNWVVPELLMKRLNEPKPEEDEAAAAAASMASSGAADGGDDAAASPRKIRLKVKKKKNGKATIVKV

SEQ ID NO: 42341 - protein, 175 aa, Sorghum bicolor
  Clone ID: SORBI-28MAY03-C38476_1.pep
MGADGGLNRAAEKPRDGEGGEARVFRCTDYSLPRTTLALTLWLGGIHFNVLLVLASLFLLSRRAAAIVVAFQLFFMFAPVNDRDKWGRSVARFICRHAMGYFPISLHVEDYKSFDPSRAYVFGYEPHSVLPIGLSALADLVGFMPLTKIKILASSAVFYTPFLRQIWTWLGLVPA

SEQ ID NO: 42342 - protein, 333 aa, Sorghum bicolor
  Clone ID: SORBI-28MAY03-C4013_1.pep
RPVIFQLSEDIPCISAVVVALLADPEPKIDYTLKAIGGSLTAVPGLSDMIDDTVNSIVSDMLLWPHRHVVKLGVNVDTSDLELKPQGRLSVTVVKATSLRNKEMIGKSDPYVKLYLRPMFKVKTKVIDDELNPEWNETFDLIVEDKETQSVIFEVYDEDKLQQDKRLGVAKLAVNPLEPEITQEFTLKLLHSLDPIKNRDTKDRGTLHLKVKYHPFTKEEQLEALEMEKQAIEERKRLKEAGVIGSTMDAVGGAASLVGSGVGFVGTGIGAGIGLVGSGIGAGAGLVGSGIGAVGSGLGKAGKFMGRTVTGPFSMSRKNGSSSTAPQPDQPSA

SEQ ID NO: 42343 - protein, 146 aa, Sorghum bicolor
  Clone ID: SORBI-28MAY03-C4016_1.pep
DAWARDEGVRSLWRGSSLTVNRAMIVTASQLATYDQAKEAILARRGPGADGLATHVAASFTAGIVAAAASNPVDVVKTRMMNMKVAPGAPPPYAGAVDCALKTVRSEGPMALYKGFIPTVMRQGPFTVVLFVTLEQVRKVFKGVDF

SEQ ID NO: 42344 - protein, 192 aa, Sorghum bicolor
  Clone ID: SORBI-28MAY03-C4028_1.pep
TRERERERERERERERLDLMSSWVSHLPPEVQFRRVVGHGLNAQELARNPRLDYFFVKDLNKEQQLELQSGTFDAVLCTVSVQYLQSPEKVFAEMFRVLKPGGVCIVSFSNRMFYEKAVSAWRDGTAYSRVQLVTQYFQCVEGFTQPEVIRKLPSAGGSSPSSPLDAVMRLFGVAGSDPFYAVISYRNFKPM

SEQ ID NO: 42345 - protein, 67 aa, Sorghum bicolor
  Clone ID: SORBI-28MAY03-C40338_1.pep
KMPRTVVALDGGLYEHYKKFSSCVEATLTDLLGEEASSSVVAKLANDGSGIGAALLAASHSQYGESH

SEQ ID NO: 42346 - protein, 313 aa, Sorghum bicolor
  Clone ID: SORBI-28MAY03-C40423_1.pep
MVSGGSIKEQQHEMNISFGMMNHHHQQQPPSSSSSSSLHAAAASFMSGKQASGAYDHLGELDQALFMYLDHGSSHVHGGTQQEHQRQTLNIFPSQPMHVEPSPKGEISLVLSPAPVGSKQPARSPDHHHHQHQQAAMEELAGSRRQQQEHHHLQHQPFAAAAAEPAAPVGMIKDVKPLAKKDHRRGTSTSERDPKTLRRLAQNREAARKSRLRKKAYIQQLESSRIRLAQLEQELHTARAQGVFFPNSGILADQGVAGKGVPIGGIDGLSSEAAMFDVEYGRWQEEHYRLMYELRAALQQHLPEGELQMYVES

SEQ ID NO: 42347 - protein, 77 aa, Sorghum bicolor
  Clone ID: SORBI-28MAY03-C38859_1.pep
LSQHSQIFNHHKLLLPSPKSFLWHKYENYIGCIQNVKVNILPCEISERVGHPTYSTSIQSHSAGVFMVPCRHAMLRL

SEQ ID NO: 42348 - protein, 316 aa, Sorghum bicolor
  Clone ID: SORBI-28MAY03-C39_1.pep
MSFLFKSSNGGTTEKTMPLEEQQEKINELRKVLGDHSSPAIQDFLSDASLARFLRARNWNVQKASKMMKAAVKWRLAFKPENICWDDISEEAETGKIYRADYKDKHGRTVLVLRPGLENTTSATGQIKYLVYSLEKAIMNLTEDQEKMVWLTDFQSWTLGSTPLKVTRETVNVLQDCYPERLGLAILYNPPRIFESFWKIVKPFLDQETRKKVKFVYSNDKESQKIMAEVFDMEELDSAFGGKNPATFEYNSYAERMQEDDKKMGSLHSSTNSLLESAEKEANGADSDASSEASFYSGTDSPKHEDGEHSIAKKSG

SEQ ID NO: 42349 - protein, 198 aa, Sorghum bicolor
  Clone ID: SORBI-28MAY03-C39265_1.pep
MERAAGEAGAPTPAARGGAAAPAGAGAGGGMVKGKSCKGCLYYSSALRSRARGPVCVGVTRAIPQVSERMVGELELEAIQEGRYLADFRYGCIGYSMYLDDKETPTGIRDKARAQLPVCAGVELLADRKVPTNVKKEDLKRRHYKPGQPGHVGDDFLTKFQRNAGLVANGVAKNLNRVGTYIKDTVGDMMQPYRKRPK

SEQ ID NO: 42350 - protein, 203 aa, Sorghum bicolor
  Clone ID: SORBI-28MAY03-C39379_1.pep
REAREVDVGEQLHSLAGVLRSFVAGGCRPVERAPPLPRLRAAASEAAPRLRGAARLPAPHPPLRSKRGGARRAGLVSSVGTITLIALTGLLIFMFFLLVATANAVIVSVLMSLAAAGGFLAIFFACLVAVYIGAVSAAIFAISATVISAVVGVMIATGWVGFFWMIWFAARKSMDLTKHSIGVTSSAIQSYSASRHVNQKPVD

SEQ ID NO: 42351 - protein, 182 aa, Sorghum bicolor
  unsure (1)..(182): unsure at all Xaa locations
  Clone ID: SORBI-28MAY03-C39436_1.pep
MPKAGGGAADEEEFRAEVEERLINEEYKIWKKNTPFLYDLVITHALEWPSLTVQWLPDRTEPPGKDHSVQKMILGTHTSDNEPNYLMLAQVQLPLDDAEADARHYDDEHTDIGGFGAASGKVQIVQQINHDGEVNRARYMPQNSFIIATKTVSAEVYVFDYSKHPSKPPLDGACXPDLRLKG

SEQ ID NO: 42352 - protein, 199 aa, Sorghum bicolor
  Clone ID: SORBI-28MAY03-C3931_1.pep
MAPVKAQDASTDQQTMLDAQLQLWHHTFGYIKSMALKAALDLRIPDAIHQHGGSATLPQIATKATLHPSKIPCLRRLMRVLTLTGVFQHSTTTDDDGGELVYELTPASRLLVGSVTTNVSPFLNMVLGTVFVSSFLDLGEWFQHELPDPSPFKLTHGRHVWDLAIHDASFAKLCDNGMVADSGFIMDVMVKECGDVFQG

SEQ ID NO: 42353 - protein, 181 aa, Sorghum bicolor
  unsure (1)..(181): unsure at all Xaa locations
  Clone ID: SORBI-28MAY03-C39560_1.pep
RPPRVHPQWWQPGVEVVREWHNKNKSPPGYSRKIITRRIKKASGPNMPPGGRSGKRVRAPEGSQLEPPSAQLRSSKRLQLSAIDGQPAEEGNGSAGAVQGNGAGAQQGNGAGGDDIAAAENDNGAADQDMATVHEDNVAAEDDTQAPAQRRPRDPRPPTKGAYLDKMXKAMGHRLPIAVAP

SEQ ID NO: 42354 - protein, 169 aa, Sorghum bicolor
  Clone ID: SORBI-28MAY03-C4135_1.pep
VRDSRPNIYSQGCLNNFLEVCLCKTKPSKHKFRAYAQEEVRPPTVSFGRDVEDEPVGGPRSKVEDDLEIGSDLLKISQRRNYEDVNVEVGGPHRLSSEMEGIANAKLVACSESQIPAVGSDVRVRHSSWDRRSGNWDMSSDVLTRSASDVIERSVFATEAAHPSLAETH

SEQ ID NO: 42355 - protein, 67 aa, Sorghum bicolor
  Clone ID: SORBI-28MAY03-C41419_1.pep
ILFNLNKFMAFETRDPFLIRQERENPTLTEWDRFAHREYIRLSMEEDGEDASNGSGDVWDESLEAPF

SEQ ID NO: 42356 - protein, 91 aa, Sorghum bicolor
  Clone ID: SORBI-28MAY03-C41478_1.pep
HSAHIRTAKSFSMTRSLCSSAFALLCKSRIAWEPQEGHTHLVLLQNPTAPHFLFLDFLLFFRAFSCLPSSIHSATRTNVVEQNRVILLFTA

SEQ ID NO: 42357 - protein, 180 aa, Sorghum bicolor
  Clone ID: SORBI-28MAY03-C41624_1.pep
HEASTKMGRLTEYQVIGRHLPTEANPTPKLYRMRIFAPNPVVAKSRFWYFLTQLRKVKKANGEIVSLNVIAEKRPTKVKNFGIWLRYDSRSGTHNMYKEFREMSRTDAVEALYQDMAARHRARFGSINILKVIEVDNAENIRRPYIKQLLTKDLKFPLPHRAAKPAGKKIFAYSRPSTFA

SEQ ID NO: 42358 - protein, 222 aa, Sorghum bicolor
  Clone ID: SORBI-28MAY03-C41684_1.pep
HEAEYENYVPCYYNVTDAVDVSDLGAGVLISYDRQCTRDGRVTCLVAPPRSYRIPVRWPSGKGFIWKDNVRISGQEFSSGSLFKRMMVEEDQISFPSDAHMADGVEDYAHQIAEMIGLRNEFNFNEAGVRTVLDIECGFGTLRAHLFERDLLTMCIANYEASGSQVQITLERGIPAMIGSFATKQLPYPYLSFDMVHCAKCNIEWYKNGMCLKSSFTCPGPR

SEQ ID NO: 42359 - protein, 189 aa, Sorghum bicolor
  Clone ID: SORBI-28MAY03-C41706_1.pep
MATPNGLARIETNGKKKHDNGVCHDDSSAPVRAQTIDELHSLQRKRSAPTTPIKDGAASPFAAALSEEERHRQQLQSISASLASLTRETGPKVVKGDPARKGEAAAKGAPPTPQKHHQHHHPAAPTIAVSDSSLKFTHVLYNLSPAELYEQAIKYEKGSFITSNGALATLSGAKTGRSPRDKRVVPPTS

SEQ ID NO: 42360 - protein, 213 aa, Sorghum bicolor
  unsure (1)..(213): unsure at all Xaa locations
  Clone ID: SORBI-28MAY03-C611_1.pep
SSRPACLEFVQLMELYYAGSHGMDIVTSVASXLEEKCKQANLKKTGWSILPMIDEVSKSLLEVTSGIEGAWVENNKFCVSVHYLNVVIRDWKVVAGLVKQVLEAFPRLKVTNGRMVLEVRPVIDWDKGKAVEFLLQSLGLNDSEDVIPIYIGDDRTDEDAFKVLRERKCGYGILVSQVPKDTTEAFYSLRDPSEVMGFLNSLVRWKKHSLRRN

SEQ ID NO: 42361 - protein, 205 aa, Sorghum bicolor
  Clone ID: SORBI-28MAY03-C61611_1.pep
MHDMNGAEKFFRRIKDDGLKPNVVVYGTLMKGYSKLNNVEKVMRVYERMRIQGVEPNQTIYTTIMDAHGRNSDFGNAVIWFKEMEARGYPPDQKAKNILLSLANTPEEQQEANELVGNGAIQLEVKPDNEEVDDDGHEVIHTDAGSHRLLDDTQTRNHVNGRIRAGNYTFDEDDNDDDDDDYEEEDDEEFNFVSFKDKRELNFAS

SEQ ID NO: 42362 - protein, 165 aa, Sorghum bicolor
  Clone ID: SORBI-28MAY03-C61612_1.pep
VLQMMRETGVKPKESTHRLIADAWKAVGLIENINNSNGSPNGPYAIDKLDDSDDNCNVQISEDDNKLQSFDESKGRAMNGRSRSSFLQITNALGCGGIVSAKVLKVGEFPSERLKAIKNTSFLQRSQRFQLLHLEFCRKQLKNGGFYSQSISSFKMVFSSRGYIY

SEQ ID NO: 42363 - protein, 153 aa, Sorghum bicolor
  Clone ID: SORBI-28MAY03-C61737_1.pep
QEKIFLAATKESSTDVNQQYTKITFTPTQADRFVLAFRAWLRKFGNSQPEWFGNPSQEALPSTVLSKREMLDRYEQHTLKCSSCKGAYHAFQTLQKVFMGATVVGCATAGIPADVQLRLLIGAAALISAAVAYAFHELQKNFVFVDYVHADID

SEQ ID NO: 42364 - protein, 314 aa, Sorghum bicolor
  Clone ID: SORBI-28MAY03-C61842_1.pep
MDRNQELEEVVPNDLDPLLGRENRESESSVELSPPQPATVSPPEIEDEETDGSSAACCRICLEAESEIGDELISPCMCKGTQQFVHRSCLDHWRSVKEGFAFSHCTTCKAQFHLRVETWEDNSWHKMKFRIFVARDVLLVFLAVQLTIAIIGAIAYFLDRDGSFRNSFSDGWDRFLSKHPIPFYYCIGVVVFFVLLGFFGLIVHCSSFNDNQDPCLAGCRNCCYGWGILDCLPASLEACFALVLVFIVVFAILGIAYGFLAATMAVQRIWQRHYHILTKRELTKEYVVEDLHGNYTAPKLDPEHEERLKMLKLL

SEQ ID NO: 42365 - protein, 327 aa, Sorghum bicolor
  unsure (1)..(327): unsure at all Xaa locations
  Clone ID: SORBI-28MAY03-C424_1.pep
KPFLPAIIPRVSPDLHDPDNAHEEREWRQPGHYIGIDASASGVNDARELWDNKRKPFTAEFIELDPTDDGFEAQVQEKGIQADMVCCMQHLQLSHSPASGAKKLLNNVSSLLKPGGYFFGLTPDSSTIWTKYQKNVEASHNKGLKAVPNSIRSENYTITWEVEEEKFPVFGKKYQLKFASDAVFENHCLVHFPSLLRLCXNRLAREAGLEYVEIQNLTEFYDDNRTQFAPMLGGYSASFLDARGKLVARSYDILGLYSTFVFQKPDPDAIPPIVSPNLHDPDNAHEEQEWLQPQQASVEDERRLHADVLPIDPAKGILGPGPADMRL

SEQ ID NO: 42366 - protein, 137 aa, Sorghum bicolor
  Clone ID: SORBI-28MAY03-C4222_1.pep
MADAKVLPAVTLRTRKFMTNRLLARKQFVLEVLHPGRANVSKAELKEKLAKMYEVKDPNCIFVFKFRTHFGGGKSTGFGLIYDNLDSAKKFEPKYRLIRNGLATKVEKSRKQMKERKNRAKKIRGVKKTKAGDAKKK

SEQ ID NO: 42367 - protein, 137 aa, Sorghum bicolor
  unsure (1)..(137): unsure at all Xaa locations
  Clone ID: LIB3481-036-P1-K1-D6.pep
MADSKATAAVTLRTRKFMANLLVARKQFXLEVIHXGRANVSKAELKERLAKLYEVKDSNCIFVFKFRTHFGGGKSTGFGLIYDNLEAAKKFEPKYRLIRNGLATKVEKSRKQMKERKNRAKKIRGVKKTKAGDAKKK

SEQ ID NO: 42368 - protein, 357 aa, Sorghum bicolor
  Clone ID: SORBI-28MAY03-C42954_1.pep
TRATLSENDTVVVNYGQLEYKLKVLELKPASSVSVLETDVEVDIEGSDSVLDNEEDQHVLVPLVIGNIESSVVEEGKFRYYKFSVEENVSEKVASGRANIEVKIDTDASGGDTDIYVSRHPLVFPTQHRHEWSSHEMGSKVLILKPREATLVTGVYSIGVYGFKGTSKYQLSVAIKDVNSQRIGEYASASRSVDVDSVLCKNCKRHIASRSAPLHEAYCMRHNVACPHDGCGVVLRKEEAADHVHCNKCGRACQQREMEKHMKVFHEPLQCPCGVVLEKEDMVQHQSSTCPLRLIVCRFCGDTVHAGGEPADVRDRLRNMSEHESICGSRTAPCDSCGRSVMLKEMDIHLIAVHQKS

SEQ ID NO: 42369 - protein, 227 aa, Sorghum bicolor
  Clone ID: SORBI-28MAY03-C42402_1.pep
MPTVSVKWQKEVFPGIEIDTSQPPIVFKSQLYTLTGVPPERQKIMVKGGILKDDADWSTLGVKDGQKLMMIGTADEIVKAPEKGPVFVEDLPEEEQVVALGHSAGLYNLGNTCYMNSTLQCLHSVPELKSALLSYSDTVRGNGIDQASHNLTLATRNTFGDLDQSVRPVAPLQFLQTLRKKYPQFAQQHNNVYMQQDAEECWTQLVYTLSQTLTSDSSESAVLPMKQ

SEQ ID NO: 42370 - protein, 190 aa, Sorghum bicolor
  Clone ID: SORBI-28MAY03-C42997_1.pep
DDDEGKIFANSRSSLHLNVAFCYQKMGEYRKSIETCNKVLDANPVHVKALYRRGTSFMLLGEFDDARNDFEKIITVDKSSEPDATAALLKLKQKEQEAEKKARKQFKGLFDKKPGEISEVGVESEGGKDAGGARGSDEATSADRGANTMDSPTREPEYAFEEERPGLLGRLWPSARRIFSSLGLNRCTIL

SEQ ID NO: 42371 - protein, 135 aa, Sorghum bicolor
  Clone ID: SORBI-28MAY03-C40583_1.pep
MSGVSSESSPLSGRNSFSSPLSRFNDLELSSESGCLSIIVLGASGDLAKKKTFPALFHLFHQGFLQSGEVHIFGYARSNLSDDGLRERIRGYLKGASDEHVSQFLQLVKYVSGSYDSGEGFELLNKAISEYETSE

SEQ ID NO: 42372 - protein, 51 aa, Sorghum bicolor
  Clone ID: SORBI-28MAY03-C4070_1.pep
VSIDGNICTVMVTILVIEGWQRKLDPGFDIMHTSSALLIEKDVKQPIDFFS

SEQ ID NO: 42373 - protein, 146 aa, Sorghum bicolor
  Clone ID: SORBI-28MAY03-C40807_1.pep
SSDRILSDMESCYGNFKCIDVCEKNALLTHLLGAHAAKPRATSVKLCKWPPCGSAVVDVHRHAATHCIEWSTLDKARASPLSFGISDLLNRYTWQEVIRGMRYEFPHYPQAVARSFENNKLWYTLSMHRRLPVPSIYGYVAPRVSK

SEQ ID NO: 42374 - protein, 207 aa, Sorghum bicolor
  Clone ID: SORBI-28MAY03-C4100_1.pep
DVDDITMLLHNVPYGEEKTGRVHAARRLFEYLQASGLNFPVIHHIDFPKAIDRDGLVIGAGANVGALLVDGLGDGVLLEAADQEFEFLRDTSFNLLQGCRMRNTKTEYVSCPSCGRTLFDLQEISAEIREKTSHLPGVSIAIMGCIVNGPGEMADADFGYVGGAPGKIDLYVGKTVVQRGIAMEGATDALIQLIKDNGRWVDPPAEE

SEQ ID NO: 42375 - protein, 106 aa, Sorghum bicolor
  Clone ID: SORBI-28MAY03-C41182_1.pep
MSMALSRFTQWLWPGGAAARVAATHEHPSAGLTSSSFPDFPSGFREPDTVTFYTGGGAGGRRARPRRVSNRRRSRGEARVDREYDMVIVPSDGGGCLSGSDSDDSD

SEQ ID NO: 42376 - protein, 206 aa, Sorghum bicolor
  unsure (1)..(206): unsure at all Xaa locations
  Clone ID: SORBI-28MAY03-C43739_1.pep
MTSCWLYMCTPMSFTGSAPEPSDPNTKPAKKQTRQWAAWTHQEEENFFNALRQVGKNFDKITHRVQSKNKDQVRHYYYRLVRRMKKLLGPRFSLDAKNSKDTIAAMLRWWSLLEKFSCSASKLHLKPRRFKTFIEALGKQLLKDRNKSRRKRSRVDMCLPSPSPIISKAPXNETPPVKFLPVDAQNGSRVASSKGTIFKRVAEXXF

SEQ ID NO: 42377 - protein, 197 aa, Sorghum bicolor
  Clone ID: SORBI-28MAY03-C43892_1.pep
MGFDVGVVPSNPDGWGPPDVPAIPQSLGGGASIPFAPFSRSDKLGRIADWTRNPAGPAAFAAASRDSVFDFTSADDSLIAGAEDSSFRLVDAKPPPRPQRFGPKWRFNQRQQLPQRQDEEVEARRRLAEKERARRDRHFQNNRSHHHSNFRFNQPLNSAKPSVDIQPDWTMREQIPFANFTKLSFSVADQPEDLLLC

SEQ ID NO: 42378 - protein, 77 aa, Sorghum bicolor
  unsure (1)..(77): unsure at all Xaa locations
  Clone ID: SORBI-28MAY03-C4406_1.pep
RALNHNSXPIHNISNNLEAELLDDFEVELDNHENTDQRITDDGNMTESGDTTNSDANRRAGLKRRHRLVIDDDDEDD

SEQ ID NO: 42379 - protein, 116 aa, Sorghum bicolor
  Clone ID: SORBI-28MAY03-C44114_1.pep
PHIILPRMHLDAQSSVSPSTQAASSSRQSFSMLLVCCSIVGRQTRFGQHKKPQKNKRICSRMHKPCISICDNPQLFLTDPSPLASDPFMILSLLQVLMNMSKGTSPTSMRSPSLSS

SEQ ID NO: 42380 - protein, 270 aa, Sorghum bicolor
  Clone ID: SORBI-28MAY03-C44178_1.pep
AYVQQQAPSPTPAKVAPNHKSQGNASSRQASGSSPSQAVAPVQISSNAPSRSKSIAEDDLFWGPSEHSKQDKKQSEFPSLSSQSRSSMMKDQSPLNRQKSQAGRLPVSSAATANQSGKGKAEAANKQTEAMDFRDWCESEWARLTGTNDISFLEFCIKQSTTEAEMLLHENIGSLDRSHQFIDKFLNYKAFLSADVIDMAFQAPNTRGTRGDGAGRANAAPAARGGTSVDAELDVVGKKKGKKGKKVSAAVLGFNVVSNRIMMGEIQNVD

SEQ ID NO: 42381 - protein, 208 aa, Sorghum bicolor
  Clone ID: SORBI-28MAY03-C41715_1.pep
MAGGGDRQGAKKRKREHAEGKAKPRPQVKGGGDGGKRKKHSAADGGAGEAVARKKTPVTHKEKRIAAKEMSEARKMKRKRHYSLEKELTKLWEKMRCHDVSKEERSKVVSEAIKKMDGKYLDIATSHITARVLQTCVKWCSQSERDAIFDVLHPHLLDLSRKKYAVFLVKKLIELASKKQFASFISSLHGRVAKLLHHTIGAAVVDYA

SEQ ID NO: 42382 - protein, 242 aa, Sorghum bicolor
  Clone ID: SORBI-28MAY03-C41840_1.pep
ARGAAPGVPVRAGRPRPRRATGGPGSPGVSWAARPGPHGQHPQPQPPEWRFALACGERAAGEDVQEVDIISAIEFDKSGNHLATGDRGGRVVLFERTDISDNASRRELERQEYQAARHPEFRYKTEFQSHEPEFDYLKSLEIEEKINKIKWCQTANNALFLLSTNDKTIKYWKVQEKKVKRVSVMNLDTSQSSDNGSTSSPGTSSCRALLPNGGCSEKMYTPNNNLSFPPGGCASLRLPVVV

SEQ ID NO: 42383 - protein, 136 aa, Sorghum bicolor
  Clone ID: SORBI-28MAY03-C42095_1.pep
FGNAIVRDLVTVKVGDVLSQPLGFVADRIKRAVSRVDDALVRSVVDYLELEAEKGNQAARGQFMPESDLWVVSWLGMPIHDADFGWGRPGFVAPAQMFGSGTAYVTQGYDKDDPINVLFALEPEYLQTFEKAFYGE

SEQ ID NO: 42384 - protein, 197 aa, Sorghum bicolor
  Clone ID: SORBI-28MAY03-C42167_1.pep
AMEKLECGFDLAEVWKFEGDEGRATLSAGENSPPTSGVTVLGAHQVPETGALTGHPDLIDPLGDNDFETDIENLPVFITGDQNVASAKFEDEIDLALEELKKSQEMEYNLAEQKLYAQKDRILCLYRELDTERAQLADPMPLSDASNYGAMLANVLRLVDQIKRDEEKFKSMLKVAGGFAKAPPNVIKELFGLPADK

SEQ ID NO: 42385 - protein, 94 aa, Sorghum bicolor
  Clone ID: SORBI-28MAY03-C42263_1.pep
RIQEFDILNWWKLNTVKFPTLSKMARDILAIPMSMVSSGSSIFSAGTGSHMLDDYRSSLRPEIVEALVCAKDWLQYSPPATEAPSSALVKAEGS

SEQ ID NO: 42386 - protein, 270 aa, Sorghum bicolor
  Clone ID: SORBI-28MAY03-C44874_1.pep
TRAHPSFPPHTLTASSAPSPLHSLLSCLTNSPQSHPKDPVSIHEPPSQSSKDHRFQVPPAMAAGGLALLPALLVAALCAASWRAEAAIGVNWGTVSDHRAPPGVVVDLMRANRISKVKLFDADPGVLRALAGSGIQVMVGVTNGELASIAGSQAAADDWVAQNVSRYVGRGGVDIRYIAVGNEPFLTSYQGQFQSYIIPAMTNIQQSLVKANLASYIKLVVPCNADAYQSASVPSQGVFRTELTQIMTQLAAFLSSSGAPFVVNIYPFLS

SEQ ID NO: 42387 - protein, 187 aa, Sorghum bicolor
  Clone ID: SORBI-28MAY03-C44913_1.pep
MGDDHCPPDDPASKHDMFPANILIPPPMYPEDIDPLPDSILFDPIGYISDRTNHTTAGALIKGGRRIEVTFWVAHPPRASYFSVRTPSGLEIGDHPAIVTTEKDLALLRVPFCHPNYNFNSTDSDYFVYEAGTKRKQPRLKLIAMPPYLSIPDSNVGLLRFRRRGMFLIAILCWTFTIGQYDLHLYS

SEQ ID NO: 42388 - protein, 268 aa, Sorghum bicolor
  Clone ID: SORBI-28MAY03-C44926_1.pep
HEVKTQYNLMDPFVSRCCSKPFTRLQGLLMLFCIATVLAWLVSGHWLLNNLLGISICVAFVSHVRLPNIKICALLLACLFVYDIFWVFFSERFFGANVMVSVATQKASNPVHTVANKLSLPGLQLITKKLELPVKLVFPRNLLGGIVPGSNPGDYMMLGLGDMAIPGMLLALVLFFDNRKFKDVNVPSDVSPPKRRKYVWYALTGYGIGLVAALAAGILSQSPQPALLYLVPSTLGPVMYLSWLRNELWELWEGSGTILNEKARLLEV

SEQ ID NO: 42389 - protein, 224 aa, Sorghum bicolor
  unsure (1)..(224): unsure at all Xaa locations
  Clone ID: SORBI-28MAY03-C4495_1.pep
LVAIAGNVFALALFLSPVPTFKRVLKAKSTEQFDGLPYLLSLLNCCICLWYGLPWVSGGGGRALVATVNCTGALFQLAYISLFIFYADSRTTRLRITGLLVLVVFAFALIAHASIALFDQPVRQLFVGSVSMASLVSMFASPLAVMGLVIRTECVEFMPFYLSLSTFLMSASFARYRLLLRDFFIYFPNGLGVIXEQCSWCYTRTIAGDGKTAAHLHRCLLDHN

SEQ ID NO: 42390 - protein, 257 aa, Sorghum bicolor
  Clone ID: SORBI-28MAY03-C44952_1.pep
ARGNYGVRRMDLGGKALTNYLKELVSYRSLNVMDETPRGDDAKEKLCFVSLDVPGDLHLARLSFKDNPFRCSYILPDGITYKKGFVKDMNEAHRYRSLPLDEEAKRKEHSMDINKSEDRKKPELSQNEFVLTNERFLVPEMLFHPIDLGINQAGLAECIVRAVQACHPYLQPVLFESIILTGGSTLFPRFADRLERELRPLVPDNYKVKITHQEDPILGVWRGGSILASTPDFESMCTTKSEYEEMGSARCRRRFFH

SEQ ID NO: 42391 - protein, 152 aa, Sorghum bicolor
  Clone ID: SORBI-28MAY03-C43090_1.pep
LKLDNNPLVEISSTDLVPLSKLEVLDLSGNASALPEPSAVSALPQLHELYLRRMKLHEFPNGLLGLKQLRILDLSQNSLTTVPEGIKNFTALIELDLSDNNITALPAELGLLEANLQVLKLDGNPLRSIRRTLLERGTKAILKYLKEKLPAE

SEQ ID NO: 42392 - protein, 244 aa, Sorghum bicolor
  unsure (1)..(244): unsure at all Xaa locations
  Clone ID: SORBI-28MAY03-C43211_1.pep
MENGDETLASPTAAEKAALNGGVAEEEQVPITHPAKSYAAVAAENPAPNGGVAKEEEEEEEGVAGAHTAARSYAAVAARAEIEDLRAAKLDLEAKLAEARRENKSLAEQTHSIEGTFMQAREEVTIAELAAASAEKEVASLRTEVDRLEALLKTEKGERELDKESHEKVAKEVDAVRQEKLKLEEEISALKASATAATTKXREAALAAEAPKEGEAAWLGMAVAAAAGAAGTAAVMLIYLRLKR

SEQ ID NO: 42393 - protein, 283 aa, Sorghum bicolor
  Clone ID: SORBI-28MAY03-C43309_1.pep
GSSTSKSRAIGKMFFKTKLCCKFRAGTCPYVTNCNFAHGMEELRKPPPNWQEIVAAHEEATEQREEHQIPIMTSGSVVAGDGGGGGSSQGGRAYKGRHCKKFYTEEGCPYGDACTFLHDEQSKARESVAISLSPTVGAGGYNAAASANGVMVQKPSNWKTRICNKWEMTGYCPFGSKCHFAHGSAAITAELHKYGGGLMDVDGRDIASTPDSKQAGASTKAPADSAAASTAMPPHADVYHLGIQSQRSTIVSQRSGQLQRPIQKWKGPDKISRIYGDWIDENE

SEQ ID NO: 42394 - protein, 352 aa, Sorghum bicolor
  Clone ID: SORBI-28MAY03-C43267_1.pep
MGSSLPPKEANLFKVIVKSYETKQYKKGLKAADSILKKFPEHGETLSMKGLTLNCMDRKSEAYELVRRGLKNDLKSHVCWHVYGLLYRSDREYREAIKCYRNALRIDPDNIEILRDLSLLQAQMRDLSGFVETRQQLLSLKPNHRMNWIGFAVAHHLNSNSSKAIEVLEAYEGTLEDDYPPENERYEHSEMLLYKISLFEECGMLDRALEEMQKKESKIVDKLSFKEQMASVLFKLGRFDESESIYRSLLFMNPDNYKYFIAVQKCLGLYSDNGQYSADDVERLSALYNSLKEKYAWSSAVKRIPLDFLEGEKFKEAADHYVRPLLTKGVPSLFSDLSPLYEHPGKANILEQ

SEQ ID NO: 42395 - protein, 188 aa, Sorghum bicolor
  Clone ID: SORBI-28MAY03-C43667_1.pep
MEGSAAAPLRTRVCIIGSGPAAHTAAIYAARAELKPVLFEGWMANDIAAGGQLTTTTDVENFPGFPNGIMGADLMDNCRAQSLRFGTNILSETVTAVDFSARPFRVTADSTTVLADAVIVATGAVARRLHFPGSDAYWNRGISACAVCDGAAPIFRNKPIAVVGGGDSAMEEANFLTKYGSHVYIIHR

SEQ ID NO: 42396 - protein, 165 aa, Sorghum bicolor
  Clone ID: SORBI-28MAY03-C452_1.pep
MSLVRLLDTLALDSWVRNPFSIFGTAVAADAWLASDTSAFANTYIESRDTAGAYVFSAALPPGVRKEEVTVEVDEGNVLVITGQRSVSREERVGDRWHHVERCCASFLGRFHLPDDAAVDGVRAAMDAGMLTVTVPKVGAAAAAIAEKPNEVPAAVEAADGGPAC

SEQ ID NO: 42397 - protein, 318 aa, Sorghum bicolor
  unsure (1)..(318): unsure at all Xaa locations
  Clone ID: SORBI-28MAY03-C45561_1.pep
VGLYEVAGAKSAIRGSAKIDHTDDFRWLDKAALQLEGDLAGGGEEAVNPWRLCTVTQVEEVKILLRLLPVPACTVMLSVVLTEFLTLSVQQAYTLNTRVAALHLPVTCMPVFPCLAIFLILALYYQTFAPLARRLTGHPHGASQLQRVGLGLFFSILSVAXAGLFERYRRGYAVRHGYLALFLTPMPDLSAYWLLIQYCLIGVAEVFCLVALLEFLYQEAPDAMRSVGSAYAAVAGGLGCFVASAINTAVDAATRNDAEGRPSWLAQNINVGRFDYLYWLLAVLSTINLLVFVYFAKRYKYRVRVDTQQTTVVVNNKQ

SEQ ID NO: 42398 - protein, 126 aa, Sorghum bicolor
  Clone ID: SORBI-28MAY03-C45671_1.pep
ARGSKGGDDEEFSELYTFKWTTLLIPPTTLLLLNFIGVVAGVSNAINNGYESWGPLFGKLFFAFWVIVHLYPFLKGLVGRQNRTPTIVIVWSILLASIFSLLWVRIDPFLAKDDGPLLEECGLDCN

SEQ ID NO: 42399 - protein, 213 aa, Sorghum bicolor
  Clone ID: SORBI-28MAY03-C456_1.pep
LIKWNPVANVDGKDIWTFLRTMDVPVNTLHAQGYVSIGCEPCTRPVLPGQHEREGRWWWEDAKAKECGLHKGNIEKDARAAAPRSANGNGSAGAPDIFESPAVVSLTRAGIENLLRLENRAEPWLVVLYAPWCPFCQAMEASYVELAEKLAGSGVKVAKFRADGEQKPFAQAELQLQSFPTVLLFPSRTPRPIKYPSEKRDVDSLLAFVNSLR

SEQ ID NO: 42400 - protein, 212 aa, Sorghum bicolor
  Clone ID: SORBI-28MAY03-C44230_1.pep
ARGNALVPNLLGAGTETTSTTMEWAMSLLLNHPDVLKKAQEEIDSNVGEGPRPDKNDLPRLPYLHCIISETLRLYPAAPMLLPHEASTDCKIHGYDVPAGSMILVNAYAIHRDPATWEDPEEFRPERFEHGRAEGKFMMPFGMGRRRCPGENLAMRTMGLVLGALLQCFDWTRIGDAEVDMATATGTIMSKAVPLEALCKPRANMSAVLQKI

SEQ ID NO: 42401 - protein, 105 aa, Sorghum bicolor
  Clone ID: SORBI-28MAY03-C44279_1.pep
IAVEVVLGSFHGRITANTANMRNELVLYDSKEADAMTVDNCGDLKLLRHVVCVYVKDLLMIAAQTSDGKSERISFSPRINDKAEGPLVVGGTELRVKICWSVMNP

SEQ ID NO: 42402 - protein, 344 aa, Sorghum bicolor
  Clone ID: SORBI-28MAY03-C44289_1.pep
MAAAAAAASVAPSGPVPFTEVDDGTVPEHTPKEEFGDLVASLPRREQSILELRLYQGFWLPEHWVPGTIVFQRRFTPRPDDVILASYPKCGTTWLKALAFATAARTAYPPSDAGHPLRRMNPHDCIPFIDEIFAGGEDAKLDALPSPRLMNTHLPYALPPASVVTATGGCRVAYVCRDPKDMVVSLWHFLRRTKPDLSFADTFESVCDGTVAAGPVWDHVLSYWRASVATPDRALFLKYEDLLRDPAGNVRRLAEFMGCPFSAAEEAAGNVAAVVELCSFDEMKGLEVNRPGGGTAGKYRAMPRDAFFRKGVAGDWANHMTPEMAARLDQIFRDKLQGTGLAFS

SEQ ID NO: 42403 - protein, 206 aa, Sorghum bicolor
  Clone ID: SORBI-28MAY03-C44586_1.pep
HEGGTRVMAANNDCVVRTFDAERYSLLSQFTFPWSVNSTSVSPDGKLLAVLGDSTECVIADPQSGRATATLRGHQDYSFSSAWHPDGRVLATGNQDGTCRLWDARSLSEPFAVLKGRIGAVRGLRFSPDGGRFLAAAEAADFVHVYDAAAGYVGREQEVELFGEVAGAAFSPDGEALFVSVADRTYGGLLEFRRRRADGYLDTCFF

SEQ ID NO: 42404 - protein, 135 aa, Sorghum bicolor
  Clone ID: SORBI-28MAY03-C44393_1.pep
MADRVYPAAKPNPPPGAATAANGAGTGNGNAAASFPAPKSQMYQRPIYRPQAPAKRRRGRSCRCSFCCCFCWALLAIILLAFVAAVAGGAFYLLYRPQRPSFTVSSVRLASLNLTSSPAHSCKVRVRVKIWKWTF

SEQ ID NO: 42405 - protein, 143 aa, Sorghum bicolor
  Clone ID: SORBI-28MAY03-C44832_1.pep
LFIGQSQGRLYCINEEHWADGIPSELSSRVFRRDSHEDSNLLSIWVLEDYDTQKWALKHSVSCSRLFGRTGFLGYNVVAIHPDNNNFMFIVYRKHQLISYGLNSKEVRTVGTFQESLQLPPYVPCFSDFLSVARHEEILGVGV

SEQ ID NO: 42406 - protein, 165 aa, Sorghum bicolor
  Clone ID: SORBI-28MAY03-C46174_1.pep
KLSVKAPSGESKLKVLKAIAQEYNIEWDSSNTEAEFIKKYEDLLDGSGSSVHQVQPPIIEGSVSSPVASASRDKLAALNSPVIDAEKHQIRESPTSLAGGTRACVATKGNVATMEHHSPAEEMPSTSPSSSDALEKARAAIAAATRASAAARAAAELAKVKITSQ

SEQ ID NO: 42407 - protein, 153 aa, Sorghum bicolor
  unsure (1)..(153): unsure at all Xaa locations
  Clone ID: SORBI-28MAY03-C46157_1.pep
TRKQLVKGXEKVQLEYDASERDGPVSEIFREKLKEFTDNAGADVQLLSSLFSEVGKKADALIKYFGEDPVRCPFEQVISTLLTFVTTFRKAHEENLKQAELEKKRAEKEAEAEKAKNTQLTSKNDSKPSNPSRQAKQTLERTRSASRRGRDVG

SEQ ID NO: 42408 - protein, 62 aa, Sorghum bicolor
  Clone ID: SORBI-28MAY03-C46204_1.pep
GTTTTASTELIGWNTSPGLPHRGIVTLPVLKSPLDNMTLLFGHALHGIRSTGDHRDVLSERL

SEQ ID NO: 42409 - protein, 249 aa, Sorghum bicolor
  Clone ID: SORBI-28MAY03-C46383_1.pep
MTCSRGSPPYKDTAPAPQRTRSAYSPAMAAPPLPFPLLILLLLLAVSSSTVAAAAAIGAPVLGEDYVRPPPSRSHRKALLSLFPWSKKKESSSASDPQQVHISLAGEKHMRITWITDDNSVPSVVDYGTKEGAYTMKSQGESTSYSYLLYSSGKIHHVVVGPLEDNTIYYYRCGGQGPEFQFKTPPSQFPLSLAVVGDLGQTSWTTSTLNHIKQCEHDMLLLPGDLSYADYMQHLWDSFGTLVESLASN

SEQ ID NO: 42410 - protein, 112 aa, Sorghum bicolor
  Clone ID: SORBI-28MAY03-C4646_1.pep
LKGLKDLVAEEEDKYLAEGKLVSFCGQILKEASDLQPSTGEAASADIHRVLDLRAPVIVKVLKGMCIMDAQIFKRHLKEFYPLITKLICCDQMDVRGALGDLFSKQLTPLMP

SEQ ID NO: 42411 - protein, 78 aa, Sorghum bicolor
  Clone ID: SORBI-28MAY03-C44959_1.pep
SRRFVTLMQGNIWLESEGVGKGCTATFFVKLGLSDKPNANLRRIMPPVQPKQGTADPDASSIINGDMAILPYRYQSMI

SEQ ID NO: 42412 - protein, 394 aa, Sorghum bicolor
  Clone ID: SORBI-28MAY03-C45192_1.pep
MTLASLARALGRSARSSRPRQGFQLGGLRQSPAPPLPPPVHGRESGATGFVRSYLTAASSAALGKPAAGKTVDWRYILASPQFRRLFSDESKKNYENYYPKGKKEAPKGDGSNKSGSRQESNTDEGWNFQDNAMKHLQNFLAPLLILGLMLSSMSSSTADQKEISFQEFKNKLLEPAWVDRIVVSNKSVAKVYIRNSPLPKSQGQNSDTHISTTDIPGKPAPSRCKYYFNIGSVDSFEEKLEEAQEALGIDSHDFVPVTYVAEVNWFQEVMRFAPTAFLVGLIYFMGKRMQSGFNIGGGPGKGRGGIFNIGKATVTKMDKNSKNKVFFKDVAGCDEAKQEIMEFVHFLKNPKKYEDLGAKIPKGALLVGPPGTGKTLLAKATAGESGVPFLSIS

SEQ ID NO: 42413 - protein, 115 aa, Sorghum bicolor
  Clone ID: SORBI-28MAY03-C45250_1.pep
MACLKLGSRADVFRKQGQEWYCTSGLPSDITVVVGEQSFHLHKFPLLSKSGLLEKRIREKIDKGDDSCTIDLSDIPGGAKAFELAAKFCYGVKFDMTASNVVHLRCAADYLEMTE

SEQ ID NO: 42414 - protein, 96 aa, Sorghum bicolor
  Clone ID: SORBI-28MAY03-C45450_1.pep
MTAITRRRTATRSGSRLDGPTDMPHVSHITYDNFGGFLSLPAGLELDILWRTPSARNEIVQCSRRALRMVRCRQALARAVQRRATTCTNGERGSLS

SEQ ID NO: 42415 - protein, 89 aa, Sorghum bicolor
  Clone ID: SORBI-28MAY03-C45474_1.pep
DALSCPSNVANYMGQMAAAMNKLSTLEGFVRQAENLRQQTLHRLHQILTTRQMARSLLAMSDYFHRLRTLSSLWVTRPRAPQEQQQGHS

SEQ ID NO: 42416 - protein, 149 aa, Sorghum bicolor
  Clone ID: SORBI-28MAY03-C45546_1.pep
KLADFGLAKDGPTGDKSHVSTRVMGTQGYAAPEYLATGHLTAKSDVYSYGVVLLELLSGQRALDKNRPPGQHNLVEWARPYITNKRRVIHVLDSRLGSQCSLPAAQKMATLALQCLSMDARGRPGMDQVVTVLEDLQEAKGSVKKLASK

SEQ ID NO: 42417 - protein, 386 aa, Sorghum bicolor
  Clone ID: SORBI-28MAY03-C47268_1.pep
ARGDCRQAWQEEYSKHIKGKPSQRMVVEPPKTLARPLVKTIPAPKFLTRKARKDNAQNREGNLMTSGRNVHFGPSVPSESIHAATRGTGSDQAVSRHQPELKRTTTTITGKGHQTTGSLGEELLIPLDNSNVNISSSNSSPTPHTNRSVFDTLESSSRGSQKTVNQETSSDNNKMRPERNSTQEEGISHSAAAAAEPPRNNNFLLHNKTEIPEHSPGSASPMHCHDDMDISSNLHTMEKSVATNSMKQQQPAVPNTCGNTPEKDHPSKPPSNSSETSSDKTTELKPNTLVRALSERQQERPNEQSSKMIKSRSVGANSPQIIILSQEAKDNIAPLISKHEEHETKNSEQDSLKNAELGRGLTSNVQIISNEDLEDLREMGSGAFGM

SEQ ID NO: 42418 - protein, 102 aa, Sorghum bicolor
  Clone ID: SORBI-28MAY03-C47627_1.pep
IPPTSILVLNMVGVVAGFSAALNSGYESWGPLFGKVFFAASVVAHLGPLLVGLWAPLLRPPTIVVLWSVLLASVFSLLWVKIDPFVGGTETVNSNNCNTVIC

SEQ ID NO: 42419 - protein, 98 aa, Sorghum bicolor
  Clone ID: SORBI-28MAY03-C47657_1.pep
RTAGDKEQNRLKRLLRNRVSAQQARERKKAYLTELEAKAKDLEVRNAELEQRVSTLQNENNTLRQILKNTTAHASKRSSGGGGGKGGDGGKKHHFAKS

SEQ ID NO: 42420 - protein, 82 aa, Sorghum bicolor
  Clone ID: SORBI-28MAY03-C47779_1.pep
MNHGNGMLNSVKVESRPSVVATNGQPRPMDVLHDGGPPPFLTKTYDMVDDPTTDAVVSWSATSNSFIVWDPHIFGTVLLPRY

SEQ ID NO: 42421 - protein, 112 aa, Sorghum bicolor
  Clone ID: SORBI-28MAY03-C4809_1.pep
MKLVRFLMKLNNETVTIELKNGTVVHGTITGVDISMNTHLKTVKLTLKGKNPVTLDHLSVRGNNIRYYILPDSLNLETLLVEETPRVKPKKPTSGKPLGRGRGRGRGRGRGR

SEQ ID NO: 42422 - protein, 88 aa, Sorghum bicolor
  Clone ID: SORBI-28MAY03-C45737_1.pep
SRNPLDLRWPRPAPRARCPKPVAARPPAGARGAPRPPRAAGGRSEAGGRAPPARCPSGRAVGRAPPAGARVSRRETSRTPSRESHMDR

SEQ ID NO: 42423 - protein, 154 aa, Sorghum bicolor
  Clone ID: SORBI-28MAY03-C45773_1.pep
MEGDADGVKSGRRGGGQVCQICGDGVGTTAEGDVFTACDVCGFPVCRPCYEYERKDGTQACPQCKTKYKRHKGSPAIRGEEGDETDADDASDFNYPASGNDDQKQKIADRMRSWRMNAGGSGDVGRPKYDSGEIGLTKYDSGEIPRGYIPSVTN

SEQ ID NO: 42424 - protein, 217 aa, Sorghum bicolor
  Clone ID: SORBI-28MAY03-C45833_1.pep
MGNCAGVEGNAEINPSFSAPNSSGTGSKNSSKNATDTSTFGTKTSGSSSSVPPTPRTETEILESSNVRKFTFSELKGSTRNFRPDSLLGEGGFGSVFKGWMDERTLAPVKPGTGMIVAVKKLKLDSFQGHREWLAEVNYLGQLSHPNLVKLIGYCLEDEQRLLVYEYMPRGSLEHHLFRRSSNFQPLPWNLRIKVALEAARGLAFLHGDQAKVIYRD

SEQ ID NO: 42425 - protein, 152 aa, Sorghum bicolor
  Clone ID: SORBI-28MAY03-C46071_1.pep
LIVLLHVPWYNSNWAHQGEGDSMMASMETLLYAARVDMVIAGHVHAYERAERVYNGRLDPCGAVHITIGDGGNREGLAHRYRNPKPAWSVFREASFGHGELKIVNSTHAHWTWHRNDDEEPVRTDDVWINSLAGSGCILEGSRELRKILMSP

SEQ ID NO: 42426 - protein, 163 aa, Sorghum bicolor
  unsure (1)..(163): unsure at all Xaa locations
  Clone ID: SORBI-28MAY03-C4608_1.pep
VRPPSVRGRVGYGRSFISNGXDQAIKLWDVRKMTSNADSCADGAPSWDYRYSRYPQQHKQLKHPHDQSLATYRGHAVLRTLIRCYFSPAYSTGQKYIYTGSYDSCVYIYDVVSGSQVAKLKWHQMAIRDCSWHPFEPTLVSSSWDGQVAKWTSARDQQASDID

SEQ ID NO: 42427 - protein, 285 aa, Sorghum bicolor
  Clone ID: SORBI-28MAY03-C46084_1.pep
ARGKLKAQFECEAFVSVSLDPRMDQVFKSMLRQLDKDKYNNIKGEMWDETQLINELRYLLKNKRYFIVVDDIWNKSVWANILRALNKCGRGSRIIITTRILDVAQQADSVYKLQALSAGDSRKLFFLRIFGNENRCLPKELDKESKNILRKCGGVPLAIITISSMLASKQETENTSEYWAKVCESMGSGLENTSSDVIDMRRILSVSYHDLPLHLRTCLLYLSLYPEDYKIMTHDLVWKWIGKGFVVIKQGMNMFEAGEDYVHELINRSLILPTFDNKSKKASSF

SEQ ID NO: 42428 - protein, 243 aa, Sorghum bicolor
  Clone ID: SORBI-28MAY03-C48430_1.pep
MGAEEERDGEEQRRPLLSSAPPAAADQHQQQYQFLGRSSSSVLRGGGGGWEGPEVSADEVRSAASFSSAAGFYPPPYGDHAYAYPPSIHSALLSPSPSHAPSSPHPNAEALAIVPQGPYPYGGSYQPSESVGRDVLDEVEIRQLLIDHIGHRCCWGSHPARTWKITSIEDCNVYVGTLETFIEERHIITKKEPYESGNIDGREKGPLLGLWELDLRSKFPALFVPEEEVIVKIPHSDIIEKCS

SEQ ID NO: 42429 - protein, 191 aa, Sorghum bicolor
  Clone ID: SORBI-28MAY03-C4846_1.pep
EVERQRQLDIERAKSRELQFNIDLEKEKQTQRELQRELEQVELGRSSRREFSANPNSRSRERYRERDGGRAQQEAGSLRSSSRGQEGVSAQAPAPAGAPTVMLAGSRTFSGGNLPTILQPRERSADEDNAWAEDASSNGDPELDGVRPHGPRGGGSSKPSSRQVVERRERDGGTAAGTGRREGKWERKQHP

SEQ ID NO: 42430 - protein, 212 aa, Sorghum bicolor
  Clone ID: SORBI-28MAY03-C4850_1.pep
MAAPYYGGGPAPPPAAAPAPVAVVSPQFCAPYVVPLTVTKKAISLSDGDFTVTDANGAVVLRVKGAIFSVRHRRVLLDAAGQPILSMQEKVFSMHNRWEVFTGDSASATVVLFTAKKSSIIQLKTEMDIFLAANTAQQLCDFKIKGRYFDRSCALYLGDSNNMIAQMNRQFTVSNVLLGKDTFGVTVFPNVDYVFIAALVVILDEIHRERSD

SEQ ID NO: 42431 - protein, 221 aa, Sorghum bicolor
  Clone ID: SORBI-28MAY03-C4852_1.pep
APVTTQYLFVTATLPLDIYNKVVETFPDCEVIMGPGVHRTSSRLEEILVDCSGDDNEEKNPETAFSNKKSALLKIIEESPVRKTIIFCNKIETCRKVENALRRVDRKASQIKVLPFHAALDQAQRITNIKEFLNKQTADSMFLVCTDRASRGIDFANVNHVVLFDYPRDPSEYVRRVGRTARGASGNGKAFVFAVGKQVSLARRVMERNMKGHPLHDVPCV

SEQ ID NO: 42432 - protein, 132 aa, Sorghum bicolor
  Clone ID: SORBI-28MAY03-C49021_1.pep
GSGAIFTGDTLFNLSCGKLFEGTPQQMYSSLQKITALPDDTKVYCGHEYTLSNSKFALSVEPGNKALQEYAANAAELRNKNIPTVPTTIGREKECNPFLRTSNPEIKSTLSIPDHFDEDRVLEVVRRAKDNF

SEQ ID NO: 42433 - protein, 267 aa, Sorghum bicolor
  Clone ID: SORBI-28MAY03-C49138_1.pep
RAARSGAAEAGDPFAAAVLGEGIEGIQSEGAGLDDLDAGEDPDDELKRQQNKAREKELMEILKGPNRAFGDLIAASGITEGMIDSLILLKDVRDIPGLPPLSEIEDEAIQKLNATSSRAEVERQKQEDIAKARVRQVDEKGRAYGTGKRKCSIARVWIEPGDGKFIVNEKEFDAYFPILDHRAELLRPFTVTKNLGHFNVTCTVKGGGVSGQVGAIRLGISRALQNWEPGLRPYLKAAGYLTRDSRVVERKKPGKAKARKSFQWVKR

SEQ ID NO: 42434 - protein, 150 aa, Sorghum bicolor
  Clone ID: SORBI-28MAY03-C46719_1.pep
MASPGRIELDKLSVEQLKGLKEQTDLEVNLLQDSLTKIRTATTRLESASAALQDLSLRPHGKKMLVPLTASLYVPGSLDDAEKVLVDVGTGYFIEKTMAQGKEYCERKVNLLKSNFDELLEVATKKKAIADDLGMLLQAKLRQASPGPSS

SEQ ID NO: 42435 - protein, 85 aa, Sorghum bicolor
  unsure (1)..(85): unsure at all Xaa locations
  Clone ID: SORBI-28MAY03-C46522_1.pep
MMAAANGIVVRAFTKEPLFSFGVIADVQYADIPDGRSFLGVPRYYRHSISLLPTAAASXVLQRAVNGWNEQGNIKFSINFGDIID

SEQ ID NO: 42436 - protein, 156 aa, Sorghum bicolor
  Clone ID: SORBI-28MAY03-C46745_1.pep
MKEGGEKKNILSKTLQRCRTSLLAQRRRPERASSSPSLGVPVPAAGYFTVLVGPEKERFGVRARCANHPLFRALLDAAEAEYGFAGCDGPLELPCAVDDFMEVMWEMEQADPSASPAGCGRFAAGSSIRAHHHHLHHQAAGGYQMVSPARFLVAGR

SEQ ID NO: 42437 - protein, 154 aa, Sorghum bicolor
  Clone ID: SORBI-28MAY03-C46837_1.pep
IERVIGAGAEQAIDYTAEDTEAAVKGKFDAVLDTIGVPETERIGINVLRRGGHYMTLQGEAAALADRYGLAVGLPAATAALLKKQTQYRYSHGIEYWWTYMRADAEGLHEIQRLSGAGKLQIPVEKTFPISHAREAHAAKEKKLVPGKVVLEFD

SEQ ID NO: 42438 - protein, 363 aa, Sorghum bicolor
  Clone ID: SORBI-28MAY03-C46980_1.pep
TRVKVGEGLFGPYEWERFDLLVLPPSFPYGGMENPRMVFLTPTVIKGDAAGAQVVAHELAHSWTGNLITNKTNEDFWLNEGFTTYAERRSAGVVQGEERAALNMGIGWRGLNRMMERFKDNMEFTKLKPNMAGIDPDDVYSEVPYERGFQFLWRIEREIGRPAFDEFLEKYIATFKFQSIDTETFLEFLKTNVPGIENQIDLNLWVEGTGIPPDAMEPDSATYKKICSLAAEFKSGKLPSEDEVANWSGQEWELYLENLPTDVEASQVTALDERYKLSESRDYEVKVAFLQLAIPTGCKCYFNEVEKCLKQVGRMKYLRPLYSSLAKCSSEEKMLAQRIFSEAQEFYHPIARSVAESILSKHS

SEQ ID NO: 42439 - protein, 145 aa, Sorghum bicolor
  Clone ID: SORBI-28MAY03-C6183_1.pep
KDVKAHKEKISDQNLEIKALRNKAAEWEMKVLENEAKVKAKEKERDQRVGEHNRKMTALKSEVESEQKCLEEKERKIKETIDKGSELCSQADSVAEAGRKKIEEIYGKYDQVCEAANMYIDGSDQSFEETDEAAAMLKTIAQSGA

SEQ ID NO: 42440 - protein, 234 aa, Sorghum bicolor
  Clone ID: SORBI-28MAY03-C49942_1.pep
MISSSKLKSVDFYRKIPRDLTEASLSGAGLSIVAALAMVFLFGMELSNYLAVNTTTSVIVDRSSDGEFLRIDFNISFPALSCEFVSVDVSDVLGTNRLNIRKTVRKYSIDRNFVPTGSEFHPGPIPTVNKHGDDVEEDHVDGAFSLSSRNFDSFSHQYPVLVVNFYAPWCYWSNRLKPSWEKTAKIIRERYDPEMDGRILLGKVDCTEEVDLCRRHHIQGYPSIRVFRKGSDIK

SEQ ID NO: 42441 - protein, 303 aa, Sorghum bicolor
  Clone ID: SORBI-28MAY03-C5012_1.pep
MQSPEPSSSSPVLLNIGGKKYATTVETLTQREPDSMLAAMFSGRHTLPQHPTTGKGMVFVDRDGKHFRHVLNWLRDGAIPVLSESDYQQLLREAEYYQLLGLADYINERLGWKKADNSEAELTRKDVIKCIQAPGVGARGGLASGRLLSTLHWSAAVFRAACTLISHVPSATLHKAKFGQVEALSSSFQNANLRECEFVGANLQESILDGANLRSANLQDASLTRCSFIETDLHSAHLQTANLTQANLRGANLEAANLKGAKLSGTNLQDANLQRAYLREVDLRDTQLTGAKLGGANLLGAIR

SEQ ID NO: 42442 - protein, 135 aa, Sorghum bicolor
  Clone ID: SORBI-28MAY03-C50351_1.pep
ARAGIGSSLTVTPAAADEEGDFAELYMFKWTTLLIPPTTILIINLIGVVAGTSYAINSGYQSWGPLFGKLFFAFWVIVHLYPFLKGLMGKQNRTPTIVLVWATLLASIFSLLWVRIDPFTTRVTGPPIGNCGINC

SEQ ID NO: 42443 - protein, 281 aa, Sorghum bicolor
  Clone ID: SORBI-28MAY03-C50297_1.pep
ARGGGGPRHVRRSPSGKTIKVKKDGAGGKGTWGKLIDTDAEACLDRNDPNYDSGEEPYELVEAPVSTPLEDYKKAVIPLIEEYFSNGDVKLAASDLKELGYDDFHRYFVKKLVSTAMDRHDKEKEMASVLLSYLYGNVVSSTQIRLGFVLLLEAVDDLAVDIPDVVDVLALFVARAVVDDILPPAFLSKAKVSLSGSSKGMQVVQIAEKSYLSAPHHAELIERRWGGSTHITVEEVKKKIADLLKEYIRNGDTAEACRCIRELAVPFFHHEVVKRALTLGM

SEQ ID NO: 42444 - protein, 171 aa, Sorghum bicolor
  Clone ID: SORBI-28MAY03-C50372_1.pep
VSPPASPPPPSPPRSSGLLVRPRPPLFASKNTTFPSLVAHSAPLVPNPASLTPKVQDHFRARQTLPSTASPLPTPPPGSIAPSVSLPPRGGAPRVSHTVETQVLRDTGAPPVCPSPLPPQQKHSWKIVSRCQQLPNRLAKHRSIKCEGGLLSLSKWLAEPSSWKNVVHISM

SEQ ID NO: 42445 - protein, 88 aa, Sorghum bicolor
  Clone ID: SORBI-28MAY03-C75223_1.pep
DFDSAIKEMCSSRPFQTSSTTNQPMGSRPSRWEPPAQACGSAATARWSSRPFHTSSTTSRPIGSMLFRMEQLAQTCSKEATTRRRSSA

SEQ ID NO: 42446 - protein, 165 aa, Sorghum bicolor
  Clone ID: SORBI-28MAY03-C75360_1.pep
PPPMGPGPNGHFMPPPMPHLDMVPPSTFGASATAKISVDASLAGAIIGKGGANTKHISRVTGAKLAIRDNEADPNHKNIELEGTFDQIKHASAMVTELIVRISGKAPGPQAKNNPGGRGPGSHAGGPGSNFKTKLCENFNKGSCTFGDRCHFAHGESELRKPAAA

SEQ ID NO: 42447 - protein, 106 aa, Sorghum bicolor
  Clone ID: SORBI-28MAY03-C75650_1.pep
GQTSPISDGASSYRDSTSREMQRVTEEVLATSRVPVGLVNITRLSEYRRDAPTQTYKKQWAEPTAEQRADPRSYADCTHWCLPGVPDTWNELLYWKLFFPSNDQFL

SEQ ID NO: 42448 - protein, 134 aa, Sorghum bicolor
  Clone ID: SORBI-28MAY03-C75387_1.pep
KPAVGSTLIGGETEALERLKKFAVECSMQPNKADKSNTQDSIYGANFSCKISPWLATGCLSPRFMYEELKKHATRAIPFGSTPKNNDGTSDAGTNWLMFELLWRDFFRFITKKYSSVQKTSEVATGCTPAPALA

SEQ ID NO: 42449 - protein, 84 aa, Sorghum bicolor
  Clone ID: SORBI-28MAY03-C51202_1.pep
MSNSNSNPLPSYMQFTESARAKTSSPKMSPDVQESNPRKRHSLPMTNGKHDSSPRMQRSSSQVQQNVKSNGPAPHNASDKRWHI

SEQ ID NO: 42450 - protein, 308 aa, Sorghum bicolor
  Clone ID: SORBI-28MAY03-C51723_1.pep
WTEFDRLRTRHEDNPKDDNISQKASTQRSAVENFVRVSESLKTSSCGERLKDIILEKGITKAAVEHVKESFASAGQTGFRTSEEWTAGLKLPSIPPILSMLKGLAKGHLSTQKCIDEEGILPLLHALEGVPGENEIGARAENLLDTLANNENNGDGFLGEKIQELRHATRDEMRRRALERRAMLLKGMGMRQEFASDGVRRIVVSQPTIEGLDDVEEEEDGVACMVCREGYTLRPTDMLGVYAFSKRVNLGATSSGSGRGDCVYTTVSHFNIIHYQCHQEAKRADAALKNPKKEWDGATLRNNETLCN

SEQ ID NO: 42451 - protein, 121 aa, Sorghum bicolor
  Clone ID: SORBI-28MAY03-C52009_1.pep
EKKRNYTSYNSFPNNKWPNRYITRHLNYHISQCSVTSYETVAWFRCPPDDIPVAYDFDMNNVHFTFSCSSPYSNLLQIPEKRSVLLSSTSAGSHILSQAVPVMTPGPEAFRRFHGAASYRP

SEQ ID NO: 42452 - protein, 171 aa, Sorghum bicolor
  Clone ID: SORBI-28MAY03-C5211_1.pep
KVKASGRTSRMESFKDKSLSNGLFFLELLSTVQPRVVNWKVVTKGEADEDKKLNATYIISIARKIGCSVFLLPEDIVEVNQKMILTLTASIMYWSLQRQPQSQSEMPEQSEPSSMTSDAASDIASEDGASTTAPSESEEVNSLSDSISNLTMDDATSNAPPAENGNGVEGS

SEQ ID NO: 42453 - protein, 258 aa, Sorghum bicolor
  Clone ID: SORBI-28MAY03-C5222_1.pep
TTTVYLIFHREAIGKILARGHSRVPVYSGNPKNIIGVLLVKSLLTVRAETETPVSAVSIRRIPRVPSDMPLYDILNEFQKGSSHMAAVVKAKPKTEPLPDKTEPNREVVGSAQLTVPLLSNAEESADNVVVDIERPHNRQVNGNAVPRSSEDIEDGEVVGIITLEDVFEELLQEEIVDETDEYVDVHKRIRVAAAAAASSVARAPSVRRCTRQKAANLQGAQNRQGQQPPGILKKPTEGDSNPSKQVNLVEPLLEKRR

SEQ ID NO: 42454 - protein, 97 aa, Sorghum bicolor
  Clone ID: SORBI-28MAY03-C52190_1.pep
NMVDPGGISNWSVTNVDWSEGKWHPRSYSADDVTYDLLKNITAIDENIHVTSDDKKLVMQKPCLWNGSKRPCYLFARKFNPEALDNLLKLFTSYTSV

SEQ ID NO: 42455 - protein, 129 aa, Sorghum bicolor
  Clone ID: SORBI-28MAY03-C4950_1.pep
MERAAPVRSSHTSTADLLSWPQPQGHAPAATPSPPRRPGQPSEAIRKVVFGGQVTEEEADSLTKRKPCSAPKWKEMTGSGIFAAGSNGDAGEAAADAAKPARTPWRQAISTLGDISYAGDWTDRPMKPT

SEQ ID NO: 42456 - protein, 200 aa, Sorghum bicolor
  Clone ID: SORBI-28MAY03-C4959_1.pep
MAATRLALALLLAAAVAASQLPAAAVAANYTVGDEKGWNPDVDYTAWVKKHKPFYKGDWLIFQYQNGRSDVVQVDEVGYDNCDKANALSSYSKGSTYAFQLKEAKDYYFICSYGYCYHGMKVHVTAKSSGSSSSGSGSSSGDDSSDSSDDSSSDDSPSPPAKKSKAKSSSAAAPPPSLLAATPRAAAITAAVALLLNRML

SEQ ID NO: 42457 - protein, 127 aa, Sorghum bicolor
  Clone ID: SORBI-28MAY03-C49677_1.pep
HEGSLLHAMKFNDFYHDTVHQFAPTYHEYVLYSNEGEDEPTKYSPNPIVTTGEHLVELAEVTVVSSKAPGMSSLLLNEADQAETIPSQVMEASTAASVEPYDLSSFLNVELSDYPDQVPAIPNVRER

SEQ ID NO: 42458 - protein, 191 aa, Sorghum bicolor
  Clone ID: SORBI-28MAY03-C49719_1.pep
HQNVMKLRSWRRTLHSIYYYYFHKDTKAVTKCEDEEASALDIATWDAMRGGRNTSVFLPPIRFRTELSNLVAAVANGHCHHAMEVVGAGLAAADDARAQEGRGRWRRLEAIHLEQVGAALAERGHGLPEGPVEGAGDELVELLPAADARGVADGLDDHERGAVDPGAVRELEQRRVAELHVAGGHLRAVLV

SEQ ID NO: 42459 - protein, 111 aa, Sorghum bicolor
  Clone ID: SORBI-28MAY03-C49820_1.pep
RSSLPAHLLTAADAAVSAPHALRLITCSCRLPPSPPTPHLPLMMTLTDDLDLTCEAAMDTEGGGGNPNRATAVPVVIVSDPTAAGVKIIHSWVRRTHPFVSTNQYNLRWPP

SEQ ID NO: 42460 - protein, 94 aa, Sorghum bicolor
  Clone ID: SORBI-28MAY03-C53103_1.pep
ELKDAAGGEWALKNEIGVSDVVPGGASQSITFLFMAFHPERELVYLWSPWKLLAFDVVERRVEEEWVFGSEKDGTHLIQVWLFPFSRHLANALA

SEQ ID NO: 42461 - protein, 82 aa, Sorghum bicolor
  Clone ID: SORBI-28MAY03-C53526_1.pep
ILGLSYTKSWWSYKSTAECYVARMWRLVSAKCSAQKYPIVVGLNITEVTKSVDYRICWAMIEPVRSAKVHAAIKLPSLFIIV

SEQ ID NO: 42462 - protein, 253 aa, Sorghum bicolor
  Clone ID: SORBI-28MAY03-C53572_1.pep
FPSDTPPNLRTKLPERPLSTGRVRPGITSGVRSTPNAEPVLSGPVKKMSVPAITRSKFSDIQSKTSLTNGHQSRPSERSLLDGQTTRTSRSVTAADNGFGRTISRKSLDMAIRHMDIRQNLGGIRGTSLFPHSIRSTTTKGRPARTSDPGHSVSNGDRYFTDNGSSNGHFSGDSSGALSHNGGSSIGSPDRETFGTKEVLSELDIYANSRYEAMLLKEDTNNMSWLHNVDDKFDQSPVFDHRFEPLPEPFGPL

SEQ ID NO: 42463 - protein, 258 aa, Sorghum bicolor
  Clone ID: SORBI-28MAY03-C53173_1.pep
MSRISRRVQVQEELSALEEGPKKMAGEVDEDVLTEILARLPCRSLARFQCVSTSWRRIISSDYLRRRLPLITSGVLYHDDTHRGGDADSGRRQRQAYTYACASGGVGSGGGTAEAPDMGFFPRHDTSTIIDGCNGLLLYYSSRPTAFHVVNPTTRRWAELPPPRARTLLSVLAFDPCASQHYRVVCFTGWLPRGATIEVFDSERGAWRDHEVDFGLDTDAMSATMHYSGGALHVLAYSGHVVRVDLDTMACAVTALPA

SEQ ID NO: 42464 - protein, 267 aa, Sorghum bicolor
  Clone ID: SORBI-28MAY03-C53926_1.pep
MAAAAAGATPATARKTLFTTTVTLLSSSLTRSSSSSSSSSSRSRSLSCSAASAAAPRLAPQPPDLVRWVQREGGFVHPALRVANHPEHGLGVSAAAADGDIPPGDVLIALPGRLPLRLRRPTGAADDVLVQLAQQVPEELWAMKLGLRLLQERAKSDSFWWPYIANLPETFTVPIFFPGEDIKNLQYAPLLHQVAGFLSSRFRLEFEKEIQQKLHTVPSVDHPFYGQDVNSSSLGWAMSAASSRAFRLHGEIPMLLPLIDMCNHSFN

SEQ ID NO: 42465 - protein, 159 aa, Sorghum bicolor
  Clone ID: SORBI-28MAY03-C50472_1.pep
TATSGSPWWAGRRLDPPRARGRCLGFAPNRSTPGACGANGGIKCAMETQPISNNRTGRLDIGTDWRLHGVALGVLARYLRRVPVQFVDITGLSELRKDAHTSVHTLRQGKLLTPEQQADPKTYADCIHWCLPGLPDTWNHFLYAHIISPSPPSSSSQDH

SEQ ID NO: 42466 - protein, 88 aa, Sorghum bicolor
  Clone ID: SORBI-28MAY03-C50764_1.pep
VLGHMKTVCVLILGWILFDSALTVKNILGMLLAVMGMVVYSWAVEAEKKAAAPIPRNKSDMLDGEDVPLKARVSGVPTGDLEDGEMKS

SEQ ID NO: 42467 - protein, 315 aa, Sorghum bicolor
  Clone ID: SORBI-28MAY03-C5085_1.pep
MGEMVVAGYGMDKALRASVSFDTPCGALLRELELRCSPSGERALVVGPPRLELETECMRVYRRKVDSANAERAQLRQSLMAKEAELKALVASIGENGPRFTVDEKHTSLKDQLAAVTPLLEDLRAKKQDRIKQISDVQSQIEKIRAQISDHNYQDSDGSVKQLNDDHDLSTRRISDLQMQLRNLQKEKSDRLQKVFIYVDEVHCLCAVLGMDFAKTVKEVHPSLHGANSENSTNISDKTLEGLTQTILKLKAEKKTRVLKLQETVEKLHKLWNLMESTEQERIHFSEVAAVLGSTEEEINSPGILSLETIQETEE

SEQ ID NO: 42468 - protein, 132 aa, Sorghum bicolor
  Clone ID: SORBI-28MAY03-C509_1.pep
MSYYGDRRPESSIVEAFTLSPLPYPVILILLMVTLLLGVSWFFTYEDFIEEASQQLSWALLAVPIALVLLIRWISSVESFEGYFGFYPRESRWKGYERPPAEGSSPWGVAMVVLLLLVLASFHSTIQDMWRP

SEQ ID NO: 42469 - protein, 176 aa, Sorghum bicolor
  Clone ID: SORBI-28MAY03-C51171_1.pep
SLCYIDTILRVHYFLLSIYLPGRQDEEDHRSKNWSMLGLKTGEAEVTTRRLVRFRFLSGGRPAEGFPVDGGAAAHCARASRTYRGRRASAAPALAVKGAGWHAAPAEARAVEHRVRGDAQVNKAQRTASHMHRDHPWNGMGDAGAIRHRAQGDDGRRVDDEQLRTGHGLHHLLRLV

SEQ ID NO: 42470 - protein, 131 aa, Sorghum bicolor
  Clone ID: SORBI-28MAY03-C55207_1.pep
SHDATQEPKIRSSARPRLQSESGHDETSNNGNGSAEAGSTRDGDGSRGGLAVDGRLASGLSRNNRRLSRVGVDGRVGSSAVVGRGSRRSRVVGLDNGDEGGGRTSSVGARDGDGLGNSNDGGLRDGVSGSW

SEQ ID NO: 42471 - protein, 180 aa, Sorghum bicolor
  Clone ID: SORBI-28MAY03-C5573_1.pep
MERAVPVRKPHTNTADLLSWSATGPDASASPAAASRPSLKPAAGITPAMFGAPVTDQEAEDVSKSERKFCSGSKLKEMSGSGIFAEKSEIGDSEASNPANKTSLRMYQQTVTGISQISFSADGSVSPKKPSSIPEVAKQRELSGTLEDADAKINKQLSEAKTKELSGSDIFGPPPEIPAR

SEQ ID NO: 42472 - protein, 184 aa, Sorghum bicolor
  Clone ID: SORBI-28MAY03-C55280_1.pep
MAAKSTMIPSLVLLIALLLSCSGISGAARLLEEAEYPHPATPAELPKPELPPHPTVPELPKPEVPAHPATPELPKPEIPEHLPELPKPELPPPHPAAVPELPKPEVVPEHPAVPELPKPELPPHPAVPELPKPEVPAAHPTVPELPKPELPPHPTVPELPKPEVPKHELPPKPESHYPVPETKP

SEQ ID NO: 42473 - protein, 228 aa, Sorghum bicolor
  Clone ID: SORBI-28MAY03-C55763_1.pep
MAAGSASATASLSVAAAAAAALRVRRPCARARAWAPSQRPQQGALLSLKPCASLAPHAPLWRAESDAAGGGAGAGDVMGLLLRERIVFLGNEIEDFLADAVVSQLLLLDAIDPDSDIRLFVNSRASGQALDVEVQAKEILTNKRNVIRIVSGFTGRTLEQVEKDIDRDRYMGPLEAVDYGLIDGVIDGDSIIPLEPVPERVKPKYNYGELYKDPQKFLTPDVPDDEIY

SEQ ID NO: 42474 - protein, 149 aa, Sorghum bicolor
  Clone ID: SORBI-28MAY03-C5577_1.pep
CWSNICLHMFTLDFLNQVANSLEKDSVYHLAEKKIPSIHGFTTGLKLEQFIFDAFTYSPSTALFEVMREEEFAPVKNANGATYDTPDSAKLMLLRLHSRWVVAAGGFLTHSVPLYMTGVEVSPLSSYAGENLEAICRGRTFHAPSEISF

SEQ ID NO: 42475 - protein, 221 aa, Sorghum bicolor
  Clone ID: SORBI-28MAY03-C55916_1.pep
MELSLLVSIIEALRHLLLILRTPRCCLRSMAIASGRREARGSVEQVCLRRLVLLGFGRPAGLLCPLRCLGCGMGARHVPNARSKGADAILLIAAVLPDVDIMYFIKICAELGMTALIEVHDEREMERVLKINGVKLIGINNRSLETFVIDTSNTKMLLEKHGNSIREKGILVVGESGLFTPDDVAYVQNAGVSAVLVGESLVKQECPGRAIVGLFGKELLH

SEQ ID NO: 42476 - protein, 92 aa, Sorghum bicolor
  Clone ID: SORBI-28MAY03-C52259_1.pep
SVFALAVACWPIGYGRFWYISLSSYVLGETPEADACNLASACLLFLILGETPETEFGFYLALGEKLLIVTETQIMNVRDINKIMENIYIPVI

SEQ ID NO: 42477 - protein, 209 aa, Sorghum bicolor
  Clone ID: SORBI-28MAY03-C52408_1.pep
MTTSMGALVLLCLVSTLLFPSAVLGHPWGGLFPQFYDHSCPKAKEIVQSIVAQAVAKETRMAASLVRLHFHDCFVKGCDASVLLDNSSSIVSEKGSNPNRNSLRGFEVVDQIKAALEAACPGTVSCADILALAARDSTSLVGGPYWDVPLGRRDSLGASIQGSNNDIPAPNNTLPTIITKFKRQGLNVVDVVALSGGHTIRMSRCTSFR

SEQ ID NO: 42478 - protein, 187 aa, Sorghum bicolor
  Clone ID: SORBI-28MAY03-C52788_1.pep
RRKQSNRESARRSRSRKAAHLNELEAQVAQLRVENSSLLRRLADVNQKFNEAAVDNRVLKADVETLRAKVKMAEDSVKRVTGMNALFPAVSDMSSLSMPFNGSPTDSTSDAAVPIQDDPNSYFANPSEIGGNNGYMPDIASSVQEDDNFVNGAAGKMGRTASLQRVASLEHLQKRMCGGPASSGSTS

SEQ ID NO: 42479 - protein, 82 aa, Sorghum bicolor
  Clone ID: SORBI-28MAY03-C52852_1.pep
GYPLLIPSTPVFHERSKHIKIKYHFIRSCLEDGSIKAEHISTGDQLADILTKALGKTKFEELRGRIVLEAISAKGNKTKGEN

SEQ ID NO: 42480 - protein, 275 aa, Sorghum bicolor
  Clone ID: SORBI-28MAY03-C52891_1.pep
MVHSERLQNENQPAFTSQTGERGRDVSGTRQDQKYGSGFMKCHSLMKDNNVVFHQTLPTTLHFLPQDGDSLKLQLSSAVTMSSDRTCSTSADDPASNHDYMTVLSVKAASVASQWLELLHQDIRGRLAALKRSRKRVRNALRTELPYLMSTEFPSNQENESSIANTSEAGCTEKAVSEAHVARWRSLFVQMDRTLQEEGKQLENRLKQVQEMQLNCDKGLKHMTCEAPLLGPMAELWKLNNPDNSESEWAVQAAAASIYSTCNMVMRAENNVPCF

SEQ ID NO: 42481 - protein, 259 aa, Sorghum bicolor
  Clone ID: SORBI-28MAY03-C56402_1.pep
MSPPAAMPTHHPPPAAVQEVPLPYTSLLMMASANCADLIGGADRVGDDDEQLLWDCAAPSVPPTRIWDFNLGRSRDHDEKSALEVGYGSNHGGFMIKSYSDMLKEISSGTTKDLEDIYDSRYCSTAEDIMSSNICQLSSKNVSTASNKRKLSSCASTIDGPTTSGNHVPTSGPALTREISFGDQTVSTPAAERPAVRIDSETLAQNRDSAMQRYREKKKNRRYEKHIRYESRKLRADTRKRVKGRFVKSTEALNAGYGG

SEQ ID NO: 42482 - protein, 456 aa, Sorghum bicolor
  Clone ID: SORBI-28MAY03-C5642_1.pep
TRHNNANNSGGIVLHGSPAPSNIQQQNYSLLHQMQALRHTDIDPGTWAGKATRPDIGPDASQIDWKSGQRFAHVANNSTKSSADNIGSPGVPGPFTSDMKMLSFASRSEERNPNVPSQLPSGERPSPGMVTAQNDNRNQVQPMGTSATSNSVERSERPRINPQMAPSWFGHYGNYRNGQSVAMLNAQKPTALPYNFPKASWNNENNSPAENRVESGQSVRPGTRLPSTRMEALVPSNVKVSSMMRRPKKRKAMDSTLVSWHKIIESPQKLRNISTFEMDWAWAANRLIEKDESETPDDAPLNYLPRKRLILTTQLIQQLLPAIPATILRAQAVSAYESATYTLSMLTLRDACSMASSSLYNSCSPVEDENNPSEQTTSAKKMEDKVSKAVEVFVGRIRKMENDFISLNKRASMLDVQLECQDLERISIVNRLGRFHGRNHAAAVEGSSASEMTPRR

SEQ ID NO: 42483 - protein, 150 aa, Sorghum bicolor
  Clone ID: SORBI-28MAY03-C56444_1.pep
EAGELQRGGSAGRQHRQGHRAQGGGGEPQQGGGGAGGPARAAGALLPAPPADTPAGAAPGNARAVAQPVGGPRGRARDHRLRRRRRPTPVRRPRRGRHDRQLELLQRARQEDMQDWEQRRAGVSEPHVHCHASDPPEQCLLASSIFPIFH

SEQ ID NO: 42484 - protein, 460 aa, Sorghum bicolor
  Clone ID: SORBI-28MAY03-C56917_1.pep
MGKSNKKSSVGAAPAAVAVPEGKSVKKGKARAEDEIEKAVSAKKQKTAPEKAVPVKKQPPPKKVESSDSEEDSSDSEVKVPVKKQPPPKKVESSSSEDSSDSEVEVPVKKQPPPKKVESSSSDSEEDSSDSEVEVKVQPKKVIQPKKGTQLAKQESSDDSSSESSDDEPSKKPVAGSKKPAASSSDSDDSSDSDDSSSDEEPAKKPTVLSKKPVTAVSNGSKQVKHDSSSSDSSSDEDEKPAANLKKPPVASLQKKTQESDSSDSDSDDDESEDDIPAKAPVVAKKKEASSDSSDSESEDEDNNAKTVQPVKAAAPKKKEESSGSSESDSESDSDSDEPEKPTVPGKRPLATNKKNEESSDESDGSSDESSDESDEEPPQKKSKETPVDTTQKSAHNEPKTPAKSQSQATGSKTIFVGNLAYSIEREQVKEFFEEAGEVVDIRLSTFDDGSFKGYGHVEF

SEQ ID NO: 42485 - protein, 108 aa, Sorghum bicolor
  Clone ID: SORBI-28MAY03-C5652_1.pep
GGVGRTRGGKLAPNEFQGGTFSISNLGMYPVDHFCAIINPPQSGILAVGRGNKVVEPVVDSDGTEKAAAVTKMSLTLSADHRVFDGQVGGKFFTELALNFSDIRRLLL

SEQ ID NO: 42486 - protein, 130 aa, Sorghum bicolor
  Clone ID: SORBI-28MAY03-C5373_1.pep
IFGSTLVPHSSTCRPPNGPNMLLDHHLLYISFHASSRTCKLTCIIRSFSSRNNFEQKNSLWARPGTAGREAGDERVQVESQDSRGLHAASQPCNLNSLTRSLTHAKEREGAKRGRSWWWTQANTRHPAGK

SEQ ID NO: 42487 - protein, 133 aa, Sorghum bicolor
  Clone ID: SORBI-28MAY03-C54266_1.pep
EEAVGIITMEDVMEELLQEEIYDETDEYVDVHNKIRINMLPPGKSLSPTISPGGGPLSQGLRRTPMASPFSPYHHGSSVLRSPASNHGQSPGILPTILSPGRSPTAQTPGQSSPSGSQVSINSNGQHKKDGES

SEQ ID NO: 42488 - protein, 296 aa, Sorghum bicolor
  Clone ID: SORBI-28MAY03-C5434_1.pep
MDPSSAGSGGNALPSVGADGQKRRVCYFYDSDVGNYYYGQGHPMKPHRIRMTHSLLARYGLLNQMQVYRPNPARDRDLCRFHADDYINFLRSVTPETQQDQIRLLKRFNVGEDCPVFDGLYSFCQTYAGASVGGAVKLNHGHDIAINWSGGLHHAKKCEASGFCYVNDIVLAILELLKHHERVLYVDIDIHHGDGVEEAFYTTDRVMTVSFHKFGDYFPGTGDIRDIGHSKGKYYSLNVPLDDGIDDESYQSLFKPIMGKVMEVFRPGAVVLQCGADSLSGDRLGCFNLSIRGHAE

SEQ ID NO: 42489 - protein, 170 aa, Sorghum bicolor
  Clone ID: SORBI-28MAY03-C54810_1.pep
EPGHPPAPPPLRPAGLTLGDLFLGPGLDLLLEYLAETDPSRQGTPPARKEDVAALPMVRVREAFTCPVCLDEVAGGGEAREMPCSHRFHDQCILPWLEMHSSCPVCRHQLPTEEPAAEAIGSGRGAGDESSGNARGGDGGNGGGRRHWFSWPFGGLFSQRSNGNSSSSSS

SEQ ID NO: 42490 - protein, 179 aa, Sorghum bicolor
  Clone ID: SORBI-28MAY03-C54860_1.pep
VHEHRRPERNLALQRRVRGVKARLIRGGAAADGRGGAARPVARQRRDGGGEARLIRGSTASDGRPVAASPVARHLLHEAGVAVGTLQLLDAQLGPEDQRGPEAAGPRSGAGSDQQVRASHDHQPRGTQAVRPRAPSMSQNITTRSILKREQVQLDQWIEHLPANRDTGCPSPRAQKRHL

SEQ ID NO: 42491 - protein, 284 aa, Sorghum bicolor
  unsure (1)..(284): unsure at all Xaa locations
  Clone ID: SORBI-28MAY03-C58338_1.pep
MDGSSSKVVELKPHGDVAEEDPARRGGPGTDEADDNEKAPRRSRRVASLDVFRGLTVALMILVDGAGGEWPVIGHAPWNGCNLADFVMPFFLFIVGMAIPLSLKRIPDRGRAVRRVVIRTLKLLFWGILLQGRYSHAPDELTYGVDMKHVRWGGILQRIALAYLVVAVLEIVTKDAKIQDQSSSGFSIFRMYLSQWIVACCILVIYLALVYGIYVPDWEFRVRNVDSPNYGKVLTVTCGTRGILDPPCNAVGYIDRKVLGINHMYQKPXWRRHRACTDDSPHEG

SEQ ID NO: 42492 - protein, 226 aa, Sorghum bicolor
  unsure (1)..(226): unsure at all Xaa locations
  Clone ID: SORBI-28MAY03-C585_1.pep
QKTSAKDKYKFFELLRSKSVNGSGTAIESPSGLTDDQQNSSLDXGVGFIENGSSSCEEANSCEGSQRHLSDNEEIIPPSESHDVLDEGSLGIQVDDRDASSSPVLGDIEDIASKKPQQDNVAIMPIIPAYVNDGSVMPNSVDNEASLSLEEANPAQVLQHIGVREENPCPAQEFESFGAGGEEELNLLRSMGWDENEDVQPLQQEEIADCLRQNARLQQKLQECRG

SEQ ID NO: 42493 - protein, 330 aa, Sorghum bicolor
  Clone ID: SORBI-28MAY03-C58921_1.pep
MRSPALLAAALVAAVLLAAGAGVAAAATEEAYVTLLYGDEFVLGVRVLGKSLRDTGTRRDMVVLVSDGVSEYSRKLLQADGWIVNRITLLANPNQVRPKRFWGVYTKLKIFNMTNYKKVVYLDADTIVVKSIEDLFKCGKFCGNLKHSERMNSGVMVVEPSETLFNDMINKVGQLPSYTGGDQGFLNSYYSDFANSRVYEPDSPLTPEPETQRLSTLYNADVGLYMLANKWMVDEKELRIIHYTLGPLKPWDWFTAWLVKPVETWQDIRQKLEESLPGTGGGRNPHDQLVVKILFILPFCLLLFGYYQSCFQTNKELISIRSLCAFARRA

SEQ ID NO: 42494 - protein, 246 aa, Sorghum bicolor
  unsure (1)..(246): unsure at all Xaa locations
  Clone ID: SORBI-28MAY03-C5927_1.pep
MGSSEADEDQLLKSFLAEVSEAERDNEVLRILGCFKLNPFEHLKLSFDSSPDEVKKQYRKLSLLVHPDKCKHPQAQEAFAALAKAQQLLLDPQERGYILDQVTAAKEELRAKRKKELKKDSASKIKSLVDEGKYEEQFERSDEFQQQLIIKVREILTDKEWRRRPSRIRCSVVVRCLLQVGVDTXLWWGWQRQHEALWVASSDRRVSSWCVFVKTGKKGRKGEIKPPKLKTEDPNKSYVQRPVKRN

SEQ ID NO: 42495 - protein, 321 aa, Sorghum bicolor
  Clone ID: SORBI-28MAY03-C59344_1.pep
MEMEIAKVDLRGVVPGGAAWDAARAAVTASMVAHGCVVVAHDALGADLRRALFSRALPELFALPLEVKQRTVSDKGQFRGYIGQQPGMNWESLRVGEPTDAASVRGFAEILWPEGNPEFCETILSFAKNMKKLEEMVETLVLEGLGTRGESIDAHFGLLGHGFRLSHYGVPPDTESSMSMSPHCDDSMVTAIVQHEVEGLEVHVGDGRWVAVPAETGTITFVAGEQLRVVTNGRVPACLHRVRTPSNRERFSVLFGRRQKDGVLVRALEDLVDAEHPLVYNPLRHEEYSKWRYSEEGLKFDDPLKVYCGVDKEEKVVGAMA

SEQ ID NO: 42496 - protein, 186 aa, Sorghum bicolor
  Clone ID: SORBI-28MAY03-C59345_1.pep
MGSGDWFKTIISKKKSKRAKSKHAKLSGQVTNGSNQTNQKLNGPSSSSDDHEDNAALEEWAATRIQNAFRKYRARKTLRCLRGVKRLRVVGQANPVKKQTAATLSYIQSWNKLQSEIRNRRAFMVTEGRNRKKKQENQMKLEAKLHNLHVEWNGGSDTMDEILARIQQREEAAVKRERAMAYAFNH

SEQ ID NO: 42497 - protein, 211 aa, Sorghum bicolor
  Clone ID: SORBI-28MAY03-C5609_1.pep
AHNLLDPTQMQVPYQQCHNNGVLHGGVNYPGNRLHLGPRIPVLFSSPERTFGPPQHPFLANPVNHRNIRILPPEHATIMDFSRLYEVSNTVDEHRDMRLDIDSMTYEELLALEEQIGDVNTGLTKSHIVDKLRTSLYVPGTSSMPDQPSKSSLENDACIICQEEYQARDCVGTLDCGHRYHAECVKQWLMVKNLCPICKTTALSANRRQGK

SEQ ID NO: 42498 - protein, 310 aa, Sorghum bicolor
  Clone ID: SORBI-28MAY03-C56078_1.pep
APGLKYQTKPKWSSHGDLYYEGKEFEVKLREMKPGMLSRELKDALGMPDGAPPPWLINMQRYGPPPSYPQLKIPGLNAPIPPGASFGYRPGEWGKPPVDEHGRPLYGDVFGVLQQDEPNYDDEPVDRSKHWGDLEEEEEEEEEEEEEEARPMEDEEMEDGIQSVDTISSTPTGVETPDVIDLRKLQRKETEKQAERPLYQVLEQKEERIAPGTLYGSSHTYVLGTQDKSSAPKRVDLLKNQKSDKVDVTIQPEELEAMDDVLAAKYEEAREEEKLRNQKEDFSDMVAENAHKRKRKQEKEGKSKKKEFKF

SEQ ID NO: 42499 - protein, 394 aa, Sorghum bicolor
  unsure (1)..(394): unsure at all Xaa locations
  Clone ID: SORBI-28MAY03-C56369_1.pep
YWIVSSHNYEYTPSCEEIXNLVARIQAVGADIVKVATTAKDIVNVSRMFQVMVHCQVPMIGLVMSERGLMSRVLAPKFGGYLTFGILNATKTSASGQPTVEDLLNIYNIKCIRPEAKVLGLIANPVKQSKSPILHNKCLQSIGYNAVYLPLLGDNLASFLETYSSPDFSGFSCSLPFSAGAVQCCDEHDPVAKSIGAINTIIRRPDGKLVGYNTDYIGAISAIEDGIGGPGSKDAASSPLAGRLVVVVGAGGAGKAIAYGAKEKGARVVIANRTYQKAVSLANAIGGQALRLEDLETFRPEEGMILANATSLGMYPNVDGTPIPKKALGFYDVVFDAVYAPKVTRLLREAEECGVKVVSGVEMFIRQAMGQFERFTGGIEAPECLMREIAAKYT

SEQ ID NO: 42500 - protein, 261 aa, Sorghum bicolor
  Clone ID: SORBI-28MAY03-C56379_1.pep
TRGTFRGRGLGVPSRRPLGVNTRSSPVAIAKSFNKAKDFVWRHDLFEDSMVAAGLSGIESGTKLYISNLHYGVTREDIQELFSEMGHLKHCAVHYDSYRHPTGSAEVIFTRRSEALAALKRYNNVRLDGKAMKIEVIGADLGLSSAAAPRISVVPGASGRGQREVVMMPGGSGFGLGASGPSSSLPGWKRGGFVQRGGQGRGGFAQRGRGQVRGRGRGRGRSSFGQVRGRGYVRKGNVEKSAEQLDKDLDNYHHSGAMNVD

SEQ ID NO: 42501 - protein, 84 aa, Sorghum bicolor
  Clone ID: SORBI-28MAY03-C56398_1.pep
ALFVEGEEPIRQPIIPATEVIDTTGAGDTFTSAFAVALVEGKPKEECMRFAAAAASLCVRVKGAIPSMPDRKSVMKLLDSAKVE

SEQ ID NO: 42502 - protein, 359 aa, Sorghum bicolor
  Clone ID: SORBI-28MAY03-C60681_1.pep
MVSKSYSNLLEMTSGDGFDFRQPFKSLPRVVTSPGIISDPDWDTISDGDSVGSASSTERKIIVANFLPLNCTRDDTGKLSFSLDHDALLMQLKDGFSNETDAVYVGSTRVQVDPSEQDQVAQKLLREYRCIPTFLPSDLQQQFYHGFCKQQLWPLFHYMLPICLDKGELFDRNLFQAYVRANKLFADKVMEAINTDDDCVWVHEDHLMLLPTFLRKRLHRIKIGFFLHSPFPSSEIYRTLPVRDEILKSLLNADLIGFQTFDYARHFLSCCSRLLRLHYESKRGYIGIEYFGRTVSLKILSVGVHVGRLESVLQLPATISKVQEIEQRYKGKILMLGVDDMDIFKGISLKLLGLELLLD

SEQ ID NO: 42503 - protein, 175 aa, Sorghum bicolor
  Clone ID: SORBI-28MAY03-C6070_1.pep
KHKDKCAKNQLNREKVQFQQRTGSRCYIAQAYVVKQEKYKDIELTAVDLFKELHCSKTKGFSEPVKKAIDDMHAQEALPSESVEDGQQAKTSIEVVSKVLPKSNTFLRNVGIQQPAAKTTNVVKELQAELDAKKLESIGLQQELERLKAQTQESEAKVDKQAEEIESLRKMAADT

SEQ ID NO: 42504 - protein, 261 aa, Sorghum bicolor
  Clone ID: SORBI-28MAY03-C60755_1.pep
MDRYHRVEKPREEEAPIGANEIRITAQGPPRNYITYALALLQDNATDDIVIKAMGRAINKTVVIVELLKRRIAGLHQNTSIESINITDTWEPLEEGLVTLETVRHVSLITIKLSKKELDTSSPGYQPPIPADQVRPAAEFDQDAEAVPSGRGRGRGRRGRGRGRGRGFSNGGVDYHDEFGEPEEAPRGYGGRGRGRGGRGSFAPGRGYGGDNYAMEEAGGYDDGYNAPPMQGYEGGRGRGRGRGRGRGRGRGSQGQGPPQQ

SEQ ID NO: 42505 - protein, 330 aa, Sorghum bicolor
  Clone ID: SORBI-28MAY03-C6072_1.pep
MASPSPSSPLHPHQHQHQHPPPPNPHHQFQSPPPSMPPPPSAALPKAFDLEVTVVSGKHLKNVNWRRGDLRAYAVVYLDPSRRAATRPDDGGGCKPTWNERLVLPLPPHLSPHDPSILLSLDVFHSKPSDSPKPLVGSARSPLRDLLYPANPNPSHDPAASALVSLPLLRPSGRPQGKIRVRVAIRERSPPPPEPQYPPPSSSPYYFPPPPPAYSAPPQYGSDQYYRPSGYYSAPAPPPPQYEYTGGPSAPVDYNRQYEQRGRTGGGGSGSGNGRYGVGTGLAVGAVAGALGGLAIDEAVKYKEEKAAERVEEKVVPAGRDDYSEYRGDY

SEQ ID NO: 42506 - protein, 339 aa, Sorghum bicolor
  Clone ID: SORBI-28MAY03-C60893_1.pep
ARREEDLERAYKNTNMKPMSHSTYLRLQVLREIFWDVDTKLEVLMKLTFTDLVAFVPKILSQLHVEGLCHGNLSEDEAVNISKIFLNTLSAPTLPEEARHSERVMCIPNGANFVRSVRVKNDLEENSVVEVYFPIEQDVGKEATRLRAITDLFSNIIEEPCFDQLRTKEQLGYTVDSSPRMTYRMLAYCFQVMSSKYSPIYLQSRIDNFIDGLSDLLDGLNEETFEHHRSGLIADKLEKEPSLSYQTNDYWSQIADKRYMFDMAKLEAEELKTVHKADVIAWYNTYIRSSAPKRRRLAIHVYGCNSDITEAAKLQEQSWIIIDDIESLKASSQFYSSLC

SEQ ID NO: 42507 - protein, 253 aa, Sorghum bicolor
  Clone ID: SORBI-28MAY03-C56927_1.pep
TFTRQRSNLFKPCFPDAEDNLTFNDTMIALQLMRTQFPKLDKVVAQPFILQSQLYSSVKDRTQVDRDLESFKNDRVLRIFKLSSGQDDHAIMFMDDYLKQVAFAIKRSGGKDQDGNEVFEWFERYVVPSKLDVSINQLDLCSLLSRGGDVTDKHITLLMNAGLLTRQLIDPNIYWFSIPRIGPILKGLSQGRKEILSLLNRRKYKEMLLSSLENTKLRLSSLDTRFLLRDLIGSGHIKTVQTPTGLLARISRD

SEQ ID NO: 42508 - protein, 275 aa, Sorghum bicolor
  Clone ID: SORBI-28MAY03-C57026_1.pep
MGNARGWKEYCESIGSGLGSNPDMENMRKILSLSYYDLPAHLKTCLLYLSVFPEDYEIVKDRLIWRWIAEDFVPPGEGGQSSFELGLSYFNDLVNRSLIQPADMDDEGTPISCRVHDMVLDLICNISREESFVATVLDDARQNTPSWGSKVHRMSLHNTTWPTVMDLSKLRSLTVFSAAKIKLMPSLSYLHLLRVLDLEGCSLKELTNLSFVARLFHLRYLSLRNTSYAGEPPSEIGKLKLLQTLDLWGTDIEELPSSIIGLRRLMFLALNWRIC

SEQ ID NO: 42509 - protein, 358 aa, Sorghum bicolor
  unsure (1)..(358): unsure at all Xaa locations
  Clone ID: SORBI-28MAY03-C57177_1.pep
MESAAIGSQSPLSFPSSLCKAKVSSGLPIYNVKIKSNHRLEVVCRGMLATRKFMQRKKKEEVFKDAADEAEQMNWRRMMREIEEAGSAVPMLEAQRSGKGPLPRDVILGTLVRFKQLKKWNIVSEILEWLRTQHWWDFSEMDFLMLVTAYGKLGDFSRAERVLKYMNKKGYQPSVISQTGLMEAYGRGKQYRKAEAVFRRMQTSGPEPSPVTYQIILKSLVEGDKYKEAEAIFEDLLNEKRTSFKPDQKMFHMMIYMYKKAGDYAQARKLFAQMSERKIPLSTVTFNSLMSFETDYKEVSSIYDQMQRAGMKPDVVSYSLLIKAYGKARREEEALAVFEEMLDAGVRPTRXSYNILLD

SEQ ID NO: 42510 - protein, 214 aa, Sorghum bicolor
  Clone ID: SORBI-28MAY03-C57394_1.pep
MRATIPALSLLVAPRPRLPSLAAPAAGGRVRVGRRPRTRLRVAAPTSVPGEAAEQAEPSTSAPESESGEKFSWKDHWYPVSLVEDLDPSRPTPFQLLNRDLVIWKEPKSGEWVALDDRCPHRLAPLSEGRIDETGCLQCSYHGWSFDGSGACTRIPQAMPEGLEARAVRSPKACAIKFPTLVSQGLLFVWPDENGWEKATATKPPMLPKEFDDP

SEQ ID NO: 42511 - protein, 139 aa, Sorghum bicolor
  unsure (1)..(139): unsure at all Xaa locations
  Clone ID: SORBI-28MAY03-C58114_1.pep
AQGLAVVLYLEPVHDRCPGGLSSCLVLFVWVGVPPSPLFTGACLPPLSRXSVIEISQNLGFLVEERPSTLVDNLGADVVFCPGTAVLVSPVGSFTHRGRRVEYGKNQEAGAVFQQLYAAFTAIQKGVTEDRMGWTLQLA

SEQ ID NO: 42512 - protein, 148 aa, Sorghum bicolor
  Clone ID: SORBI-28MAY03-C6185_1.pep
KFLDGMQDHYTFAQPGIQRLVFRLKELVRRIDEPVSKHIEEQGLEFLQFAFRWFNCLMIREVPFHLVTRLWDTYLAEGDYLPDFLVYISASFLLTWSDKLQKLDFQEMVMFLQHLPTRTWAHHELEMVLSRAYMWHTMFKSSPSHLAS

SEQ ID NO: 42513 - protein, 159 aa, Sorghum bicolor
  Clone ID: SORBI-28MAY03-C62290_1.pep
QSHRLIVRGRWAAGTLQCPIFQGHGKNLKYLALSWSGLHEDPLLLIAPHVPNLTYLSLNRVSSTETMVISEGSFPQLKTLILKNMLNVNQLTVGKDALPNIEGLYLVALPKLNKVPQGFESLVSLRKLWLLSLHKDFKFLWELSRMHQKMPHVVEVRVE

SEQ ID NO: 42514 - protein, 131 aa, Sorghum bicolor
  Clone ID: SORBI-28MAY03-C62397_1.pep
CPFPLHSEECPYSYTRQCNHDGPLFVILLEHDKMSVQEFPANSTVMDLMDRVGANSSRWSPYSIPVKEDLRPRVNHEPICDPNRKLSMGDVVELTPALPRKSLSGYREEIQRMYDRGGFALSTRGGGSRRC

SEQ ID NO: 42515 - protein, 237 aa, Sorghum bicolor
  Clone ID: SORBI-28MAY03-C61912_1.pep
RHEDVDMQKIPVRFAITNAGLVGSEGPTNSGPFDITFMSCLPNMIVMSPSNEDELIDMVATAAMIEDKPICFRYPRGAIVGTSGTLTYGNPLEIGKGEILVEGKEIAFLGYGEVVQRCLIARSLLSNFGIQATVANARFCKPLDIDLIRTLCQQHSFLITVEEGTVGGFGSHVSQFISLDGLLDGRIKWRPIVLPDRYIEHASLAEQLDLAGLTAHHIAATALTLLGRHRDALLLMK

SEQ ID NO: 42516 - protein, 192 aa, Sorghum bicolor
  Clone ID: SORBI-28MAY03-C59526_1.pep
MGSGSFLKVLANNFDVLAGPLISLAYPLYASVRAIETKNPVDDQQWLTYWVLYSFITLFELTFAPIIEWLPFWSYAKLFFNCWLVLPWFNGAAYVYDHFVRPTFVNRQIVNIWYVPRNEKLGKSDDVLSAAERYIEQNGPEAFEKLISKSTKSSKSRNTKRSILEEAEAENRAKAERESWDENPFYDKNYRY

SEQ ID NO: 42517 - protein, 294 aa, Sorghum bicolor
  unsure (1)..(294): unsure at all Xaa locations
  Clone ID: SORBI-28MAY03-C59695_1.pep
ARGASATISPGAPAWSLPAGCRGLHPLPLVPHPPAGVFVLLASPTDPAVFSAALIAALALGRVLGPPGLSLKLPSALSSLIPPVVEEGFWYHHAEETYLMLAYWLPNTTHTLPVNATHRVGVGAFIMNDKREVLVVQEKSGVLRGLGVWKFPTGVVXNRYWYTLGEDINVAAVREVKEETGIDAEFVEVLAFRQSHKSFFDKSDLFFVCLLRPLSYDITKQDSEIEACQWMPIEEFAAQPFVQKHELVKYILEVGLAKVDKEYAGFSPISIKSAFTDKLSLFYMNRRDLDRASG

SEQ ID NO: 42518 - protein, 285 aa, Sorghum bicolor
  unsure (1)..(285): unsure at all Xaa locations
  Clone ID: SORBI-28MAY03-C59700_1.pep
MGRKCHAAVAIAVAFAAAAAVAVAADRRLSLVRAAVAPEEEMSLFRKVANLMWKSDGNSYQHVWPTMELGWQIVLGSLIGFFGAAFGSVGGVGGGGIFVPMLTLIIGFDPKSSTAISKCMIMGASVSTVYYNLKLKHPTLDMPVIDYDLAVLIQPMLMLGISIGVIFNVIFPDWLVTVLLIILFLGTSTKAFLKGIETWKRETIIQREAAKRLEQIAGEEAEYAPLPTGPGAAANKKTLSSDEAPSLIKNIHWKEVGLLSFVWVAFLVLQVTKNYTATCSPWYXV

SEQ ID NO: 42519 - protein, 340 aa, Sorghum bicolor
  Clone ID: SORBI-28MAY03-C6015_1.pep
VSPLPRSSPPMAAPQPAAPAPEAPPSAQVVGNAFVQQYYLVLHQSPDLVYRFYQDASRLARPASAAGAAGMDSVTTMEAISEKIMEMDVSKAEIRTVDSQESLGGGVTVLVTGHLTGRDGVRREFSQSFFLAPQEKGYFVLNDIFRFVGDIPAPTAVEAQPEADAVVPPVAAPLANGTATPAVEPAIPDDHDAVPQQENHVVDRSPPQPEEDEAEVYNPPPEEVVDEEQPVPEVINEVPNNVAPVAATTVAPVLQEEAPKKSYASIVKVMKEVPLPAPAPPTRPAPPKPEKQSPPAPTPVTDVPPFSSNPDNSNIQEPEVDAHAIYVRNLPLNATETQLE

SEQ ID NO: 42520 - protein, 285 aa, Sorghum bicolor
  Clone ID: SORBI-28MAY03-C60291_1.pep
MMTSRLKLLALPILLVLLILFAARPRVLPEAVLRAPVLPGDLLPLLPWSVAQPLLRRLALRGPADLLPAFVGAARPQAPDDAHPLAEWKGACFYENRAWVEFRNGTDGGLGGGIVHVETSKAHSWTCIDLYVFATPYRVTWDYYFLGREHTLDFEEWESEAEYEYVKRNGVSIFLMPSGTIGTLRALWEVFPLFTNTAWGENANLAFLKKHMGATFEERPKPWVSELNPDDIHSGDFLVLSKIRGRWGGFETLEKWVTGAYAGHTAVCLRDSDGKLWVGESGNEN

SEQ ID NO: 42521 - protein, 212 aa, Sorghum bicolor
  Clone ID: SORBI-28MAY03-C7570_1.pep
MSPFAKKPTPREVMRSSKRDLTNATRGIERDIASLQQEEKKLVAEIKRTAKTGNEAATKILARQLIRLRQQISNLQGSRAQIRGIATHTQAMHANTSVATGLQSASKAMGALNKQMEPTKQMKIMKEFQKQSAQMDMTNEMMSDSIDDVLDDDQAEEETEELANQVLDEIGVDIASQLSSAPKGKIAGKKVQVDESSELEELEKRLAALKNP

SEQ ID NO: 42522 - protein, 160 aa, Sorghum bicolor
  Clone ID: SORBI-28MAY03-C62781_1.pep
DSVAPGLEAFVHDPLINWRLFNFNEVPQVSNYGNAHAHTVVSSEDAVANRELMQPQRGARERELLQAVNQLGDANEVLNERAVAVMARMSDKLTGRDFSSGSALAGAGSSTQHGSEHLASGDARDAQPALSVKVQVQKLILQATSHENLCQNYVGWCPFW

SEQ ID NO: 42523 - protein, 54 aa, Sorghum bicolor
  Clone ID: SORBI-28MAY03-C63136_1.pep
WIYDLGRKRNFAQVFGNDKKYWFIPAYSEEDLRRIPALQGLDYPVRPDFDGQEL

SEQ ID NO: 42524 - protein, 155 aa, Sorghum bicolor
  Clone ID: SORBI-28MAY03-C6336_1.pep
HEGIKLQIWDTAGQERFRTITTAYYRGAMGILLVYDVTDESSFNNIRNWIRNIEQHASDNVNKILVGNKADMDESKRAVPTAKGQALADEYGIKFFETSAKTNLNVEQVFFSIARDIKQRLAETDSKPEDKAIKINKPDQGSEAPAAQRSACCGS

SEQ ID NO: 42525 - protein, 332 aa, Sorghum bicolor
  Clone ID: SORBI-28MAY03-C6348_1.pep
TRLFTVSSYTASAIRDTNLLSIFEEEIKDTRDMLKTLSALEVLYELVEHPHSNIFLLKTNLLQLIVDIINDSSADSVIRSRAALISGRLLSSADAFTAIDKSCVTNLLVAIDKILKMEESQNTDEIESALETLGLIGTTSQGAHFLLTSSNVARHVVKSSFDRQGRGRQLAALHAFGSICGMDRQEDQMKLDDEAEGNLKRLVYTTAANSPKLTPSAALLSILQQDPDIRIAGYRVISGLVIREWCLREVCLNSEIIRFVTDPTMETTKLGMEARYNCCVAINKALSSSHLLHEASLSGLIGKLNDAVKRGPYLSERKRVEARPVVDTAERF

SEQ ID NO: 42526 - protein, 215 aa, Sorghum bicolor
  Clone ID: SORBI-28MAY03-C6358_1.pep
MVFYFKVRPEAGDYTIFMGLDKYENEDLIKYGFPEDIWFHVDKMSSAHVYVRLNKGQTMDDMSEGLLEDCAQLVKANSIQGNKVNNIDVVYTPWYNLKKTPSMDVGQVGFHNPKLVRTIKVEKRINEIVNRLNKTKVERKPDLKAEREAVSAAEKAERKAQLRDKKRREEMERLEKEKQADIRSYKGLMVQEKMTSNKQIASGSKTLQELEEDFM

SEQ ID NO: 42527 - protein, 121 aa, Sorghum bicolor
  Clone ID: SORBI-28MAY03-C64101_1.pep
FIMGPLFLELGIPPQVSSATATFAMMFSSSMSVVEYYLLNRFPVPYAVYFTIVAFAAALIGQHAVRKLINWLGRASLIIFILAFMIFVSALSLGGVGISNMVHKIARHEYMGFENLCKYDA

SEQ ID NO: 42528 - protein, 151 aa, Sorghum bicolor
  Clone ID: SORBI-28MAY03-C107960_1.pep
NKRARWRSKQLEHDYAALRARYDALHARVDSLREEKLALAKQVDELRGRLQSVSERQDQSGSCEVNDAADDGKRNLNSTTTTCLVLVQEDDGATPPAAVDASGSEDSAATEYGYGYDYDHVVAYGEGLHDPLCATPDLWDTWPLLEWNAVA

SEQ ID NO: 42529 - protein, 161 aa, Sorghum bicolor
  Clone ID: SORBI-28MAY03-C10727_1.pep
MELLFFPSSRLLPCPPFYPAAPTRLHESRRLPTPAAPGLRRALRRQRASTRRRAAMATFELYRRSTIGMCLTETLDEMVSSGTLSPELAIQVLVQFDKSMTDALENQVKSKVNIKGHLHTYRFCDNVWTFILTDASFKNEETTEQVGKVKIVACDSKLLGQ

SEQ ID NO: 42530 - protein, 49 aa, Sorghum bicolor
  Clone ID: LIB3478-017-P1-K1-H10.pep
MATFELYRRSTIGMCLTETLDEMVSSGTLSPELAIQVLVQFDKVEMLLV

SEQ ID NO: 42531 - protein, 263 aa, Sorghum bicolor
  Clone ID: SORBI-28MAY03-C10751_1.pep
MDAGGEKFSDAAAAEGGEGGGDLYAVLGLKKECSDADLKVAYRKLAKKWHPERCSSSSSVKHMEEAKEKFQEIQGAYSVLSDANKRLLYDVGVYDDEDDEDSMQGMGDFIGEMAQMMSQVRPTRQESFEELQQLFVDMFQSDIDSGFCNGSAKDQVQGQAKSRTCSTSPSSSPSPPPPPTIVKEAEVSSCNGFNKRGSSAMDSGKPPRPVEGGAGQAGFCFGVSDTKQTPKPRGPNTSRRRNGRKQKLSSKHDVSSEDETAGS

SEQ ID NO: 42532 - protein, 115 aa, Sorghum bicolor
  unsure (1)..(115): unsure at all Xaa locations
  Clone ID: LIB3478-018-P1-K1-B4.pep
KKWHPDKCSSSSSXETMEEAKEKFQEIQGAYSVLSDANKRLLYDVGVYDDEDDEDSMQGMGDFIGEMAQMMSQVRPTVRADGTTGPSYRCFFVVSSRPRLAGADIFRFVVTLTLL

SEQ ID NO: 42533 - protein, 124 aa, Sorghum bicolor
  unsure (1)..(124): unsure at all Xaa locations
  Clone ID: SORBI-28MAY03-C10842_1.pep
DVAHPDELDEEFDTFPTSRSPDLIRMRYDRLRHVAGRIQTVVGDIATQGERLQSLLSXWRDPRATAMFLIFCLITAIILYVTPFQVIALCLGFFWMRHPRFRHKVPSAPANFFRRLPAKTDSLL

SEQ ID NO: 42534 - protein, 231 aa, Sorghum bicolor
  Clone ID: SORBI-28MAY03-C10973_1.pep
MGDGAAAAVPSRFRTICVFCGSNAGRRKVYADAALELGHELVRRGISLVYGGGSIGLMGVIARTVGDGGCHVLGVIPKALMPIEISGGSVGEVKVVDDMHQRKAEMARQSEAFIALPGGYGTMEELLEMITWCQLGIHDKPVGLLNVDGYYDPLLALFEKGATEGFINPDCSQIFVSAPTASELLTKMEQYTRLHQEVAPATSWEISELGYGRAAADGGGGGAPSSEEEGL

SEQ ID NO: 42535 - protein, 259 aa, Sorghum bicolor
  Clone ID: SORBI-28MAY03-C6523_1.pep
WSLNRYCLHATACPHPTWGQQGQPPKQHRALTRPIAMARRLLLLLLAFLFSTAALCSPDASAAEDPLIEQVVGDGADDELELNAEAHFASFVRRFGKTYRDDEERAHRMSVFKANLLRSRRHQRLDPTAVHGVTKFSDLTPAEFRRQFLGLRRSRSSGQDLLKGSGSAHEAPILPTDGLPTDFDWREHGAVGPVKDQGSCGSCWSFSTSGALEGAHYLATGKLEVLSEQQMVDCDHECDPSEPRSCDSGCNGGLMTTAF

SEQ ID NO: 42536 - protein, 136 aa, Sorghum bicolor
  Clone ID: SORBI-28MAY03-C6528_1.pep
LERKVEDAKCRERRSNQRLLIDSVNAALLDIGQSKLWGAYPCTARHSNAPGVATCDVLVTDEAWRLVKSWLFDDENDIAGLGDYPGLAADWVVGKEINGKGWPEMLRLEVDEISKEICEEVLGELVGEAFSQLADH

SEQ ID NO: 42537 - protein, 280 aa, Sorghum bicolor
  Clone ID: SORBI-28MAY03-C65600_1.pep
LYRFLEHDPAVPKYYNFRGSTNDGEPKPAAAVGQRMTRIMLAILEAYASDDRRHLDYSRIAASGTRRRYANLVQELQRADMTQLPAEERLPFFLNLHNAMAIHAVIRVGQPGAVDRRPFFSDFQYVVGGHPYSLAAIRNGILRANRRQPYTLAKPFGSNDRRLELAQRRANPLVHFALCDATRSSPIVRFYTTQGVEPELRHAAREFFLRGGVEIDLESRTVHLTRIIKWYSADFGQDRDILRWLLNYLDPTKAGLLTHLLNDGGPINISYMNYDWSLNV

SEQ ID NO: 42538 - protein, 236 aa, Sorghum bicolor
  Clone ID: SORBI-28MAY03-C6565_1.pep
MQSLVRNVCRAGSRGAAARLLELAAAPVAAAHPGAAQPSSAVKHLWQPYGLARPIGVDQSVRVQSRVIPAAASGFGHCAKVLVATRGLSTVGNAAEVASDSDDSTSLAVEHPPRIKFKRPDKTARHIMNILNKEAVDKVRSEREIPDVQPGCMIQMRLQVPENKRRELTLKGIVLGRRNAGINTTFRLRRLVSGIGVESVFPLYSPNIKEIKILDRKKVRRAKLYYLRDRVNALKK

SEQ ID NO: 42539 - protein, 97 aa, Sorghum bicolor
  Clone ID: SORBI-28MAY03-C6555_1.pep
RLRLRLRLRLRLRLRLRLRALAPNSTLSLGWCSWSPPLLFHPPVIRTSSSLLAAAGSLIPRLLFQPPVKMNEVPKRGPHSISGARCGNLKTNVLYFH

SEQ ID NO: 42540 - protein, 71 aa, Sorghum bicolor
  Clone ID: LIB3476-021-P1-K1-F8.pep
SRTKTFVRAWVPKDLRINSLIPVTCFTFVVSAEWYASYFGHLALDPWVIGVMAVNSCFTFVVSALVNAGAM

SEQ ID NO: 42541 - protein, 116 aa, Sorghum bicolor
  Clone ID: SORBI-28MAY03-C65656_1.pep
MAAETVVLKVAMSCEGCAGAVRRVLSKMEGIETFDIDLKEQKVTVKGNVKPEDVFQTVSKSGKKTSYWEGEAVAPDASAPAAAEAAPTTAAEAPADAAAAAAAAAVPEITPAKADA

SEQ ID NO: 42542 - protein, 130 aa, Sorghum bicolor
  Clone ID: SORBI-28MAY03-C62420_1.pep
GYNSLKDYFPAMEMRPNPQCSNPACVTRQKEYMESKPARDAAAKAKMEAEASAANECPVHVDNEWNISVVDDEETGTSNIRNTPDILPEGLVRELPDADSYAEPAAAGSSSAIDDDLEELQRQLDALNAS

SEQ ID NO: 42543 - protein, 280 aa, Sorghum bicolor
  unsure (1)..(280): unsure at all Xaa locations
  Clone ID: SORBI-28MAY03-C6251_1.pep
MASHIILPPDDADENHNHQAEEEEREELGRDEDADDEEHGHGHPPALPPKAALPFSATCVRISRDSYPNLRALRNASSVSLADAAYVKISEGDYGYVLDDVPHFTDYLPDIPTYPNPLQDHPAYSTVKQYFVNEDDTVPQKVVVRKNSRRGVHFRRAGPRQRIYFGTDEVKACIVTCGGLCPGLNTVIRELVCGLSHMYNVSSIFGIQNGYKGFYSSNYLPLTPKSVNDIHKRGGTVLGTSRGGHDTKKIXDNIQDRGINQVYIIXGDGTQKGAYEIFKE

SEQ ID NO: 42544 - protein, 271 aa, Sorghum bicolor
  unsure (1)..(271): unsure at all Xaa locations
  Clone ID: SORBI-28MAY03-C6266_1.pep
MPLGQRPGDKSDSRYCGVEVLDFPAGEGLPAVLSHSISSGFDFILAPLVDPNYRPAPGAVLPVSASDLVLGPAQWSNHVVGKISEWIDLDAEDERLRLDSELTLKQEIAWASHVSLQACVLPAPRTSFCGNYARVVNQILQGLTNMHLWLPRVREKSEPMDDDLDKIKNNNHMSEIVDSWELWNSFRLLCDHSSQLCVALDISSTLPSINSLGRWFGEPVKAAILQTNAYLTNSKGYPCLSKRHQXLLTGFFNHSVQVIIPGRSNLNVFPA

SEQ ID NO: 42545 - protein, 140 aa, Sorghum bicolor
  Clone ID: SORBI-28MAY03-C62542_1.pep
GLTTEEDYPYTGTTDACDRAKLAHNAASIAGLRRVATRSEASLANAVAGQPVAVSIEAGGDNFQHYKRGVYNGPCGTSLNHGVTVVGYGQEEEDGDKYWIIKNSWGASWGDGGYIKMRKDVAGKPEGLCGIAIRPSFPLM

SEQ ID NO: 42546 - protein, 102 aa, Sorghum bicolor
  Clone ID: SORBI-28MAY03-C62678_1.pep
NEHKRMIGQGRHGTKQTEQVENTTDVQAPLIRPTPKATPGAPRRLPATTRGHPSLAELHYKNLVLALGVLLIRARLREPSLCRNARPVIIQTVIINQWLCQH

SEQ ID NO: 42547 - protein, 203 aa, Sorghum bicolor
  Clone ID: SORBI-28MAY03-C66386_1.pep
CQSTPTHGRLVSRSGPPQGQVVDDVDARHEHHGGDAEVHPAAEDRYQEADLLCVCREGDDLDDTGQGVEPDDSHAAGAAHAAEHAVHGVRKKQLHLHRRRGTLLIRRRRRRRRCRGWGRRRQAQHRNGIRRGDESRLERSGDRARREDGEHLRPWGNRSWQPPAAEPRSRWARAEMRWEMEIRKRDSKTLGIDCSGKRGRRRR

SEQ ID NO: 42548 - protein, 193 aa, Sorghum bicolor
  Clone ID: SORBI-28MAY03-C66414_1.pep
MARTTAPAAGYGADGVYRSPRPAVRIESDPGLSLNDLLFRRADACPSALALVDSATGQSLSFAAFRSAVLTTAVALSSRAGVRRGDVVLFFAPNCFLYPVCFFAVTALGAVATTANPLYTPREVAKQATDSRAKLAITVSELLPKIVDLRLPTILLDVDGGAASVTASKPQGASVTLYSDLISGVRETEYRRP

SEQ ID NO: 42549 - protein, 182 aa, Sorghum bicolor
  Clone ID: SORBI-28MAY03-C6656_1.pep
MEAGGEEFAIGVVISAKTTLGEEFEGQIVAFDRPSNLLVIQEVVGRAERGERRNVRVLKANYIREFSVVSKGDDPLDPAGCMLDLNAIYAREDAALRQAEIEAERIGVGVTPEAQSIFDALSKTLPVQWDKTDIVVMKEVRVCSPYLPENVSGGTAAANERVKKVIDFERKRLHSRVPGQFS

SEQ ID NO: 42550 - protein, 375 aa, Sorghum bicolor
  Clone ID: SORBI-28MAY03-C6647_1.pep
TRRLFLDMPEHLELSSLPSSNGVLKYLAGKTLPSHAAILCGLVKNQVYSDLEVAFAISEDAAVYKALSQTIELLEGHTSLISQHYYGCLFHELLAFQIADRHPQQERQPAEVIPQQMIGFSDPAMSTLKAAEFFVPDSAESSIIHMDLDRSFLPVPSAVSASVFESCVRQNITDSETDVHSSIQQLVKDSYGLSADGCSEIIYGNTSLALFNKLVLCCMQEQGTLLFPLGTNGHYVSAAKFVNASTLTIPTNFGTGFRIEPKVLADTLKNVSQPWVYISGPTINPTGFLYSDNDIQELLSVCAEYGARVVIDTSFSGLEYQTDGWSQWNLEGCLSSLKRSKPSFSVVLLGELSFELTAAGHDFGFVILSDSSLAE

SEQ ID NO: 42551 - protein, 170 aa, Sorghum bicolor
  Clone ID: SORBI-28MAY03-C66796_1.pep
KGQEMVEQDNLASMPYLRAVVKETLRLHPPAPLLLPHLSMVDCDVDGYRIPSGTRVIINDWAISRDPESWERAEEFMPERFMDAASAAAIDMRGNDFQFVPFGAGRRICPGLNFGLATVEIMLANLVYCFDWGLPIGMKEEDIDMTEVFGLSVRRKEKLILLSEPHACTC

SEQ ID NO: 42552 - protein, 158 aa, Sorghum bicolor
  Clone ID: SORBI-28MAY03-C66840_1.pep
LDVVTINPGLVFGPLLQPTVNASIQFLIYFLKGGPDLVRNKLWHVVDVRDLADALLLLYEVPEAAGRHICAPHVISARDLLDLLKSMYPDNPFIAKESICDRDHPAPMTSDKLKKLGWSCRPLEETILDTVECCQRAGFLDGAAGETPCRFPPIFNKI

SEQ ID NO: 42553 - protein, 271 aa, Sorghum bicolor
  Clone ID: SORBI-28MAY03-C6420_1.pep
TRDPAPPKRGTPEVLKFSVFQGNLESGGKGEKNPKNSTTIALQSPFPEYNGRFEIGLGQSMMVPSNYSCADQCYGMLTTYGMKSMSGGRMLLPLNAPADAPIYVNPKQYEGILRRRRARAKAESENRLAKGLQPYLHESRHLHAMRRVRGSGGRFLNTKKEGGHGTDVDANGGSKMAAAAPSRLTMPPSSEPPRPPGLSNISNPHFHSQSSVSSLSGSDVSNIYGGLEQPPRAPPFFTVLPPIMDGDHGGVTHISSFKWAASDSCCELLKA

SEQ ID NO: 42554 - protein, 166 aa, Sorghum bicolor
  Clone ID: SORBI-28MAY03-C64316_1.pep
VLQPPTIASLLAIIIGMVPVLKDFVFGADAPLSFFTDSLEILAAAVVPSVMLILGGMLAEGPKDNALGMRTIIGIIVARLLVLPCIGIGVVTLADKLHLLVEQNHMYRFVLSLQYSTPSAILLGAIASLRGYGVKEASALLFWQHICAVFSLSLYLIVYFKLFSFI

SEQ ID NO: 42555 - protein, 301 aa, Sorghum bicolor
  Clone ID: SORBI-28MAY03-C6439_1.pep
LVSPDPGFLICSSGVGAMATAALAMAEQVVADLRAKCEAPPPMLREVAAEMAREMGAGLEKEGGSRVKMLLSYVDKLPTGGEEGLFYGLDLGGTNFRVLKVELGGNEKHVVDRDSREVIIPPHLMSGSSSELFGFIASELAKFVVDDEKFINVLNGKKRELGFTFSFPVKQRSVASGTLVKWTKAFSINDAVGEDVVAKLQTAMEKQGLDMHVAALINDAVGTLAGARYYDKDVVAGVIFGTGTNAAYVEKANAIPKWEGELPNSGDMVINMEWGNFCSAYLPITEYDQELDKESLNPGEQ

SEQ ID NO: 42556 - protein, 98 aa, Sorghum bicolor
  Clone ID: SORBI-28MAY03-C64644_1.pep
VKNGKAPDFLMCVGNDRSDEDMFECINGMTSNDAISPTAPEVFACSVGQKPSKAKYYVDDPSEVIRLLKNVTRVSSQREDVNASHGRVTFRDVLDYVD

SEQ ID NO: 42557 - protein, 140 aa, Sorghum bicolor
  Clone ID: SORBI-28MAY03-C64747_1.pep
MVSFEMNDLKKIGLGLTGFGIFFSFLGIVFFFDKGLIAMGNILFLSGLGLTIGLKSTMQFFTKPKNYKGTISFGAGFFLVLIGWPFFGMLLEAYGFIVLFSGFWPTLAVFLQRIPIIGWIFQQPFVTSFLDRYRGKRVPV

SEQ ID NO: 42558 - protein, 165 aa, Sorghum bicolor
  Clone ID: SORBI-28MAY03-C67723_1.pep
ILAGAGPQRSRVLATLYKDERCSKLKIYPILQKVYLERILRKPEIDAFAEELRPHQKALLPDRSTVLDRAMIEHNLLSASKLYTNISFDELGTLLGIDPRKAEKIASRMIYEDRMRGSIDQVEAVIHFDDDTEELQQWDQQIAGLCQALNDILDSMSSKGIAIPV

SEQ ID NO: 42559 - protein, 159 aa, Sorghum bicolor
  Clone ID: SORBI-28MAY03-C6774_1.pep
GSNCQISFVPKPQFPIPRSLSPATRLSAALEMDRDTPVPRRRRTESRHAGEPSSAVAVETTNGKSKTTWLWEAGGRLVETQSVTAEQTSATITEEAEDEEWTDDALPLIASSRPLPHRCPSFPKGRSRQDIAEWHEATRVAYEKAANDPVSNPPILRET

SEQ ID NO: 42560 - protein, 172 aa, Sorghum bicolor
  Clone ID: SORBI-28MAY03-C68064_1.pep
HVPDQQPQGSPYRMPSQMTAPQAATVFYNPHQYGYWYPPDYPYQQALYNSQVLQHYYPQMYGPASPSGPPYQYMGYMPGGPSPRTGFSPMQQPMRPPFFQQPPAQMDGSFPPGPSLPPNFRLQLPPHAVSRESDDVSGSQSAQPTSSTPATITNNQEDSRPVVSDSDPNTPN

SEQ ID NO: 42561 - protein, 202 aa, Sorghum bicolor
  Clone ID: SORBI-28MAY03-C6780_1.pep
PTPPIPIAAARPRHRAGRAWSAARVLPGPPCPPEALRPPVRREEPRPPVCREETQLPGPPEASRRRPAGPPEAPRRPPAGPPGGTAPFSVARFSVASRATWDDLRNKLGVLVGPISSFADLAASRLAVTSSMAPPTVATASPAPIPPQDVPSKVLVAASSKPVTISIHAQMVFAEMPADRGAVLFARVVATMAHTSMSSSVS

SEQ ID NO: 42562 - protein, 139 aa, Sorghum bicolor
  Clone ID: LIB3476-024-P1-K1-D7.pep
PLRPTPPIPITATRPRHRAGRAWSAARVLPGPPCPPEALRPPVRREEPHPPVCLEETRLPGPPEASRRRPAGPPEAPRRPPVGPPGGTAPPLPEMNTRLKAFVFAAAAHWLLCVMAIVARPRKRKRVARKGGDYLCTNI

SEQ ID NO: 42563 - protein, 147 aa, Sorghum bicolor
  Clone ID: SORBI-28MAY03-C68137_1.pep
ETQGEGGATARRAGLSTTQDAARPKPLGKSPGLVCCSSRPQASIARNQQPKPRALRAPPHRTKVEGGDEAQTANTCGAPMAASSSSSGPGGSPAHAPPGGGGGSGGPHNHRSRLRHPSLAYGVVGGLAWETPSEGLRQHFEVYGEIL

SEQ ID NO: 42564 - protein, 163 aa, Sorghum bicolor
  Clone ID: SORBI-28MAY03-C679_1.pep
MAMRALPLTPSKTSSFGAHQIRPSSGNLRSVRAYAKGNEEEGNKQSLFGSITEALDFSQVRSEKDAELLYEARESTKGGGRMTREQYGALRRKIGGTYQDFFKSYVDVDGQYVEEGWVDKTCKICKKDTRGEPRQVDKLGRYAHVACLENPKPMNFFAKIFAR

SEQ ID NO: 42565 - protein, 92 aa, Sorghum bicolor
  Clone ID: LIB3478-042-P1-K1-B9.pep
MAMRALPLTPSKTSSFGAHQIRPSSGNGRSVRAYAKGNEEDGNKQSLFGSITEALDFSQVRSEKDAELLYEARESTKGGGRMTREQVWNWNH

SEQ ID NO: 42566 - protein, 63 aa, Sorghum bicolor
  Clone ID: SORBI-28MAY03-C65717_1.pep
RGGGGCSYAGTYSETKCQTGCGDVSQRYYHVPRSWLNPSGNLLVVLEEFGGDLSGVKLVTRTT

SEQ ID NO: 42567 - protein, 146 aa, Sorghum bicolor
  Clone ID: SORBI-28MAY03-C66216_1.pep
GLNGAEIVFNPSATVGELSEPMWPIEARNAAIANSYFVGSINRVGTEVFPNPFTSGDGKPQHADFGHFYGSSHFSAPDASCTPSLSRYRDGLIISDMDLNLCRQIKDKWAFRMTARYEMYASLLSEYLKPDFKPQVIVDPLINKKA

SEQ ID NO: 42568 - protein, 111 aa, Sorghum bicolor
  Clone ID: SORBI-28MAY03-C66338_1.pep
TGFVRKGSIRRTSRAEKICFVLPTCRSKDRGQMVANISKSTSLDGAEPDHHRKSGVKEQPVECQNEIALNQDRTCRARKYCKPSGRRPKFEVLTAIAIFHSLFSIFRKDFE

SEQ ID NO: 42569 - protein, 323 aa, Sorghum bicolor
  unsure (1)..(323): unsure at all Xaa locations
  Clone ID: SORBI-28MAY03-C6604_1.pep
PATSSPSRTQQQGGGCSSPPPPPPLPPPWPLLLPPARSSIPTSTSGPRHSRPRRSTPTSQARNPRSVATTNSCSXCMSEAGVDGALIVQPINHMFDHSLVTSTLKKYPSKFIACCLANPADDGSGIKQLEHLIVQEIYXALTLSTNLSPAGQKMKNDVGRALFSKAGELGAPVAILTMKGIGPYIQEIEELCRDYPATTVILDHMSFCKPPTNDEEEKALSSFLNLSRFPQVYVKYSALFRITREAYPYEDTAQLLSRAISHYGANRIMWGSDFPYVVPECGYKGAREAISLVAGKIPVSLSDLDWILGKTVSQLFQGAWVTP

SEQ ID NO: 42570 - protein, 128 aa, Sorghum bicolor
  Clone ID: SORBI-28MAY03-C68572_1.pep
AVLKKRWFLTEKRRTEDWEARERFSSTELAEKSGSIDEVAVQLTPEELDMYIDLHPFTNTTPYTVVETMSVAKAVVLFRTCALRHMLIIPKFQGPEIAPIVGILTRQDLRAHNILGAFPHLANKRKVH

SEQ ID NO: 42571 - protein, 172 aa, Sorghum bicolor
  Clone ID: SORBI-28MAY03-C69281_1.pep
SHQVRCPRLALSERTERACPSPIPPIGHTRALCQCRRTSSATAAAASWWALGGGPLGGTGGVAVWAWRGAWPGPRGGVHGFCLPEWRVVAYVCVCRGAWWPGSAGMESFAGGPAGRVGRLPGDTASGGAPVTPLPLALLTCGCLLRLVIVSARFLPLALPPAPAANGLPSKP

SEQ ID NO: 42572 - protein, 168 aa, Sorghum bicolor
  Clone ID: SORBI-28MAY03-C69344_1.pep
MARLLLLLGAAMVLLASAATAQDCLSATFSGGRTFGKCNSMPTLSASLHWTYHPENGTADVAFRAPSDTSGWVGWGINPTSGNSMVGSSVFIASQDSSGVVSVLMTYLETTSQPALTNNTFKFNVPVGPAAEYSDGAYTIYATVELPGNSTQQYTVWQAGPTSNGAIA

SEQ ID NO: 42573 - protein, 124 aa, Sorghum bicolor
  Clone ID: SORBI-28MAY03-C6889_1.pep
HFLVQLCRTTGKLLKGGEPDLTAAPVGVPHDGRGGSVPSAAPPPPLAGVGASQRAVPVPCPEEHGAGSDRTAAAMKAIAGIISSQQNMNVPCHKEHNADNEDTASEDNEDIESADNDEHAEQSE

SEQ ID NO: 42574 - protein, 63 aa, Sorghum bicolor
  Clone ID: LIB3476-025-P1-K1-G11.pep
VIFMSMQSNLSNLWVQMWIRANMSMIMSLSAQVLCTYFYRCARKRKFHVDLRSNWVLFCNCRT

SEQ ID NO: 42575 - protein, 250 aa, Sorghum bicolor
  Clone ID: SORBI-28MAY03-C6968_1.pep
MPLAEPPQWRRKATDFFSTSSVKLKQAGQSAGDNIADVAGKVGSVVKSRWAVFQEARQQQQHPPHETVQVRIITAAASTGLLFRKGISETKEKVAVGKVKVEEAAKKAADKSKSILNNIERWQKGVASTDVFGVPIEATVQREQSGKAVPLVLVRCADYLVISGLNNEYLFKSEGDKKVLQQLVSLYNEDSGASLPEGVNPIDVGALVKCYLASIPEPLTTFSLYDELRAARVSIPDLRNILKKLSNVNY

SEQ ID NO: 42576 - protein, 437 aa, Sorghum bicolor
  unsure (1)..(437): unsure at all Xaa locations
  Clone ID: SORBI-28MAY03-C6979_1.pep
MEVAGAQARAVPLLLRHPASLRSSVSVSCTGSRRSWAAAATAEGDETRGFDKVPMDTPGAYRLXDRATGRSVIVWGGTDDGDEAAIPSPAVLSRTRTTDRARGTGVGGGTGIGNFGRLKAQKIKSLVTRSAHRKRESSSRSSTNRSGESSFDGSGDEEESYFERRKPVSDSEHRAKLSSDYRNGRTRGAHSLTSVLGQYRGADDTGFPASEATSGSKGWGNVADVTYGRQNQKQREPLNFPQRKGPLDSGFFSRRARGEIGCSDEILVVLRNFDFPRPSHIQAMAYGPILEGRSCGIADQSGSGKTLAYLCPMIQNLRSEEVQGLHKSSPRNPRVIVLTPTAELASQVLNNCRLISKSGVPFRSMVATGGFRQKTQLESLNQELDVIIATPGRFLYLLQEGFVQLANLRCVVLDEVDILFGEEGFEQVLHQLITVAP

SEQ ID NO: 42577 - protein, 224 aa, Sorghum bicolor
  Clone ID: SORBI-28MAY03-C6689_1.pep
MAAPVTVYGPVISPAVARVAACLLEKDVPFQIEPVDMSKGEHKSPSFLKLQPFGQVPAFKDHLTTVFESRAICRYICDQYADRGNQALFGKKEDGAVGRAAIEQWIESEGQSFNPPSLAIIFQLAFAPMMGRATDLAVVEQNEAKLAKVLDVYDQRLGESQYFAGDDFSLADLVHLPNADFLVNRTNKAGLITERKNLARWWDDVSARPAWKKVTEMQSTPRSS

SEQ ID NO: 42578 - protein, 374 aa, Sorghum bicolor
  Clone ID: SORBI-28MAY03-C67155_1.pep
TALSPASISAEFPQSSKSAMAAAADPAACVLLPPRRRTMKLGSQGLEVSAQGLGCMGMSAAYGERKPDAEMVALLRHAIAAGVTFLDTSDVYGPHTNEVLIGEALRHGAREKVQLATKFGITPELRTVRGDPAYVRAACEASLRRLGVDCIDLYYQHRIDTTVPVEVTIGELKKLVEEGKIKYIGLSEASASTIRRAHAVHPITAVQLEWSLWTRDAEQDIVPTCRELGIGIVAYSPLGRGFFSSGAKLISDLPDDDFRKNLPRFQPENMEKNALIFERVSQMAARKGCTSSQLALAWVHHQGSDVCPIPGTTKIANFNQNLGALSVKLTPEEMAELESYAAMDDGVQGDRYHSTFLNTWRDSETPPLSSWKGN

SEQ ID NO: 42579 - protein, 216 aa, Sorghum bicolor
  Clone ID: SORBI-28MAY03-C67201_1.pep
MGRSSRCSCSRSVAAVQLLVAISAVCGAALSSATVTVNEPDIANGLSWRFYDASCPYVEDIVSWHVTEALRRDIGIAAGLIRIFFHDCFPQGCDASVLLSGPKSEQIEIPNQTLRPAALKLIDDIRADVHATCGPTVSCADITTLATRDAVVASGGPFFDVPLGRRDGLAPASSDLVGTLPAPFFDVPTLISAFENRGLNKADLVALSGAHTVGRG

SEQ ID NO: 42580 - protein, 299 aa, Sorghum bicolor
  Clone ID: SORBI-28MAY03-C67231_1.pep
MGSLRAPPPPAQLVGSTRVAFRSGIRFSSDTVLKYRGLTTSGAMKSYRLSELSDTEVSGLKARPRIDFSSIFGTVNPIVEDVRVRGDAAGRHYTEKFDKVTLDDVVVRVSDLPDAELDPAVKEAFDVAYDNIYAFHVSQKLPEKTVENMKGVRCKRITRCIGSVGLYVPGGTAVLPSTALMLAVPAQIAGCKTIVLATPPSRDGSICKEVLYCAKKAGVTHILKAGGAQAISAMAWGTASCPKVEKIFGPGNQYVTAAKMILQNSEAMVSIDMPAGPSEVLVIADKYANPVHVAADLLS

SEQ ID NO: 42581 - protein, 342 aa, Sorghum bicolor
  unsure (1)..(342): unsure at all Xaa locations
  Clone ID: SORBI-28MAY03-C677_1.pep
PPAAAAAGAPASAARAPAPPGGAPGRAPGGRRQEVTGFFGTQTGTAEGFAKALAEEAKARYDKAIFKVVDLDDYAAEDEEYEEKLKKEKLALFFVATXRHLFAVAPCILLNSAIKFGAVAKVVYEILTEQGGKRLVPVGLGDDDQCIEDDFNAWKEALWPELDRLLRDENDASTGTTYTAAIPEYRVEFIKPEEAAHLERNFSLANGHAVHDAQHPCQANVAVRRELHTPASDRSCTHLEFDIAGTGLTYETGDHVGVYTENCPEVVEEAERLLGYSPDTFFTIHADKEDGTPLSGSSLAPPFPSPITVRNALARYADLLNSPKKTSLVALATYASDPAEAD

SEQ ID NO: 42582 - protein, 375 aa, Sorghum bicolor
  Clone ID: SORBI-28MAY03-C72092_1.pep
MLGAARRQLGSGPMLGQVLRRLRPAAAAAEVARGYSAAAKEMNVRDALNSALDEEMSADPSVFLMGEEVGEYQGAYKISKGLLDKYGPDRVLDTPITEAGFTGIGVGAAYHGLRPIIEFMTFNFSMQAIDHIINSAAKSNYMSAGQISVPIVFRGPNGAAAGVGAQHSQCYAAWYAHVPGLKVLTPYSSEDARGLLKAAIRDPDPVIFLENELLYGESFPVSAEVLDSSFCLPIGKAKIEREGKDVTITTYSKMVGYALQAAEILSKEGISAEVINLRSIRPLDRAAINASVRKTNRLVTVEEGFPQHGIGAEICMSVVEESFEYLDAPVERIAGADVPMPYAANLERMAVPQVDDIVRAAKRACYRAVPMAAAA

SEQ ID NO: 42583 - protein, 210 aa, Sorghum bicolor
  Clone ID: SORBI-28MAY03-C722_1.pep
RLTARSSWAHSPIKLYCPGGIRYEANTYYMSPSLRIEDSYDMPTDVPPAEDEPHYENCLSIGLPMQPSSVVLLLGNRTKQHGGSHVTHSMQVPLSYADAVIGSAGASISYIRRHSGATISIQEGAPGEMTVEITGSASQVQTAQQLIKNFMAEASPQGPPAPAPPAQPVDTGYSSYPPYGGASYGSPPGAPAPAPHNGGSYGAYPPSYGY

SEQ ID NO: 42584 - protein, 202 aa, Sorghum bicolor
  unsure (1)..(202): unsure at all Xaa locations
  Clone ID: SORBI-28MAY03-C7179_1.pep
RRSSRPVRXXXKXXXIPIHIYRTTERAKREGARDMADLVRGIELPQEEQQRREMRVREAGPFLQLMNLPLSGDDDDDNNNNIEIRRVLPNREVLKKIADACDLVLLLQDPLLPSVRRLPTDATHLLMMDACANKLEEYARAVGGSFNVSCTEFAQRINSYTADARGHPGYSTDDSLRNSIDDLLCQASRFLDMTYTPDEAEA

SEQ ID NO: 42585 - protein, 65 aa, Sorghum bicolor
  Clone ID: LIB3476-030-P1-K1-D9.pep
NLQIYARLVVPNLHQNVWLVWLSIFSSSSSRDARVVWSNWLARSYWSMEMETKLVMVHFDLFLNM

SEQ ID NO: 42586 - protein, 186 aa, Sorghum bicolor
  Clone ID: SORBI-28MAY03-C72206_1.pep
MSGGGGSPNNTEWRFNQTLRNVQGMLKGRSFPGKVLLTRRSEPLSPPDYSPRFESEHDEDERKEGSQEGEGQASGNSFDSTSSKKSNLLSTGSSNSLPDAQGLVSGARATDSARIAKFTTELSRPAVILDKLRELSWSGVPPYMRPNVWRLLLGYAPPNKDRREGVLTRKRLEYVECVSQYYDIPD

SEQ ID NO: 42587 - protein, 140 aa, Sorghum bicolor
  Clone ID: SORBI-28MAY03-C7271_1.pep
RHKATVAEFLSNNYDWFFEEFNSRLLSSTNYITKRQAIKLLGDMLLDRSNAAVMMRYVSSKDNLMILMNLLRDSSKNIQIEAFHVFKLFAANKNKPPEVVNILVTNRSKLLRFFAGFKIDKEDEQFEADKEQVIKEISAL

SEQ ID NO: 42588 - protein, 117 aa, Sorghum bicolor
  Clone ID: SORBI-28MAY03-C72903_1.pep
MGKLREKHVDVREIRCDDFAVSAELLAGRVPGLTRAFADALVDVLRRKGFVDEKGFLKKDGRKTLWKEAAKEAKVLPEGFGLERHVTEEFNVAYAYHEFTSLKNTEIFEWFESHMNH

SEQ ID NO: 42589 - protein, 370 aa, Sorghum bicolor
  unsure (1)..(370): unsure at all Xaa locations
  Clone ID: SORBI-28MAY03-C6835_1.pep
DFRLKVIGGEISSVPGISDALEDTIKNAIEDSITWPVRKVIPIIPGDYSDLELKPVGTLEVKLVQARDLTNKDLIGKSDPFAIVYVRPLPDKMKRSKTINNDLNPIWNEHFEFTIEDADTQNVTVKIYDDDGIQESELIGCAQVRLKDLQPGKVKDVWLKLVKDLEIQRDRKDRGQVHLELLYCPFDMKEEAPNPFXQQFSMTSLERTMTSMENGSGGSSFARLSSRKKREIIIRGVLSVTVISGEDLPAMDMNGKSDPYVVLSLKKTKTKYKTRVVNESLNPVWNQTFDFVVEDGLHDMLMLEVYDHDTFRRDYMGRCILTLTKVLLEEEYKESFNLEGAKSGKLNLHLKWSPQPIMRDSREVDSLRFR

SEQ ID NO: 42590 - protein, 209 aa, Sorghum bicolor
  unsure (1)..(209): unsure at all Xaa locations
  Clone ID: SORBI-28MAY03-C6837_1.pep
MSSAAQNTAGTPMPGTQGGQAVAFRISGDKAFFFGCGFYGAQDTLCDDAGRHYFRDCYIQGSHRLRRSGNRPSTLYHRLARLHIDGCRGFGSVAAQXRYDPRERTGCLSVXCNSNCSGRLYVGRAMGQYSRIVYAYTYFDSVIAPGGWDDWDHTSNKSMTAFFGMYRNWGPGVDAVHGVSWALELDYFADRPFLGMSFVNGYHWLTPDV

SEQ ID NO: 42591 - protein, 200 aa, Sorghum bicolor
  Clone ID: SORBI-28MAY03-C6839_1.pep
MLLRCRAVLLLPLPLPPPPRLLRRLPHPRALSSSSGSSPLPPPGMEASYKFGPYKIDAREVFHATPLSYAMVNLRPLLPGHVLVCPKREAKRFADLSSDEISDLWVTAKEVGARLEQYHKASSLTFAIQDGPQAGQTVAHVHIHLIPRKKGDFEKNDEIYDAIDVKEKELKEKLDLDIERKDRTMEEMAHEANEYRALFS

SEQ ID NO: 42592 - protein, 178 aa, Sorghum bicolor
  Clone ID: SORBI-28MAY03-C69211_1.pep
MKQHTMTSISKFLLLLLCSYLCLVAHAADHRTHKVLSVGSLKSAATCSEPKATPPSTSGGITVPLHHRHGPCSPVPSNKMPASLEERLQRDQLRAAYIKRKFSGAKGGDVEQSDAATVPTTLGTSLSTLEYVITVGIGSPAVTQTMSMDTGRDVSWVQCKPWPRRPAKVDSLFDPSAS

SEQ ID NO: 42593 - protein, 328 aa, Sorghum bicolor
  unsure (1)..(328): unsure at all Xaa locations
  Clone ID: SORBI-28MAY03-C73625_1.pep
MKSMGTRDKLAAASGHRRVLFVVFASCFAFATFLTFLYTTSXAPAAPGSASASTASSTTTTSSGSSGGGGQAGLPLPVFEALVHFASISNATHRMSDTDIRAISAVLRARAPCNLLVFGLGAESPLWLALNHGGRTVARGENEFYVKYLEPRHPGMEAYDVSYTTKVRDFRDLLAAARASRRKECRPIQNLLFSECRLAINDLPNDLYDVPWDMVLIDGPSGWNPNSPGRMPSIFTTAVLARSGATAAKGRPTDVLVHDFQFEVEQVLSREFLCDENRVAGSGTPSLGHFVIPGAGAGAGDAFCAGQEDGGSSEESGEKTRRRRRRRK

SEQ ID NO: 42594 - protein, 149 aa, Sorghum bicolor
  Clone ID: SORBI-28MAY03-C7422_1.pep
HEATLCSTTRAARCGCAPSIDRGGGGSSNPRSTRLRRSRCGSREGGIDLPSLPPAPQRSPLAPHHSLGPPNPRASTSCSTTRAARCGCAPSIDRGGGGSSNPRSTRLRRSRCGSGEGGIDLPSVPEGVLDPVREDAFRMRQLEWQRARA

SEQ ID NO: 42595 - protein, 173 aa, Sorghum bicolor
  Clone ID: SORBI-28MAY03-C74352_1.pep
MGMADTSIFSLSPPLLRLRLRMSHHPHTSSSSAIPPVPAAASSTSSSPRPRRLLIKQQRSIIGNNHSSPTRQRSLLLSSSRASASASSSSSSSSSSVATATATATAPAQNENEKDVVFVAGATGRVGSRAVRELIKLGFRVRAAVRNAQRATSLVQSVQQLKLEAQPELELVE

SEQ ID NO: 42596 - protein, 100 aa, Sorghum bicolor
  unsure (1)..(100): unsure at all Xaa locations
  Clone ID: SORBI-28MAY03-C74510_1.pep
GXGHEPPTQGRGYPPPYQGGHHGGGGYGGGAQMGLPVPAPPGGAYATYGAYHKHHGGYGDGGYGVYGGGGYGGGGGYGHGKYKHGHQGKFKQYSHHQGKY

SEQ ID NO: 42597 - protein, 249 aa, Sorghum bicolor
  Clone ID: SORBI-28MAY03-C75063_1.pep
HSHSLQAQARQSSERAELAITGRALAMDPCAFVRLTVDQLLLKLPAVPRPSSGAGVHPSNSPCFCTLTLQDHPSSSLSRTALLPLASASAASGPGAAAAYADPVVLSLDAEAVRRLSARPAELVVSVHAGPTGSSCGVSASRALGRVRVAIDVARAAAGETVVARDGWVDVGKPASSASSSAVSVRAQIHMVVRAEPDPRYVFQFGGEPECGPVVYQVPGGAAGGGQQRQPVFTCRFSAGRRAARSRLV

SEQ ID NO: 42598 - protein, 192 aa, Sorghum bicolor
  Clone ID: SORBI-28MAY03-C7049_1.pep
LPATVGSAPDSFIHGSVTDQGTVNDLMAGLNLNGTGQAQSAVKAEPSSNFSGSQFFDTNNETSHVASAAALNGILGQNSFYQQQQTPLQYNFPQHMMINQSFPGQQLNYGAMGILLAQQQQLLQNLGNFNAGLGNSSFNSMHSGNASVLPDIFNSSNQPQNHVAVMSSSKKDDTKAFDFVSDHLAAARGSRK

SEQ ID NO: 42599 - protein, 253 aa, Sorghum bicolor
  Clone ID: SORBI-28MAY03-C7126_1.pep
MAMATSTFSPRPATLNKPLRPGAKPASLLPFPCRRAGRLVCATAAGEAPPVEVEQRDEAEPAPAAASNGAAVKAEAPAPKAVQAEAPPAPAPVPAFRDARWVNGTWDLTQFDKGGVVDWDAVIDAEARRRKWLEDYPEATSTDEAVVFDTSIIPWWAWMKRFHLPEAEKLNGRAAMVGFFMAYFVDSLTGVGLVDQMGNFFCKTLLFVAVAGVLLIRKNEDIESLKKLIDETTFYDKQWQATWQDDSTGGPKN

SEQ ID NO: 42600 - protein, 257 aa, Sorghum bicolor
  Clone ID: SORBI-28MAY03-C7099_1.pep
CQYWQQRYSLKEGIPSFLTNVAAMILTTGKYLNVMRECGHNVQVSLSDNTKLMSFGSNHQYLECIKSAYDFASGELLTLMKDKYDLIGKLRSLKRYLLLDQGDFLVHFMDIAREELTKKPEEISAEKLQSLLDIALRSTAAASDPSHEELICCVERSSLLKKLGTLKDLDCAYPADKLAAADVDQSMQLSITGLETFCLSNKVQWPLSLVISRKALTKYQLIFRLLFHCKHVSRQLCAAWQIQQVFRSVKILGTPIL

SEQ ID NO: 42601 - protein, 78 aa, Sorghum bicolor
  Clone ID: LIB3476-050-P1-K1-D12.pep
MQLSITGLETFCLSNKVQWPLSLVISRKALTKYQLIFRLLFHCKHVSRQLCAAWQIQQVCRAVKILGTPILRSLILCC

SEQ ID NO: 42602 - protein, 197 aa, Sorghum bicolor
  Clone ID: SORBI-28MAY03-C71374_1.pep
MLPSFVSPTASASVTPPPRPIPGSHGPPVLGPLRDRLDYFWFQSQDEFFRKRAAAHRSTVFRTNIPPTFPFFVGIDPRVVAIVDAAAFTALFDPDLVDKRDILIGPYNPGTGFTGGTRVGVYLDTQEAEHTRIKTFAMDLLHRSARSWPAEFRAGVGAMLDAVDADFAANKASSASYLVPLQQCIFRCRRSSSGRAT

SEQ ID NO: 42603 - protein, 108 aa, Sorghum bicolor
  Clone ID: SORBI-28MAY03-C7135_1.pep
DAWVPRDLSPLPQIQSFESSLLPLLRRQAQAAELPDVPSHHSPAATCHHHRLSAISLRSYPPDPSSLLPARDPALAAPRPRPPKRSPQDPKRDVRILWIYHKILKFNS

SEQ ID NO: 42604 - protein, 248 aa, Sorghum bicolor
  Clone ID: SORBI-28MAY03-C7610_1.pep
ILDRAKQKMGIDAKVIQAGLFNTTSTAQDRRALLQEILRRGTSSLGTDIPSEREINRLAARTDEEFWLFEKMDEERRLRENYKSRLMDGNEVPDWVFANNDLPKRTVADEFQNIIVGAKRRRKEVVYSDSFGDQWMKSDEGFGDVPKATPRPKRTAYSSDLQVEFSERRKRPRSVENSADGASNPTWTPDKGRAGVSSYSKDETEDDGEDEVITSGLQKGNSFTWNTLGRRRSSHFSSTSDSKGRPSF

SEQ ID NO: 42605 - protein, 216 aa, Sorghum bicolor
  Clone ID: SORBI-28MAY03-C770_1.pep
MASTATFLSTLATRSAATVSPRSAAEPSGAKIVRFLPAQISRTGRAAAVLPTPRAAVSGTEKQAPSSKHERVVRVHSTQEFDDALKAAKNRLVVVEFAASDSESSSQIYPTMVQLSRTCGDVDFLLVLGDESEATKELFRREGITQVPHFNFYKGAEKVHEEEAMAIGPERLAGDVLYYGDSHSAVVQLHSREDVEALIDEHRGDKGKLVVLDVGL

SEQ ID NO: 42606 - protein, 102 aa, Sorghum bicolor
  Clone ID: SORBI-28MAY03-C7704_1.pep
DSQVAFNVILGQHLQVLSLNATNASLQAKLVCFYMNIKILVLPLDAMAQDKEAKKMEKKNAKKNTIEKNYKNVLNKKYKDKKTPTTDETFMKNIVYKEVLTP

SEQ ID NO: 42607 - protein, 262 aa, Sorghum bicolor
  Clone ID: SORBI-28MAY03-C7717_1.pep
YADSSLQAALSQDSLAVAGDAVKTYTFGCLQKATGTAAPPQGLLGLGRGPLSFLSQTRDMYQGTFSYCLPSFKSLNFSGTLRLGRNGQPPRIKTTPLLANPHRSSLYYVNMTGIRVGRKVVPIPPPALAFDPATGAGTVLDSGTMFTRLVAPAYVAVRDEVRRRVGAPVSSLGGFDTCFNTTAVAWPPVTLLFDGMQVTLPEENVVIHSTYGTISCLAMAAAPDGVNTVLNVIASMQQQNHRVLFDVPNGRVGFARERCTAV

SEQ ID NO: 42608 - protein, 91 aa, Sorghum bicolor
  Clone ID: SORBI-28MAY03-C7770_1.pep
MMSGRSGGRDAEGEWEVRPGGMLVQRRDGEAAGPVIRIRVSHGASFREVLVPAQATFGELKSILAQTTGLEPERQRLFFRGKEKSDREFLH

SEQ ID NO: 42609 - protein, 357 aa, Sorghum bicolor
  Clone ID: SORBI-28MAY03-C7743_1.pep
NLYTSAELPAGLFRVRVRSKTYIVSVDLKKQLPLSQLSELPVPREVLQGLDVVVREASRWRKIILGRGFYSPSSSVDIGQGAVAMKGTQQTLKYTQQGLILCVDYSVMPFYKAGPVMDIVQKLVPHLDYRTTLNRRQLENLIEELKGRRVTVVHRRTNQKYTVQGLTPLPAIQMTFVDAESGQTKARGDYYAQKHDKVIEYQMLPCLDLSKSKDKPNHVPIELCTLLEGQRFPKANLDKNSDRILKGKALIPPSHRRNEIQDLVNASDGPCRGEIAQQFGISLDLRMTEVTGRILPPPNLKLGASNGHMSKFSMDQNCQWNLVKKRLVEGRDLQCWGIVDFSAEPSHPRQEPLNGRM

SEQ ID NO: 42610 - protein, 154 aa, Sorghum bicolor
  Clone ID: SORBI-28MAY03-C73014_1.pep
FVQANSATFQSDNNLGLVKQVLSSMYKRNIQRLTQTYLTLSLEDIARSVQLETPRDAEMHVLRMIEDGEIHATINQKDGMVSFHEDPEQYKSVEMVEHIDSSIQRLTALSKKLASIDENMSCDPAYLMKTGRDRGRFDGRFDYDDYDSVPHKFF

SEQ ID NO: 42611 - protein, 174 aa, Sorghum bicolor
  Clone ID: SORBI-28MAY03-C73166_1.pep
MASSLLSSPAKPFCSTTKTTPAPKATRFPSPRFLSSAHVLSAARRLRAVSARASQQQSPPPRGQQQRRPEYVPNRIDDPNYVRIFDTTLRDGEQSPGATMTSAQKLVVARQLARLGVDIIEAGFPASSPDDLDAVRSIAIEVGNPAPAGEDGGADATHVPVICGLSRCNRKDID

SEQ ID NO: 42612 - protein, 295 aa, Sorghum bicolor
  Clone ID: SORBI-28MAY03-C7324_1.pep
MAFLLPKLTTPSGPSCKLPPSPLLKPQLAQPGHSGGKIQGSVSGAGAAQVAAPGHLSLLLLLSAPQQAADPASKSTATKNRGKGGGDPQRSDFYLNLGTAVRTLRDDLPDVFDREPNYDIYREDITFVDPLNTFHGIDNYKTIFWALRFHGRLLFREIGLDVSRIWQLTETSIVVRWELWGTPRVPWESYGCFSGTSRYKVDRNGKIYEHKVDNLALDFPRSVAKVGSIADMVVATPSPNLTFWNVVGPGDGCSWTKLYEAVVEAVEREEHGSTGIGVGGLPVPCSFGCGCGCSF

SEQ ID NO: 42613 - protein, 137 aa, Sorghum bicolor
  Clone ID: SORBI-28MAY03-C73243_1.pep
DLVIVIGATNKPQELDDAVLRRLVKRIYVPLPDPNVRKLLLKNQLRGQAFKLSNYDFERLAVETEGYSGSDLRALCEEAAMMPIRELGPQNILTIKANQLRPLRYEDFKNAMTVIRPSLQKSKWDELEKWNEEFGSS

SEQ ID NO: 42614 - protein, 170 aa, Sorghum bicolor
  Clone ID: SORBI-28MAY03-C7420_1.pep
MNGSMHENDDYSAHDIRRSIREAALSKPLRNTERPQDKNSDDASEHFFIPLSTGAAKKDMDSVTNGHNRRLGLLPSQMKFSKSTSGIYYNADSPIYTSPVLLSELNGHDSISAMSFLDPAGGLAHQSFLTDDALDQVFSPPLLLESSLFHDADEDLLAPLSETEAALMEH

SEQ ID NO: 42615 - protein, 340 aa, Sorghum bicolor
  Clone ID: SORBI-28MAY03-C79112_1.pep
MGGAAAGTKWIHHIQRLSAAKVSTEAVERGQSRVIDASLTLIRERAKLKAELLRALGGVKASASLLGVPLGHNSSFLQGPAFAPPRIREAIWCGSTNSSTEEGKELNDPRVLTDVGDVPIQEIRDCGVEDDRLMHVISESVKTVMEEEPLRPLVLGGDHSISYPVVRAVSEKLGGPVDILHLDAHPDIYDCFEGNTYSHASSFARIMEGGYARRLLQVGLRSITKEGREQGKRFGVEQYEMRTFSKDREKLENLKLGEGVKGVYVSVDVDCLDPAFAPGVSHIEPGGLSFRDVLNILQNLQGDVVAADVVEFNPQRDTVDGMTAMVAAKLVRELTAKISK

SEQ ID NO: 42616 - protein, 196 aa, Sorghum bicolor
  Clone ID: SORBI-28MAY03-C79686_1.pep
MTRVSSRAVAAAFLVLAVAWPLLASAQPAPSMPPPSPPAAAATNNSRLEKAYVALQALKRAITDDPKKLTKNWCGPDVCNYFGVYCAPAPDDPCQRTVAGVDLNHGDLAGTLPEELGLLSDLAVFHLNSNRFCGSLPQSLRSLHLLHEIDVSNNQLSGPFPSQLLCLPNVQYVDIRFNNFCGEVPAAIFDKKTDAL

SEQ ID NO: 42617 - protein, 110 aa, Sorghum bicolor
  Clone ID: SORBI-28MAY03-C80056_1.pep
MFFFFVGGVEQGAGRVLKEAAGRCLRCGGAADLVETEKVLKLFFVPVWRWPGKDPAYLCRDCGLLAPGSLGAEPGPGRSSLLLPREARCGACSRAVDPQFRFCPFCGSSL

SEQ ID NO: 42618 - protein, 191 aa, Sorghum bicolor
  unsure (1)..(191): unsure at all Xaa locations
  Clone ID: SORBI-28MAY03-C80343_1.pep
MGSLPTEERERRQQQPPHVVMVPYPAQGHVTPMLQLAKLLHTRGFHVTFVNNEFNHRRHLRARGPGALDGAPGFRFVAIDDGLPRSDADATQDVPALCYSTMTTCLPRFKDLVARTNAEAEAQGRPAVTCVVADSVMTFALRGARELGLRCATLWTASACGFIGYYYYRHLXERGIVPLQNEAQLTDGYLD

SEQ ID NO: 42619 - protein, 200 aa, Sorghum bicolor
  Clone ID: SORBI-28MAY03-C81473_1.pep
MGRAPCCEKMGLKKGPWTPEEDKILVNHIQSFGHSNWRALPKQAGLLRCGKSCRLRWINYLRPDIKRGNFSKEEEDAIITLHEQLGNRWSAIAARLPGRTDNEIKNVWHTHLKKRLEPTTKPEEQHGAQAGGAGKKHRPKRGAAKKTTADDVAVVPATTAPVSPERSPASSSVTESSSMTEQEQEQGNTGSSAGGFPIKE

SEQ ID NO: 42620 - protein, 269 aa, Sorghum bicolor
  Clone ID: SORBI-28MAY03-C80_1.pep
MATKIFALLALHALLVSGTTAAIIPQCSLAPNAIIPQFIPPVTALGNEHLAVQAYGLQQVLSASILQQPIAQLQQQSLAHLTVQTITAQQQQQQQQQQQQQQFLSSLSALAVANQAAYLQQQLLTSNPHSLANAAAYQQQQQLQLAMANPTAYVQQQLLLSNPQAATNAATYLQQQQFQQILPALSQLAMANPTAYLQQQQLLPINQLALANTDAYLQQQQLLPVNPLVVANPLVAAFLQQQQLSSFNQISLVNPALSWQQPIIGGAIF

SEQ ID NO: 42621 - protein, 86 aa, Sorghum bicolor
  Clone ID: SORBI-28MAY03-C18140_1.pep
MATVPVNPKPFLNNLTGKFVIVKLKWGMEYKGYLASVDSYMNLQLANTEEYIDGQFSGNLGEILIRCNNVLYLRGVPEDAEIQDAE

SEQ ID NO: 42622 - protein, 86 aa, Sorghum bicolor
  Clone ID: LIB5047-002-R1-XP1-E9.pep
MATVPVNPKPFLNNLTGKTVIVKLKWGMEYKGYLTSVDSYMNLQLANTEEYIDGQFSGNLGEILIRCNNVLYLRGVPEDTEIEDAE

SEQ ID NO: 42623 - protein, 268 aa, Sorghum bicolor
  Clone ID: SORBI-28MAY03-C18403_1.pep
MGAASPDSGDLIVVEPARPGSPVAVVTINRPAALNALTKPMMISLAAAFRRLGADDSVAAVVLAGRGRAFCSGVDLTTAEEVFKGDVKDVATDPVAQMELCRKPIVGAIAGFAVTAGFEIALACDVLVAGRSAKFLDTHAKFGIFPSWSLSQKLSRIIGPNRAREVSLTCMPVTAEMAERWGLVNHVVDDNEVLSKAIEVAEAIARNNRNLVVLYKSVINDGFKLDLEHAQALEKERGHNYYNGMTKEQFTNMQKFIQGRSSKTPSKL

SEQ ID NO: 42624 - protein, 122 aa, Sorghum bicolor
  Clone ID: SORBI-28MAY03-C18441_1.pep
IWGYMYSNEKEIVTYIAKMLPILGISFFIDGLHSSLSGVLTGCGKQKIGAAVNLGAFYLLGIPMSVLLAFIFHLNGMGLWLGIVCGSVTKLVFLLFVTCSIDWDNEAVKAKYRVLSSSLPLV

SEQ ID NO: 42625 - protein, 169 aa, Sorghum bicolor
  unsure (1)..(169): unsure at all Xaa locations
  Clone ID: SORBI-28MAY03-C18544_1.pep
MSLASIFVFLFVFALQLVDRYLDLARKRGAHSDELTKLRLEIKQLLKEADQLSTPSTFAQAAKLKRLAAAKEKELAKMQEQDLKGKQSLYDKYAKFLLVTKVIIYAVLVLCFWSTPVTTVPQHLLQPFGKMFSXGGVDTATGHVVVGILPWLFLTSRVSKLLCWYFGKK

SEQ ID NO: 42626 - protein, 243 aa, Sorghum bicolor
  Clone ID: SORBI-28MAY03-C8302_1.pep
MASSKLQLPADDSVLLLVTHSNLSTFAADIRVSQQTTVEALKDKLWRKTGTAVASMRLQLRDDTGAKIADLDDDAAPLAAYAPYNGYRIHVVDLDPSSLTSGGWLEDTSLVDKYKMSDEAYDKLDTNFRKFKEKMVPKNSPSEDKEQLEKHMEELCSKIKVGDRCEVEPGAKRGTVKFVGRAEALGRGFWGGVQYDEPLGKHDGMVKGIRFFECPQGHGAIVRPEKVKVGDFPERDPFEDDEI

SEQ ID NO: 42627 - protein, 320 aa, Sorghum bicolor
  Clone ID: SORBI-28MAY03-C8331_1.pep
HEAHVEVPQENLASVCESSFEDEQESIPRYSNTGGNMDDVVLSKAARPVKSARAIEDFETWQRIIRLDAVRANDEWVSYSPSQASVSKERAIESAKAVFLKDYDHLEPYRIHHASRLVAILEAYAIYDQEIGYCQGMSDLLAPLLAVLEEDDEAFWCFAGFMRKARHNFRLDEVGIRRQLNMVARIIKYKDFHLYRHLEMLQAEDCFFVYRMVVVMFRRELTFEQTLCLWEVMWADQAANRAEIAKSSWRKLQLGAPPTDDLLLYAIAASVLQKRKLIIESYSSMDEIIRECNSMAGQLDIWKLLDDAHDLVVTLHDRIE

SEQ ID NO: 42628 - protein, 152 aa, Sorghum bicolor
  Clone ID: SORBI-28MAY03-C83411_1.pep
NNPALQQSLCPFPLRRPVMSAVPSITTRELRPGDRFLIFASDGLWEQLSDEAAVGVVASSPRKGVAMRLVRAAQLEAARKKEVKYDKIRTIEKGQRRHFHDDITVVVLFLDKCRGAARSGPEDIDGTYAPLDVFSYSPAGDHEDPTKPVLRR

SEQ ID NO: 42629 - protein, 195 aa, Sorghum bicolor
  unsure (1)..(195): unsure at all Xaa locations
  Clone ID: SORBI-28MAY03-C84008_1.pep
MSRLDTKTLKDELTSMDRRCLLDLGHPLLNRVADSFIRAAGVGAARAVSREAYFVTVEGLSXDSSGLDPDGGKRSHFSSIRGDDGQRSLDAVVKTAGKEAFQWGLAAGVYSGLTYGLREARGCHDWKNSAIAGAIAGAAVALTGDAAGLSAGLAHGPSAAAARPGAASCPSAGACAGPALPPPGRARGHALNPGF

SEQ ID NO: 42630 - protein, 269 aa, Sorghum bicolor
  Clone ID: SORBI-28MAY03-C8427_1.pep
MKVLAVLALVAAAAPFLRAAGQGEEGAGPLPFAVGAAPAGCDVAQGEWVRDDDARPLYQEWECPYIQPQLTCQAHGRPDKAYQSWRWQPRGCSLPSFNATLMLEMLRGKRMLFVGDSLNRGQYVSLLCLLHRAIPDGAKSFETVDSLSIFRAKDYDATIEFYWAPMLAESNSDDAVVHSADDRLIRGAPMDRHSSFWKGADVLVFNSYLWWVAGDKIQILRGADNDPSKDIVEMKSEEAYRLVLYQVVRWLERNVDAKKSRVFFVTASS

SEQ ID NO: 42631 - protein, 302 aa, Sorghum bicolor
  Clone ID: SORBI-28MAY03-C84471_1.pep
MDASLRTLPPAGSSFPGEVRSAVSSLLLSSPGGTSALDTVFSHLPPPVTIPPLGSSVYYRQCELLRHFAASQTHQPATATAAACSSSSSSSSAASASFQFQPQAPPDDAAAAAAMLRQKLYRGVRQRQWGKWVAEIRLPQNRVRVWLGTYDSPETAAHAYDRAAYRLRGEYARLNFPGVMDAPDTDCPDHLRQLRAAVDAKIQAIRARMARKRARARKQREEKESARSGSGANSSKPAAARPVASEGAATTTTTTTTSETSTTPYGSPDGVLSVSAVSAEGDCPLERMPSFDPELIWEMLNF

SEQ ID NO: 42632 - protein, 217 aa, Sorghum bicolor
  unsure (1)..(217): unsure at all Xaa locations
  Clone ID: SORBI-28MAY03-C7778_1.pep
APATKPAPPPHGAPAHPRRTPPARPAHPARVRQSASRLPPPPQRGARGGGALAILVSIPAAGVPFPFPPLAVARASRXRAPEPEPRGESRFASAPPSPPDTPGGWNXDEGNRGRRLRGTPXLVECTGDRSVXEESEHAGGEXVEGKALKMSSTVPKSSSIFWRDCPVGKTHRPKLLQQKPCGVCKTSLGGSGVISLPGPFTCGHFGFPLGGNGNHVR

SEQ ID NO: 42633 - protein, 232 aa, Sorghum bicolor
  Clone ID: SORBI-28MAY03-C77992_1.pep
ARGSVAVPPPPLALVHHSRPVSSSALLRLPRTASARSPRSASCSTSAPPPPPPPPLPFVAVASMDAPPQGYRTNVGICLADPSLTKIFSASRLDIPSAWQMPQGGIDAGEEPRAAAFRELREETGVTSAEIVAEAPNWLTYDFPPDVRDKLNARWGTDWKGQAQKWFLFRLTGNDDEINLNGDGSEKPEFGEWTWMTPQEVIEKAVEFKKPVYEEALKHFAPYLQSDPAASS

SEQ ID NO: 42634 - protein, 188 aa, Sorghum bicolor
  Clone ID: SORBI-28MAY03-C7837_1.pep
RQNGHAEPPQMYGLSHRKLLRQLIMSGDIDSAFKRLGEWYPQVIKDEKSVICFLLHSQRFIEYIRAEQLEDAVKYGRANLASFLTHKAFEGLLKDSVALLAYEKPAESCMGYLMDSPQREFVADAVNAAVLSTNPTMKDPESCLYSCLERLLRQLTVCSFERRAFNNDQGDAFLLHKEVQNYERSRRS

SEQ ID NO: 42635 - protein, 174 aa, Sorghum bicolor
  Clone ID: SORBI-28MAY03-C78664_1.pep
MAPARRCSLLALALSLSLCSVFAAAAQQQVDAVAAAQQAADRVAGLPGQPPLGFAHCAGYVSVNEAHARARFYGFFEATSSPDNKPLVLWLNAAPGGPPLGGGGAVVLGPLSVLTGRPARRGVPLPAPPQALPLFRDSPAGAGFPPTASRSLPPPIVRQSWLIWAFPFRLLPNM

SEQ ID NO: 42636 - protein, 172 aa, Sorghum bicolor
  Clone ID: SORBI-28MAY03-C79364_1.pep
MAASATAARPLAGAAAVPLPLPARPRTARVALLPLTPVPGQRLALGRAGQERLPARGRSVRCLAALSPEMRATLDKVVGSSKVVLFMKGTKDFPQCGFSHTVVQILRSLDVPFDTLDVLANEALRQGLKEYSSWPTFPQLYIDGEFFGGCDITVEAYKSGELQETLEKAMCS

SEQ ID NO: 42637 - protein, 127 aa, Sorghum bicolor
  Clone ID: SORBI-28MAY03-C8635_1.pep
IASGPPFFFFFLQSQLHNIFPIKLMNCAQNKEVVSVLSLVSFTNCSAPTTQQPLPSSWYLARNRIKYHHTHNHCHREKDSRAKPLFAKHVHAARTYKKLESHNPSWSLTTSSQLKSSHHDNVRRDQQ

SEQ ID NO: 42638 - protein, 172 aa, Sorghum bicolor
  Clone ID: SORBI-28MAY03-C8633_1.pep
MAPNMETYTTDDALTMMGFGKFQALVLFYAGMGWVAEAMELMLLSFLGPFIREEWNVSPENEGLLSSVVFAGMLLGACAGRFVSDKYGRRTGLIFSTLFTSGMGFLSALSPNYLCWGALRVLAALPGGRCHVFISWFLEFVPAQNRGTWMVIFSLFWTLGTILEASLAWVVL

SEQ ID NO: 42639 - protein, 179 aa, Sorghum bicolor
  Clone ID: SORBI-28MAY03-C8641_1.pep
MATAFDAFTDKNAVFRRLKAKPENKMCFDCNAKNPTWASVTYGIFLCLDCSAVHRSLGVHITFVRSTNLDSWTPDQLKMMAFGGNNRAHAFFKQHGWTDGGKVEAKYTSRAAELYRQMLNKEVAKSAMTDNALPSSPVTSEASKPSDDFPEFKLPDVPAPLAENLNGKHEPQSPKAAPR

SEQ ID NO: 42640 - protein, 131 aa, Sorghum bicolor
  unsure (1)..(131): unsure at all Xaa locations
  Clone ID: SORBI-28MAY03-C8665_1.pep
EYAQKMNYPIPSYICTKQARGVAPFICTGGDWWHXYIGAAPRTKNAAEIKAGRTALLAIQGQWWGCANGSRKYIGGPGRRQRXKTAEKPTVQPKPLKVNKRGSKRKWYMLKDVGMASQIVDAQLNVPRHGM

SEQ ID NO: 42641 - protein, 125 aa, Sorghum bicolor
  Clone ID: SORBI-28MAY03-C86905_1.pep
MMMKKGGAGIMVAVAVALVVLVAAASSSVARADVSCADVDANLRACVGYVTGKEAAPGGECCAGVRRIRGMPSGTAERRQACECVKQAAAGYQPLNADAIRDLPKQCGAPLPFPLTLNFDCTTIP

SEQ ID NO: 42642 - protein, 104 aa, Sorghum bicolor
  Clone ID: SORBI-28MAY03-C8674_1.pep
WVHAGRAAQAGQEARPPGPPRDQGRRRPGTAREGGRDTDYPRPGRKPRKAGRPRNVRERPPGGDGQGLGRLATSRRGGRKGTKRLQGCTQINQNKGTSSKAAAS

SEQ ID NO: 42643 - protein, 68 aa, Sorghum bicolor
  Clone ID: LIB3476-052-P1-K1-E11.pep
DHSSSYIFFLYRQLRQSPWSVLVLFLPTLSSCPMIAEAMVNWLSMFSCIYSCLICFVTYYAAEICSWL

SEQ ID NO: 42644 - protein, 73 aa, Sorghum bicolor
  unsure (1)..(73): unsure at all Xaa locations
  Clone ID: LIB3478-050-P1-K1-E11.pep
CPSLLLCSSSSAYTLCLLVFLWEGTAEQRGLLILCSSKVRGRSSDVHGRQTGTMAXHGLRTRECYAGGCGTKG

SEQ ID NO: 42645 - protein, 243 aa, Sorghum bicolor
  unsure (1)..(243): unsure at all Xaa locations
  Clone ID: SORBI-28MAY03-C8195_1.pep
TRHKHIVRACAFSEDTHLLLTGGMEKTLRVYDMNRPDAAPRELDKSPGSVRTAAWLHXSDQTILSSCTDMGGVRLWDVRTGKIVQTLETKASVTSAEVSQDGRFITTADGSSVKFWDANHFGLVKSYDMPCNVESASLEPKSGSKFVAGGEDLWVHVFDFFTGEEIACNKGHHGPVHCVRFAPGGESYASGSEDGTIRIWQLSPANSDDNEAANANGKTTAGVNEVTTKIEGFHIPKEGQTEG

SEQ ID NO: 42646 - protein, 117 aa, Sorghum bicolor
  Clone ID: SORBI-28MAY03-C82080_1.pep
KARNEDPISAPEGYSAEVRQQPKMASRRMIRRGKAAIVSEWFIFPGFSNQLFHLSPIQHPGIEMDTSNIGSPSTILFLTFNLDLMRGLSFCPQHKFLRIGSCRTDSVCPHPLILQYI

SEQ ID NO: 42647 - protein, 161 aa, Sorghum bicolor
  Clone ID: SORBI-28MAY03-C82465_1.pep
MSSGELRTSFPDLAVGSPALTEGQTKSSGDLSSEGALQVTCFTEDLHDVILHFQIVRFAKQIYVWVGCNTTKFGHLYAAATTRPDSRVSVTSVLGGTSDNTGSSMARRLVLKTGLNIVLACNIPKDSPMLEAAAERKLVEKLKGLGYVGTAADKASTSTAH

SEQ ID NO: 42648 - protein, 91 aa, Sorghum bicolor
  Clone ID: SORBI-28MAY03-C8180_1.pep
CTHSEVVRQIDIYRMVTLHKCRHMVQMLMFHRVAYEVVILHLSWMWSLIVASWWKKATCRSRVNLEKSLSCAHHKTCISVSNSNRKLTKGM

SEQ ID NO: 42649 - protein, 68 aa, Sorghum bicolor
  Clone ID: LIB3476-045-P1-K1-B1.pep
GRIFFPLNSDMYIQIYPISTLSSSMLFSLSLALLVLFLIAVVVVDRFTRLLHVAFFHQLATIKDHIQD

SEQ ID NO: 42650 - protein, 164 aa, Sorghum bicolor
  Clone ID: SORBI-28MAY03-C8297_1.pep
MYGGGGGHYDGGGGGGAANANSLFGGGGFMPSQSTAVPESSGLSKGRSAQTLLPLTVKQIMDAAQASDDKSNFAIDGVEVSTVRLVGRMLNKVHRVTDVQFTLHDGTGKIDVNRWENEPSDAKEMADVNDGDYVIVNGGSRENESSDAKEMADVNDGDYVIVNG

SEQ ID NO: 42651 - protein, 243 aa, Sorghum bicolor
  Clone ID: SORBI-28MAY03-C89977_1.pep
VYSPSSRPVLSATSVAASTTTTTVVPLTPSPPTPHIRMRRSRYASYDDYLRHQLNKTLDPRLRRVWATRDWQRKVDAFARLFTGLRAEGLLSTPPRAPRPGPRLGLLVAALPPVGVRDALGIDLAPAPPRVARGDFHNQPFDNDTFDFEFSNVFDHALYPDRFAAEVERTLRPGGVAVLHVAVHRRGDKYSANDLLDVRGLVGLFPRCDVVRVSKVDAFGLDTEVILRKKRPSSRRRRRRRRL

SEQ ID NO: 42652 - protein, 244 aa, Sorghum bicolor
  Clone ID: SORBI-28MAY03-C9058_1.pep
MSLSLLQGYSSAEEDDDPAAGTELSESGDSSAEEAGSDGDEGSAPQKPAPKPRRRPNPKGGDAGGGDGDSSLPSALEAFADVSGPPDFLRHRVAEPEEGTEALGVLDRRGKEGSKHPPPGAVVVAKPQLVAIRERVTTTGANPSGSVTSGSVDGKRIIGAANPGPEDAADLLRMCLQCGVPKTYSHGKGMVCPQCGDSPVQTKEPEKKKGSPVKDKEKIKRMRGQSSHASWKSETEMALRQQFD

SEQ ID NO: 42653 - protein, 129 aa, Sorghum bicolor
  Clone ID: SORBI-28MAY03-C9048_1.pep
IAAARDLELVPDTEVPEPDEDQDDPDERHDPDSDMEVDDHKAVEESARRSIPGIKVKREFGENETKVQDGGRIASDHRGVEPMAEDIGSSKQAPQADASAMAVDEPSNVKNEPESSTKLQDQAAAYHKP

SEQ ID NO: 42654 - protein, 153 aa, Sorghum bicolor
  Clone ID: SORBI-28MAY03-C9180_1.pep
TSPFSVDPVASPPFSHSLRSRLAAHRGGGLQSAAIPATAASSSPTAAAPPSPPQASTTATPRPATATLLVAARLGPLGEGYGGTMHHQHVCWGPSVPTMAAPFVYGHAACRAMLSTPDCMACLRSIVSHMDAAPGPCFLTAACAMSSTCSWIN

SEQ ID NO: 42655 - protein, 186 aa, Sorghum bicolor
  Clone ID: SORBI-28MAY03-C9182_1.pep
RKTSLLPPDTRKAAYLAVMRTVSTSNRSGYDALLKIYREASEPQEKSRVLGSLSSSPDKDIVLEALNFMFTDEVRNQDSFYILGGISLEGREVAWTWLKENWDYVLKTWKSSSLISDFIESIVPPFTSEEKATEVTEFFAGRIKPSFERALKQSLERVRISARWIQSIRSEPKLGETVQELLQAEA

SEQ ID NO: 42656 - protein, 178 aa, Sorghum bicolor
  Clone ID: SORBI-28MAY03-C92704_1.pep
FSGTYTYNGEEYEATAPPEGASYDTCRDEAIAALNIGAHCEAKNCTFNGVWNGGGGAGQADLYVASYFYDRASQVGIIDGDAPNGKSTPAAFADAALKVCSFSIDDAKAAYPNAWDAEYLCMDLVYEYTLLVDGFGLEPSKEFTLVTKVKYGEYYVDAAWPLGDAIETLSSQKLNQIA

SEQ ID NO: 42657 - protein, 115 aa, Sorghum bicolor
  Clone ID: SORBI-28MAY03-C84635_1.pep
NLQAAYAAAFKNIRPSADNLPEELSEILTSCWKEDPNNRPTFTQIVQMLLHYLSTLSPQETLAPHRTFSSENTILPPESPGTSSLMASRGDLGETPKGKMEDKPRGFFFCFSECY

SEQ ID NO: 42658 - protein, 110 aa, Sorghum bicolor
  Clone ID: SORBI-28MAY03-C84949_1.pep
SPGLAGFLKSRCPANPTSSGNDPTVMQDVVTPNAMDNQHYKNVLSHTVLFTSDADLLTSAQTAKLVLDNANIPGWWEDKFEKAMVKMASIEVKTGYQGQVRKNCRAINHY

SEQ ID NO: 42659 - protein, 233 aa, Sorghum bicolor
  Clone ID: SORBI-28MAY03-C85627_1.pep
MAVLLRRAAAVAAAVLVVAAVCADGASTFYSSDPNLGSARVVFQTNYGDIEFGFFPHVAPKTVEHIFKLVRLGCYNTNHFFRVDKGFVAQVADVMSGRTAPMNAEQKREAEKTIIGEFSSVKHVRGILSMGRHSDPDSAGSSFSILLGNSPHLDGQYAVFGRVTKGDDTLSKLERLPTRREGIFVMPIERIDILSTYYYDIDVESCEAEKTILRRRLSESASEVERWRRKCFA

SEQ ID NO: 42660 - protein, 157 aa, Sorghum bicolor
  Clone ID: SORBI-28MAY03-C84696_1.pep
AVDGFCMSRCGTHGASPRSRSGRFAYVWVGNPASQCPGQCAWPFHQPVYGPQAAPLTPPNGDVGVDGMVISLASMIVGTVTNPFGNGFYQEGSADAPLEAATACAGVYGKGAYPGYAGSLLVDQASGASFNANGAHGRKYLVPALVDPDTSSCATLG

SEQ ID NO: 42661 - protein, 162 aa, Sorghum bicolor
  Clone ID: SORBI-28MAY03-C9787_1.pep
MGKGAQGSDAAVAAAAAAGAGEVEENMAAWLVAKNTLKIMPFQLPPLGPHDVRVRMKAVGICGSDVHYLREMRIAHFVVKEPMVIGHECAGVIEEVGAGVTHLTVGDRVALEPGVSCWRCRHCKGGRYNLCPDMKFFATPPSSQESKIWISLGVFFPLLGWN

SEQ ID NO: 42662 - protein, 255 aa, Sorghum bicolor
  Clone ID: SORBI-28MAY03-C982_1.pep
MRKKLGTRFPAARIKKIMQADEDVGKIALAVPVLVSRALELFLQDLIDRTYEITLQSGAKTLNSFHLSPWVKRYSSFDFLTEVVNKVPHLGGADSCGDERGLPTRRKSNGSDPQNDESRSSKMVIRNANISPRGRGRGRGRGRGRPPTKRKEVGYVQFEDESSMFAEQGEPLPGEETVQEINNGNEIMPQSTQPPVEAPPTAPAQATSSKVEEANTNHQSDWPMPDAIGSIGVGPSGFGHLTVQVDEDEDYDNED

SEQ ID NO: 42663 - protein, 100 aa, Sorghum bicolor
  Clone ID: SORBI-28MAY03-C98916_1.pep
VVVFVVPAAAAAGVGAVAVAASLDLSLALPADAAAAVKPYQLFMDPTAALALRQLLPPRSEEERRSRSARWSSSSSSSAGQVVGLGLLDLNLPPPVEMVM

SEQ ID NO: 42664 - protein, 123 aa, Sorghum bicolor
  Clone ID: SORBI-28MAY03-C991_1.pep
MAERKRGAGTRKDEVVTREYTINLHKRLHGCTFKKKAPNAIKEIRKFAQKAMGTTDVRIDVKLNKHIWSSGIRSVPRRVRVRIARKRNDEEDAKEELYSLVTVAEIPPEGLKGLGTKVVEDED

SEQ ID NO: 42665 - protein, 152 aa, Sorghum bicolor
  Clone ID: SORBI-28MAY03-C99177_1.pep
PTLISLPLTPIVKQPLGPGSDPPPSCPAGPVGDRLFPRQAPLMPPRHSPYSRGVAFLKIQFPTDYPFKPPKVHFSTRIYHPNINSNGSICLDILRDQWSPALTISKVLLSICSMLTDPNPDDPLVPEIAHVYKTDRPRYEATAREWTRKYAV

SEQ ID NO: 42666 - protein, 286 aa, Sorghum bicolor
  Clone ID: SORBI-28MAY03-C102053_1.pep
HEAEAHLLCRVRLALLLLLVCSWWLLPRSDARRTLVAPGLPIRAVNLGGWLLTEGWILPSLFDDIPNKDLLDGTQLQFKSVTQNRYLVADQGHEAAILADRVQASGWETFKLWRINETTFNLRVFGNQFVGVNSTAGVVATANTPGPSETFQLVRWNSDKSRVRIRAPNGLFLQAKTMESVTADHKEDTDWGDDDPSVFLTNNVGGLQGEYQICNGYGITEATQVLRNHWSTYINESDFSFVASSGLNAVRIPVGWWIASDPYPPHPFVGGSLQALDNAFSWAEKY

SEQ ID NO: 42667 - protein, 153 aa, Sorghum bicolor
  Clone ID: SORBI-28MAY03-C8830_1.pep
AGYALPNVGQLLAPGPPTDKAVVLGDGDTKVVFVEEGDIGTYTVLAADDPRAENKTLYIKPPANTLSHNELLSLWEKKTGKTFQREYVPEEAVLKQIQESPIPLNIILAIGHAAYVRGEQTGFEIDPAKRVDATELYPDVKYTTVDEYLNRFL

SEQ ID NO: 42668 - protein, 135 aa, Sorghum bicolor
  Clone ID: SORBI-28MAY03-C8825_1.pep
MVELLGRRIGVAAAAAAFIALAAFGSASSSPKSFVKSTVSAHDVVIFSKSYCPYCKRAKAVFKELQLKKEPYVVELDQREDGSEIQDALRDIVGRRTVPQVFVHGKHLGGSDDTVDAYESGKLAKLLNIGVKDDL

SEQ ID NO: 42669 - protein, 171 aa, Sorghum bicolor
  Clone ID: SORBI-28MAY03-C8757_1.pep
METSLRLRSGGGLRIHAKEKLPLGHSSLLQAHAELDLHTSPAGVTAPSYLALFVRHFYPQLSANLGPYFAGVQLHNGDDLTYSLRAKKAVLFRPDNGFLGLNLKGRLLIDKEFKPTKTSGAVELAWTILDFKQGQDVRLKVGYELDDKVPYFQLRENSWTLNGYMDGKLGC

SEQ ID NO: 42670 - protein, 111 aa, Sorghum bicolor
  Clone ID: SORBI-28MAY03-C8855_1.pep
MARERREIKRIESAAARQVTFSKRRRGLFKKAEELSVLCDADVALIVFSSTGKLSQFASSSMNEIIDKYNTHSKNLGKAEEPSLDLNLEHSKYANLNEQLVEASLRLRQMR

SEQ ID NO: 42671 - protein, 126 aa, Sorghum bicolor
  Clone ID: SORBI-28MAY03-C8939_1.pep
HASEEKDLFDALAKLSEVSYDVVYFGADHNHRSVNLNEHDNGKGDEAVLLKLVSSSDEMSSEINKVKIQGVASVPLSCDPHRWHCQLISAPPSAATARGCVFRLWPTDGRGVDLRALGSVQEAVLN

SEQ ID NO: 42672 - protein, 265 aa, Sorghum bicolor
  Clone ID: SORBI-28MAY03-C100758_1.pep
MAEEGYKVTLNVYDLSNGLARQLSTSFLGKPIEAIWHTGVVVYGNEYYFGGGIQSSPAGTTPYGRPLRTVELGVTHIPREVFEDYLRDIAPRYTAETYRLLTHNCNNFSHEARGFLVGTGAGVPDYILNLPAEVMSSPMGPLIMPMIQNLESTLRANTAPQATQFVPTPASVSAPAPAPAAAPAKREAPAPAPAEKASKEAPSSAPAPAPAADPLGSARGKVQEEVMREFAAIMASGTLRASEAAALAMRRVMERHGDGATMQQG

SEQ ID NO: 42673 - protein, 196 aa, Sorghum bicolor
  Clone ID: SORBI-28MAY03-C10076_1.pep
ERVESLVKRVIVAESEAANEKEKVRMGLEEIRRKTLQVETMSAKVEEMEKFAVGTNGMLNEMRQRVEDMVLETTRQRQRAAENEQELSRVKQDFESLRTYVSTLVSVRETLLSSEKQFETMEKLFDRLVAKTNQPESGTAQKEAAVHKVLEDNVGLRDLRDKEGAQQQRKKKHRKMRPLPSHHLQGPDFRRRHSSC

SEQ ID NO: 42674 - protein, 136 aa, Sorghum bicolor
  Clone ID: SORBI-28MAY03-C10094_1.pep
RVTLVEHEANTNTAPFFLRYMETLDYYTAMFEAIDVACPRDDKKRIGTEQHCVARDIVNLIACEGTERIERHEPFGKWRARLAMAGFRPYPLSPVVNRTIKTLLDSYHSYYRLEERDGILYLGWKNRKLVVSSAWC

SEQ ID NO: 42675 - protein, 168 aa, Sorghum bicolor
  Clone ID: SORBI-28MAY03-C101586_1.pep
LLNEPWAPGATLSSLTKYYQEGYNAVRRHTSAAYVIMSNRLSADATELLQFAGGFSGAVLDVHYYNLFSSVFNSLTVEQNIDFVRNNRSTDIATVTNQNGRPLTFVGEWVAEWDVQGANKTDYQRFAQVQQDVYGRATFGWSYWTLKNVNNHWSMQWMIQNGYISLKS

SEQ ID NO: 42676 - protein, 268 aa, Sorghum bicolor
  Clone ID: SORBI-28MAY03-C1017_1.pep
GTSSQEPILDYSQLSKSHLQDIRPSERDKHEAEFKKRTGVLLADIERTAPNLKALDQYDALQRKEKEVTERFEAARKEEREIADKYNSVKQRRYELFMEAFDHISKGIDKIYKQLTKSHTHPLGGTAYLNLENEDEPFLHGIKYTAMPPTKRFRDMEQLSGGEKTVAALALLFAIHSFRPSPFFILDEVDAALDNLNVAKVAGFIRSKSCDRVADEQGSDGACGFQSIVISLKDSFYDKAEALVGVYRDSERSCSSTLTFDLRKYREA

SEQ ID NO: 42677 - protein, 185 aa, Sorghum bicolor
  Clone ID: SORBI-28MAY03-C93943_1.pep
MAAQASSIIVPTDAELLQAQADLWQNSLCYLKSMALKCAAELGIPTAIYRLGGAASLADLIAALSLPQAKLPFLGRLMRLLASSGAFAVVGSTDEAVYSLTPLSYLLVDGIAGDSNHMDHAPFLLTVTSTHYIDLAMDLADWFKKEDKTPPFDHKHGASLFEDSMERTDPGFHKMSKLGLLVHDN

SEQ ID NO: 42678 - protein, 111 aa, Sorghum bicolor
  Clone ID: SORBI-28MAY03-C94211_1.pep
AHTYAGTTSPAVRAAAASAGLSSTRRSRLNQTTVRIPGSPAAPLIEDCDADMAPSPLSGTADQEFPDTRTSSWPSGEIRSSTRIGQAAKNKLLGSWLSSMSCAGESSCFTH

SEQ ID NO: 42679 - protein, 258 aa, Sorghum bicolor
  Clone ID: SORBI-28MAY03-C9461_1.pep
HEVTLFPYVDSICDKLDFIGINYYGQEVISGPGLKLVDNDEYSESGRGVYPARRFRILIQFNERYKSLNIPFIITENGVSDETDLIRKPYILEHLLAIYAAIIMGVPVLGYLFWTMSDNWEWADGYGPKFGLVAVDRANNLARKPRPSYYLFSKVVTTGKITRQDRLGAWRELQQAAFQKKTRPFFRAVDKHGRMYAGGLDRPIQRPFILRDWRFGHYEMEGLQDPFSRFIRSIFSPILRKKKIHYIEYEDISYAISP

SEQ ID NO: 42680 - protein, 73 aa, Sorghum bicolor
  Clone ID: SORBI-28MAY03-C9466_1.pep
ITESYKSKLKSIDCKYFALGTGSCPFGTSCFYRHAYREYYGIEVVLRHLDADDGSTVIAKDIRLSDFLGRMHL

SEQ ID NO: 42681 - protein, 223 aa, Sorghum bicolor
  Clone ID: SORBI-28MAY03-C9783_1.pep
ARGTVEFFNHLYYVAESYHDEPEKQTELAKLGNDCVDALQAHDDTTGSLEALNAAELKLKDILNSPSVDAACRKIDDLAEKKELDSALVLMLSKAWSAAKGTDITKSEAKDIMFHLYMTAVANLQRQWPKDIRILKHLIMIEDPEERLSALNDAFTPGPELQGDNVDTLYTSPDAMHTWARAIVDAYYNSREGTLLGQARDMMNPKVIKRVEEIVKIIKDKYL

SEQ ID NO: 42682 - protein, 195 aa, Sorghum bicolor
  Clone ID: SORBI-28MAY03-C10478_1.pep
GITIDYGSAFPLNLRRATQLDIEAEFQLDRRAVMSLNEADVGYNCSTSGGAAARGALGPFGLLVLADKHLREQTAVYFYVAKGLDGSLTTHFCQDESRSSSANDIVKRVVGSSVPVLDDETTLSLRVLVDHSIVESFAQGGRSTATSRVYPTEAIYANAGVFLFNNATAARVTAKKLVVHEMDSSYNHDYMVTDI

SEQ ID NO: 42683 - protein, 241 aa, Sorghum bicolor
  Clone ID: SORBI-28MAY03-C1059_1.pep
MPGRLLSVRIPSLAKLGAPRCAKFMASDTGKKLIQIDVSSDTVCPWCFVGKKNLEKAMEQSKDKFDFEVRWHPFFLNPDAPKEGVRKTDFFRAKFGPVQYERAISRMTEIFRGLGLEYDMSGLTGNTMDSHRLITLAGHQGYDKQNALVEELFLNYFCQGKYIGDKQVLLDAARKVGIEGAEELLEDPSKGVDEVQEELKKYSSGISGVPRTRINNKYQLSGGQPPNVFMRAFEMAAKDGA

SEQ ID NO: 42684 - protein, 213 aa, Sorghum bicolor
  Clone ID: SORBI-28MAY03-C10512_1.pep
GGFVACRALSQRNSDPAKASRPWDVDRDGFVMGEGSGVLVLEELEHAKQRGAEIYAEFLGGSFTCDAYHMTEPHPEGKGVILCIENALADSGVTKEDINYINAHATSTQMGDLKEFEALNRCFGQNPQIRVNSTKSMTGHLLGAAGGIEAVAAIQAIRTGWVHPNVNLDNPEKNVDVSMLVGPQKERCDVKVALSNSFGFGGHNSSILFAPFK

SEQ ID NO: 42685 - protein, 120 aa, Sorghum bicolor
  Clone ID: SORBI-28MAY03-C10641_1.pep
MVAATTAGMFLVCFESLCPCFRSKRKDGSEDHVLAEHSNSLNSSEMRSISDRIPASPLRVPASPSRFSLSSSPPSRNEPLNLSLEHVVKLTHNFAPALMIGEGYFGKVYRVELRDGRVVA

SEQ ID NO: 42686 - protein, 178 aa, Sorghum bicolor
  unsure (1)..(178): unsure at all Xaa locations
  Clone ID: SORBI-28MAY03-C10796_1.pep
MSCLACCGGEDTQRTPDNGGPYPGGYPARDDAYRTADPTPRGAQPLKVQPIAVPTIPVEEIREVTKAFGDEALIGEGSFGRVYFGVLENGRSAAIKKLDSSKQPEQEFLAQVSMVSRLKHDNVVELLGYCVDGNTRILAYEFATMGSLHDMLHGRKGVKGAQPGPVLSWXTRVKIAVG

SEQ ID NO: 42687 - protein, 152 aa, Sorghum bicolor
  unsure (1)..(152): unsure at all Xaa locations
  Clone ID: SORBI-28MAY03-C99532_1.pep
LAGRTPALPAAPAQSYELPDGQVITIGNERFRCPXEALFQPSFLGMEAAGIHETTYNSIMKCDVDIRKDLYGNVVLSGGTSMFPGIADRMQKELTALAPSPMKIKIIAPPERKYSVWIGGSILASLSTFQQMWISKEEYDESGPSIVHRKCF

SEQ ID NO: 42688 - protein, 169 aa, Sorghum bicolor
  Clone ID: SORBI-28MAY03-C9971_1.pep
LSVDIEQNSSITSCLKNFCSTETLNAEDKFFCDKCCSLQEAQKRMKIKKAPHILVIHLKRFKYIEQLGRYKKLSYRVVFPMELKLSNTSDDVDTEYSLFAVVVHVGSGPNHGHYVSLVKSHNHWLFFDDENVEMVEEQTLQTFFGSSHEYSGNTDHGYILFYEGLGGKS

SEQ ID NO: 42689 - protein, 284 aa, Sorghum bicolor
  Clone ID: SORBI-28MAY03-C10023_1.pep
MRSAIEGMNGKELDGRNVMAAAVRGDYDTCALYADQLKRRSAEQFKEGVLGLEHLAAVDAFCELVARGMGAPEPPRTYHINLSVFTSLPDMWAIGQQFPIIPIQRLQERPAVDGVLSDLTCDSDGKVSEFIGGRHSLPLHELPTHATRGYYLGMFLGGAYQEALGGLHNLFGGPSVVRVSQCDGPHCFAVTRAAAGGRVADVLRAMQHEPEVMYEVLKQRTDGATAAALARAFGAMPYLVFDPEAAVLSSGESSGMSSDSEGSAAGAAEEEDDEEWEFMRGLTV

SEQ ID NO: 42690 - protein, 249 aa, Sorghum bicolor
  Clone ID: SORBI-28MAY03-C100460_1.pep
MATTTTTTTTMKASDPGSAWFGSGASRTPSAAGTGGHNARLITTAVAAFVSVLGLALFLHLYVCHVRRRNRRRAEAARAAVLPTTAAAPAKCGLDAAAIAALPTTIYRDDVGGEAATDECTICLGAVEDGEVVRALPACGHVFHVPCVDTWLASSSSCPVCRAEVEPPPPTATVGSARFVLEKVQDAVKEEAGSCSSTPERGIGACASLMKMLSRERPAAPRRPQQGAYADAGDLDDLERQQYAVAVNN

SEQ ID NO: 42691 - protein, 220 aa, Sorghum bicolor
  Clone ID: SORBI-28MAY03-C1000_1.pep
STANLKYLLVPYYLAEMTEKIAQEDRIPVLKASQDHLKEFIALCEVLELIPEDELELSRQKQPDTMANRRAQKVARFKRQKAAETKLQEIRERKERRGRSLRAAALSAPIEAGEEDDLEDDGEEEREAWLATISLALCKAFDLLDMLKKEEEMLLAVKERKAKVWYDHLAVVLPLRDATLETSSGVNILFVLTSSARTYTYLHGKLFQWLLIKQYTRRGW

SEQ ID NO: 42692 - protein, 358 aa, Sorghum bicolor
  Clone ID: SORBI-28MAY03-C11412_1.pep
TRRPAPPRPPASPAVAPSAPPPRRPPSPAASSPPPPPAPPRPSAARAPSPSVSAPLVPSPPVASSPAPAGAACGSSPRVRDTESSLEKVKRQLSSGSGRYLLQGPLLKRSETLRKWNERWVILDPTSGKMEYKLRRNETAIKGTILFDASSTITLSPVNFQGMPKYDGCCFYIGTPQKKDYFLCAETPGAAKAWVSTLHATQLVLRAHKEAVNSLAGNGSSATLGTVATAVANANATAMEATKEIEAALKVSMRAALGLGTNNSNEGQLDDLTIMKETLRVKDEELQHLAKDIRSRDSTIKEIADKLTETAEAAEAAASAAHTMDEQRRLLCLEIERLKQALERQIEQSMLKLGHSEE

SEQ ID NO: 42693 - protein, 245 aa, Sorghum bicolor
  Clone ID: SORBI-28MAY03-C11418_1.pep
MAPPPTSSSFLRPPPLPHHPHPRLHFRPPSASFRVSEILGGRGLCNGEVGVRKELTSGSSASTTTSSPAPSPSPSTESPPPAVDLDAFDKEMMGLTGGFPGGEVGLKDFVAKNPPPPRSKKSNSQLVAPQATTLSAPPRTPELPLFLPGMVVLVKNPKHEDYMYCGIVQRVTDGKVAVLFEGGIWDRLITFNLDELEGREKGPPMVNPKSVVLEDIVAQLEDDDDDKEDEAAKKEKEPEGAAAAA

SEQ ID NO: 42694 - protein, 138 aa, Sorghum bicolor
  Clone ID: SORBI-28MAY03-C11041_1.pep
ATAYDVSINDDSWPTEAFELVTGEKSKTLERLGPGATASHTFVLETKTQGRFQGSPARITYRVPTKTALQEAYSTPIFPLDILAERPPEKKFEWAKRLVAKYGSLVSVVSFVGLFIYLVASPSKSGSKASKTETLIYL

SEQ ID NO: 42695 - protein, 84 aa, Sorghum bicolor
  Clone ID: LIB3478-022-P1-K1-C8.pep
RFQGSPAIITYRVPTKTALQEAYSTPIFPLDILAERPPEKKFEWAKRLVAKYGSLVSVVSFVGLFIYLVASPSKSGSKASKKRR

SEQ ID NO: 42696 - protein, 179 aa, Sorghum bicolor
  Clone ID: SORBI-28MAY03-C1125_1.pep
AAAARIGPASGRQPARIRFLGGRARNTVVRSRTTGKKARRGDGAADDGNLRLAGVEGGGGAHGGFRGAGGHSASGRSRVPSDVGVVGSASASASCSWASELASTSTSICCCFSAAGKATDSASGAGAVDDEAADEQAGAGRGRPDAAAGDVGRWSSSLRRVGARESRCGCGWVGAREER

SEQ ID NO: 42697 - protein, 129 aa, Sorghum bicolor
  Clone ID: SORBI-28MAY03-C114279_1.pep
STRTWHTAVHPHISSLRPLHPKQPSGEQQGRPAMGKQATATALALLCVVLLAATAVDDAAAAASCNPSALSACSGALFGGAVTQGCCASLRAQQPCLCQYKRDPAYRGYVNGPVAQSVTRACGLPMMKC

SEQ ID NO: 42698 - protein, 144 aa, Sorghum bicolor
  Clone ID: SORBI-28MAY03-C1019_1.pep
SFDFRQSGSGFFSFHLWLCFLIGMDRASLNLGSGGNINSLNDPCHWSTGQQAVEYKGTAIGTLVYSNFSRGVLAALVPPAALTAAPRRPLPPPPARGRGRSPCSSGIGPSGSWAGGVSTVVFVSGIAKTVAAATLGSRINSCPM

SEQ ID NO: 42699 - protein, 154 aa, Sorghum bicolor
  Clone ID: LIB3476-017-P1-K1-A10.pep
CPKSVHGGTQYCVAHGGGKRCLVSGCTKSARGRTEYCVRHGGGKRCKFEGCAKSAHGSTDFCKAHGGGKRCSWGQEGSSFGVGGPACDKFARSKIGLCASHSALVEDHCVHGGGFVGTAIRQLTADCNPDEIQAAAMKDDADMANGEDETFLGW

SEQ ID NO: 42700 - protein, 330 aa, Sorghum bicolor
  Clone ID: SORBI-28MAY03-C10276_1.pep
MARAGVSTAPLSRLHSLPPRPSLLHNPQPNVLLLRPQERKAPATTAAALPTAADLPELSLPAAAAAAAALAAAVSLSDPERRRRAQAEAAGGGDKEAVRAYFNSTGTGRWRKIYGSATEGVNRVQLDIREGHAQTVAAALSMLRDSPLELAGTTVCDAGCGTGSLAIPLAAEGADVLASDISAAMVSEAQRQASLAQATAPGSTTFRMPRFEVRDLESLEGRYDVVVCLDVLIHYPREEAKAMIRHLASLADKRLLISFAPRTLYFDFLKRVGELFPGPSKATRAYLHAEADIEDALRQAGWRVANRGFISTQFYFAKLFEAVPVASSSS

SEQ ID NO: 42701 - protein, 195 aa, Sorghum bicolor
  Clone ID: SORBI-28MAY03-C1038_1.pep
MARWSAAVLVLVLAAGIMGMASVAVGDMNADKTECADQLVGLAPCLQYVQGQARAPPPDCCGGLRQVLGKSPKCLCVLVKDKDDPNLGIKINATLALALPNACGATRANVSHCAQLLHIPPGSKDAAVFSPGGDKGSTAAPAKDNSTATTDSRALQATNGGGVSSSAATAGAALTAVLLAGYLLLLVPELSPSSF

SEQ ID NO: 42702 - protein, 148 aa, Sorghum bicolor
  Clone ID: SORBI-28MAY03-C10241_1.pep
MNNSIHSSCSSVVLTTSRLDVYAGVNSVAIAGEAKDQLEVVGESVDITCLINHLRKKVCRADIVVVEEVKDKKKEEEEKKKKEEEAKKKKAEEDKKKAEEARKKAEEEFKKLWAACPPPPYNGGYYSYPGPPATFVCEEQPAAGCHIM

SEQ ID NO: 42703 - protein, 116 aa, Sorghum bicolor
  unsure (1)..(116): unsure at all Xaa locations
  Clone ID: LIB3478-012-P1-K1-A2.pep
MSKQKTVIRLGVPNAKNRSKAMQLASKAVGVNSVAIAGEAKDQLEVVGESVDITCLINHLRKKVCRADIVVVEEVKDXKKEEEEKKKKEEEAKKKKAEEDKKKAEDARKKAEEEFK

SEQ ID NO: 42704 - protein, 242 aa, Sorghum bicolor
  Clone ID: SORBI-28MAY03-C10425_1.pep
PHHYTQGYLGSETFTLGSDAVPGIGFGCTTMSEGGYGSGSGLVGLGRGPLSLVSQLNVGAFSYCLTSDAAKTSPLLFGSGALTGAGVQSTPLLRTSTYYYTVNLESISIGAATTAGTGSSGIIFDSGTTVAFLAEPAYTLAKEAVLSQTTNLTMASGRDGYEVCFQTSGAVFPSMVLHFDGGDMDLPTENYFGAVDDSVSCWIVQKSPSLSIVGNIMQMNYHIRYDVEKSMLSFQPANCDNF

SEQ ID NO: 42705 - protein, 226 aa, Sorghum bicolor
  Clone ID: SORBI-28MAY03-C18624_1.pep
MATEQAAENYTVEDLVALNPYNPDILNDLEKFVNEQVSSQTYNLDANLSLLRLYQFEPERMSIQIVAHILIKALMAMPAPDFSLCLFLIPEHVQMEEQFKTLIVLSHYLETARFSQFWDEAAKNRHILEAVPGFEQAIQSYAIHVLSLTYQKVPRPILAEAINIEGLALDKFLEYHAANSGWVIEKGGQSQVIVLPRNEFNHPELKKNPADIVPFEHVTRIFPVLS

SEQ ID NO: 42706 - protein, 106 aa, Sorghum bicolor
  unsure (1)..(106): unsure at all Xaa locations
  Clone ID: SORBI-28MAY03-C12023_1.pep
LPSGNYVRSNSTGTIGEPFSASTNAYESNNPGAYGSSSIYGDSTWRFNSSEVDMPPFGHDLGNVDPDIKSEISASYMGNYTVNNNQTSXEVSLPRESTIKFIYDLG

SEQ ID NO: 42707 - protein, 80 aa, Sorghum bicolor
  Clone ID: SORBI-28MAY03-C12041_1.pep
MGGGGAHGGTTYKGYTIPHNKRWHTVAGKGLCAVMWFWVFYRAKQDGATLLGLRHPWDGHDDHSHGHGHGHEASSSSSSH

SEQ ID NO: 42708 - protein, 149 aa, Sorghum bicolor
  Clone ID: SORBI-28MAY03-C12132_1.pep
MATAHPRRWALLLQLGIALGILLAAAEAWTGEISGRVVCDVCGDAAIGPEDHALEGAEVAVLCITKSGEVINYQAFTNSKGMYTVAETMPESDRWDSCLARPISSFHLHCTRRGDAHSGVKFTYNKPSGNSHTVKTFLYKPATAPLYCS

SEQ ID NO: 42709 - protein, 146 aa, Sorghum bicolor
  Clone ID: SORBI-28MAY03-C12158_1.pep
RGDLYQRNYTHASEAILSILLDKDKSSSTILSLKKAGPEITELLTQCSIGIAGTGLAVLLSVMCKMATGVRTPFASARLLSTSVGFGLFWLSWAVNGLRDTIASIFRSPSNMNIEDDEVAVKIEKSVNEILFRALTLLAITALKFA

SEQ ID NO: 42710 - protein, 197 aa, Sorghum bicolor
  Clone ID: SORBI-28MAY03-C123170_1.pep
MANGGAEASGSGPAAGPLRPQTQRRAGGDPLLVVCRCFGVVTAAVALLCVAANVLSAVYSFRGGADIIGGVFRCYAVVFSVFVAVLETEWAPIIRLWKIFEYLPARGMLQIFVAIMTKAYPNVERNELILLQEIATYMLLACGAVYIIAGILCLGVLKRSRQHKATSQEQAVKDLEELEKRREELESLLIAERPETA

SEQ ID NO: 42711 - protein, 243 aa, Sorghum bicolor
  Clone ID: SORBI-28MAY03-C12123_1.pep
MRIFVLSGQSNMAGRGGVHRRHWDGVVPPDCAPDPSILRLSAALQWEEAREPLHADIDTTKTCGIGPGMAFARAVLPRLQEDTPGAGTRTGIGLVPCAVGGTAITEWSRGEHLYEQMVCRARVAAGYGEIEAVLWYQGESDAESDADTGAYLENVERLIGNVRADLGMPQLPFIQVALASGNKRNIEKVRNAQFSVNLPNVVTVDPMGMALNEDNLHLATESQVKLGKMLAEAYIMNFLTATC

SEQ ID NO: 42712 - protein, 57 aa, Sorghum bicolor
  unsure (1)..(57): unsure at all Xaa locations
  Clone ID: LIB3478-038-P1-K1-H12.pep
SEQVALASGNKRNIEKVRNAQFSVNLPNVVTVDPMGMALNEDNLHLXTESKVSLANA

SEQ ID NO: 42713 - protein, 100 aa, Sorghum bicolor
  Clone ID: SORBI-28MAY03-C27756_1.pep
YADVLHPINTVLLDELDDLDHQRVSIKERTDAVKKKKKDTQKAKRLLSMCMSVTNVVPNLEDQDKVSGKIIDQNSRRMEKFEFENTKPPVEICDELWKKI

SEQ ID NO: 42714 - protein, 254 aa, Sorghum bicolor
  Clone ID: SORBI-28MAY03-C27780_1.pep
MASLQVSGAGVGAAAFAAKGKASIGALRLPSTVTVGEVCPARRAFRGLVVRAATVVAPKYTTLKPLADRVLVKINSSEEKTTGGILLPTTAQSKPQGGEVVAVGEGRIIGDKKVDVSIQVGAQVVYSKYAGTEVELNDYNHLVLKEDDIIGILETDDVKDMKPLNDRVLIKVAEAEVKTPGGLLLTETSKEKPSIGTVVAVGPGPLDEEGKRSPLSVSAGSTVLYSKYAGSEFKGADGTNYIVLRVSDLMAVLS

SEQ ID NO: 42715 - protein, 356 aa, Sorghum bicolor
  Clone ID: SORBI-28MAY03-C2789_1.pep
MATAEVVVVANGSGSADTKAAFKEPDGKLKEEMLQDPAFEFTDESLQWIDRMVDYNVLGGKCNRGLSVIDSYKILKGVDVLSKEETFLACTLGWCIEWLQAYFLVLDDIMDNSQTRRGQPCWFRVPQVGLIAVNDGIILRNHISRILQRHFKGKPYYVDLIDLFNEVEFKTASAPLLDLITTHEGEKDLTKYNLTVHRRIVQYKTAYYSFYLPVACALLLAGENLDNFGDVKNILVEMGTYFQVQDDYLDCFGDPEFIGKIGTDIEDYKCSWLVVQALERADENQKSILCENYGKSDPACVAKVKDLYKELKLEEVFHEYERESYNKLIADIEAQPSKAVQTVLKSFLHKIYKRDK

SEQ ID NO: 42716 - protein, 123 aa, Sorghum bicolor
  Clone ID: SORBI-28MAY03-C2802_1.pep
YSSKLHHIIGANKTVKTTALVLVALLGLPLSITYSVPFSVTAELTAGTGGGQGLATGVLNLAIVVPQIVVSLGAGPWDALYGGGNIPAFALASVFSLAAGVLAVLKLPKLSNSYQSAGFHGFG

SEQ ID NO: 42717 - protein, 75 aa, Sorghum bicolor
  Clone ID: SORBI-28MAY03-C28208_1.pep
GYICIHISMYACMVASSVVVVVVHHGHHHHFTGHRYGSHPTHHHMHWFQSASIQSQSIAGHPGVVSSLGLFFIGG

SEQ ID NO: 42718 - protein, 190 aa, Sorghum bicolor
  Clone ID: SORBI-28MAY03-C13646_1.pep
MRGLRDDSDDAIDAKKYLSKVNEDSQLEDGSPLKKTKKRTYGNSHNDSGSSGSEERDKHRSHSEKRRHKKAHKHKKQYDDSSESDSEPDGKEAKKRRKEEKRLRKEERRRRREERYRRRAERHASKQKLKNTDTAAVPSDSEKDRDSDSDVAVRKRGSHAGREESDQKKLEIELREKALETLRAKKAINN

SEQ ID NO: 42719 - protein, 144 aa, Sorghum bicolor
  Clone ID: SORBI-28MAY03-C13422_1.pep
MGEVADMYTQDGTVDRKGNPALKKDTGNWRACPYILANECCERLAYYGMSTNLVHYMKTRLGQVNSVASNNVTNWSGTCYITPLIGAFFADAYLGRFWTIASFMVIYIFGLALLTMASSVKGLVPTSCDNDGVCHPTDAQSAVV

SEQ ID NO: 42720 - protein, 133 aa, Sorghum bicolor
  unsure (1)..(133): unsure at all Xaa locations
  Clone ID: LIB3478-058-Q6-K1-D11.pep
MGEVADMYTQDGTVDRKGNPALKKDTGNWRACPYILANECCERLAYYGMSTNLVHYMKTRLGQVNSVASNNVTNWSGTCYITPLIGAFFADAYLGRFWTIASFMVIYIXGLALMTMASSVKGLVPTSCDNDGV

SEQ ID NO: 42721 - protein, 171 aa, Sorghum bicolor
  Clone ID: SORBI-28MAY03-C13687_1.pep
TLGKFLQLKFLEITLSASNFSPDFDFSSLVSFLDASPALETFILRISMPTIRHDSILEDPDGDSSLLQCLSDCYHDNLKNVMITGFCSAKSMVQLTIHIMQKARSLDCLTLDTTRGHDRRFANIDRCWPLTEEALVEAGKARVAIERYIEAGVPPSVNLKIIEPCSKCTYR

SEQ ID NO: 42722 - protein, 184 aa, Sorghum bicolor
  Clone ID: SORBI-28MAY03-C13792_1.pep
KSKRSDMAVMILRYFNVIGSDPEGRLGEAPRPELREHGRISGACFDAALGIIPGLKVKGTDYETPDGTCVRDYIDVTDLVDAHVKALNKAQRGRVGIYNVGTGKGRSVKEFVDACKKATGVDIKVDYFPRRPGDYAEVYSDPAKINKELNWTAQRTDLHESLRVAWTWQKAHRSGYEPPQAMIL

SEQ ID NO: 42723 - protein, 100 aa, Sorghum bicolor
  Clone ID: SORBI-28MAY03-C1382_1.pep
PILMGFLYNSWANTMEDVRCGQRRRRRSRRVGGPRPTTCCCGLKLKRCSFPGDGNWWFAANEDLAWSWFYAYSQNFMRRLPLPSPPVNRKTTSLVENEHD

SEQ ID NO: 42724 - protein, 156 aa, Sorghum bicolor
  Clone ID: SORBI-28MAY03-C11549_1.pep
PYLVNQNAMGVSSRPPGVLKTESTDSLSRSYGYIGGSTSVDSVLLSSQSKNAQYGLLQSQNDVSGSWSPSQDFDSFGNSLGQGHPGSTSSNFQSSALGKLPDQGRGRNHGFVGKGTCIPSRFAVDEVESPTNNLSHSIGNSGDIVNPDIFGFSGQM

SEQ ID NO: 42725 - protein, 167 aa, Sorghum bicolor
  Clone ID: SORBI-28MAY03-C11600_1.pep
LSEEVMSNRIMHICNEEGLNLDAQALSTLSAISQGDLRRAITYLQSAARLFGSSISSSDLISVSGVIPEDVVKSLLAACRSGEFDVANKEVSNIIADGYPVSQLMAQFLDVIVGADDIPDDQKARICKKLGETDKCLVDGADEYLQLLDVASETIRALFNMPQTLVF

SEQ ID NO: 42726 - protein, 207 aa, Sorghum bicolor
  Clone ID: SORBI-28MAY03-C118763_1.pep
MAITHDDYVSLCLMALAAAGGGGQAAGLTTQYALTNTAACWTATAQESELRFRCSVCGKAFASHQALGGHKASHRKPTPVLQAQASSSSAGGAAASSSGITTSAGGSSGQGRHRCTVCHRSFATGQALGGHKRCHYWDGLSVSLTASSAPSGSGSTVKGFDLNLVPAPAATAANAATRWREEEEVQSPLPVKKRRLSGPSLDLSLTI

SEQ ID NO: 42727 - protein, 404 aa, Sorghum bicolor
  Clone ID: SORBI-28MAY03-C1155_1.pep
GRVGGRVGLCAYSSVDGGGTLFVLGSEDEMDTFTRGVEEETLKNTLKCGVGYVHEGLSELDQELVTQLFLGGRIQVCVASSTMCWGRPLPAHLVVVMGTQYYDGRENAHTDYPITDLLQMMGHASRPLQDNSGKCVILCHAPRKEYYKKFLFEAFPVESNLHHFLHDHMNAEVVVGVVENKQDAVDYLTWTFMYRRLTKNPNFYNLQGVSHRHLSDHLSELVETVLNDLESSKCVAIEEDMYLKPLNLGLIASYYYISYTTIERFSSMLTQKTKVKGLLEILASASEYAELLGRPGEEEFIERLVRHQRFSIEKPKYGDPHVKANALLQAHFSRHTVVGNLAADQREILLSAHRLLQAMVDVISSNGWLSLALSAMELSQMVTQGMWDRDSVLLQVPHFTKDLA

SEQ ID NO: 42728 - protein, 207 aa, Sorghum bicolor
  Clone ID: SORBI-28MAY03-C11883_1.pep
RGKELNRLAGISGTCDFVKADFMKMPFDDNTFDAVYAIEATCHAPDPVGCYKEIYRVLKPGQCFAVYEWCITDHYDPNNATHKRIKDEIELGNGLPDIRSTRQCLQAVKDAGFEVVWDKDLAEDSPLPWYLPLDPSRFSLSSFRLTSVGRMITRTMVKALEYVGLAPQGSERVSNFLEKAAEGLVEGGKKEIFTPMYFFLAQKPVSE

SEQ ID NO: 42729 - protein, 112 aa, Sorghum bicolor
  Clone ID: SORBI-28MAY03-C13960_2.pep
SGHLGPFLGFTPVSLLRPAPSTRAAAPALHARAVERRGQGTGERERERNPRKAKMIYRNWSLLSSTVVIWGGVATAGLAGIFLFGGKEKFNNYLCREGERLRQQDRAAMGRR

SEQ ID NO: 42730 - protein, 72 aa, Sorghum bicolor
  Clone ID: SORBI-28MAY03-C13960_1.pep
RGEAKGRESEREAKMIYRNWSLLSSTVVIWGGVATAGLAGIFLFGGKEKFNDYLCREGERLRQQDRAAIGRS

SEQ ID NO: 42731 - protein, 347 aa, Sorghum bicolor
  Clone ID: SORBI-28MAY03-C14375_1.pep
RPGREYAWNTVANVLYLESPVGVGFSYAANTDVYKGMGDNMTADDSLQFLVKWLDRFPEYKGRDFFIVGESYAGHYVPELATAIIAAKNAGINLKGIAVGNAILEFAAEQAALYEYLWQHAFLSDSAHTLIAQRCKNAEDNSPLCSGARDTAYNQLGNIDVYNIYSSTCHDKNKVKPTGSNCMDLADPCAQYYVEAYLNQPEVLKVIRANTELKYKWTRCRQTFYSLLKFGDSPTKSMLPYIKAVVAGGVRVWVFSGDLDAMVPVIATKQSMEKLGLGVVADWRPWSIDPKDPEVAGYVIEYKGVVFATVRGSGHMVPIDSPARGLALFSSFIKGEPLPKAAPMVDG

SEQ ID NO: 42732 - protein, 165 aa, Sorghum bicolor
  Clone ID: SORBI-28MAY03-C14475_1.pep
MHEGRQKEVELRLLEEETSKRVEQAIRRKVEDSLNCDEIKHEIQRRIEEGRKRIHEEVAIQIEKEKEAALNEAKLKVEREKKEREELEKKLEEERKKAEEALMKEAMEQQQKELERYQELERLQKEREEAMKRKKMEEEQQRQNQMKLLGKNKSRPKLSFAFGMK

SEQ ID NO: 42733 - protein, 142 aa, Sorghum bicolor
  Clone ID: SORBI-28MAY03-C145_1.pep
ECIPERPDQPECQFYMKTGDCKFGAVCKFHHPSCPIIPTPNCALSPLGLPLRPGEPICSFYNRYGMCKFGPNCKFDHPMGSAMYGHASSPTSEAPTSLRMLAHVPSHPEVSPDSGSGRSRRIAHSDSQQIPSVERSTEREAS

SEQ ID NO: 42734 - protein, 306 aa, Sorghum bicolor
  Clone ID: SORBI-28MAY03-C14706_1.pep
TRVHSIVRKFESDSRSRSTVSFLVYCAEVLASLPFTCSDEPLYLIYDINRVIHLRAGGVEGNLKRWTSMSQPQDTAGVPTLPRESHVVMQEPGGYYDSVGYVRERVNDNNPCSTSNVDMAKVQVDVDVAKVQVDVDMTKVQGDCHDAIALQLLLKLKRHLKVVYSLDDARCQAFSLKEPPKSGEAFSRQNVPFNIGNTNISLPSCLQDVASVYQDFKTALREDSMDFAVFIPSVQTRKRPTPRSAANPTPRSTTRVRRTAAPSVTKARGGARGDDSDDADDDDWTGGPRMLDFSGGGRVTRQRVQV

SEQ ID NO: 42735 - protein, 176 aa, Sorghum bicolor
  Clone ID: SORBI-28MAY03-C1241_1.pep
TRVYFSLLPIIGGCALSAVTELNFNMVGFMGAMISNLAFVFRTIFSKKGMKGKSVSGMNYYACLSIMSLVILLPFRPAMEGPKVWAAGWQNAVAEIGPNFVWWVAAQSVFYHLYNQVSYMSLDEISPLTFSIGNTMKRISVIVASIIIFQTPVQPINALGAAIAILGTFIYSQAKQ

SEQ ID NO: 42736 - protein, 223 aa, Sorghum bicolor
  Clone ID: SORBI-28MAY03-C13127_1.pep
MSFLFGKRKTPAELLRENKRMLDRSIREIERERQGLQAQEKKLITEIKKTAKEGQMGAVKVMAKDLIRTRHQITKFYQLKSQLQGVSLRVQTLKSTQAMGDAMKGVTKAMGQMNRQLNLPGLQRIMQEFERQNERMEMVSEVMGDAIDDALEGDEEEEETEELVNQVLDEIGIDINQELVGAPSAAVAQPASAGRVAQAEGTGNADSGIDADLQARLDNLRRM

SEQ ID NO: 42737 - protein, 332 aa, Sorghum bicolor
  Clone ID: SORBI-28MAY03-C13226_1.pep
MHYLMPKRGILSLHSGCNMGKDGDVALFFGLSGTGKTTLSTDHNRLLIGDDEHCWSNNGVSNIEGGCYAKCIDLSQEKEPDIWNAIKFGTVLENVVFDEHTREVDYTDKSVTENTRAAYPIEYIPNAKIPCVGPHPKNVILLACDAFGVLPPVSKLNLAQTMYHFISGYTALVAGTEDGIKEPQATFSACFGAAFIMLHPTKYAAMLAEKMQKYGATGWLVNTGWSGGRYGVGKRIRLPYTRKIIDAIHSGELLTANYQKTEVFGLEIPTEIKGVPSEILDPINTWTDKAAYKETLLRLAGLFKKNFEVFASYKIGDDSSLTDEILAAGPNF

SEQ ID NO: 42738 - protein, 263 aa, Sorghum bicolor
  unsure (1)..(263): unsure at all Xaa locations
  Clone ID: SORBI-28MAY03-C13492_1.pep
MGASPGVAAARRAGAVGQGGGRGGGGGXDGDDGGGASKKKKPHVNHGKFKADPWTDGHATFYGGRDGSGTTDGGACGYKGELGKDYGALTAAVGPSLYTNGAGCGACYELKGSKGTVVVTATNQAPPPVSGQKGEHFDLTMPAFLKIDEEKAGIVPITYRKVACARQGGIRYTITGNPNYNMVMVTNVGGAGDVVALSVKGNKRVKWTPMKRSWGQLWITEVNLTGESLTFRVMTGDHRKATSWHVAPRDWKYDKTYQATKNF

SEQ ID NO: 42739 - protein, 143 aa, Sorghum bicolor
  Clone ID: SORBI-28MAY03-C13543_1.pep
LDGANVEIREEVGEDNFLLFGAKADQIAGLRKDRENGLFKPDPRFEEAKQVIRSGAFGSYDYEPLLDSLEGNSGFGRGDYFLVGYDFPSYIDAQDRVDAAYKDKKKWIKMSILNTAGSGKFSSDRTIAQYAKEIWDIKASPVA

SEQ ID NO: 42740 - protein, 136 aa, Sorghum bicolor
  Clone ID: SORBI-28MAY03-C15003_1.pep
MVHGKLEVLLVSAKGLEDTDFLNNMDPFVILTCRTQEQKSSVANGAGSEPEWNETFIFTVSDETPQLHLKIMDSDVTNDDFVGEATIPLEVVFQEGSLPPAVHPVVKEEKYCGEIKLALTFTPAEETRSPDDSVWS

SEQ ID NO: 42741 - protein, 44 aa, Sorghum bicolor
  Clone ID: LIB3480-054-P1-K1-B3.pep
FQEGSLPPAVHPVVKEEKYCGEIKLALTFTPAEETRSPDDSVWS

SEQ ID NO: 42742 - protein, 93 aa, Sorghum bicolor
  Clone ID: SORBI-28MAY03-C15385_1.pep
KYYAINRHKMTVLTPSYHAESYSPEDNRFDLRQFLYNSRWPYQFRKINELVQEMDKDGKWETSAEGKLRGQTGAQGSGMGVVAAGSANPSAGF

SEQ ID NO: 42743 - protein, 231 aa, Sorghum bicolor
  Clone ID: SORBI-28MAY03-C15394_1.pep
HEEDILSEDKSNDGSDNEGDDEDDGIPVGSDEDENVEVRQKVPAVDPKEQEDFDRELKALLQESLESRKSEARSRLPLNMMVPMNVLEGSKDSRATESESGEETVDEEGGNAGSSSKVRVKVLMKKGHKQQTRQMLIPADSSIVQSTKQQEAAELEEKQSIKRRILEYNEREEEELNGASQMGNWGQGATNTSSIRSGGRGSWDGSTRGGGRQRHHIAGSGGFYHSYGRRR

SEQ ID NO: 42744 - protein, 143 aa, Sorghum bicolor
  Clone ID: SORBI-28MAY03-C1503_1.pep
MTESLVRNKPGMASIKEMPVVQDGPPPGGFAPVRYARRIPTSGPSATAIFLTTFGAFAYGMYQVGQGNKVRRALKEEKIAARSAILPMLQAEEDERFVKEWKKYLEEEARIMKDVPGWKVGESVYNSGKWMPPATGELRPEVW

SEQ ID NO: 42745 - protein, 115 aa, Sorghum bicolor
  Clone ID: LIB3478-026-P1-K1-A7.pep
HPPVTLATASARLIPAGSCRSASGRSGVRIPTTFGAFAYGMYQVGQGNKVRRALKEEKIAARSAILPMLQAEEDERFVKDWKKYLEEEARIMKDVPGWKVGQSVYNFRKWMPPAT

SEQ ID NO: 42746 - protein, 218 aa, Sorghum bicolor
  Clone ID: SORBI-28MAY03-C154_1.pep
ASEFMPLGSGGGGYFQGYGALPWSTDENALGAAKGLAFLHEAEKPVIYRDFKTSNILLDEEYNAKLSDFGLAKDGPVGDKSHVSTRIMGTYGYAAPEYIMTGHLTAMSDVYSYGVVLLELLTGRKSLDKSRPVREQMLADWAFPLLTQKKKVLGIVDPRLAEDYPVKAVQKTSMLAYHCLSHNPKARPLMRDIVATLEPLQQLEETPSDSVAMTLQGT

SEQ ID NO: 42747 - protein, 129 aa, Sorghum bicolor
  Clone ID: SORBI-28MAY03-C15466_1.pep
MAHYHPKEAYGDLEAGFSGHSSSSSSPLKPAASPRRPGRMFCDPCDDADELHGHHHYLDICFRCRKLLSGNRDIFMYRGDMPFCSEECRQEQIEIDEAREQRLKQTGRAEQQRQRQQKQNPQRIPIWAW

SEQ ID NO: 42748 - protein, 193 aa, Sorghum bicolor
  Clone ID: SORBI-28MAY03-C13907_1.pep
MVGVLSNRVDRDDLKAGDHIYTWRAAYIYAHHGIYAGHGMVIHFTRAAGHEIGTGTFLDWFLYSSSPAATEGPPCQKCGHLVKSDGVITSCLDCFLDGGSLYLFDYAVSPAFFLAKARGGTCTLAASDPSDVVIHRARYLLDNGFGMYSLFKNNCEDFAIYCKTGLLVETAFSVGRSGQLASLTAAFSAVASS

SEQ ID NO: 42749 - protein, 397 aa, Sorghum bicolor
  unsure (1)..(397): unsure at all Xaa locations
  Clone ID: SORBI-28MAY03-C13911_1.pep
MGCFTFRSGGGSKSQHPRSGARTPAAKSTPASSSSSSPSSSGGARGKTKASAASTPTRTIQELSEERGAQRLRVFDLDELGSATXRQFSRALKLGEGGFGSVYRAFFRSASGARVVLAVKRLNQRSLQGHKQWLAEVQFLGVLEHPNLVKLIGYCAVDSEASKHRLLVYEFMPNKSLDDHLFNRAHPPLSWRQRLQIMIGAARGLDYLHEGVPEVQVIYRDFKASNILLDAEFKPKLSDFGLAREGPTEGKTHVSTAVVGTHGYAAPDYIETGHLTAKSDVWSFGVVLYEILTXGRRSLERSRPAEEQKLLGWVRQHPPDSAGFRAIMDPRLGGRYPLAAAREVARLADRCLGKNPKERPSMRDVVEELERVLQMEPPPPLAADKKKGGDGRLPTKR

SEQ ID NO: 42750 - protein, 80 aa, Sorghum bicolor
  Clone ID: SORBI-28MAY03-C14001_1.pep
MPATPTIIGALLGLGTQMYSNALRKLPYMRHPWEHVLGMGLGAVFVNQLVKFDEKLKEDLDKMLERARLANEQRYIDDDE

SEQ ID NO: 42751 - protein, 233 aa, Sorghum bicolor
  Clone ID: SORBI-28MAY03-C13925_1.pep
MAKTTILLLLLLLLLSSILVVADQAATTATQLSPAAEKSIGDLNLEVEKVIDVVVSAAPPAKQMETMHAALKHLQPIKSALAKAKESGDEKKIAKLVFRVEIAAAIINAAPADKKLMMMEDSFNSVAAPSPLDCPTVDKAYCETDSKIQKAFDGVVAAAPVEKRLEVRATILKKTMYTAGSTINKAYADGDEKKIAQVLAAYSKAADEVIAAAPADKLTIMEKTFIAAAATGN

SEQ ID NO: 42752 - protein, 112 aa, Sorghum bicolor
  Clone ID: LIB3480-009-P1-K1-C12.pep
SKTTILLLLVLLLSSILVVADQAATTATQLSPAAKKSIGDLNLEVEKVIDVVVSAAPPAKQMETMHAAAIINAAPADKKLMMMEDSFNSVAAPSPLDCPTVDKAYCETDSKI

SEQ ID NO: 42753 - protein, 96 aa, Sorghum bicolor
  Clone ID: SORBI-28MAY03-C14278_1.pep
WNYYDIKINFIFDVLKIALFIQLFMMEFVCWVWENRCIAYLSPYWPSCSIVAVHALLQFLIAACYRLAGRRCLDMCMLHEQVWTLHSPVALIRQTL

SEQ ID NO: 42754 - protein, 185 aa, Sorghum bicolor
  unsure (1)..(185): unsure at all Xaa locations
  Clone ID: SORBI-28MAY03-C16112_1.pep
LXNEIYNKVEYLKSIMGRNQDAILAACLYIACRQEDRPRTVKEICSVANGATKKEIGRAKEFIVKQLEVEMGQSMEMGTIHAGDFLRRFCSTLGMNNQAVKAAQEAVQRSEELDIRRSPISIAAAVIYMITQLSEDKKPLKDISLATGVAEGTIRNSYKDLYPYAARLIPNTYAKEEDLKNLCTP

SEQ ID NO: 42755 - protein, 358 aa, Sorghum bicolor
  Clone ID: SORBI-28MAY03-C16318_1.pep
PPKTLEITGRGSKTQRPPCCPLPHHHHHTLLPAAMSATATDEAAVEARLQALRQRLGKKQHFEEAVNELAAAVRDRYAGASPTLRKSMYSTVCRVATVLQTRYTAPGFWRAGLNLFMGTEKLVSNPAEKEHLKTCISRAREHLDEKENEDSMPSSREADTRFLFEGHLTVGQEPPPPAWLVAQNLTRELSILTESSGDQDGNSNRTVPRAEEITPAIMNLLESISGDRDLETALEESLQGIIEHPPRAPPASKEVVANLPVIAVTEEVIARLGSETECAVCRENLVVDDKMQELPCKHLFHPPCLKPWLDENNSCPICRHELRTDDHVYESRKEREKEEEEDRRGAANAVRGGEFMYI

SEQ ID NO: 42756 - protein, 216 aa, Sorghum bicolor
  Clone ID: SORBI-28MAY03-C16401_1.pep
MAAPPSRSRGDYDHLIKLLLIGDSGVGKSCLLLRFSDDTFTTSFITTIGIDFKVRTVELDGKRVKLQIWDTAGQERFRTITTAYYRGAMGILLVYDVTDESSFNNIRNWIRNIEQHASDNVNKILVGNKVDMDAKRVVSTAQGQKLADEYGIKFFETSAKTNQNVEQVFFTMARDIKQRLTETVAAATEPPTIQISRPDPDQAGTASSRWSSCCNT

SEQ ID NO: 42757 - protein, 168 aa, Sorghum bicolor
  Clone ID: SORBI-28MAY03-C165_1.pep
QSASLPLPSRIQIIGREVLIPPAFIRTTTADSLGFSSMSAAAAGQEVAPAIVAVAEAEEWEVCACCGLREECTPAYAAGVRARYVGHWLCGLCGDAVGEEVAAGGGSVLEVEAAIAGHAAFCRALGGGTPAAAERLIAAVRRLLRNADAGAKQEDKAVVVVEFQEAAS

SEQ ID NO: 42758 - protein, 116 aa, Sorghum bicolor
  Clone ID: SORBI-28MAY03-C16501_1.pep
VERVRQELKHELKQGYRDKLVDIREGTWRKRRAGKLPGDTASTLKAWWQAHSKWPYPTEEDKARLVQETGLQLKQINNWFINQRKRNWHNNPASSSSDKSKRKRSTAGDGNAEQSW

SEQ ID NO: 42759 - protein, 382 aa, Sorghum bicolor
  Clone ID: SORBI-28MAY03-C14824_1.pep
MGVEEAGRAATGKKLALASIGFADVRVGAAVPGGAGVYKDGLLVVGLPVPKDDGLDAAARVVGDLAARLPDVGAAARTFLRNREVAEFVSGALAGAMTKAVLAPLETIRTRMVVGVGSKHIFGSFVEIVEHNGWQGLWAGNTINMLRIIPTQAIELGTFECVKRTMASAQEKWKEDGCPKIQLGNLKIELPFHLLSPIAIGGAAAGIASTLVCHPLEVLKDRMTVNRQAYPSIAIAINKIYRTDGLGGLYAGLCPTLVGMLPYSTCYYFMYETIKTSYCRAHKKKSLNRPELLIIGALSGLTASTISFPLEVARKRLMVGSLQGKCPPHMIAALAEVVQEEGVKGLFRGWAASSLKVMPTSGVTWMFYEAWKELLLGSRLHA

SEQ ID NO: 42760 - protein, 511 aa, Sorghum bicolor
  unsure (1)..(511): unsure at all Xaa locations
  Clone ID: SORBI-28MAY03-C14977_1.pep
WAASPTSSLAPPVVPMELHAGNRDRLVAALRGHLSASARPLHGLVLLQGGEEKTRYCTDHLELFRQESYFAYLFGVREPGFYXAIDIASGQSILFAPRLPADYAVWMGEIQPLSYFRDTYKVNMVFYVDEIAQVVQDRFGDHGKPLLFLLHGRNTDSGNFSKPASFEGIEKFDTDLSTLHPILTECRVIKSDLELALIQYANDVSSEAHIEVMRRARPGMKEYQLESIFLHHVYMYGGCRHCSYTCICATGDNSAVLHYGHAAAPNDRTLNDGDMALMDMGXAEYHFYGSDITCSYPINGKFNSSQIIIYNAVLKAHNAVISHMRPGVNWMDMHKLAERAILESLRKEQIVQGDVDDMMVQRLGAVFMPHGLGHLLGIDTHDPGGYPEGLERPKDPGLSSLRTTRELKEGMVITVEPGCYFIDALLNKTRDDPISSKFFNWQEVEKYRNFGGVRIESDVYVTAQGCRNLTNCPRETWEIEAVMAGAAWPLPASSSMAAAAAENRNGISKAL

SEQ ID NO: 42761 - protein, 437 aa, Sorghum bicolor
  unsure (1)..(437): unsure at all Xaa locations
  Clone ID: SORBI-28MAY03-C1494_1.pep
MEATTALALSSSLATARRSPEKAAAASSLRLRNFSATSSLHHLRAARSPAPRSHPSSSPFQGWRRRGRAGGLVVRAEMFGQLTTGLESAWNKLRGVDILTKENIAEPMRDIRRALLEADVSLPVVRRFIESVSEKAVGTDVIRGVRPDQQLVKVVNDELVQLMGGEVSDLVFAKSGPTIILLAGLQGVGKTTVCAKLAFYLKKMGKSCMLVAADVYRPAAIDQLTILGKKVGVPVYSEGTEAKPSQIAKNGLKEAKVNKADVIIVDTAGRLQVDKSMMNELKEVKKAVNPTEVLLVVDAMTGQEAAGLVSSFNDEIGITGAILTKLDGDSRGGAALSVKEVSGKPIKFVGQGERIEDLEPFYPDRMAQRILGMGDVLSFVEKAQEVMRQEDAEELQKKILSAKFNFNDFLKQTXMIAQMGSFQRLIGMIPGMNKVPL

SEQ ID NO: 42762 - protein, 376 aa, Sorghum bicolor
  unsure (1)..(376): unsure at all Xaa locations
  Clone ID: SORBI-28MAY03-C14826_1.pep
MAGAGGSGGGGVVRDVEALDGVRSIVLKPSESLDESRFTRIAGADFNDPGLGLEGLLASLASTGFQASNLGDAIDVVNQMLDWRLSHEKPSEDCDDAELDPKYRESVKCKIFLGFTSNLVSSGIRDIIRFLAQHHMVDVIVTSAGGIEEDLIKCLAPTYRGDFSLPGALLRSKGLNRIGNLLVPNDNYCKFENWIMPLFDQMLLEQSTENVWTPSKVIASLGKEINDESSYLYWAYKNNIPVYXPALTDGSLGDMLFCHAVRNPGLIIDIVQDIRLMNGEAIHATPRKTGIIVLGGGLPKHHICNANMFRNGADYAVYINTAQEFDGSDSGAQPDEAVSWGKIKGSAKPVKVHCDASIAFPLVVAATFARKVHGSK

SEQ ID NO: 42763 - protein, 72 aa, Sorghum bicolor
  Clone ID: LIB3480-026-P1-K1-G7.pep
NANMFPNGADYAVYINPAQEFDGSDSGAHPDEAVSWGKIKGSAKPVKVHCDASIAFPLLVAATFARKVHSSK

SEQ ID NO: 42764 - protein, 311 aa, Sorghum bicolor
  Clone ID: SORBI-28MAY03-C15014_1.pep
MVLLRVCHRFGRPPRFLSFLSMAAPQQPGKTLPRPCPSPPLSGSAPKRFRAMATDVAAAAVDPPAARGCPAMKAEFAKHAEYLNALNDKRERLVKASRDVTMNSKKVIFQVHRITKVNRDEVLSKAENDLAAVVNQYIAKLVKELQGTDFWKLRRAYTFGVQEYVEAATLCRFCKTGTLLSLAEINDSLLALSDKSDEPLQLNVLDYLLGVADLSGELMRLAIGRISDGEVEYAKTICAFVRDIYRELTLVVPLMDDNNEMKKKMEVMLQSVVKIENACFSVHVRGSEYIPLLGSSGDPDYSFFGASDFDQ

SEQ ID NO: 42765 - protein, 135 aa, Sorghum bicolor
  Clone ID: SORBI-28MAY03-C17010_1.pep
HACIRFATTHQHITAVSQFSNQSPVQALQTKAQVQRRHTTFQTLCLTFSFPSQDSLHRYTVASNRSTIFSVFPCLHSSARFILDNPAGALLVEDAVATLTALDDISGLQGVLSSTISAEVADGLRLLRIHGCRAL

SEQ ID NO: 42766 - protein, 121 aa, Sorghum bicolor
  Clone ID: SORBI-28MAY03-C17043_1.pep
MNPRGYRSNRTSLFDGIEEGGIRATSYSSHEIDEQENDRAIDGLQDRVSILKRLSGDIHEEVETHNRMLDRMGNDMDASRGFLSGTVDKFKMVFETKSSRRMGTLVASFVALFLLVYYLTR

SEQ ID NO: 42767 - protein, 376 aa, Sorghum bicolor
  Clone ID: SORBI-28MAY03-C17099_1.pep
PAAAPPPPPPPQADPAPRRPGPGLPASACRGPRRRGRGPRGPPAPPPPRPPGGPPAAGPRPAPGPPPGGPPPPAPRAAGPGGGPPAPPPPPPPPPPAPPPPPPPPPPPPAPPPPPPPPPGPPAPPPPPPPPPPPPPPPPPPPPPPPGGRPGLRPHGARRDRCPPRRAPLPPAPPAPLVPARAVPRPPVRRAGVKAYAEKMHDVIVGVAGELASSLGLEKHSFQDWPCQFRINRYNYTQETVGSSGVQTHTDSGFLTVLQEDECVGGLEVLDPATGEFVPVDPVAGSFVVNIGDVGTAWSNGRLHNVKHRVRCVAPVPRISVAMFLLAPKDDGVSAPEAFVDEDHPRRYKAFNYDDYRRLRLSTGERAGEALARMAA

SEQ ID NO: 42768 - protein, 267 aa, Sorghum bicolor
  unsure (1)..(267): unsure at all Xaa locations
  Clone ID: SORBI-28MAY03-C17223_1.pep
MAMDAERRQAELIAQFSAQAAALSSAPQLAALVLEATSHPALFAFSELLTLPALSKLAGTQYASSLDLLRLFAYGTLKDYKSNSGSLPALLPDQVRKLKQLSVLTLAESTKILPYDQLMQELDVSNVRELEDFLINECMYSGIVRGKLDQLRRCFEVQFAAGRDLTPDQLNNMIETLSDWLGTSDSLLHQIQEKIKWADTMSEVNKKPQKEFEDRVEEAKKSIKKLNNLXQADIDLRGHDDFLSESGGIMDFEEARVRPKRRRQPPA

SEQ ID NO: 42769 - protein, 522 aa, Sorghum bicolor
  Clone ID: SORBI-28MAY03-C17328_1.pep
HEVDKNLGSNNDRWIVARNESDANLEAQKKYPGTKLRLDQDPDVLDTWFSSGLFPLTVLGWPSDTADLRAFYPTSVLETGLDILFFWVARMVMMGIQLGGDVPFQKVYLHPMIRDAHGRKMSKSRASVVDPLEVINGMSLDGLLKRLEEGNLDPNELNIARDGKKKDFPDGIAECGTDALRFALISYTSQSDRINLDIKRVVGYRQWCNKLWNAIRFAMGKLGDHYIPPATVDVSLMPPICKWILSVLNKAVGKTVTSLEAYKLSDATSAIYSWWQYQLCDVPARPGKPYFFNDSQEFESARAASRDTLWICLETGLRLLHPFMPYVTEELWQRLPQPKDSCRKDSIMISEYPSPVEEWSNGGLENEMDIVLDAVNKIRSLKPPTDSNERRPAFALCRGQEIAATIQCYQSLIVFLSSISHLKILTENDETPADSATAVVNKDLSVYLQLQGALNADAEREKLRKKKDEIQKLQNALAQKMDASGYREKAPQSVQEEDMRKLTALLEQLEVISEAEKKLDAN

SEQ ID NO: 42770 - protein, 230 aa, Sorghum bicolor
  Clone ID: SORBI-28MAY03-C17410_1.pep
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFSVPAMYVAIQAVLSLYASGRTTGIVLDSGDGVSHTVPIYEGYALPHAILRLDLAGRDLTDSLMKILTERGYSFTTTAEREIVRDIKEKLAYVALDYEQELE

SEQ ID NO: 42771 - protein, 73 aa, Sorghum bicolor
  Clone ID: SORBI-28MAY03-C15631_1.pep
EITCMDVVQRFLMYISLTFFFMITDTPTVSSACTCIYTHIKGGGICYHVLVSMYGLTPLVLPSFLVFSILQIL

SEQ ID NO: 42772 - protein, 369 aa, Sorghum bicolor
  Clone ID: SORBI-28MAY03-C15869_1.pep
MAMMVDPPNGMASQGKHYYTMWQTLFEIDTKYVPIKPIGRGAYGIVCSSVNRETNEKVAIKKINNVFDNRVDALRTLRELKLLRHLRHENVIALKDIMMPAHRRSFKDVYLVYELMDTDLHQIIKSSQPLSNDHCQYFLFQLLRGLKYLHSAGILHRDLKPGNLLVNANCDLKICDFGLARTNNTKGQFMTEYVVTRWYRAPELLLCCDNYGTSIDVWSVGCIFAELLGRKPIFPGTECLNQLKLIVNVLGTMSEADLEFIDNPKARKYIKSLPYTPGIPLTSMYPQAHPLAIDLLQKMLVFDPSKRISVTEALEHPYMSPLYDPSANPPAQVPIDLDIDENLGVDMIREMMWQEMIHYHPEVLTRMTM

SEQ ID NO: 42773 - protein, 358 aa, Sorghum bicolor
  Clone ID: SORBI-28MAY03-C15872_1.pep
DRGTNARVQKGFVVKDAGGAGMVLANTAANGEELVADAHVLPGSGVGEKAGNAMRDYAMSDPKATATIVFAGTKVGIKPSPVVAAFSSRGPNTVTSSILKPDVIAPGVNILAAWSGSVGPSGLPGDSTRVGFNIISGTSMSCPHVSGLAALLRAAHPEWSPAAIRSALMTTAYNDYPGGAGILDVATGRPATPLDVGAGHVDPAKAVDPGLVYDISRADYIDFLCANNYEPAQIAALTRQHPSEGCSANRTYTVTALNYPSFSVAFPAAGGTVKHTRTVTNVGQPGTYKVTASAAAGSAPVTVSVEPSTLSFSKAGEKQSYTVSFTAGGMASGTNGFGRLVWSSDHHVVASPIAATWT

SEQ ID NO: 42774 - protein, 191 aa, Sorghum bicolor
  Clone ID: SORBI-28MAY03-C16_1.pep
STSTCSNSTEARYFAAVVPLLNSIRLLIYGLRLYTDEALVKSVTREGKPEELLRGPLYYVLVLLFSVLVFWRESPVGIVSLSMMSGGDGFADIVGRRYGSVKLPFNKKKSWAGSISMFISGFLLSAMMMFYFSSLGYIDVIWQEALGKLALVALAATVVECIPVTEVVDDNISVPLATMLVAFLLFSSNAQ

SEQ ID NO: 42775 - protein, 535 aa, Sorghum bicolor
  Clone ID: SORBI-28MAY03-C1608_1.pep
MKPPIPTSKQTASMADDPFVVLETASASGSSYTSPGRSTDTVEDLDKSARFDGKAANNIADDDSLFEESSAFDQAPKSDPLFTSEFNGHAKDTDPPSGARDSSPLHHSMDRNPARQSSMEDFSNTMPNSQSARYSDIRGNDMEDQSPRSTESEDDIWLTASEIPLFTAPTTAPPPSRSPPFLKRKPLGATANGKENGHARQSSQNRNYYTDLPKQPEVSSIDDVEGFAMGKPQMPAYDNNAFDEDFERSSSDPEERDRQARGEKEREMKQREEMERERRRLEKERELEQQRERERERQAVERATKEARERAAAEARAKAEREARQRAQRAAVQRAQQEARERAAVDAKERAARVAAEARERAAAEARDKAAAEAREKAAAEAKERERTAARERAAAERAATERAQQEARKRAERAAVERAAAEARERQAAAAAAAAAASREKQSTPDDLESFFGVGARANSAPKQRAPTPTVDSMFGFGAQGTGTTNGSQRAASTSAPVRKVASATSFGDDLSDLFGAPASSDVFQEVQGESEER

SEQ ID NO: 42776 - protein, 136 aa, Sorghum bicolor
  Clone ID: SORBI-28MAY03-C17862_1.pep
MDPSGGAFLPQLQAGSSSFPRSSSNTSLARTGSAGRGRGGTRGRKMMRRVCRGVITFIFAIAGLFLGAVTGGLIGLATESGLFRGTGIGAITGALVSIEVVDSSIRLWQSRRSGIWSILYVLNVIYSLLTGRLVRE

SEQ ID NO: 42777 - protein, 117 aa, Sorghum bicolor
  Clone ID: SORBI-28MAY03-C18098_1.pep
RPGCEWCRPGLEKRKQKIPNLGRQQIRGARYHAYLNMPSRNKISVAMLSLALMGLLLCHLATTASAATDSEDGSVRDGGSPAPDSGEGRVVYADMRLADSESSSSDAPASALAPSSS

SEQ ID NO: 42778 - protein, 91 aa, Sorghum bicolor
  Clone ID: SORBI-28MAY03-C17897_1.pep
MVKAVAIVVALALAMVVAMSVGRVSANCNIALLAVCKTAVIGGLKPTVTCCSILRAQEACLCKYQKDPKYGMYINPARKMITSCGMAIPNC

SEQ ID NO: 42779 - protein, 164 aa, Sorghum bicolor
  Clone ID: SORBI-28MAY03-C1839_1.pep
RRRRGATLVRAGSRVTWEGFSDASDADLIAEHEIWAAVDPFAKNEAFNCSNGDIFKWKQLWPILADHFGVEWAGYEGEAHGLGLERALPRQQPGWPQVVAAVALPPPALRGGAGWGSGGAVPALAPRRLGRVGPRVGRGRRGVPAPAAAAASGGQLVVRRQIVP

SEQ ID NO: 42780 - protein, 228 aa, Sorghum bicolor
  Clone ID: SORBI-28MAY03-C17946_1.pep
MAAAALRSSAARRLLRLAPAASSALSAASRPTAGVAPLSRPFAALSGGNNPISWKPRRFFSSNEKHLPAISDPEIESAFKDLLAASWNELPDSLVEEAKKAESKATDDNAGQEALKNVFRAAEACEEFSGTLVTLRMALDDLCGLTGENVGPLPGYIEDAVKAAYNRYMTYLESFGPEENYLRKKVETELGTKMIHLKMRCSGIGSEWGKISLIGTSGISGSYVELRA

SEQ ID NO: 42781 - protein, 301 aa, Sorghum bicolor
  Clone ID: SORBI-28MAY03-C16656_1.pep
MGAAAASAPFLLSGDLTPCRSVYDGVSPGSLALSRCGCRACTGTCVPLADSGATVFPPLALSYEDTSNTCFQLYGVRPRPHWITTEYGGYKIDKVLKRFGSNIIFSNGLRDPWSRGGVLKDISSSIVALVTEKGAHHLDLRSTCNKIEDGDDPHGLDGWQWQACTEMIMPMTVSNESMFPPSSFSYDERSDECFQSWGVRPRPHWITTEYGGYKIDKVLKRFGSNIIFSNGMRDPWSRGGVLKNISSSIIALVTEKGAHHLDFRSSTKGDPDWVIEQRRQEVDIIQGWIDQYHQDMAETSS

SEQ ID NO: 42782 - protein, 116 aa, Sorghum bicolor
  Clone ID: SORBI-28MAY03-C16711_1.pep
TSYTSVTNYNFLSLQAKFKARATVIMATFFSLTAPMGIALGIAITSSYSKHSDTALVVEGVFNAAAAGILIYMSLVDLLAADFSNPRLQTNMKLQLATYIALFLGAGLMSLLAKWA

SEQ ID NO: 42783 - protein, 226 aa, Sorghum bicolor
  Clone ID: SORBI-28MAY03-C1700_1.pep
ASAISYALDIAHAMDCLHANGIIHRDLKPDNLLLTANRKKLKLTDFGLAREETVTEMMTAETGTYRWMAPELYSTVTLRRGEKKHYTNKVDVYSFGIVLWELLTNRMPFEGMSNLQAAYAAAFQQKRPALPEETPQELVFIVQSCWVEDPAMRPSFSQIIRMLETFLMTIPPPPISEPNEDEESEETRSSLSSRSSSGSSLVSRATSKLSVVRHLFASKKTGNGKA

SEQ ID NO: 42784 - protein, 175 aa, Sorghum bicolor
  Clone ID: SORBI-28MAY03-C16822_1.pep
MSSSISMMEARMPPGFRFHPRDDELVLDYLLDKLSGHGHGGGAAIVDVDLNKCEPWDLPESACVGGKEWYFFNLRDRKYATGQRTNRATRSGYWKATGKDRAVVAGGDGGEDAAAVVGMRKTLVFYRGRAPKGRKTEWVMHEFRLHPHAAPSLPAAATKVITWICKHILLHTSYI

SEQ ID NO: 42785 - protein, 95 aa, Sorghum bicolor
  Clone ID: SORBI-28MAY03-C16979_1.pep
MASTSASGRLLFSLSLVVLVLLVETTAPHGQAEAIDCGASCAYRCSKSGRPKMCLRACGTCCQRCGCVPPGTSGNENVCPCYANMTTHNGKHKCP

SEQ ID NO: 42786 - protein, 370 aa, Sorghum bicolor
  Clone ID: SORBI-28MAY03-C18716_1.pep
MAPVEAEQHPRTALALAAHDASGRVSPIRISRRDTGDDDVAIQILYCGICHSDLHTIKNEWKNANYPVVPGHEIAGLITEVGKNAKKFNVGDKVGVGCMVNTCQSCESCEEGHENHCSKIIFAYNSHDRDGTITYGGYSDMVVVNERFVIRFPDGVPLDKGAPLLCAGITVYNPMKYHGLNELGKHIGVVGLGGLGHVAVKFAKAFGMRVTVISTSPEKREEAMETLGADAFVVSSDANQMKAVKGTMHGILNTASASMSMYAYLALLKPQGKMILLGLPEKPLQISAFSLVTGGKTLAGSCMGSIRDTQEMMDFAAKHGLVADIELIGTEEVNEAMERLAKGEVRYRFVIDVGNTLSAASLASSPVPAL

SEQ ID NO: 42787 - protein, 178 aa, Sorghum bicolor
  Clone ID: SORBI-28MAY03-C18784_1.pep
MGAEEDAAARRERLRALRAAKELLSTPDGAPTPATDGEQQNGNHEMAEELALPGPQDASDEAAKEDGSPTEEAEEVEDDGELPAMKFRNYLPHDEQLRGGKLAPVSLPKFEDPISAETAEPKEVENPFGNIAPKNPNWDLKRHVQKRIDKLERRTQKALAEIALEQQREKEALEESQD

SEQ ID NO: 42788 - protein, 242 aa, Sorghum bicolor
  Clone ID: SORBI-28MAY03-C18840_1.pep
RPGRERGKEIELEAQAIRKPFLVSSPSSIRAASSSAAAAMARKRKTDAAPRLDEADRTLYSTFCGAANSLSQLYTQAMAQQKLSFQAGERHALEKLYQWILRKHDEEARLTVAEIMSHIQHEIDYGGTDAHVSPRVNQHPQIANPFTNSVVPPGTGLYGQSAPGFAPRPSVTDQSKNTIFSNALSSPVRRSLQNYHITQGAGNGGRNAEANLAGANRETNSASSNDTSMDMVADSAGNEFYQ

SEQ ID NO: 42789 - protein, 259 aa, Sorghum bicolor
  Clone ID: SORBI-28MAY03-C1916_1.pep
MSLQCVAHAVRALAVLPAPASPRRRTSHVSLSLPSRRPGLAVAPVRAAESSSPPAVPASAAGKAVVPDDEFSLAKVSFGVIGLGVGLSLLSYGFGSYFNLLPGSEWSALLLTYGFPLTIIGMALKYAELKPVPCITYADAFALREKCATPILKQVRSDVTRFRYGDEQHLDEALQRIFQYGLGGGIPRRSAPILQKIREEVTEDGKYSLVLVFEAKALELSDFEKRQAKFTSFFGVGIKAEIGKDGNDLYEVRLISETT

SEQ ID NO: 42790 - protein, 187 aa, Sorghum bicolor
  unsure (1)..(187): unsure at all Xaa locations
  Clone ID: SORBI-28MAY03-C1944_1.pep
ELVPAASDDCFKCGRPGHWARECPYSDGSGRTGTSAPAXRYGGGTGGRGDRFGGSDRFARYDDDRYDGGRYVDSRDTYYGAGRDRYASDRYAPAADRYSGDRYSGADRYASSGFARERSYERDGGRSNGGYYRDDPRGTGGYGRGGSRGGGGGGGPARFGGSYRDRPAPYDRPSRGGGAARAYDDRY

SEQ ID NO: 42791 - protein, 157 aa, Sorghum bicolor
  Clone ID: SORBI-28MAY03-C17495_1.pep
MGFISFVGRVLFASLFLLSAYQEFIEFGNDGGPAAKTLKPKFNLFVKLVSKNTGLGVPHIDIKTVIAATMFLKGFGGLLFIFSSSFGAFLLLIYLAFMTPIVYDFYNYEMESEQFVQLFFKFTQNLAFIGALLFFLGMKNSIPRRRSKGRTTKTKTN

SEQ ID NO: 42792 - protein, 118 aa, Sorghum bicolor
  Clone ID: SORBI-28MAY03-C17535_1.pep
MARSMKLAVAIAVVAAVAAATTSEAAVTCGQVSSAIGPCLSYARGQGSGPSAGCCSGVRSLNSAARTTADRRAACNCLKNAARGIRGLNVGKAASIPSKCGVSIPYTISTSTDCSRVS

SEQ ID NO: 42793 - protein, 297 aa, Sorghum bicolor
  unsure (1)..(297): unsure at all Xaa locations
  Clone ID: SORBI-28MAY03-C1756_1.pep
MPATARSATPRGEALFVLAXLGRKLDSLPSDLAAAIESGRIGGDIGARFNELEANGFIKWLLTFKGFRERLLADELFLTKLGIECGIGLVAKTAAELQKRGDNFFKEIEVVISDVVMAIVADVMLVYLPAPTIGLQPPIARNASAIASFFSSCPDNAFQTSVAGRSFTLVQRIGAFVRNAAKLLVVGTTASLVGTSVTSAALKAKAAVNKDEAVEIPVLQTSIAYGIYMSISSNLRYQLLAGVLEQRILEPLLHNQKLLLSAMCFMVRSGNTFLGSLLWIDYARWIGVQKGHDHEEA

SEQ ID NO: 42794 - protein, 233 aa, Sorghum bicolor
  Clone ID: SORBI-28MAY03-C17624_1.pep
MAAKSLVVLALLALLASASANDSAPYSSLLIPQCSQSPIATGIPLLPTINQVAAANLIAYLQQRQFLSFNQLAGANPVAYLQTQQLLPLNQLAIVSPASLLQQQQFLPFNQLVGVNPIAYLQPQQLLPFNQLALGSPAAFLQQQQLLALYPQAMANIAAFLQQQQLLPFYPQVVANIVPFLQQQQQQLMPFYPQVVPNIDAFLQQQQLLPFSQLPLTNPTALLQQPIIRGAIF

SEQ ID NO: 42795 - protein, 344 aa, Sorghum bicolor
  Clone ID: SORBI-28MAY03-C17849_1.pep
MLAGISRFLTRHRPPFPLAATATAAAAAMSSSSTAANVSDRPISPDTTRVAWVGTGVMGQSMAGHLLSAGYALTVFNRTASKTQSLVSRGASLADSPRAAASAADVIFLMVGFPSDVRSTALDPSTGALSGLAPGGILVDMTTSDPTLAAEIAAAAAAAGCSAVDAPVSGGDRGARNAALSIFAGGDAAVVARLAPLFKLMGNALYMGGPGAGQRAKLGNQIAIASTMVGLVEGMVYAHKAGLDVAKWLEAISTGAAGSKSLELYGKRILERDMAAGFYVRHFVKDLGICLSECQAMGLSLPGLALAQQLYVSLMAHGEGGLGTQALILAVERLNNTSLEKKDE

SEQ ID NO: 42796 - protein, 361 aa, Sorghum bicolor
  Clone ID: SORBI-28MAY03-C1993_1.pep
MAMAAEWWDAATAAVAAYTGMTPAAFFTAVAVAAALYVAISGLLARPAQTSSTRQEVAAAEEEERAFEPLPPPVQLGEVTEEELRAYDGSDPNKPLLMAIKGQIYDVTQSRIFYGPGGPYALFAGRDASRALAKMSFEASDLTGDISGLGPFEVEALQEWEHKFKSKYVRPRVRKKTVPLSEGDDTARNAVTTERDIDASTTESNNVPEPNETGITDQGSVAEKIAESPDVDVNTSSHEDTEEKAKELPDSDVTNTIGQVDAVEKPEGTPNAVVKNRRSIEDAVEPKETPQVVDGKDTCEPEGATVKPEEAADAIELKNTTSHEDAKQPKEIRNEDEKDVTSYQHGEENPKETSDVEVNNA

SEQ ID NO: 42797 - protein, 195 aa, Sorghum bicolor
  Clone ID: SORBI-28MAY03-C20200_1.pep
MVDVSRVQKELTECNRDREVSGVSIALHDGANISHLTGTIAGPADSPYEGGTFVIDIRLPGGYPFEPPKMQFVTKVWHPNISSQNGAICLDILKDQWSPALTLKTALLSLQALLSSPAPDDPQDAVVAQQYLRDYPTFAATARYWTEAFAKSASTGMEEKVQKLVEMGFPEDLVRSTLKSVDGDENMALEKLCSG

SEQ ID NO: 42798 - protein, 173 aa, Sorghum bicolor
  Clone ID: SORBI-28MAY03-C20240_1.pep
MGDERVKAEALQILGLFQVLPRLVVFDLDYTLWPFYCECRSKRDSPSLFRHARGIIYALKEKGIDMAIASRSPTPDKAKVFLDKLELQSMFVAQEIFSSWTHKTEHFQKIQRKTGIPYKSMLFFDDEDRNIDPVSNLGVTSVLVENGVNLDMFKLGLSNFATKYAASSRKEDE

SEQ ID NO: 42799 - protein, 119 aa, Sorghum bicolor
  Clone ID: SORBI-28MAY03-C2042_1.pep
ARGFILVPSIFEPCGLTQLIAMRYGSVRIVRKTGGLYDTVFDVDNDKDRAQAQGLEPNGFSFEGADSSGVDYALDRAITTFYDARDWFNSLCKRVMEQDWSWNRPALDYMELYHSARKN

SEQ ID NO: 42800 - protein, 288 aa, Sorghum bicolor
  Clone ID: SORBI-28MAY03-C20505_1.pep
MAAVQRLLRAAASGGSAAARRRMTSLATEQAPSAAAGFPFAAEERARRLPMAERNVQWVFLGCPGVGKGTYASRLSRLLGVPHIATGDLVRDELASTGPLATQLAEIVNQGKLVSDEIIFNLLSKRLKKGEDQGESGFILDGFPRTVKQAEILDGVTDIDMVVNLKLREDVLVEKCLGRRICGQCGKNFNLACIDVKGENGLPAIYMEPLLPPNNCMSKLITRADDTEEVVRNRLRIYNDMSQPVEGFYREQGKLLEFDLPGGIPESWPKLLQVLNLEDQEELKLAAA

SEQ ID NO: 42801 - protein, 333 aa, Sorghum bicolor
  Clone ID: SORBI-28MAY03-C20542_1.pep
LVALLLAPLGVLEPSGRGALLAALVRFPALTSGFAAFTASASQLLPLATFCVRLPLVAGCFPCGPRALSSALLVTVALASGAAAASPSASFLLLVRTCGLVPAPLLVLGPSGPPFLPSSVRNAGAPPFRPTAPRPVRPICRTMLIWALVTSPLLVLGGLAPHHCHSLCHAPSRAPPAPWGGPRLPGDRCPVPQMAMAGFLPFSAIYIELYYIFASIWGHKIYTMASILFIVFIILIIVTAFVTVALTYFQLAVEDHEWWWRSVLCGGSTGIFIFFYCIYYYHARSDMSGFMQTSFFFGYMTCVCFGFFLMLGTVGFRASLFFVRHIYRSIKCE

SEQ ID NO: 42802 - protein, 127 aa, Sorghum bicolor
  Clone ID: SORBI-28MAY03-C36351_1.pep
STSRMLSPHVLGEDHYKHEGGVQKVLQNYKNLQDIIAILGMDELSEDDKLTVARARKIQRFLSQPFHVAEVFTGAPGKYVELKESVKSFQGVLDGKYDDLPEQSFYMVGGIEEVIAKAEKIAKENAS

SEQ ID NO: 42803 - protein, 134 aa, Sorghum bicolor
  Clone ID: SORBI-28MAY03-C36364_1.pep
VLKDSVPNISEIISTGSPDNLTKEDRFQTLAPSGVEQEAPKLGHAPRAPSSPWMPFSMLFAAISTKVPRSDMDLVIRYYEEFKRKGISRSDLVIRIRQIVGDKILVSTIMRLHQKSPQVAAAGLPRALARGKRE

SEQ ID NO: 42804 - protein, 329 aa, Sorghum bicolor
  unsure (1)..(329): unsure at all Xaa locations
  Clone ID: SORBI-28MAY03-C36625_1.pep
MGGGGAIVHGFRRWFHRRNGSTSGSNQSSVAGEGDDGSSDLEVIEDPDLVALRAIRVPKRKMPLPVESHRKNSVEMEFFTEYGEASQYQIQEVIGKGSYGVVAAAVDTRTGERVAIKKINDVFEHVSDATRILREIKLLRLLRHPDIVEIKHIMLPPPRGEFQDIYVVFELMESDLHQVIKANDDLTPEHHQFFLYQLLRALKYIHAANVFHRDLKPKNILANSDCKLKICDFGLARASFNDAPSAIFWTDYVATRWYRAPELCGSFFSKAIPPVLVCTLGXIFSEPSPGRPFLPGLMLVLLNCVEHHISLLVNLLVVYSCNYVFFIFL

SEQ ID NO: 42805 - protein, 278 aa, Sorghum bicolor
  Clone ID: SORBI-28MAY03-C36647_1.pep
MASAGFPSRIAGISVRPDSSSACLIHKVGAPSNSLPGAVAVQVQGHQNRVRNGQAIRCAMATGKEQGAISTASSGDQTKGGLRGKLNKVVLAYSGGLDTSVIVPWLRENYGCEVICFTADVGQGAIELEGLEKKAKASGACQLVVKDLREEFVSEYIYPCLRAGAVYERKYLLGTSMARPVIAKAMVDVAKEVGADAVAHGCTGKGNDQVRFELTFYALNPELKVVAPWREWDITGREDAIEYAKKHNVPVPVSKKSIYSRDRNLWHLSHEGDILEDP

SEQ ID NO: 42806 - protein, 112 aa, Sorghum bicolor
  Clone ID: SORBI-28MAY03-C21072_1.pep
GYPFHADGCVPLHSFDYVYNYLMGTNVSFVDCFKDPGPHGSGRYAPEMYPEIDERDFRKGAQWFAVTRRHALMILADNLYYKKFKLYCKVYLFILDKGRILLIHNHYIELVQ

SEQ ID NO: 42807 - protein, 174 aa, Sorghum bicolor
  Clone ID: SORBI-28MAY03-C2112_1.pep
MGGFSGATGLAVYREEDDEELFETSSSISGGDSERRLRGPGPVLRPGARRRRPGAPPAHPPPAPAAGADSLFGLSSMMAQLPVKKGLSKYYDGKSQSFACMSEVRCLEDLRKKETPYKKMKPSRSYVALDEEQDCHVPGPNSRGSCANLVARKNSKNMLYRPPAIPVNKSGYHQ

SEQ ID NO: 42808 - protein, 356 aa, Sorghum bicolor
  Clone ID: SORBI-28MAY03-C21133_1.pep
MPTLGTASSLLLTHRHRLLAARTHSRSASASIKMARSALDEVTDTGAFDRSPSTFRSSVSRDGRFPVVAGRYHLYVSYACPWASRCLAFLKLKGLDHAIGVTAVKPIFERTKETDDHLGWVFPAAADEEPGAEPDTLNGARSVRELYEIASSNYAGKPTVPVLWDKQLKTVVNNESSEIIRMLNTEFNDIAGNPGLDLYPPHLRASIDEANELVYDAINNGVYKCGFAKKQGPYDEAVARLYEALDKCEEILGKQRYICGNQLTEADIRLFVTLIRFDEVYAVHFKCNKKLLREYPNLFNYTKDIYQIPGISSTVNMEHIRKHYYGSHPSINPYGIIPAGPNIDYNAPHDRERFGA

SEQ ID NO: 42809 - protein, 194 aa, Sorghum bicolor
  Clone ID: SORBI-28MAY03-C2134_1.pep
MAAAKWSETAMLVIDMVQDFVDPAMRSPMLVAGGEAVVPAVAEAVAVARERGIFLVWVVREHDPSGRDVELFRRQHYSGGKGPTVKGLKGAELADGLVIKEGEYKLVKTRFSAFFATHLDSVLKTAGIKNLVIVGVQTPNCIRQTVFDAVALDYEKVTVLIDATAAARPEIHLSNIRDMKNIGVDTPTVEEWRR

SEQ ID NO: 42810 - protein, 58 aa, Sorghum bicolor
  Clone ID: SORBI-28MAY03-C21617_1.pep
YVVVTHQHSTIRRAVDRLLFLHEGKVVWEGMTNEFTTSTNPIVQQFASGSLDGPIKYF

SEQ ID NO: 42811 - protein, 178 aa, Sorghum bicolor
  Clone ID: SORBI-28MAY03-C19479_1.pep
LSTYELTVLRNRGPRRMQCTMHSIPAECIQEGGKAPTPTGTIQSLDEPVSTSPSTKGKEVALEFSSTSLSADLSGLALACANETPLVLKNKAPRWHEQLQCWCLNFRGRVTVASVKNFQLVASVDPSLNIPAAEQEKVILQFGKIGKDIFTMDYRYPLSAFQAFAICLTSFDTKPACE

SEQ ID NO: 42812 - protein, 104 aa, Sorghum bicolor
  Clone ID: SORBI-28MAY03-C1934_1.pep
LSLNCSNTGTCKCRPIIKQKQWPKKLGTLHTDKHWWGAEQPPKYARSKQAEEATDPPPQEQCSCRFLKSDIWHLACREGNTAVMVSNRHNHECSRNILKLFDQK

SEQ ID NO: 42813 - protein, 251 aa, Sorghum bicolor
  Clone ID: SORBI-28MAY03-C19625_1.pep
RPSPIPASAASRRAPMAAAVTLLRLPLARLSYHLRSVPSSRLPPPRLRILTSHRFFSSLDHGSASASASAAVAEVVGVPDAEESVEEESAAEAEAEAESEAPRSFVLPRLPRPKLSVKERKELASYAHGLGKKLKSQQVGKSGVTPNLVSAFSDNLESNELLKLKIHGNCPGELPDVILQLEESTGSIAVDQIGRSVILYRPSTSKMKKKQQVAENARSISRPEAGNARNNVKSEISFDLRLLNSSILGGL

SEQ ID NO: 42814 - protein, 214 aa, Sorghum bicolor
  Clone ID: SORBI-28MAY03-C1969_1.pep
MAASVFPALLLAVAAAAALLLLPAAEAVWLELPPSGTKCVSEEIQPNVVVLADYSIMYESHPSSHPTVAVKVTSPYGNTVHHNENATMGQFAFTTSEAGNYLACFWIDSVEKGSGTSLNLDWKIGIAAKDWDTIAKKEKIEGVELELRKLEAAVESIHHNLLYLKAREAEMRTVSEKTNSRVAWFSILSLGVCVAVSVLQLWHLQGFFRKKKLI

SEQ ID NO: 42815 - protein, 119 aa, Sorghum bicolor
  Clone ID: SORBI-28MAY03-C19785_1.pep
AGLTGLGSNRIGSLGFKPHSLHSSKPSPPIGFGERDAKQDVPRRGPASPEQGGCVQAAAVAPRHHGLLRRRHPRRPLHPPLPHPRRRCPGAQARALGPSVPMPPPKVLQRQSSFETTAK

SEQ ID NO: 42816 - protein, 173 aa, Sorghum bicolor
  Clone ID: SORBI-28MAY03-C22230_1.pep
DTHIVNLFSFSKAYGMMGWRVGYIAFPNEADGFHDQLLKVQDNIPICASIIGQRLALYSLEAGPEWIKERVKDLVKNRALLVEALSPLGEDNVKGGEGAIYLWAKLPDNCSNDFEVVRWLANKHGVAVIPGSASGGPGYIRVSFGGLKEEDTRLAAERLRRGLQELVTDGMVQ

SEQ ID NO: 42817 - protein, 140 aa, Sorghum bicolor
  Clone ID: LIB5048-003-R1-XP2-E9.pep
PERGRSPFQGKIGSPGTPYPQPQDFFWGYRPKRKKRKFLPLQGSTTRAGPPKIEAGPPPLVFPPSKGRAKLAPGFPSHNKSKPFFSPTPPARARQSQGPPAGGAPRFFFFFFFFFFFFFFFFFFFFFFFFFFFFFFFFIT

SEQ ID NO: 42818 - protein, 79 aa, Sorghum bicolor
  Clone ID: SORBI-28MAY03-C223_1.pep
SSPSGQGHLVTVTLAPKPPQPITLALNLSPLTDWPHTAHELSSRTNPPAQVGNASPPVTLAEALPPGILSAYAPLRTIG

SEQ ID NO: 42819 - protein, 135 aa, Sorghum bicolor
  Clone ID: SORBI-28MAY03-C2226_1.pep
MEPMRGVLGRRLISAEDLPPMDIGGKADPFVVLYLKKGETKKKTRVVTDTLNPIWNQTFDFMVEDALHDLLMVEVWDHDTFGKDYVGRCILTLTRVILEGEFQDTFVLQGAKSGKLNLHFKWTPQPIYRDRDRDQ

SEQ ID NO: 42820 - protein, 102 aa, Sorghum bicolor
  Clone ID: LIB3481-005-Q6-K1-D9.pep
ELPTFPTNFFEHAAIKIYQTPFNSKFVDRFICFRSCGSKNCRFVYRTANMHAPLGISVYLPSRLQVSLVPVTISIDWLWRPLEVQVQFSRFGTLQDKGILAD

SEQ ID NO: 42821 - protein, 279 aa, Sorghum bicolor
  Clone ID: SORBI-28MAY03-C22361_1.pep
MEMDPPPPPPLHADNRRRRRCREYLLALEEEERKIRVFQRELPLCLDLVTQTIEEMRSHMDSVVVGSEEETVSDHGGGPVLEEFMPLKPTLSSSSSEDDDDDEHDSSRHHQHRAAGVGDDDKKNDEASGDPETAAALASSRRPLLPQPETKKAMPDWLQSVQLWSNQQQPPPQQQHQDELLLPCRPVALNAYRKPGGAFQPFEKDKDKEKQRGELPLPASSSAAASSAVVGDSCCDRAGGATDTDTAENIIIVRRASAARTRRLSRRRRRPAGSRARCW

SEQ ID NO: 42822 - protein, 188 aa, Sorghum bicolor
  Clone ID: SORBI-28MAY03-C22727_1.pep
MATRCLAVAGSLPLLSASTAAAAAARAQPLPSAAAPRRALTRLSVATGGDQQLVTAQDPAHEPDYGVISLHHVGILCENLERSMAFYKDLLGLEVNPARPNDKLPYRGAWLWVGSEMIHLMELPNPDPLTGRPEHGGRDRHTCIAIKDVLKLKEIFDKAGISYTLSKSGRPAIFARDPDGNALEFTQV

SEQ ID NO: 42823 - protein, 229 aa, Sorghum bicolor
  Clone ID: SORBI-28MAY03-C2459_1.pep
HIYMHDFILPNRAAHQKEVNYNNIQCGCGLHGANNFSFFGLQTKTDGKMLDISIQAPRRSSQKFTCLSSVPQEDCKLKLEAKSAINGVHYAEVVCDDDDDTAGDPEQASPLRRPPEQLLDCLSGRGCSSPGVVNVVATGAYTLLAVAVGVPDASPVLARCGACCGCDAAAAAAAAAAAAAAAAYSGGGTQMPPTTTNCGAVGGATTLVPPLWTATAVVEFGRLVCKRYF

SEQ ID NO: 42824 - protein, 80 aa, Sorghum bicolor
  Clone ID: LIB3481-009-Q6-K1-E9.pep
RPRTRGFFLHHIYMHDFILPNRAAHQKEVNYNNIQCGCGLQLVHKLAVSSIPVSIRIQTPRTSTTWLGLLWRSPWWRRRR

SEQ ID NO: 42825 - protein, 558 aa, Sorghum bicolor
  Clone ID: SORBI-28MAY03-C2047_1.pep
VGFPVWDPRKNPRDRCHHMPIITPAYPCMNSSYNVSTSTLRVMVEQFQFGNKICQEIEMNKASWSALFEPFQFFEAYKNYLQVDIIAEDDEDLRLWKGWVESRLRQLTLKIERDTYGMLQCHPYPHEYADPSRQCAHCAFFMGLSRKEGVKIQEGQQFDIRGTVDEFRHDINLYMFWKPGMELAVSHVRRKQIPAYVFPEGYKRPRPSRHVNHQSDKNDSEDGTVTRSPDSQLKRKHDSVGTDDIEPNRSAKRSSVSPVHPKNSPQSGSTGDETRCNNQIKRAPSDASGGSPASPQASERSPDTIVSSPMCTTTGAVCSGDAISKHGVPLVENCTTPTVAVCTTLKRVAEKVVSELVGSERLGSNNSAELLESMEKDVLAENVCFGGNGVTQGGLPEELVVCCLVFVGSHLAGLVASTAQDWGKNVVEMDKFYFLLDGMVSSSTHKFPSGHRLAIAGFLSDGRWSNIMPCNGMAKNNKEDFVEGHGRISCVLLVHSRSAWTFSFWFFLVEQLALVYELSCSGLPRVDLFESEMPLPCCRSRIELDDMMCSLRPVCTPP

SEQ ID NO: 42826 - protein, 165 aa, Sorghum bicolor
  unsure (1)..(165): unsure at all Xaa locations
  Clone ID: LIB3481-006-Q6-K1-G1.pep
RPLHCSVFFILGCLVFVCYFLAGLVASTAQDWGKNVVEMDKFYFLLDGMVSSSTHKFPSGHRLAIAGFLSDGRWSNIMPCNGMAKNNKEDFVEGHGRISCVLLVHSRSAWTFSFWFFLVEQLALVYELSCSGLXRVDLFESEMPLPCCRSRIELDDMMCSLRPVC

SEQ ID NO: 42827 - protein, 169 aa, Sorghum bicolor
  Clone ID: SORBI-28MAY03-C20929_1.pep
MRIHPASPTVVGGGGGKKDLRRLPHVYSKVLELPLPADTDVEVFEGPDAFHFVAAPPAGGGARGAGVVRVRTVRIHPGVTKVVVQAGDAAEGVADDDDAGDSMELDRWRSRLPEPSCPAMAVAGYVDGQLVVTVPKGPGGGEGGDGGQGEVTWRCSGGGKISGRLVLVQ

SEQ ID NO: 42828 - protein, 99 aa, Sorghum bicolor
  Clone ID: SORBI-28MAY03-C20996_1.pep
GFVPSAIAVGPIIATGAAAIGYPITPSSRSALTVVAVAASPAFTVPDKVCNPASIVCCTRSAVSCVIPSCAQMGWPAVVMTRKTTRRSLAPMVVPLPKD

SEQ ID NO: 42829 - protein, 149 aa, Sorghum bicolor
  Clone ID: SORBI-28MAY03-C2054_2.pep
RPKVLGSSVRWIARKVLTDSSPKLRSTLQTLLYKDGTFQIDRLESLLTESLRARTEQSLVRNQQEDVDSTRYAIKQVLSFTLADQGAFVKDLLLQEIAKGIDALGVATLSSATSAAPSRLPFAGVPSPLTSLDDEDATNLRNLYRLLLL

SEQ ID NO: 42830 - protein, 152 aa, Sorghum bicolor
  Clone ID: SORBI-28MAY03-C2054_1.pep
MALVCFHGEAPLREHERGVQRDRPSMHRLVVATGGGAVIRPINWSYMKKGLTVWLDVPLDALARRIAAVGTASRPLLHQESGDPYAKAYAKLTSLFEQRMDSYANADARVSLEHIALKQGHNDVTILTPSAIAIEALLKMESFLTEKTMVRN

SEQ ID NO: 42831 - protein, 238 aa, Sorghum bicolor
  Clone ID: SORBI-28MAY03-C21040_1.pep
MPRPARAPLLRRLLLLAAVAASCSYYLLFLQAQASVPPRYDGFAYGGGAAAAWKDAVLVEAFLDPLCPDSRDSWHPLKLAIERYAPRVSLIVHPFPLPYHTYAFHACRALYIANKLNSSSTYPLLELFFKNQEKFYNSATSSLSSPSVAVEMSKMAAQTVGNSVSEFLSGFSDTKTDSAARVSFKYGCTRGVYGAPFFFVNGFLQPGGGSPIDYSTWIGILDPLVSQNGERIEMFTSM

SEQ ID NO: 42832 - protein, 204 aa, Sorghum bicolor
  Clone ID: SORBI-28MAY03-C23887_1.pep
MAEEKSVPRLNERIMSTLSKRSVAAHSWHDLEIGPGAPAVFNCVVEITKGSKVKYELDKKTGMIKVDRVLYSSVVYPHNYGFIPRTLCEDGDPMDVLVLMQEPVIPGCFLRARAIGLMPMIDQGEKDDKIIAVCVDDPEYRHLTDLKELSPHRLNEIRRFFEDYKKNENKEVAVNDFLPPTTSLEAIQHSMDLYAEYILHSLRR

SEQ ID NO: 42833 - protein, 248 aa, Sorghum bicolor
  Clone ID: SORBI-28MAY03-C24319_1.pep
ARGYDDWSLDSDVAKKIVEIERIPRFLHKMILEGGSIHVDGEGTCITTEECLLNPNRNPNMTKLEIENELKDFLGVSKVIWIPRGLYGDEDTNGHVDNMCCFIKPGVILLSWTDDEKDPQYERSVEALSVLSQSIDAKGRQLEVVKIHVPGPLYMTKEEAEGVVSTGHAVPREPGTRLAASYVNFYIANGGIVAPSFGDNKWDKEAYAVLQKAFPDHEVVMVEGAREIVLGGGNIHCITQQQPVRPSS

SEQ ID NO: 42834 - protein, 170 aa, Sorghum bicolor
  Clone ID: SORBI-28MAY03-C2444_1.pep
RVTQLARMGVGLVVLTLAMLAAGALGVARRGVIARHGMYDTNTGGGGDDGRYLPLSIFWQVPQYVVVGASEVFTFIGQMEFFYDQAPDAMRSLCSGLSMTSFALGNYVSSALVTVVARATARGGRDGWIPDDINRAHLDYFFWLLAMLCVGNFGVYLLIARWYTYKKSVG

SEQ ID NO: 42835 - protein, 120 aa, Sorghum bicolor
  Clone ID: SORBI-28MAY03-C24567_1.pep
DRRAWLIGGEVPLAGLGAAAASGNPAAAGGCCQGNGGFTCCQTDLPKEKQDKSIAAEQNPKSSEENDKEGGAGSKKGNTKTCPMPTWFETWERADTYAALAVVAAAAAVFVSFRIYKNLN

SEQ ID NO: 42836 - protein, 371 aa, Sorghum bicolor
  Clone ID: SORBI-28MAY03-C24734_1.pep
MAASAAAGVQMVAARPCISASQGIHAARVAVSRTDCMLSTTATFPKISCSWPLDSKRNGVLVARGSGESGRQGLPIDLRGKRAFIAGVADDNGYGWAIAKALAAAGAEILVGTWVPALNIFETSLRRGKFDESRKLPDGSLMDIVKVYPLDAVYDSPDDVPEDVKSNKRYAGSSNWTVKEVVESVKNDFGSIDILVHSLANGPEVTKPLLETSRRGYLAAISASSYSYVSLLQHFLPIMNPGGASISLTYIASERAIPGYGGGMSSAKAALESDTRVLAFEAGRKGKIRVNTISAGPLGSRAAKAIGFIEKMIEYSYVNSPLQKELLADEVGNTAAFLVSSLASAITGSTVYVDNGLNTMGIAIDSPTITS

SEQ ID NO: 42837 - protein, 202 aa, Sorghum bicolor
  Clone ID: SORBI-28MAY03-C2125_1.pep
MAETVFTPSLEGMKHVKAQNGVILTKPFLDVCKQILPVLHKFGAAMALVKTDIGGNITRLETKYSSDPSKYEHLYSMVQEEVQNKTAKGSSSCTNGLLWLTRAMDFLVELFRNLLEHADWTMTQACTDSYTKTLKKFHGWLASSSFTVAMKLAPNRDKFMEVISGTGDINADIEKFCTTFSPFLKENHNFLASVGLDDMKAS

SEQ ID NO: 42838 - protein, 54 aa, Sorghum bicolor
  Clone ID: SORBI-28MAY03-C21798_1.pep
EYVPTYEGKDGDWMLVGDVPWEMFVESCKRLRIMKGSEAIGLAPRAMEKCKNRS

SEQ ID NO: 42839 - protein, 101 aa, Sorghum bicolor
  Clone ID: SORBI-28MAY03-C2197_1.pep
ELQEIYGIGNSMEGDADANDPGKECVICLSEPRDTTVLPCRHMCMCSECAKVLRYQTTRSSVCRQPVERLLEIKVNNKSEEQQQTPQSPPLPAPAPQQEEV

SEQ ID NO: 42840 - protein, 180 aa, Sorghum bicolor
  Clone ID: SORBI-28MAY03-C22123_1.pep
MAAAAASVWLQLQVPPHRLHSPPVLSLPSNHSSSHACPPVYKYKKHAAPGRGNLLLCRASGASSSSVVTKEQEGAASDPSSEEGYSEPQIYSYKDDPNFRGCKGCGRDELERGCNGEGRIQGGIAAVPGFGWWPIKAYRPCPGFVASGGRYRRQGQSMDDVASGRGKKKPSPAKKKSDNK

SEQ ID NO: 42841 - protein, 232 aa, Sorghum bicolor
  Clone ID: SORBI-28MAY03-C2218_1.pep
HEASPPVPLPVRLSPAFARVRRPVDGHVTPRRAAQLIRHPLFLAELRIDASRARSGLPIRRLPILQQETSTRAFPLAVARPTLNFTMSGMASDDAPAQVSVEGDVSDKKVEVQDQNEVSGMPSRQEEEAVIKKKYGGILPRKTPLISKDHERAYFDSADWALGKQGGVPNKPKGPLEALRPKLQPTQQNARARRTSYASADSDETLNLSPEDLIPQGEPSQQGEPVEDKNKE

SEQ ID NO: 42842 - protein, 214 aa, Sorghum bicolor
  Clone ID: SORBI-28MAY03-C22103_1.pep
MAKRRRSSSSLPLALLPPLLLLLLLAAGSLAVAAALDISPEARRGRSLQQLPTPLPQPVPQPQPTPVPQPLPQPNPNPQPQPLPQPDPNPQPLPQPLPQPDPNPQPQPLPQPQPGPIPPQPLPQPDPNPQPVPQPLPQPQPGPIPPQPLPQPDPNQPLPQPQPAPGTQPVSTQNPQPQADQLSGGPQPLSDGGLRMLNLQYVKYIFLDLIVLIL

SEQ ID NO: 42843 - protein, 143 aa, Sorghum bicolor
  unsure (1)..(143): unsure at all Xaa locations
  Clone ID: LIB5121-011-A1-PF1-D8.pep
MAILPRPTAVLVAALAVALAFGMASAQGPAASLPLTLLTPLLLLLLLAYGSLSSDXPRLTSPRRHILLESCQQLPTPLPQPVPQPHPTPLPQPLPQPNPNPQPQPLPQSDPNPQPXLPQPLPQPYPNPQSQSLPQPQPGPIPS

SEQ ID NO: 42844 - protein, 176 aa, Sorghum bicolor
  Clone ID: SORBI-28MAY03-C25307_1.pep
TREREALSLARAWAEEEAKKAREHARALEDARNQWERQGIKVVVEGGLQDDASAGVTWANAGKEHPVDEVINRAESLLEKLKSMSAEMKVRSRGALERVMQHVRSFIASLKQQAADARQWCSEFGASAASKALMVSAEVQGSVSAFGATLGDKSKRVMEECKDGLEKFSHRFKTSD

SEQ ID NO: 42845 - protein, 165 aa, Sorghum bicolor
  Clone ID: SORBI-28MAY03-C25360_1.pep
VCIGWPGSMPDDQVLEKSMLHQRAAAGMMHESWLVGGASYPLMDWVLVPYTHPNLTWTQHAFNEKVGELRRVAVEAFARLKARWACLQKRTEVKLQDLPVVLGACCVLHNICELRGEEVDPAIRCELVDDETTPENPVRSETAKHARDNIAHNLLHRGFGGTTFF

SEQ ID NO: 42846 - protein, 305 aa, Sorghum bicolor
  Clone ID: SORBI-28MAY03-C2540_1.pep
MPPHKIETGHQDVVHDIAMDYYGKRLATASSDNTIKIIGVSGNSHQQLATLSGHQGPVWQVAWAHPKFGSMLASCSYDGRVIIWKEGSKPDEWALVHTFAEHKSSVNSIAWAPHELGLCLACGSSDGNISVFTARSDGGWDTTRIDQAHPVGVTSVSWAPAMAPGALISAGSSGQFEYVQKLASGGCDNTVKVWKLNNGSWRMDCFPALQMHKDWVRDVAWAPNLGLPKSTIASASQDGTVVIWTAAKEGEQWEGQVLYDFRTPVWRLSWSLTGNILAVSDGNNNVTLWKEAVDGEWQQVTTVEP

SEQ ID NO: 42847 - protein, 377 aa, Sorghum bicolor
  Clone ID: SORBI-28MAY03-C25514_1.pep
MTRSTREKPTTAAASASDSAMDKIAATAFALLLCLCFSSTPAAMALTPDGEALLELKLAFNATVQRLTSWRPSDPNPCGWEGISCSVPDLRVQSINLPYMQLGGIISPSIGRLDKLQRLALHQNSLHGPIPAEIKNCTELRAIYLRANYLQGGIPSEIGELLHLTILDLSSNLLRGTIPASIGSLTHLRFLNLSTNFFSGEIPNVGVLGTFKSSSFVGNLELCGLSIQKACRGTLGFPAVLPHSDPLSSAGVSPINNNKTSHFLNGIVIGSMSTLALALIAVLGFLWVCLLSRKKSIGGNYVKMDKQTVPDGAKLVTYQWNLPYSSSEIIRRLELLDEEDVVGCGGFGTVYKMVMDDGTSFAVKRIDLSRESRDRTF

SEQ ID NO: 42848 - protein, 143 aa, Sorghum bicolor
  Clone ID: SORBI-28MAY03-C25626_1.pep
RFFVAHSRVANAATATAQADKKKSAKAGNKHTVDATADDTEGTSKVDEEPAPESKKASESADYGASQLHEFSQVEVGDAHAPVEGAGEEDGDIDIVGGQGALPDVLMTPSGSELGAEQEDEDDDDSERRNQSIGKKLWSFFTT

SEQ ID NO: 42849 - protein, 119 aa, Sorghum bicolor
  Clone ID: SORBI-28MAY03-C2282_1.pep
MAGGKEPIEVRFRLFDGTDIGPTKYDPSTTVSSLKEFILARWPQDKDVAPKTVNDLKLINAGRILENNRTLAESRVPVGEVPGGVITMHVVVRPPQADKNSEKQLANSPKQNRCGCTIL

SEQ ID NO: 42850 - protein, 131 aa, Sorghum bicolor
  Clone ID: SORBI-28MAY03-C2335_1.pep
SSDVYTMDLSEEEPCWRCLTGSGMPGAGNPAGAGPPPRLDHVAVSLPGGRILIFGGSVAGLHSASQLYLLDPTEDKPTWRILNVPGRPPRFAWGHSTCVVGGTKAIVLGGQTGEEWMLTEIHELSLASNSV

SEQ ID NO: 42851 - protein, 256 aa, Sorghum bicolor
  Clone ID: SORBI-28MAY03-C23484_1.pep
MEAEKKTPAVSDVGAWAMNVVSSVSLIMANKQLMSSSGYAFAFATTLTGFHFTVTALVGWISNATGYSVSKHVPLWELVWFSLVANTSITGMNLSLMLNSVGFYQISKLSMIPVVCLMEWVLNSKHYTTKVISAVIVVAAGVGICTVTDVEVNAKGFICACVAVFCTSLQQITIGSFQKKYNIGSFELLSKTAPIQALSLVILGPFVDYYLNGRSLLNYPFSGGATFFILLSCSLAVFCNMSQYLCIGRVSADSFQ

SEQ ID NO: 42852 - protein, 200 aa, Sorghum bicolor
  Clone ID: SORBI-28MAY03-C2297_1.pep
MAPAAVAAPVASVSPGGGAVRSARRIASLHPCHSSTKIVLLPPPNGLLRSVRQRRRFAARSSISESSTDDSQSPKQEKAPFGYTRKDVLLIGLGVTAFGVGLKYGLELLGVDPLQAGNVVQLLVVLGMTVGWISTYMFRVANKDMTYAHQLRDYEKQVMEKRLESLTEAELQALLEQVEEEKQRMPSVPEEPNAITFKKK

SEQ ID NO: 42853 - protein, 233 aa, Sorghum bicolor
  unsure (1)..(233): unsure at all Xaa locations
  Clone ID: SORBI-28MAY03-C23811_1.pep
MASPTCRLVSLVLCLGALAVLLAARGADAARAFFVFGDSLVDNGNNNYLITAARADSPPYGIDTPDHRATGRFSNGKNVPDIISEHLGAEPVLPYLSPELDGEKMLVGANFASAGVGILNDTGIQFANIIHIAKQLRYFEQYQKRLTALIGADAATRLVRGALVLITLGGNDFVNNYYLVPYSARSREFSLPDYVSYILSEYAQVLEHMYDLGARXVLVQAVGPIGCVPAELA

SEQ ID NO: 42854 - protein, 129 aa, Sorghum bicolor
  Clone ID: SORBI-28MAY03-C258_1.pep
GCHILLPRALGILLYEMLYGRTPFRGKNRKRTFHNILHKDLTFPSSIPVSLAAKQLIHGLLQRDPSSRLGSSAGANDIKQHPFFKDIYWPLIRCMEPPELDVPLKLTRKEPELTVKPEEDTHAQILDTF

SEQ ID NO: 42855 - protein, 84 aa, Sorghum bicolor
  Clone ID: LIB3481-024-P1-K1-B8.pep
RPPTRPAAKQLIHGLLQRDPSSRLGSSAGAGDIKQHPFFKDIYWPLIRCMEPPELDVPLKLTRKEPELTVKPEEDTHAQILDTF

SEQ ID NO: 42856 - protein, 155 aa, Sorghum bicolor
  Clone ID: SORBI-28MAY03-C26039_1.pep
IGLLLYLVYLKLIACSIAYQLIHLVVLACHAKRTRERTPTPGKYCGRRGGSQRSPSPYRPRRRERSRSRERRRERSRSRDRRERSRSRERRRERSRSRDRRERSRSRDRRRDRSRSRDRRRERSRSRDRRGSSPHDRRRGDRSRSPTTNGNHKAD

SEQ ID NO: 42857 - protein, 180 aa, Sorghum bicolor
  Clone ID: SORBI-28MAY03-C26401_1.pep
MAARAVATLAASSAMVLAVLLLAGGASAQSSPSSQCTTVLVSLSPCLNYISGNESSAPATCCTQLAKVVQSDPQCLCVALSADPASLGLTVNRTRALGLPDACKVKTPDVSNCKGGAAAAGAPVTSPGGTTTTTTTPATGSKTTPTTTSVPETAAASPRGSAGVVAGFVVAAVVVAGFAV

SEQ ID NO: 42858 - protein, 157 aa, Sorghum bicolor
  unsure (1)..(157): unsure at all Xaa locations
  Clone ID: SORBI-28MAY03-C26501_1.pep
FHQEVYFNRMPEWHGKILRXHGDEFERTSDGYYRAHGRADDTMNLGGIKVSSIEIERICNRVHDAIVETAAIGVPPVGGGPEQLTIAVVLKDQSSQLEDWNQLKLAFNVALKKLNPLFKVSSVVVVPSLPRTASNKVMRRVLRKEFSQAAQAKHSKI

SEQ ID NO: 42859 - protein, 129 aa, Sorghum bicolor
  Clone ID: SORBI-28MAY03-C26554_1.pep
RSENIQGPCLLIVGDMQGAVFGGLLNSPLRPTEKRKYQGTNQTFVFTTIHGEPRLFRPTGANRFYYLCLNDALAFGGGGSFALCVDEDLLHGSSGSCETFGNSCLAHSPEFELKNVELWGFTHSWNRST

SEQ ID NO: 42860 - protein, 128 aa, Sorghum bicolor
  Clone ID: SORBI-28MAY03-C26654_1.pep
SNRESARRSRLRKQAETEELATQVESLTTENTSLRSEIGRLTESSEKLRLENSALMVKLKDTAALTPAEPSPHTAVTSSSSPGAAAENFLSMIDSAKAAGVSRHTEHGEPKLRQLLDSSPATDVAAVS

SEQ ID NO: 42861 - protein, 213 aa, Sorghum bicolor
  Clone ID: SORBI-28MAY03-C24774_1.pep
ARGQSPRPRHATPPTPHAARRAPRPPHVVPRRCHPDALPNLPWTPTQRPRRPSLSDRRSGCPARATATRAQTLAPAAPPPAVASLSAGAAHLRSPPRSRSPRPPRARPRPASAPTRATAPSARGDARAPAPKEATGPSGCSEPPPPASVEAAAPPRNNGATTTSSRSSPQPLPSASATAEPRASRTWPSCSSPLGTPSPRTSTSSWCTTRLSA

SEQ ID NO: 42862 - protein, 272 aa, Sorghum bicolor
  Clone ID: SORBI-28MAY03-C25021_1.pep
MSYYERRGGDRGSGRIQGSGGRGGHVLRGRSGLPPRGPLGVNSRPSARTIAKSFSRTKDMTWRPDLFSDSMAASGIETGTKLYISNLDYGVSNEDIKELFSEVGHLKRFAVHYDGYGRPNGTAEVVFTRRSDAIAALKRYNNVLLDGKAMKIEVIGSDLGLPMTPRINVVGASNGRATRTVVMTPEFSQRGRGSSSRPLSNPSNRFNNRGGFQAGRGRGQFQARGRGRGQFQSRGRGRGQFQGRGRGRKPEKTADELDKDLESYHAEAMKTD

SEQ ID NO: 42863 - protein, 257 aa, Sorghum bicolor
  Clone ID: SORBI-28MAY03-C25085_1.pep
MSRLLSRRQIDAVRRSAPLACVSRWLHTPSFATVSPHEVSGSSPAEVQNFVQGSWTASANWNWIVDPLNGDQFIKVAEVQGTEIKPFVESLSKCPKHGLHNPLKAPERYLMYGDISAKAAHMLGQPAVSDFFAKLIQRVSPKSYQQALAEVQVSQKFLENFCGDQVRFLARSFAVPGNHLGQRSNGYRWPYGPVAIITPFNFPLEIPLLQVMGALYMGNKPVLKVDSKVSIVMEQMIRLLHDCGLPAEDMDFINSDG

SEQ ID NO: 42864 - protein, 157 aa, Sorghum bicolor
  Clone ID: SORBI-28MAY03-C25228_1.pep
MGAWVSVLLGMDDGAAAAAAARPAAVGLGDLPELCAAQVLLRLDPPEICSLAGLNHAFRGAAGADFVWEAKLPENYSYLMEFVGGSGDEGRRRRRRAGKKEIYARLARPVPFGDGQKEFWLDKSKGMICMALSSKALVITGIDDRRYWQHMPTSESR

SEQ ID NO: 42865 - protein, 137 aa, Sorghum bicolor
  Clone ID: SORBI-28MAY03-C25237_1.pep
RRGDTLAGDVAPKVPHTPPAHAASPPKVPARPPRSDVVPNWDPTRGEHDPARPTRPRRGGPRRCSRGPAAGAGRSEVGTRPPAPRSKEGTKLEDVLGELALAVPSLMEMAPVQFLLSIYHRVEEDADYNNVNYVPPS

SEQ ID NO: 42866 - protein, 161 aa, Sorghum bicolor
  Clone ID: SORBI-28MAY03-C27199_1.pep
ATHAAASITTAQSPGLHYLLPSQASTVSGMLADAHGGTGSIGRSTSLVNPSLFSPLTSSQTTMMRSNPAVPTAPPQHPRTAQQPQSAPLLQPFPLPTASPSPPYGTPLLQPFPPPNPSPSLASAPVLSPALSRDKVRDALLRLVENDEFVDLVYREIMNRQ

SEQ ID NO: 42867 - protein, 162 aa, Sorghum bicolor
  Clone ID: SORBI-28MAY03-C27279_1.pep
MSDNLMDKVSAFGERLKITGTEVSKKMTAGMSSMSFKMKELFQGQTPADKIVEDATSENLDGPDWNSNLEICDLINTEKVNSVELIRGIKKRIMLKDARVQYLSLVLLETIVKNCEKAFSEVAAERVLDEMGRLIDDPQTVVNNRSKTLMLIEAWGESGDEL

SEQ ID NO: 42868 - protein, 308 aa, Sorghum bicolor
  unsure (1)..(308): unsure at all Xaa locations
  Clone ID: SORBI-28MAY03-C2734_1.pep
MRNWTKEEFVHILRRQSTGFARGSSKYRGVTLHKCGRWEARMGQLLGKKCSLGGLLSNAVGSPVRALRSQGLQAVGFDVDVRKQEDADRVLAATVAHFGKLDILVNGAAGNFLASPEDLTPKGFRTVLEIDTLGTYTMCYEALKYLKKGGPGKGPSTGGLIINISATLHYTASWYQIHVSAAKAGVDSITRSLALEWGTDYDIRVNGIAPGPIQDTPXVRKLAPEEMSKGLRELMPLFKFGEKQDIAMAALYLASDAGKYVNGTTLVVDGGLWLSHPRHIPKEEVRELSKVVEKKVRTSGVGAPTSKL

SEQ ID NO: 42869 - protein, 141 aa, Sorghum bicolor
  Clone ID: SORBI-28MAY03-C27587_1.pep
FFPAVGPRKYDFTKKQLFALSPTEVGSLISLGPAESCEFFHDPSMKSSNEGMVKKSLSITPLGSDSGYFVNITVVNSVEKTNDRLSVPITKAEFAVMRTTLSFALPHIMGWDQALTNHHPSPPAISKPRVERPHPDSEWER

SEQ ID NO: 42870 - protein, 395 aa, Sorghum bicolor
  Clone ID: SORBI-28MAY03-C27593_1.pep
HEGRYNEAALKKEVQELIVSWKSYFETCVCAFIYAPSKNRQMLFDGEKTQSVIQSCDIRPVPLTVHRPTLKEAKRVYCNLTQLYYEMECSTTDETLPDAGSVKNVEQSQGKKKEVDADPEESISDLSARLELLNKNESATIPSSKNETTPLHEAAKCGNAQLTLELLEQGLDPCIKDARGKTPYSLASDKEVRNTFRRFMALNLDKWDWHAADVPSALTKEMEESQAAKQADKDAKRKARAKELKKLKKAREKEEKEKEKAKAQASQSQTDVKGTSSGQMANRTASVPGLKPKHQTPQQILIAKEEERQRKQAEEREKRAAAAERRLAALAAQSAGAGASGAAATNCSAQRAVPDDNSCSCCFASLAGKVPFHRYNYKYCSTTCMHLHSEMLQDD

SEQ ID NO: 42871 - protein, 179 aa, Sorghum bicolor
  Clone ID: SORBI-28MAY03-C2565_1.pep
QAEHGPDSQVVLVIAGDGVNLGAIEAEVSKQCNALPRGEFASKALSHSFTVFAKDMVEAISFSNLYAPEHLIINVKDAEQWEELVENAGSVFLGQWTPESVGDYASGTNHVLPTYGYARMYSGVSLNSFLKYITVQSLTEEGLRKLGPYVAKMAEVEGLEAHKRAVTLRLQEVEASVTV

SEQ ID NO: 42872 - protein, 195 aa, Sorghum bicolor
  Clone ID: SORBI-28MAY03-C2578_1.pep
RTRGIMAPEDLRVFTQLSTANITQRIAVPYCGSFEVIKYRLKQIYESVESATEESDVPALIVHERVTVRLDSESYVTLQWSSDPISDMVSDSVVAMILNIGREGPKVVPVEEAVKTKEETEKVAQKVVYALMTSLFGDVKVTAEGKFVISVDGNVAHLDGMSGDVKCENATLKERIKTAFRRIQSAVRPIPLSAS

SEQ ID NO: 42873 - protein, 130 aa, Sorghum bicolor
  Clone ID: SORBI-28MAY03-C25846_1.pep
MATSVSAVAALAVFSAPRSLLQRPAQLPSRQNVVSFFVGPARAHRRLVAVAASSPATPPDLANKVSESIKQAKETCADDPVSAECVAAWDEVEELSAAASHARDRQKGVDPLEEYCKDNPETDECRTYED

SEQ ID NO: 42874 - protein, 131 aa, Sorghum bicolor
  unsure (1)..(131): unsure at all Xaa locations
  Clone ID: SORBI-28MAY03-C25937_1.pep
AXNATAVLSVEEMLPAVAQGAIGIACRSNDDKMMEYLSSLNHEDTRLAVACEREFLAVLDGNCRTPIAAYAYRDKDGNCSFRGLLASPDGSKVFETTRSGPYSFDDMVELGKDAGHELKAKAGPGFFDSLQ

SEQ ID NO: 42875 - protein, 177 aa, Sorghum bicolor
  Clone ID: SORBI-28MAY03-C2594_1.pep
RPRVRIFEDDQTRHVTSRIIGTRGYMSPEYAMRGQYSAKLDIFSFGVLVLEIVTGRRNNYAVNSEHSPNLFCLVWKHWVEGTIAQIADPSLGRHYPMAEVLKCINIGLLCVQQSPTDRPSMSAIVVMLSSDTVAVEAPYRPAYVDRSRSYTEMTVELIKEKEELCSPQSSITELMPR

SEQ ID NO: 42876 - protein, 269 aa, Sorghum bicolor
  Clone ID: SORBI-28MAY03-C28324_1.pep
MDEGYANLPTSHLLGSVPAVTQDDRKPVPPAAQDAAATSRLQEFPPAPGGNGGGYRPPSGPADGDVENQADWKGYFNVASYAPYFNVDTDVVVDRLISSIYPMDGFYRKIDANPDMYGPLWITTTLVFMLAAFGNYATYLMQNKKDLDIWNFDVGYFSWAASVMYGYAIIVPALFFFLFQYFGSRQSLVRFWCMWGYSLFVFIPASVLLLIPVEFLRWVIIALAGGASSWFIALNLKECTEGADLMVLIASASVLQVALALFIKVFFFA

SEQ ID NO: 42877 - protein, 79 aa, Sorghum bicolor
  Clone ID: SORBI-28MAY03-C28328_1.pep
VAAEVTHKFKTKENYFTVGSSHALDPSTLLKTRFSNSGKVGLLCQHEWRPKSLVTLSAEYDPKVVSAPSRIGVAISLKP

SEQ ID NO: 42878 - protein, 85 aa, Sorghum bicolor
  Clone ID: SORBI-28MAY03-C2829_1.pep
GRRRRPDEPERWTSDAKALDAFKRFGSRLVEIETRIKTMNDNPPLKNRKGPVEMPYMLLYPNTSDVTGEKGEGLTAMGIPNSISI

SEQ ID NO: 42879 - protein, 92 aa, Sorghum bicolor
  Clone ID: LIB3481-014-P1-K1-G12.pep
RPHASDEVYLGQRDEPERWTSDAKALDAFKRFGSRLVEIEKRIEKMNADPALKNRNGPVKVPYMLLYPNTSDATGEKGEGLTAMGIPNSISI

SEQ ID NO: 42880 - protein, 174 aa, Sorghum bicolor
  Clone ID: SORBI-28MAY03-C28473_1.pep
GDAKPAEHEAVAPAPVSNPTENSAPAPAEPAVVPAPAPETKSDAEPVAVDAPAPETKSDADLAAVTAPAPEAKLDAEPAAVVAPASETKPDAEPAAVTAPAPEAKSDAEPASKSDAVAADLAPGTKADAAAADPAPGAKLDAAAPVENSTNKGGNQESQPVNNGQVPHSTVKCI

SEQ ID NO: 42881 - protein, 123 aa, Sorghum bicolor
  Clone ID: SORBI-28MAY03-C28512_1.pep
AFLRFMGDDAEAKNYSYSLEVGGTGRKMIWQGVPRSIRDSPRKVRDSYDGLIIQRNMALFFSGGDRKELKLRVTGRIWKEQCTRGQLIHLFCSTAARAFLPCVGIDNSVIHSFFQLFWLAIAS

SEQ ID NO: 42882 - protein, 364 aa, Sorghum bicolor
  Clone ID: SORBI-28MAY03-C1334_1.pep
LLSTKSSFYLHASITVLLRDSIGESRVLSQGRGGVGARGAAEALEFEEEKMVVLVVATTSDPASIGPAAAFLAMPGWSPGPPIAEGMESFTNGNVRLLKHEHSIIAEDDLDQRWQEATGESVSEVIFLSKHTAVSKRPALTVHPIGVPHLKEDETPPQGGIPGWAAIPSPRIGPWLRLMQKIAAEQGLVPEFEITLEATHHGPVTSTPTMFVEIGSTEDHWGRQDAAQAIALVLWKGLGLEDGDAVGSWQRNCEKVLLGIGGGHYVPRHMDIVIKDGVWVGHLLSGYSLPMDTPSQVNGKTYGEVAGMWKHAIKVSYEATKAAFPGGEVIAHLDHKSFKGWQKNAVTSFLQEQNIRIGKPSDFF

SEQ ID NO: 42883 - protein, 227 aa, Sorghum bicolor
  Clone ID: SORBI-28MAY03-C26678_1.pep
MKRKTRNKVIVWTLALAAAPLPVDASIALVLTAGTWKAQIKKSQEKICNKGWECSGSKYCCNDTITDFFKVYQFENLFAKRNTPVAHAVGFWDYQAFITAAALFEPQGFCTTGGKQMQMMELCAFLGHVGAKTSCGYGVATGGPTAWGLCYNHEMSPDQTYCDKTYSFSRAGEAAACCGRGAWPVSWLYVLAAAGVGFVVVLPRRPELVCFGFFGSVRYIIHMFKED

SEQ ID NO: 42884 - protein, 147 aa, Sorghum bicolor
  Clone ID: SORBI-28MAY03-C2700_1.pep
KAALDRLSRPEELVGDDDVSRALLGACKGLPEPVLAVYDQLLSNGAIIPSLNLKLRLLRSVLAILREWGISVVAHRLGTTSAGASFFLDGTFSMNQTGTANQGARDKIISLANRYMTEVRRLNLPQNQTEDVYRGFRELEEKLLSPY

SEQ ID NO: 42885 - protein, 131 aa, Sorghum bicolor
  Clone ID: SORBI-28MAY03-C26774_1.pep
SVFAHIYTFPVVGFIILSCLIAVSVNFSTFLVIGTTSPVTYQVLGHLKTCLVLSFGYTLLHDPFTARNILGILVAIFGMALYSVFSVREGKKKSAGDALPVSQMPDKETEPLVATKDNSDTKKANGVAHDC

SEQ ID NO: 42886 - protein, 271 aa, Sorghum bicolor
  Clone ID: SORBI-28MAY03-C27083_1.pep
MAKPSVAAVPEVVGVPAAAQATTLFPYPPPRGAGITAAVVRRKCLQVELGAGAAGPLLGGACWGVESMRASSPTHAKAAAALAAGVDEERRAAWTVRHPSALGKFEQIVAASEGKRIVMFLDYDGTLSPIVDDPDAAFMSETMRMAVRSVAKHFPTAIVSGRCRDKVFEFVKLAELYYAGSHGMDIRGPAKASSRHAKAKAKGVLFQPASEFLPMIEEVHDRLVETTRCIPGAKVENNKFCVSVHFRCVDEKMWGELSESVKGVLREYPKL

SEQ ID NO: 42887 - protein, 132 aa, Sorghum bicolor
  Clone ID: SORBI-28MAY03-C27089_1.pep
MTAGFQLGVIGSLTLSVASSVAIVICNKALISTLGFPFATTLTSWHLMVTFCTLHVAQRLRFFEPKAIDGQTVVLFGLLNGTSIGLLNLSLGFNSIGFYQMTKLAIIPFTVLLETIFLKKRFSETIKFSLLV

SEQ ID NO: 42888 - protein, 265 aa, Sorghum bicolor
  Clone ID: SORBI-28MAY03-C29394_1.pep
ARGLGIVRVPGIGLIYTELVTGVPSIFSHFVTNLPAFHEVLVFLCVKSVPVPYVSQDERYLVGRIGPKEYRMYRCIVRYGYKDVQRDDDNFENMLVMSIAKFIMMEAEDASSSPSYDIANEGRMAVITTTDASGSPLAMRDFNGLADSMTTRSSKSESLRSLQSSYEQESPSVSRRRRVRFEVPEEDDMGQQVKEELMALVEAKHAGVAYIMGHSYIKARRSSSFLKKFAIDVGYSFLRKNCRGPSVTLHIPHISLIEVGMIYYV

SEQ ID NO: 42889 - protein, 374 aa, Sorghum bicolor
  unsure (1)..(374): unsure at all Xaa locations
  Clone ID: SORBI-28MAY03-C2896_1.pep
VRAYASPLEPVLPDVSVLISGPPIKDPGALLRYALPIDNKAIREVQKPLEDITDSLKVAGVRALDSVERNIKQASRALNNGRSLILAGLAEPKRANGEELLNKLAVGLEELQRIVEDRNRDASXVAPKQKELLQYVGTXDLAGTLHFCSVEEDMVDGFPYEIPEEYSTMPLLKGRATVDMKVKIKDNPNVEDCVFRIVLDGYNAPVTAGNFIDLVERKFYDGMEIQRADGFVVQTGDPEGPAEGFIDPSTGKIRTVPLEIMVDGDKAPVYGETLEELGRYKAQTKLPFNAFGTMAMAREEFDDNSASSQIFWLLKESELTPSNANILDGRYAVFGYVTENEDYLADVKVGGVIESIQVVSGLDNLVNPSYKIVG

SEQ ID NO: 42890 - protein, 122 aa, Sorghum bicolor
  unsure (1)..(122): unsure at all Xaa locations
  Clone ID: LIB3478-018-P1-K1-C11.pep
LEDITDSLKVAGVRXLDSVERNIKQASRALNNGRSLILAGLAEPKRANGEELLNKLAVGLEELQRIVEDRNRDAVAPKQKELLQYVGTVEEDMVDGFPYEIPEEYMTMPLLKGRATVDLKLK

SEQ ID NO: 42891 - protein, 206 aa, Sorghum bicolor
  Clone ID: SORBI-28MAY03-C29505_1.pep
ARGYLGLFDSEVEAARAYDKAAIKCNGREAVTNFEPSTYDGELLTEVSTEVAEVDLNLSISQPASQSPKRDKSCLGLQLHHGSFEGSESKKTKIDTPSELSGHPHRFPLMTEHPPAWPAQSHPFFTNHESTSSRDLNRRPEGGAPSWAWKVTAAPPHTLPLPLFSSSSSSAAASSGFSNTATTAAPSASLRFDAPPSSSSSHHHRR

SEQ ID NO: 42892 - protein, 197 aa, Sorghum bicolor
  Clone ID: SORBI-28MAY03-C29502_1.pep
TRVIFWVPVYDRVIVPVVRSYTGRPRGFTQLQRMGIGLVVSIFSMVAAGVLDIVRLNAVARHGLYGKDDHVPISIFWQIPQYFIIGCAEVFTFVGQLEFFYDQAPDAMRSMCSALSLTTVALGNYLSTVLVTIVTHITTRNGNIGWIPENLNRGHLDYFFWLLAVLSLLNFLVYLVIATWYKYKKTADDIPDAKGEH

SEQ ID NO: 42893 - protein, 296 aa, Sorghum bicolor
  Clone ID: SORBI-28MAY03-C29668_1.pep
ARGDDGHVASASTTERPVVAPAERRTRSGTPHRKRPKSKVWEEFTKIFRDGKLQAAVCKHCESSLSAKTTGGTSHLKRHLQSCPGRPSTGRVQLQRPFSHPNSSVQKNLNLDQNKSLELLIKVLVSNLFPSPFTSSTIFRQFWAGISPTNDMVSPAAIEEKFLSIFQTEKLKLQEEIELAPGGVFLTVAGSSLELKCVIFLMVHFIDKEWNLNRKIIRCCFTGCEDSDAEYYASMFPFLKSYYYIFNGNVRAVQIEIVKEVVQNWKPVCKLLGWSSAKSLDTLKESLFLKMPILIF

SEQ ID NO: 42894 - protein, 155 aa, Sorghum bicolor
  Clone ID: SORBI-28MAY03-C29694_1.pep
NLHKATGNPVLVCMVAGRFAYEIEKLSDEESVNFVMSQLRKMLPQATEPVQYLVSRWGSDPNSLGSYSCDLVGKPADLYERFCAPVGNLFFAGEAACIDHSGSVHGAYSSGIAAAEDCRRRLSTQLGISDLFQVAKVVMREEMNEVMVPFQISRL

SEQ ID NO: 42895 - protein, 151 aa, Sorghum bicolor
  Clone ID: SORBI-28MAY03-C46569_1.pep
RRWPVRWHQRARSWNGVEVAARSVSVRARRRVAGELLTGGVAVGDGGGASSLSGAVSLAREMAAWVVAFGGEAGVLLTSGATGLLRPCADLSTGHRGKEGGVASAAAIAGRRGRRRRAGSGRGADLRVCFLFSSQERESGGVLEGGLHRSQ

SEQ ID NO: 42896 - protein, 119 aa, Sorghum bicolor
  Clone ID: SORBI-28MAY03-C4661_1.pep
QPSNLKEMDPSIRLVQSVTPYEFEKQRDASDRNQQQLRLTYHLPIHPHGAPTREQGRKEGRGIPTTRFIYLSTKGRRPPGWVGFIGGTGQVGLVEDGQPMGSEYLPHPAPAAPRRNRTA

SEQ ID NO: 42897 - protein, 216 aa, Sorghum bicolor
  Clone ID: SORBI-28MAY03-C46780_1.pep
HEEKETSQHTFLGNTKDKTPPQSLPEPSKKPRKFQAPLTKDDMKDIKCGMEIGLTSPNSKKLVALGTVQKTDRKAKANDGQPLADYIEVLVSIVYKQTTILPRSHGKIQNLGSATARCIPWPPRVIICRDGTPLHSKQVCSPISKITPNTRGTVGPKRSTSKADATRLDKGQVASQGLLENKQAKRNVSKEETEQLTSSKYVEGHKSNIHITTSRC

SEQ ID NO: 42898 - protein, 131 aa, Sorghum bicolor
  Clone ID: SORBI-28MAY03-C46987_1.pep
ILDGETQLACRSPLQGHGKNIQSLCWDSAGEYLASVSEDSVRIWSFSSGRDGEFVHELNRSGNQFHSCVFHPTYQSLLVIGCYESLELWDIRDKNTMTFNAHDGLVAALAASSATGKVASVSHDRTLKLWK

SEQ ID NO: 42899 - protein, 134 aa, Sorghum bicolor
  Clone ID: SORBI-28MAY03-C30134_1.pep
SSTRSSRSRWRSGRGRWTTPWRRRCRRCRSSSSSSNPRWRPSTARARRPRSTPAGTRASRSRAPPRTPPRRPSSPSAATPRPRSPSRSRTRTRRPAPPRTTAPRRRPPRRRSRRCWTPPRCRSRLSVPTTTWPR

SEQ ID NO: 42900 - protein, 152 aa, Sorghum bicolor
  Clone ID: SORBI-28MAY03-C3016_1.pep
SAADHHIHYFDLRNPSAPVHIFGGHKKAVSYVKFLSNNELASASTDSTLRLWDVKDNCPVRTFRGHKNEKNFVGLSVNNEYIACGSETNEVFVYHKAISKPAASHRFVSSDLDDADDDPGSYFISAVCWKSDSPTMLTANSQGTIKVLVLAP

SEQ ID NO: 42901 - protein, 365 aa, Sorghum bicolor
  Clone ID: SORBI-28MAY03-C3039_1.pep
GSATEKKEVLLEDHDPVWLELRHAHIADASERLHDKMTNFISKNKAAQLHQARTGGELSTRDLQKMVQALPQYNDQIDKLSLHVEIAGKLNNIIREQCLRDVGQLEQDLVFGDAGTKELINFLRTQLVVSRENKLRLLMIYAALNPEKFESDKGAKLMQFVGLSADDMIAVNNMRCLCGPDTKKSSVGGFALKFDVHKKKHAHRKERTGEESAWALSRFYPILEELIEKLSKGELPKDEYNCMNDPSPSAHGPPTSSSARSSPAHSMRSRRTGGTWARPRGSDDGYSSDSVLKHASSDFRKLGQRIFVFVIGGATRSELRAAHKLSSKLKRDIILGSSSLDDPPQFITKLKLMSAEELTLDDLQL

SEQ ID NO: 42902 - protein, 183 aa, Sorghum bicolor
  Clone ID: SORBI-28MAY03-C30493_1.pep
MGCLPCFGSAGEGAAKKVGARKDGSSDRRVTRVESDKSKAHGGPDSKKDAVILRDGSNQHIAAHTFTFRELAAATKNFRQDCLLGEGGFGRVYKGRLENGQVVAVKQLDRNGLQGNREFLVEVLMLSLLHHDNLVNLIGYCADGDQRLLVYEFMPLGSLEDHLHDIPPEKEPLDWNTRMKIAA

SEQ ID NO: 42903 - protein, 289 aa, Sorghum bicolor
  Clone ID: SORBI-28MAY03-C30483_1.pep
ARGVCTTIRPRTPPPQSASTSTCGPTSPPVLVRSRRSPIPLPAAAPLSSPLCCRWACWICTEPGRLAAPPSTLPDPAASRLPCRCRCANPGAAPALHPRQQAPALAPRQILLLPLVRVHGPVGVGTRRASRGLPRSSSSFSILPTLSRTSSASTYPTLTRLTWPARLFSIHAPGVTHVLVTGGAGYIGSHAALRLLKDSFRVTIVVDPPCFLLHSSATSRLLLLLKSCVVPVRVFHIWDAYGYGTHLCCLQDNLSRGNIGAIKVLQNLFPEPGRLQFIQADLGDPEAVS

SEQ ID NO: 42904 - protein, 176 aa, Sorghum bicolor
  Clone ID: SORBI-28MAY03-C31439_1.pep
MSAPGRAPCGLPRIGLGTAVQGPRPDPVRAAVLRAIQLGYRHFDTAAHYATEAPIGEAAAEAVRAGVVASREELFITSKVWCADAHPDRVLPALRRTLSNLQMEYVDLYMVHWPVTMKAGRYTAPFTPEDFEPFDMRSVWEAMEECHRLGLAKAIGVCNFSCKKLDTLLSFATIPP

SEQ ID NO: 42905 - protein, 182 aa, Sorghum bicolor
  unsure (1)..(182): unsure at all Xaa locations
  Clone ID: SORBI-28MAY03-C28620_1.pep
TRVLQQHGHGPVRGHGGGGEPPATAASIAALPTVEVAEPTRXCAICKDDLPLASEARKLPCAHLYHSFCIVTWLQMHNSCPVCRFRIPDDEAAPLEQDPAPPTTRITIRFTTTTRRRVRVGGDATLAAAPISASPTQLAQAITGDGAGGPANSGETVSSEWPPHPESDTVMSEAREGDAIFD

SEQ ID NO: 42906 - protein, 230 aa, Sorghum bicolor
  Clone ID: SORBI-28MAY03-C28714_1.pep
MPLQHGPRLRMAAASGAARRPRSRLPGRPTSLPCGGSRTRTTALVLVAATTREGAKTTAAVATATAADVVRAFYDGVNRRDLAAVEPLIAEGCVYEDLVFPRPFVGRERIIGFFGEFMGTISPDLQFVIDDISADDSAAVGVTWHLEWRGKPFPFSRGCSFYRLLAGSESESEQQPLQIVYGRDCVEPAAKPGDLALVIIRGVTWILERFPSLASRFMMTFYEHNREGAN

SEQ ID NO: 42907 - protein, 144 aa, Sorghum bicolor
  Clone ID: SORBI-28MAY03-C28664_1.pep
MASQAIESHRAGAEVVTGGDAICRKKLIELLEELGLPKGFLPLEDIQEFGFNRQTGFMWLVQGKKKVEHTFKKIKQTVSYAAEVTAFADKGKLSKITGVKTKELMLWLSVVEVYVPEASPEKVTFKTGTGLSDTFDASAFALGE

SEQ ID NO: 42908 - protein, 61 aa, Sorghum bicolor
  Clone ID: SORBI-28MAY03-C28731_1.pep
ARGVAERLAQATGCCRGQGGSMHMFSAPHNLLGGFAFIGEGIPVATGAAFAAKDRHERLLS

SEQ ID NO: 42909 - protein, 347 aa, Sorghum bicolor
  unsure (1)..(347): unsure at all Xaa locations
  Clone ID: SORBI-28MAY03-C29299_1.pep
MASADADAGTCPWDALPSHLQERILSLLPITELLPVAAVSRALRRLLRSPAFHALLSPHRLDAFFLLSPRLAVHPLSRRVLTLPALAALSPPSYPLVSSPSPSLLITCASLQFLPPIPDGAYLLSVIVPSRRSSPSCTLVAVTTGAAVRSHTLDTGDPSPRWASRGDLPLSLTILGNAAVARDRGKLFVLGRGPDALLAFDLVTGTWXVPPVVMPQGLTTAHLFVFDGSLFLVGGIESFGEVERVVVWRLDVDKEEVWWWREVSEMPTEVFDELLAGRFGSFWHFQAADRLGIVCLYNAVDGRLVMFDASDGAWTVLPRLSGLDADESLRWFGHVLEPGVEILMGLR

SEQ ID NO: 42910 - protein, 251 aa, Sorghum bicolor
  Clone ID: SORBI-28MAY03-C30790_1.pep
LLAIPSDDRPEYASLQAVLFGPFVLAGLSTGDWDAKAGNGSAISDWITAVPPAHNSQLVTFSQVSNGKTFVLSSANGTLTMQERPEVDGTDTAIHATFRAHPQDSTELHDIYRTIAKGASILIEPFDLPGTVITNNLTLSAQKSTDCLFNLVPGLDGNPNSVSLELGTRPGCFLVTGTNYSAGTKIQVSCKSSLESIGGILEQAASFSQTDPLRQYHPISFVAKGMTRNFLLEPLYSLRDEFYTVYFNIGA

SEQ ID NO: 42911 - protein, 160 aa, Sorghum bicolor
  Clone ID: SORBI-28MAY03-C30797_1.pep
SDKVAFIFDLIKLYEDDPKTLDSCLRRIMCSSKILKLGYDIQCDLHQLTQSYGELDCFQSYEMLLDMQKLFKGVTGGLSGLSKEILGAGLNKSRRNSNWEQRPLTQNQKEYAALDAVVLVHIFHEHMRRQAQFGVSEGSKVEWKSHVVSRVNSMRRPLRF

SEQ ID NO: 42912 - protein, 171 aa, Sorghum bicolor
  unsure (1)..(171): unsure at all Xaa locations
  Clone ID: SORBI-28MAY03-C30804_1.pep
LGGVCSAGLLVAQNAGFPWRVEYLVWLGDPECLAWVRRAVSHLPRLLLSPCRGGWRAGAPPAPPERAPVVVTATRRCPGPQLSGSAMLGLHXAELASPFVKMFHAGTALDEDGNLVAVGGRVLGVTAKGKDIEEARARAYDAVDAVDWPEGFFRRDIGWRALRHKQVANCL

SEQ ID NO: 42913 - protein, 158 aa, Sorghum bicolor
  Clone ID: SORBI-28MAY03-C31231_1.pep
HEAYNRGILNNFLEIFCTAIPPSKNNFRARVTVEQGLHQTRSQSRGFMSPSMGKPIGDLEMGRKPVAPWDEPRTAADIRDLETGLGGMFDEKEGRVAHASPDLSRDLPAEFVEGRSGMHSRQSSWVQRAGDAFEASMVQMANARTAEASNNVARSGTR

SEQ ID NO: 42914 - protein, 269 aa, Sorghum bicolor
  unsure (1)..(269): unsure at all Xaa locations
  Clone ID: SORBI-28MAY03-C31121_1.pep
MDGRPPPPYYARSSALPEGYARPFAGEEHPSDSRVGYPNYLAPEGSVASYYTSRPSVLPGGPDVLRNDVMLQPSGYGYDGPVGVMNPALVGARGLPVGAMPRGSSALEDPSLAGLSVRAPARALGPSPLKEEPDVVGRSSSLVPGASIPDVERHSTLQNFDGPSEDESNILFVDCLPTDCTRREVAHLFRVFPGFKDIRVVHXGPRRSGDKAYVLCFVEFENAKCAGCPMRELQGYCFDDRKPDSPRLKIQFARFPFALPAAQDHHKKR

SEQ ID NO: 42915 - protein, 156 aa, Sorghum bicolor
  Clone ID: SORBI-28MAY03-C29797_1.pep
YSKTLTSVGDQVVQCSAASFSPDQISSFATSQVDYILGDNPKGMSYMVGFSSKFPRRIHHRGSSIPSIKVLPRKVTCNEGFSSWFPTSNANPNNHVGAIVGGPDGNDQFSDNREDSTHSEPATYINAAFVGACAAALGQQNQLKEPVDNIAPVDII

SEQ ID NO: 42916 - protein, 121 aa, Sorghum bicolor
  Clone ID: SORBI-28MAY03-C2984_1.pep
AENQEELMASNYVDTVVEESRFHGHHHHHHHHHHSSSTTPTGAAASPKTMRRSWSSASSAHSHGSTPKCVCAPATHAGSFKCRLHRSSSHSHPASPPSPATTSAAPPPAAAASSSRTVAAQ

SEQ ID NO: 42917 - protein, 129 aa, Sorghum bicolor
  Clone ID: SORBI-28MAY03-C29829_1.pep
VLEKNAGPHDRLVHVYHFDLERRVLQFADPCFLLRRDGEALSDIKVRIQKRLQVPDEQFIKWKFAHVTFSRPEYLQDSDIVLNRFHKQKPVYGAWEQHLGLEHTATTPRRSYFGSQNRHSFERPVKIYN

SEQ ID NO: 42918 - protein, 182 aa, Sorghum bicolor
  Clone ID: SORBI-28MAY03-C29972_1.pep
MDYSGTKEGVWWSRETVAVVTGANRGIGHALAARLAEHGLTVVLTARDGERGEAAAAPLLARGLAVVFRRLDVSDPASVSEFAAWIRDAVGGLDILVNNAAVSFNEIDTNSVEHAETVLRTNFYGAKMLTEALLPLFRQSSATSRILNISSQLGLLNKVSDPSLKALLLDEDRLTEAGIEAM

SEQ ID NO: 42919 - protein, 236 aa, Sorghum bicolor
  Clone ID: SORBI-28MAY03-C30112_1.pep
HEAEVEEEEVEEPPPPSATAEEAKAALGSEGSRPFTMRELLGELKEDGETAAGGGSARSAFGDGNGVGSADAEGSSYSQDSTQQFSSHHDVAMDLINSVTGVDEEGRSRQRILSFAAKRYVNAIERNPDDPDAYYNWALVLQESADNVDPNSSSSKDALLEEACKKYAEATRLCPTLYDAYYNWAIAIADRAKMRGRTKEAEELWKQAILNYEKAVQLNWNSPQALNNWGLGLQEL

SEQ ID NO: 42920 - protein, 189 aa, Sorghum bicolor
  Clone ID: SORBI-28MAY03-C32166_1.pep
ARRPRPAPGLLSRLSAPRSAPLGTTRLWCCLFVYRTHYPARIMFILGMGFLWKPVAILAAFMTGLSIAFLNDSFAVTFNEKVTRTVRQFSPHLAAKMRPPITPVLRGRPSSKRSIHICGRPRWVFVLFFSAVSCMLWLTSCSLLTVLWALLIALFATVLHASFRTPNLKARLNTFREEFRAVWRNYSEL

SEQ ID NO: 42921 - protein, 154 aa, Sorghum bicolor
  Clone ID: SORBI-28MAY03-C3192_1.pep
ILDLGGVWRSQLQKLVRAWLATCMAPRWHVGCATGISTGRRCRATSPVWPRNRRPGGGGTGTTSSPGFVSGSPEAASQLMVHCSGTVAAMFAATLVGLITAANAKPKNAMLWKVAPALTVVYNDAKFVNERAQNDILLLSRLNERACQDAAVLG

SEQ ID NO: 42922 - protein, 81 aa, Sorghum bicolor
  unsure (1)..(81): unsure at all Xaa locations
  Clone ID: LIB3481-019-P1-K1-C3.pep
CGNPQFSHDQVPPKKSAYASQGLAEACKFVWXDAKFVNERAQNDILLLSRGITRLNERACQDAAVLGLGVLKLDARARKDT

SEQ ID NO: 42923 - protein, 208 aa, Sorghum bicolor
  Clone ID: SORBI-28MAY03-C32747_1.pep
VAGDLLKQYQEKFKGGTLSVTWNYLRDSMGTYLSQPNPVTARWEGEDHLRDPNFQLDAFRYRTSRLLHSVAARLQKHSKTLGGFGAWNRCLNHLLTLAESHIESVILAKFIESVKSCPDEKTREALKLVCDLYALDRIWKDIGTYRNVDYVAPNKAKAIHKLTDYLSYQVRLVARELIDAFDLPDLIIRAPIGMQSEAYAQYTQYVGF

SEQ ID NO: 42924 - protein, 102 aa, Sorghum bicolor
  Clone ID: SORBI-28MAY03-C32732_1.pep
SEPAGSGPREAWWKQQLLSLYKNAKESNNFWPIVATAAALVGLAYFGRRWHKGKLQFQLVKVPPSSNKEKISDAVGPLNRIKDILVAGSHPSQGIHGHARAS

SEQ ID NO: 42925 - protein, 98 aa, Sorghum bicolor
  Clone ID: SORBI-28MAY03-C32780_1.pep
RCGPSGAGPLRKPSLSWVPPAVSGGRLAAAPSLDPEMEVDPWNLLEDGTSCPSTTSGSNGASGVTGDHANLKACSWLKGAVRVRRTELTYIGSLDDDS

SEQ ID NO: 42926 - protein, 151 aa, Sorghum bicolor
  Clone ID: SORBI-28MAY03-C32846_1.pep
YTCDMYGTVEMWAEPPHAWPDEEVTHRWRFRCLIETPAGDLIRVKRLCQNKFAVWILDKGTFSWVGTENIGDLALFVSHYNSFCFPANDHPNLKANCIYFIDMYNNLCAFNLEHGTKELVQTLAIGQGQGRNDYYRRPQRDQILWFIPSLE

SEQ ID NO: 42927 - protein, 117 aa, Sorghum bicolor
  Clone ID: SORBI-28MAY03-C30573_1.pep
KLKVDPPPPPAAPISPAAATRAPPVPQTQANQSVPRQAATPKEQLPPPPPLAKPPIADPAALVRERLPPTPKKPEPPVVTLDDLFKKTQSSPRIYYLPLSEEEVAAKLAAQGKGKKE

SEQ ID NO: 42928 - protein, 339 aa, Sorghum bicolor
  unsure (1)..(339): unsure at all Xaa locations
  Clone ID: SORBI-28MAY03-C3063_1.pep
PRVRDIANYNQLDNQDEAQEETGWKLVHGDVFRPPVHSGLLCVYVGTGVQFFGMTLVTMMFALLGFLSPANRGGLMTAMVLLWVFMGVLAGYTSSRLYKMFKGTEWKKITLKTAFMFPGIIFSGFFFLXALIWGEKSSGAVPFGTMFALFLLWFGISVPLVFVGSFLGFKQPAIEDGVMGNKIPRQIPEQAWYLQPAFAILAGGILPFGAVFIERTCILTSIWLNQFYYIFGFLFIVFVILIVTCAEITIVLCYFQLCSEDYHWWWRAYLTAGSSALYLFAYAIFYFFNKLEITKLVSGILYFGYMLIISYAFFVLTGTIGFYACFWFVRKIYASVKID

SEQ ID NO: 42929 - protein, 292 aa, Sorghum bicolor
  Clone ID: SORBI-28MAY03-C30661_1.pep
MLHPTLLFVLPPSPPACAQRSPPTHTTGPPVANAPLRPLRRRRAPPVTMSSYPVLNNRPIDQWRVTDLKDELRKRKLPVKGLKDELVRRLFDSIQSEREAEETEEADEDVGVNVDDQLPDANASEENTVTVTEVHQETVVHITQQVEAPTTEVGQESALSPTRGAPSVDVEEASTAKGEVPESFAGTFEEVQVQTESTNEPLHEKTSDIDTNEEVIVNDAIDVNSDLTPAEVKLGTMEASKIEEQDFPPAPVDAITSDASGPMDTDVVTAATSDAGPMDTDVVTAAPVSDDG

SEQ ID NO: 42930 - protein, 384 aa, Sorghum bicolor
  Clone ID: SORBI-28MAY03-C30738_1.pep
ARGTCPVTHAPLRHEDLVPNHAIRRVIQDWCVANRSRGVERIPTPKIPVTPVQASELLFDLAGCARRRDAAAPARCAEVVAKIKALARDSERNRRCFASIGTGRVLAAAFESLASAAAADAAPAGRVLEDILAALVCMMPLDEHAARTLGLPSSLGSLVAIAENGTLAGRLNAVLAIKEVVSCDGAFTDLSGKVDEIVDALAKIIKSPICPQATKAGMVATYHLALYDERVAARLAAAGLVPVLIEALVDADKSMSEKALAVLDAVLASEEGRASARAHALAVPMLVKKMFRVSDLATQLAVSAMWRLGKAHSDGEEEENAVTRCLVEALRVGAFQKLLLLLQVGCRDATKEKATELLKLLNKYKSVGECVDAVDFRGLNKLSS

SEQ ID NO: 42931 - protein, 92 aa, Sorghum bicolor
  Clone ID: SORBI-28MAY03-C30789_1.pep
LNTAMAINGLTTLLIARLDHREAIARLTLLKLIKVVYEHHPRPKQLIVENDLPQKLQNLIEERRDGQRGGQQVLVKQMATSLLKALHINTVL

SEQ ID NO: 42932 - protein, 114 aa, Sorghum bicolor
  Clone ID: SORBI-28MAY03-C34250_1.pep
VDLLIRLLEHLYTKKIFKTQDLEAGCLLYGALLDDIGIDLPKAPTQFGEIIARLTLLGALRFEAVEEVLKKMEDTFYRKQVFNAVMKTLEANPSGQAILGSQAAVIDACNSLLK

SEQ ID NO: 42933 - protein, 244 aa, Sorghum bicolor
  Clone ID: SORBI-28MAY03-C3427_1.pep
TRKTNQHIMKEPSSHVTPRADGMQIDGNEDSADKSVEEYPTKRRRLFSSMDATTSLMEQLALLTTTASPDVVAAAADAAIKAFSNENPQAKKAFRLSEREYKTKAFGSNHVQQIDRKIGDKDVKMHGQPGSDKQEKKFIANAYQLRAAVATAVGVAAARAKMLADQEEREMELLMASVIETQLRKMQYKIKHFEELESVMDQEYTTIQQMKGSLMNEWLKVLEHAFRAGVSLPRDELLTKLFLN

SEQ ID NO: 42934 - protein, 197 aa, Sorghum bicolor
  Clone ID: SORBI-28MAY03-C34290_1.pep
STAADNDSGVRYYDMERFQLFKHFQFEWPVNHTSLSPDRKVVVIVGDDPDGLLIDANSGKTLHSIKGHRDYSFASAWSPDGRTFATGNQDKTCRIWDVRNLSKSVHVLRGNLGAIRSIRFTSDGQFMSMAEPADFVHIYDVKSDYNKRQELDFFGEISGTSFSPDTDTLFVGVWDRMYGSLLQFGRLYNYSYLDSLF

SEQ ID NO: 42935 - protein, 101 aa, Sorghum bicolor
  Clone ID: SORBI-28MAY03-C3432_1.pep
MLPSTIFGHIPGFSPTLPSVRAKLNAAKDKYLSPPTPVSPSSQMEEKQWNFSFTLVWNSIVWLVLLNFFIKIITSTAQDYLKKQQDMEMELISDSPTLEQN

SEQ ID NO: 42936 - protein, 321 aa, Sorghum bicolor
  unsure (1)..(321): unsure at all Xaa locations
  Clone ID: SORBI-28MAY03-C34374_1.pep
TRLSAWFRLKFPHLTCGSLASSGVVLARGNFTDFDKQIGISAGPECKAALQEITGLVDGQLQSGRNSVKELFGAPKLENDGDFLYLLADAAAIAFQYGNPDVLCSPLAEAKKNGTDLVETFASYVKDYYIGKFGASVASYDQEYLKNTTPAESSYRLWWYQVCSEVAYFQVAPKXNDSVRSPKIDTRYHLDLCRNVFGEGVYPDVFMTNLYYGGTGIAGSKIVFANGSQDPWRHASKQKSSDELPSYLIECENCGHCSDLSGCPQAPSNIEGDSSKCSPPESLNKVRKEIVDHIDLWLSECQEQGHDKEPSLGSRWAISTI

SEQ ID NO: 42937 - protein, 130 aa, Sorghum bicolor
  unsure (1)..(130): unsure at all Xaa locations
  Clone ID: SORBI-28MAY03-C31508_1.pep
APPPPAPPLLPPAPPSPPPPPPPAPAAPPRPPPPGADAPPTPRGRGPGPAPTPPRPPRPPSPLPAPPPRPPAXSSPLPPPGCRAAPRRARPGSGSGMRPSSAAPPQPGNHSKPLPLPPRRALPLMARRRC

SEQ ID NO: 42938 - protein, 77 aa, Sorghum bicolor
  Clone ID: SORBI-28MAY03-C3156_1.pep
GRPRVAQVQPQQPQPKGSKTAAATELDTVAAGRRVSYGGANAKASTGGARRTFLPYRQDLVGLFANVRGLSRSHHPF

SEQ ID NO: 42939 - protein, 231 aa, Sorghum bicolor
  Clone ID: SORBI-28MAY03-C3169_1.pep
MAPKNALPAASAVTDGMMEPRFRGVRKRPWGRYAAEIRDPARKARVWLGTFDTAEAAARAYDAAALHFRGPKAKTNFPVAFAAAAHAQALALPLPLPPPPKKLAVSPSSSTVESSSRDSPATPPRARSPSPAPTVMPAPSLDLCLGMPAMVAAQPFLFLDPRLAVTVAVPAPVACRPTAVAAGAKKQTAPTSCGGDEEQSDTGSSSSVVDASPEAVCVGFDLNMPPPAEVA

SEQ ID NO: 42940 - protein, 112 aa, Sorghum bicolor
  Clone ID: SORBI-28MAY03-C32149_1.pep
MATLRNLKIKTSTCKRIVKELRSYEKEVEKEAAKTADMKDKGADPYDLKQQENVLAESRMMVPDCHKRLETALADLKATLAELKESNEQGAEIGEAESTIAEVEAVVKPTED

SEQ ID NO: 42941 - protein, 352 aa, Sorghum bicolor
  Clone ID: SORBI-28MAY03-C347_1.pep
MELQLLVRPAATAPSSARARPPLRLPAPAAGPSRPRRPGFPTLRAAAAAAAAIAAEPETKEQQQNSIMETEVFACPVCYEPLMRKGPPGINLPAIYRSGFKCSKCNKSFTSKDIFLDLTVTAGTKEYSEQKPARTELFRSPLVSFLYERGWRQNFNRSGFPGLDEEFEMAQDYFQPVAGGILLDVSCGSGLFTRKFAKSGTYSAVIALDFSENMLRQCYEFIKQDDTLLNANLALVRADISRLPFASCSVDAIHAGAAIHCWPSPSNAVAEISRVLRPGGVFVGTTFLSSPRNNPFSVEALRPLRQIVGPVNTSYNYFTEGELEDLCKSCGLVNYSSKVQRSFIMFSGQKPY

SEQ ID NO: 42942 - protein, 117 aa, Sorghum bicolor
  Clone ID: SORBI-28MAY03-C34845_1.pep
NEFMTLLRNPLYLFAIFVIYLVGKTIWVQSEIGREFQHGFLPAILSLSTKFVPTVMNILKRLADAGQEPAAAPDRQRELELQPKSTRNGSYSNVTSAGSSSVTTSEIGPEYSSPVAQ

SEQ ID NO: 42943 - protein, 165 aa, Sorghum bicolor
  Clone ID: SORBI-28MAY03-C34869_1.pep
QREIPAASFVSRQQYGSVGEEFPHIDIINDLLDEDQSSAHMAVSPLHEYHTFGLPFSSGGNMADSETASVSSSVRFDLTDLYYDEGYRRAYDTQNALRRLDAYPNGRLDSTAPQRWPYNHPNPAVNLGNSSNVFPQQLGEYTNLASGRVNGEYLDYMYRRANGQW

SEQ ID NO: 42944 - protein, 146 aa, Sorghum bicolor
  Clone ID: SORBI-28MAY03-C34721_1.pep
GISMNLPISRMQRDLTDSTVLRNLGMGLGHSLLAYKATIRGISKVQVNESRLAEDLEQTWEVLAEPIQTVMRRYGIPEPYEKLKELTRGQAVTKDSMQQFIDGLDIPEEVRSKLSKLTPHSYTGLAEDLARDIEKWVDLESGFQIK

SEQ ID NO: 42945 - protein, 156 aa, Sorghum bicolor
  Clone ID: SORBI-28MAY03-C34943_1.pep
LEKPAPANIEQKVEPVVMDESMMKACEAVARVRAEVDKLSAKVCDLEKNVLGGRKVEDKEFVVLTELLMMQLLKLDGIEAEGEARAQRKAEVRRVQSLVETLDKLKARNANPFSDHNKAVSVTTQWETFENGMGSLSAPPPRVSSTQVNTDWEQFD

SEQ ID NO: 42946 - protein, 139 aa, Sorghum bicolor
  Clone ID: SORBI-28MAY03-C34973_1.pep
TGTSGHCTVEYSMLSPNQSAEKWIPLQGVKSGEIHVKIARRVSVPDSEKKNILGTDPSGKGHKISTQMRDSLKKFTGLIDDGGDPEALALAVTEMEGIQGEQEEYIETLEREKAMLLHKIHELGSEIIRTSSGPPRTRY

SEQ ID NO: 42947 - protein, 51 aa, Sorghum bicolor
  Clone ID: SORBI-28MAY03-C3249_2.pep
ENYSIEIVPCSLERYYWEKNKPMELGSWITFLRMLNFPLKQRQTLMDSAPE

SEQ ID NO: 42948 - protein, 90 aa, Sorghum bicolor
  Clone ID: SORBI-28MAY03-C3249_1.pep
TSFTTLQMQRGHVEGLNPLMFAFALVGNSTYVGSILVNSMDWSKLRPNLPWLVDAGGCVLLDSFIILQFLYFHYRKQREPSDEHDDADKA

SEQ ID NO: 42949 - protein, 73 aa, Sorghum bicolor
  unsure (1)..(73): unsure at all Xaa locations
  Clone ID: LIB3478-034-P1-K1-H7.pep
MPSGTVIPVGRRLLLFVDDHGNSSLSHGSGSEIGSFLGWAMAIIYMGGRLPQIXLNMQRGHVEGLNPLMXCLA

SEQ ID NO: 42950 - protein, 84 aa, Sorghum bicolor
  Clone ID: SORBI-28MAY03-C32953_1.pep
MDTSRGVACLLVAVICLSCAAAAAARSPAARLHRHLKRLNKPAVKSIESPDGDMIDCVHISHQPAFDHPYLKNHTIQMRANYHP

SEQ ID NO: 42951 - protein, 238 aa, Sorghum bicolor
  Clone ID: SORBI-28MAY03-C33022_1.pep
RELVSSFLKGDLRHRNRSRESLVRVELDRISEESPMHNPNSHLNSNTKAKELSICRLKMRAVQLSTDHSTSIEEEVLRIKVEHPDDPQAVFNDRVSARLKVTRAFGAGFLKKPKFNEALLEMFRIDYVGTSPYISCNPAVLHHRLCANDRFLVLSSDGLYQYFSNDEVVSHVLWFMENVPEGDPAQYLVAELLCRAAKKNGMNFHELLDIPQGDRRKYHDDVSVMVISLEGRIWRSSG

SEQ ID NO: 42952 - protein, 167 aa, Sorghum bicolor
  Clone ID: SORBI-28MAY03-C33173_1.pep
MPGGSSGADGEVDAGFAKLQGEDFEYYMQTYSIMLGRNSKKSTVDVDLSSLGGGMNISRHHARIFYDFQRRRFALDVIGKNGCLVEGVLHLPGNPPVKLDSQDLLQIGDKKFYFLLPTRSIFASAAAARHAPVIPPQLPPPSYAHARGPGRPRLSEFHDRSYEADYG

SEQ ID NO: 42953 - protein, 208 aa, Sorghum bicolor
  Clone ID: SORBI-28MAY03-C33054_1.pep
MRRPWRHPGPGAAVAARHGAADLCLREVGDLLPRRFARRAAGSEDLVMRLQIHRKLDRHTGCVNTVSFSEVGDILVSGSDDQRVMLWDWDTGTVKLEFHSGHGGNVFQARFMPCSDDQTIVTCAADGEVRLAKIQDGGDVSTTLLGEHGGRAHNLAIEPGSPYILYSCGEDGLVQQFDLRTNTASKLFLCRSSFIKSVSSTRIHLNAI

SEQ ID NO: 42954 - protein, 234 aa, Sorghum bicolor
  Clone ID: SORBI-28MAY03-C33684_1.pep
MASSASLQRFLPPSSHAATASSSRRRTGRARAAVSMPPSSPPATGEVPAERLEPRVEEREGGYWVLKEKYRTGLNPQEKVKLEKEPMGLFMEDGIKDLAKIPMEEIDAAKLTKDDVDVRLKWLGLFHRRKHQYGRFMMRLKLPNGVTTSEQTRYLASVIEAYGADGCADVTTRQNWQIRGVTLPDVPAILDGLRAVGLTSLQSGMDNVRNPVGNPLAGVDPHEIVDTRPYTNLL

SEQ ID NO: 42955 - protein, 197 aa, Sorghum bicolor
  Clone ID: SORBI-28MAY03-C35913_1.pep
MGSTRLGCSTYYSSDRGGEELAGAGSTRGKLTPSSAAMGSLGGSAGAGDGGKVGLPALDVALAFPQATPASLFPPAASDYYQFDDLLTEEEKALRKKVRGIMEKEIPPIMTEYWEKAEFPFHAIPSLASLGLAGGTIKGYGCPGLSLTASAISIAEVARVDASCSTFILVHSSLAMSTIALCGSEAQKQKYLPSLAE

SEQ ID NO: 42956 - protein, 189 aa, Sorghum bicolor
  Clone ID: SORBI-28MAY03-C362_1.pep
RPPHPGALAGAPPIDAARCFVAGDSAGGNIAHHVARRYALDPSAFASLRLAGLIAIQPFFGGEERTPAELRLVGAPIVSVPRTDWMWRAFLPHGADRDHEASSPEAATAGIDLDAAGSFPPATVVVGGYDPLQDWQRRYCDALRGKGKEVRVLEYPDAIHAFYVFPEFAESKDLMLRIKEIVAGSSSSE

SEQ ID NO: 42957 - protein, 155 aa, Sorghum bicolor
  Clone ID: SORBI-28MAY03-C36294_1.pep
MDPRALGAGMLLAVLLMAATAAASARPDDDDVAGSGAGAGGIRQPASDGYRGRKVGARTEVRDVESDGEVQELGRFSVAEYNRQLRGDGGGRLEFGRVVAAQRQVVSGLKYYLRVAAVEEGAQNAGGERAFDAVVVVKPWLESRTLLTFAPAAAK

SEQ ID NO: 42958 - protein, 426 aa, Sorghum bicolor
  unsure (1)..(426): unsure at all Xaa locations
  Clone ID: SORBI-28MAY03-C36083_1.pep
TGRIPRVRVFVLAFASSRSCLERASLCRRPHSVTHRRSQWTEAKLLGAGTGMAAAPPPGADELQPFPPKEQLPGVAFCITSPPPWPEAILLGFQHFIVMLGTTVIIPSSLVPQMGGGNEEKARVVQTILFVAGINTLFQTFFGTRLPVVMGGSYIFVGPTISIILAGRYSNEADPHEKFLRTMRGTQGALLIASTIQIILGFSGLWRNVVKLLSPLAAVPLVSLVGFGLYELGFPGVAKCVEIGLPEVFLLVVFSQYLSQVLDFGKSVFSRFSVLFTVSIVWLYAYILTIGGAYKNSPPKTQVHCRVDRSGLISGAPWISVPYPFQWGAPTFDAGEAFAMMMTSFIALVESTGAFIGASRYASATMIPPSIISRGVGWQGIGLLLDSFFGTATGTSVSVENIGLLALTRIGSRRVVQISAGFMIXF

SEQ ID NO: 42959 - protein, 143 aa, Sorghum bicolor
  Clone ID: SORBI-28MAY03-C36308_1.pep
LDDDPQCAVCKDKFELGAEAREMPCKHLYHTDCIIPWLVQHNSCPVCRHPLPSQRSGSTSTPRAPSAYYNEAADAPEVTRTDLDPAPRNSGSESQERHSSFSFLWPFGPSGSSSSPYQYEESVDEPAVYDPNQIAYSEWHYDH

SEQ ID NO: 42960 - protein, 152 aa, Sorghum bicolor
  Clone ID: SORBI-28MAY03-C36321_1.pep
GGKHGIGRIDMVENRLVGMKSRGVYETPGGTIMAAAVRELGSRPLDRETMQWKDIIALKYAELVYAGRWFDPLRQSFDAFMEKITATTTGSVTLKLYKGSVNVASRKSPYSLYREDISSFENGEIYNQADAEGFIRLYGLPTRVRAMLEKGI

SEQ ID NO: 42961 - protein, 196 aa, Sorghum bicolor
  Clone ID: SORBI-28MAY03-C34400_1.pep
MAGAAAAAVASGISARPAAPRRASTGRRARLSVARAAISLEKGEKAYTVQKSEEIFNAAKELMPGGVNSPVRAFKSVGGQPIVFDSVKGSRMWDVDGNEYIDYVGSWGPAIIGHADDEVNAALIETLKKGTSFGAPCLLENVLAEMVISAVPSIEMVRFVNSGTEACMGALRLVRAFTGREKIVKFEGCYHGHADS

SEQ ID NO: 42962 - protein, 274 aa, Sorghum bicolor
  Clone ID: SORBI-28MAY03-C34421_1.pep
STTRSLIRSPLPLGQGGKSSKAQAGEASEMGAGSSRADAPSRRRARLSLGGCFGAGSSSSAAAAVAAEHRGGSFTAAGPSSSRAIEVQSRQSGRPVSALNFQASLAAKDLQISSESNPRLHSSSSTISHHLRFNHLNCHENKEDGLGTENAETSGLESSSRKPVMVRGSLSNEAVNSDVSGEGISFIGSELENVPSTVSTNEIGDSTSESGLGPSLMTSERIMSDLEGEISPQGTSSTTVMTSERSDVSQSSLTSMFPNSSTASSATVEPMPDP

SEQ ID NO: 42963 - protein, 293 aa, Sorghum bicolor
  unsure (1)..(293): unsure at all Xaa locations
  Clone ID: SORBI-28MAY03-C3456_1.pep
TNLKLCKIWFDMGEYGRMSKILKELHKSCQREDGSDDQKKGTQLLEGYAIGIPMVTGTKDXKRFRDWFXNGRVGKSAIPHPRIMGIIRECGGKMHMAERQWAEAATDFFEAFKNYDEAGNPRRIQCLKYLVLADMLMESEVNPFDGQEAKPYKNDPEILAMTNLIAAYQKNDIMEFEKILKSNRRTIMDDPFIRNYIEDLLKNIRTQVLLKLIKPYTRIRIPFISQELNFPEKDVEQLVVSLILDNRIQGHIDQVNKLLERGERSKGMRKYSAIDKWNTQLKSIYQTLSNRVG

SEQ ID NO: 42964 - protein, 278 aa, Sorghum bicolor
  Clone ID: SORBI-28MAY03-C34590_1.pep
HEALFETQVSQKVVVFFSTCDSVHFHHTVLSQLKWSSDPHLDIDKKQNFLSCKVFRLHGNMEQDDRKKSFLGFGSEKSAILVSTDIAARGLDFPKVKYIIQYDSPGEASEYVHRVGRTARIGEKGEALLFLQPIELDYLKDLELHGVSLTEYPFQRVLDSFPVNGQKPHKRKLISLDMHPWIMSLQRSLEAFVAAEDATKKLARDAFCSWVRAYTAHRGELKKIFMVKKLHLGHVARSFGLKEQPSLVGRSHQMQLKKRKKEQKRERPAKRRKLPSKK

SEQ ID NO: 42965 - protein, 163 aa, Sorghum bicolor
  Clone ID: SORBI-28MAY03-C3676_1.pep
MARVYVGNLDARVTSGELEDEFRVFGVLRSVWVARKPPGFAFIDFDDRRDAEDAIRDLDGKNGWRVELSRNSSGRGGRDRYGGSESKCYECGETGHFARECRLRIGSGGLGSGRRRSRSRSRSRSPRYRRSPSYSRRSYSPRYRSPRRRSPSPARGRSCSRSP

SEQ ID NO: 42966 - protein, 184 aa, Sorghum bicolor
  Clone ID: SORBI-28MAY03-C3678_1.pep
ARGPCAHIYHADCILPWLAIRNSCPVCRHEMPTDATPRAAANAGAAGEEEEATVGLTIWRLPGGGFAVGRFAGGRRPEERELPVVYTEMDGGFNSGGAGAPRRISWGSRQTASTDRGTVRRFLRNVFACFGGRGSAASRSHAMPELDDDDASDHSAAFSRGGSRSRSTSWRLEDGHAADAMVQR

SEQ ID NO: 42967 - protein, 118 aa, Sorghum bicolor
  Clone ID: SORBI-28MAY03-C36853_1.pep
MGMGPGAGAGAGYGGGMGMNRPMGMGMGMGMGMNQQQMRMRVDPLPMGMGMGMGMNQQPMGMGMGMNQQQMGGMNMGMGMNQGMPMRPMGMGPGGMPGAGYNQMGAAYGGQQPYGGYR

SEQ ID NO: 42968 - protein, 157 aa, Sorghum bicolor
  Clone ID: SORBI-28MAY03-C3667_1.pep
PRATHGSASPPFLLNLFWGVLYWKRRAEQALIASGIPYTIIRPGGMERPTDAFKETHNLVLAPEDTYVGGQVSNLQVAELIGCMAANRRAAYCKIVEAVAETTAPLLPTEQLLSTIPSKREPPCSGPADDDEPGDDADPKPPQPPPAPAAAEGSQTT

SEQ ID NO: 42969 - protein, 99 aa, Sorghum bicolor
  Clone ID: LIB3481-027-P1-K1-B10.pep
CLRKGDEGARCDIIYGTQVFFFSLRAYALTLSTTGFALRSVQTHISKQIRIEMYVCTFFNANPVVERVAAHAGKNNFLVIYGLYLRRVGCQSVNWLCSD

SEQ ID NO: 42970 - protein, 260 aa, Sorghum bicolor
  unsure (1)..(260): unsure at all Xaa locations
  Clone ID: SORBI-28MAY03-C36860_1.pep
HEGGSSLYGNLSAARMREWLAYHAHFFGPASHFVLHDAGGVSPEVRAVLDPWVRAGRVTVQDIRAQAEYDGYYYNQFLVVNDCLHRYRHAANWTFFFDVDEYLYLPXGRTLQEVLGQLAAYSQFTIEQNPMSSKLCLQDPTMDYSREWGFEKLVFRNSITGVRRDRKYAIQARNAYSTGVHMSQNVIGRTTHKTESLIRYYHYHNSINVMGEPCREFVPTPTNGSKVMFEGIPYVYDDNMKRITGEIKRFEEETLGTIRR

SEQ ID NO: 42971 - protein, 235 aa, Sorghum bicolor
  Clone ID: SORBI-28MAY03-C36875_1.pep
NFLCYTHTLHYKPEYTAASQICTGGARHDEVDFEFLGNASGEPYLLHTNIFSDGRGEREQQFALWFDPTRGFHTYTILWNPHSIILYVDGVPIRVFANNAAAGVPFPARQPVRVFASIWDAEDWATQGGRVRTDWNRAPFVATYRRYNVTNACVWEDEEDGGGGNGGRVRCPTTAVAGSGRRRRAAAWMAQRMDWWSWMTLSWVRMNYMVYDYCADRRRFPHEFPPECAIPIGRS

SEQ ID NO: 42972 - protein, 150 aa, Sorghum bicolor
  Clone ID: SORBI-28MAY03-C35193_1.pep
SSTSVNQTLLNTRFVLRTPDISAMHHDDTPDLRIVAQKLADNLKIMDTSLDTRKMVVEICDIVTSRSARLAAAGIVGILRKIGRAVPGDERRSVVAIDGGLFEHYAEFRKCLESTLVELLGEEASKSLVVKLTKDGSGLGAALIAAAQSQ

SEQ ID NO: 42973 - protein, 169 aa, Sorghum bicolor
  unsure (1)..(169): unsure at all Xaa locations
  Clone ID: SORBI-28MAY03-C35069_1.pep
PPGSRSTKTISEVSGTGRKPLQRGGSGSARPGTPRAPRLRAGATTLGPWPRRRAFWRRMEAPRLGRXSALPARTAEGKLLVFEDLEAPGPSTMTPVQCLGPLAAASLGRLVDGGDIDKKLKLATQNLHYVNVLPSIGLNVYSILQHDTLVMSRAAINRIVERMHTPINR

SEQ ID NO: 42974 - protein, 272 aa, Sorghum bicolor
  unsure (1)..(272): unsure at all Xaa locations
  Clone ID: SORBI-28MAY03-C353_1.pep
FRRNFFGESTAVLRFPGGVGPAVTFDSEAPLRERILPFSAAAPRELKATANHSKXTGHQDAEANGKLAHDDSKLLHGRCSGEISSFQSLCAHIWRAVTRARRLLAADKTTTFRMAVNCRHRLRPAISPLYFGNAIQSVATTATVAELASNDLGWAAARLHATVTSHEDGAIRRAAAEWEAAPRCFPLGNPDGAALTMGSSPRFPMYDGNDFGWGRALAVRSGRANKFDGKMSAFPGQAGDGSVDVEVCLAPDTMARLLLDEEFLQYVSSPAP

SEQ ID NO: 42975 - protein, 108 aa, Sorghum bicolor
  unsure (1)..(108): unsure at all Xaa locations
  Clone ID: SORBI-28MAY03-C35351_1.pep
SVCLLFPRGGRPSSDESLLLWTFLGKRSLVKLITRGRYKLLREIGDGTRGKGFMAYNVETNGIVAGREMKGKIFQWEECVSLREVKXIVAVKKMKRKFFQWEECVSLR

SEQ ID NO: 42976 - protein, 171 aa, Sorghum bicolor
  Clone ID: SORBI-28MAY03-C35522_1.pep
MGAPKQRWTPEEEAALKAGVAKHGPGKWRTILRDSDFSELLRLRSNVDLKDKWRNLSVTAGGYGSREKARMALKKGKRVVPKLTAEPMDIDGKDMDNAHDAAIEAEPLAMALEPLAIEESPDKSVARLDDLIFEAIRKLNEPSGSNKAAIAAYIEEQYWPPADFQRLLSTK

SEQ ID NO: 42977 - protein, 227 aa, Sorghum bicolor
  Clone ID: SORBI-28MAY03-C37359_1.pep
MPLATDQPAGSVSVTPKVPYARDDDNFNDGMYEDLCVDDADMTFENYEELFGTSHIRTEELFDDAGIDSYFEMKETQPFDFNEEPKTMQLECSNVVSADCGMLNPGARADSSLSPPPARRGASTSPSPSRLSREGGVFSTGAATAKASRSLSLSPRQPPRPVGAAAPGPRLRAPAPCSPWRSAAAFRITFGSAARSAWAGLGKGVLGRALNAGGAFAYAPLGHARSF

SEQ ID NO: 42978 - protein, 216 aa, Sorghum bicolor
  Clone ID: SORBI-28MAY03-C3761_1.pep
HEGSNFLGTKFTVYDAHPPCTGAVVSKGPSAHMIGSAQVSPGVPAGNYPISHISYEATFGSRYPRKMNCVMDSIPLSAIKEGGTAPTQTEFPSINSNSFASVPFFRKSGRLDSSGVQLATQNEAKMVLKNKSPNWHEPLQCWCLNFHGRVTVASVKNFQLVASGESDLNNQGDDDVILQFGKVGKDLFTMDYRYPISAFQAFAICLSSFDTKITRE

SEQ ID NO: 42979 - protein, 159 aa, Sorghum bicolor
  unsure (1)..(159): unsure at all Xaa locations
  Clone ID: SORBI-28MAY03-C3763_1.pep
MSFLRSLADSFSSLLFSSWGEAAPMDAAGAAPSPAAVVGERVAVKLRGYFDLAKEEIDKAVRAEEWGLPDEATAHYRNAMRVMLEAKAARVPDAVSSSVXGGRSGCTKRRSPSGRRRSRSGSECLVGEVVAASNPIGRTARIAPNSIQRSPLQNSPTFN

SEQ ID NO: 42980 - protein, 134 aa, Sorghum bicolor
  Clone ID: SORBI-28MAY03-C3795_1.pep
MGAFFSKQVDRRKLVTTEKRALATRLSSSGETFPGSEHRPADRKRWMAELGADKLRVHQVVWPGTHDSATNKIGVPFVTRPFAQCQSMSVYEQLATGTRVVDVRVQEERRVCHGILATYPVDVVLDDVNRFLGE

SEQ ID NO: 42981 - protein, 191 aa, Sorghum bicolor
  Clone ID: SORBI-28MAY03-C378_1.pep
MAAAVAASASTPQGVAERRGIPAAAFVEDVEAYLRQAGLDVNSALAFLQERLQQYKIVEMKLLAQQRDLQAKIPDIEKCLDIVATLQAKKDLGEALIADFELSEGIYSRAKIEDTDSVCLWLGANVMLEYSCDEANALLKKNLENAKASLEVLVADLQFLRDQQTITQVTIARVFNWDVHQRRSKQAIKET

SEQ ID NO: 42982 - protein, 201 aa, Sorghum bicolor
  Clone ID: SORBI-28MAY03-C38114_1.pep
MAAAGEKARVVLVGGGPAGSLFAKTMEGHADVVLLDPKEYLEIPWSELRSMVEPSFAERSLIYHKDYLNDTTIVTSSAVNITEDAVLTADGQSLPYDYLVIATGHALTSPASRAERLKEFQRDNGKIESSESVLIIGGGPTGVELAAEIAVDYPGKKVTLIHRGPRLLEFMGEKASKKCLDWLTSKKVDVLLQQSVDLGSL

SEQ ID NO: 42983 - protein, 147 aa, Sorghum bicolor
  Clone ID: SORBI-28MAY03-C60834_1.pep
ARGPSPPPRPGPHPSSRSSPLARVSDFGSRLRLAERSPLSCPGRDLRVVVELVLPPWILPSSSRLRVRGPWPACRSGSTPFPRGFAIGSRLLPHELANCAAPALLHASSLQFITCICSYYFRWSFFHSLCYSANLQLAYTKNKASFL

SEQ ID NO: 42984 - protein, 128 aa, Sorghum bicolor
  Clone ID: SORBI-28MAY03-C6088_1.pep
LKVGYLTAPPANNAIAPHKDWERSQFILNHEGLQQADASDQPPSQSPGHLDRGRKPVRINIADIVSVSACADLTLPSGAGLCIETIHGPTFLVADSWEALDGWLDAIRLVYTIFARGKSDVLAGIITG

SEQ ID NO: 42985 - protein, 168 aa, Sorghum bicolor
  Clone ID: SORBI-28MAY03-C6129_1.pep
LKRLAPGQVELSSRAGPIPAIAEDDDEPHSSGLWPLLSLNGSDGSLQGFEELLASVLGKKAGEKGTFKLLKARASAQTYVKMAFTVEKKLVEGEVNWSNIPEWKTKPKRLRAHYEVLARVEEGQAIPERIAQVQPFQADEAMSESVLTGNVTRSKMEIVHPPPVYFTL

SEQ ID NO: 42986 - protein, 136 aa, Sorghum bicolor
  Clone ID: SORBI-28MAY03-C61410_1.pep
ARGILLFNCMSVRDPMRLLPHLLDASTQNGVHFDMALFVPNQSQYNKLGSNTSAPAEPEQIDLSWQLSLQTVWEKLLQDKGINTTKSSDTSQVFESLPLAIDWLRRNAQENQSTSFQVLVTGSLHLIGDVLRIIKK

SEQ ID NO: 42987 - protein, 317 aa, Sorghum bicolor
  unsure (1)..(317): unsure at all Xaa locations
  Clone ID: SORBI-28MAY03-C38478_1.pep
MASVAPPSSSVAALTRQPVQFLKGCSVSKETKGPISSFFPANSNSTKVKSVGLRVASSFRSDGSYPAGGVSGNGDTLLPKSTSVRGQDHPVADPVLPLDSMITPEILSTNLARAVEKFSDDDTDTELDLDSPTEGVASIADAIEDIRQGKLVIVVDDESRENEGDLIMAANLVTPEAMAFIVRHGTGIVCVSMKEDDLERLNLPLMVTTKENEEKLCTAFTVTVDAKEGTTTGVSAKDRAKTVMTLASPDSKPEDFNRPGHIFPLKYREGGVLKRAGHTEASVDLAMLAGLPPVAVLCEIVDDANGSMARLPXLRVF

SEQ ID NO: 42988 - protein, 118 aa, Sorghum bicolor
  Clone ID: SORBI-28MAY03-C38510_1.pep
RCNALYNHSATRLSVVPIHASRSQALRYLCIRWGIEVPNVAVLVGESGDSDYEELLGGLHRTIILKGEFNIPANRIHTVRRYPLQDVVALDSSNIIGVEGYTTDDLKSALQQMGILTQ

SEQ ID NO: 42989 - protein, 124 aa, Sorghum bicolor
  Clone ID: SORBI-28MAY03-C38718_1.pep
HQQRTQRDASIASTSQELWGSLTSYMRSSQLGPVLAVALVALIILMQVTIIILLTRSPQVQMAPHEVSTGSLGYSKDSMEWVQKRLSLLSEEMQLAEAHMEKMRHEFAWLRSYLERLEKLRGST

SEQ ID NO: 42990 - protein, 146 aa, Sorghum bicolor
  Clone ID: SORBI-28MAY03-C38719_1.pep
RAAQEHTQMQWYAEQGAQLMTAEKYLRLQLASDGDRFQHFQDALSKSNEVFETYKQEMEKMISVIKNLKKENEFLKGKCENSDFALVKLIEERELTKKQLEKLKNQKEKLESLCRSLQAERKQGPSASIPDAPSSQEDVSATSQES

SEQ ID NO: 42991 - protein, 125 aa, Sorghum bicolor
  Clone ID: SORBI-28MAY03-C38730_1.pep
SCLDQVNPSSFIVPFLLSGLGDHYDVKMPCHLILSKLADKCPSAVLAVLDSIVEPIEKTISHKPKGDAVKQEVDRNEDMIRSALRSISSLSRISGSDYSIRFKNLMNKITTTPALAEKYNSVRSE

SEQ ID NO: 42992 - protein, 401 aa, Sorghum bicolor
  unsure (1)..(401): unsure at all Xaa locations
  Clone ID: SORBI-28MAY03-C37_1.pep
MKVERDLHMSRGDGEDSYASNSRLXEKSILKTRPVLHKAVAAAHASSLSSGGGAMVVADLGCSSGPNTLLVVSEVLGAVADRREDLAMAAGAQPQHVQFFLNDLPGNDFNLVFQSLELFKKLAVKDKGDALPPYYVAGLPGSFYTRLFPDRCVHLFHSSYCLMWRSKVPDELAGGAVVNEGNMYIWETTPPAVVALYRRQFQEDFSLFLRLRHRELVSGGQMVLAFLGRKNKDVLHGEVSYMWGLLAQALQSLVKQGRVEKEKLDSFNLPFYAPSVDEVRDVIRQSQAFDVTHIQLFESNWDPHDDMEDDDGGLVLDGVQSGVNVAKCIRAVIGPLIAHHFGDHVLDGLFELYAKNVAVHLQKVKTKYPVIVVSLKASISRAPKNQANDKYYSGFTHGQFM

SEQ ID NO: 42993 - protein, 342 aa, Sorghum bicolor
  Clone ID: SORBI-28MAY03-C3715_1.pep
VRGRVGKDAKDFLFGSFDVPLANLEASLRTYEPSEEPFDISLVSREVRSLPLKEKAAPGKKPPAAAAAPAPVSTVDAYQKMLSSIPEFSGFGRLFKSSEPMELTEAETEYAVSVVKHIYDGYIVLQYNCTNTIEEQLLEDVTVCVDASDAEEFSEICSKPLTSLPYNSPGQVFVAFEKPEGVPAVGKFSNLLKFTVKEVDTTTGEADEDGVEDEYQLEDFEIVSSDYMLRVAVSNFRNAWENMDPESERVDEYGLGVRESLAEAVNAVINILGMQPCEGTEVVPRNARSHTCLLSGVFIGNAKVLVRLSFGLSGPNEVAMKLAVRSDDSEVSDKIHEIVASG

SEQ ID NO: 42994 - protein, 78 aa, Sorghum bicolor
  Clone ID: SORBI-28MAY03-C37176_1.pep
CVQLRVVTCEDNCRLLNSWLSQAAWEQLCRLLDCQKLSLEACTHAAQNERLPLRVVVQVLFFEQLQLRTSIAGCLLVS

SEQ ID NO: 42995 - protein, 167 aa, Sorghum bicolor
  Clone ID: SORBI-28MAY03-C37179_1.pep
RGLAADVMTCRKYAERAYKYRPLKVVEFDRPYPQCIAYLDLKREECSRLFPSGRIYSQAFHLAGQGFFLSAHCNMDQQSAFYCFGLFLGMQEKGSTSVTVDYEFAARTRPSGEFVSKYKGYYTFTGGKAVGYRNLFAIPWPSFMADDSLFFIDGVLHLRAELTIKQP

SEQ ID NO: 42996 - protein, 333 aa, Sorghum bicolor
  Clone ID: SORBI-28MAY03-C37304_1.pep
MAADPDTEVQAEFPPLVRQYKSGRVERFFNPSPLPAGTDPATGVVSKDVVVDPATGLWARLFLPPSSSHGKKQQLPIVVYYHGGAYVIGSAADPWTHTYLNGLVAKAGVLAVALEYRLAPEHPLPAAYEDSWEGLKWVATHAAATAAAGGGPEPWLTEHGDFSRVFLAGASAGGTIAHYVAVRAGEQQGQGQGDLLGVRVRGLLIVHPYFSGAADIGDEGTTGKQRKAQADAFWRFLYPGSPGLDDPLSNPFSEAAGGSAARVAAERVLVCVAEKDDLRDRGVWYYESLKAGGYPGEVELLESKGEGHVFYCMNPSCDRAREMEERVLSFLRK

SEQ ID NO: 42997 - protein, 234 aa, Sorghum bicolor
  Clone ID: SORBI-28MAY03-C4000_1.pep
ARSRGIIPATDFDALICGSGSEVYYPGTVNCIDAEGKLRPDQDYLMHISHRWSHDGARQTIAKLMASQDSSDDAVELDVASSNAHCFAFLIKDPKKVKTVDEMRERLRMRGLRCHIMYCRNATRLQVVPLLASRSQALRYLFVRWGLSVGNMYLITGEHGDTDLEEMLSGLHKTVIVRGVTEKGSEALLRSSGSYKRDDVVPTETPLAAYTTGELKADEIMRALKQVSKTSSGM

SEQ ID NO: 42998 - protein, 137 aa, Sorghum bicolor
  Clone ID: SORBI-28MAY03-C40118_1.pep
LQGVSATISACDANSAIYVTDSAKEIKTKVNKYAFSENLELTLTGGQDSIELHRKLGANLDVDVPIKYLNFFLEDDDELAHIKKEYKEGRMLTGEVKQRLIAVLSEIVARHQRARAQVTEEMVDAFMAVRPLPNMFG

SEQ ID NO: 42999 - protein, 300 aa, Sorghum bicolor
  Clone ID: SORBI-28MAY03-C4024_1.pep
PPGPLPSTARPLLPNGRAAARSRASSHRRPTSIFQHLPWLPLPGPSLSASCLGCMGMSAFYGPPASEPPMIKLIHHAVAAGVTLLDTSDIYGPHTNEILLGKALQGGVREKVELATKFGLSFADGKREIRGDPAYVRAACEGSLKRLGVDCIDLYYQHRIDKKVPIEVTIGELKKLVEEGKIKYIGLSEASASTIRRAHAVHPITAVQIEWSLWSRDVEEDIIPTCRELGIGIVAYSPLGRGFLCSGAKLVDSLSEQDFRKHMPRFQPENIDKNAKIFEHVNAMAAKKGCTPSQLALAWV

SEQ ID NO: 43000 - protein, 175 aa, Sorghum bicolor
  Clone ID: SORBI-28MAY03-C40639_1.pep
HPSMDSIEGQTMGMNSPFVQQADVTMVDGHDTKEQTHPSTSGMTDSSSGSASSQPTFKGNPGHTLLKDRSSPALTVKATYNGDTVRFKFLPTMGWYHLLEEIAKRFKLTTGAFQLKYKDDEDEWVILANDADLQECMDVLDSISSCNMKLQVRDLPCLISSSGSSSCLQVEAHSS

SEQ ID NO: 43001 - protein, 337 aa, Sorghum bicolor
  Clone ID: SORBI-28MAY03-C405_1.pep
HEDGVSYCHDKGVYHRDLKPENVLVDRKGNIKISDFGLSALPQHLGNDGLLHTTCGSPNYIAPEVLQNRGYDGSLSDIWSCGVILYVMLVGYLPFDDRNLVVLYQKIFKGDCQIPKWLSPAAQDLLKRILEPNPMKRINITGIREHEWFKKDYVPAVPYDDDEDVLSGSVLSIKEQIEEPAQEKCTHINAFQLIGMASSLDLSGLFEEEDAAQRKIRFTSTHPPKDLFDKIESVAMEMGFEVHRGASKLKVLKNSKCSKKSRNPSSFLVCTEVFELGPSLYVVELRKSHGDSTLYRQLCERLSDELGACKTEQIMRTESLSDDLSSLDGEAFPLSGF

SEQ ID NO: 43002 - protein, 186 aa, Sorghum bicolor
  Clone ID: SORBI-28MAY03-C40830_1.pep
NTCSYDSFDAAVALHASRYQASEQPAHAPHSTIWGAEETCDEFSFNLSASRKQEGSNTPSSSPDTDNEVHPSSSEGFQGFFQDLTGEDDADNPYNDDAKDEEELCAKSPPQNDETNELKDQSLADIYWPDSLGPLDLDIPSVRYQADDILIGDSQNSWNRLMANSLDAFRNLSFFSDKNDSIPSIM

SEQ ID NO: 43003 - protein, 257 aa, Sorghum bicolor
  Clone ID: SORBI-28MAY03-C3816_1.pep
MAETLDMTLDDIIKNNKKSNSSSGGGRRSRGGSAPGGGGGGGSGGVGPTRRPFKRAGNRQAPYQPPKAPDVAWQHDMYPAVAAGGGGGGRVSALETGTKLYISNLDFGVSNEDIKELFSELGDLKRYSINYDRSGRSKGTAEVVFARRSDAVAAVKKYNNVQLDGKPMKIEIVGTNTPTAAAALPVSNGGHARNAARSAPRGAAPAGMPQRRPHQRGGRRGGGSGGGRRGKERSTPKSAEELDADLEKYHADAMQTN

SEQ ID NO: 43004 - protein, 200 aa, Sorghum bicolor
  Clone ID: SORBI-28MAY03-C38220_1.pep
MGEEKKAGKDAGGDKKKDAGAAAAPQPIVLKVDLHCAGCASKVRKAIKRAPGVESVTADMAAGKVVVTGPADAVELKERIEARAKKPVQIVSAGAGPPKKDKEKEKDKEKEKKADGGDKKADKGKGGDGGDKKADKEKGGGGGGEKKADKEMGGGGGEKKADKEKGADKPKEEKKPKEETVTLKIRLHCDGCIDRIKRRI

SEQ ID NO: 43005 - protein, 167 aa, Sorghum bicolor
  Clone ID: SORBI-28MAY03-C38315_1.pep
MGSACSRKRGQLVQEDDLYSARFSKSGSFKWLLHTLPRSNSADVQRRTQGPAPGRCPSLVELCVAKVCEDINRYSDFSLLPRDLSQQIFNELVECGCLTEASLGAFRDCALQDVCLGDYPGVTDAWMEVVASQGQSLLSVDLSCSDVTDSGFNLLKDCSSMQSLACD

SEQ ID NO: 43006 - protein, 90 aa, Sorghum bicolor
  Clone ID: SORBI-28MAY03-C38375_1.pep
EIKDELVYRFIFPERPGALMKFLDAFSPRWNISLFHYRAQGEAGANVLVGIQVPPAEFDEFKSHAENLGYEYMSEHNNEIYRLLLRDPKV

SEQ ID NO: 43007 - protein, 225 aa, Sorghum bicolor
  Clone ID: SORBI-28MAY03-C38351_1.pep
MEYSKALASLFTMLVLAPLLVVKATDPDPLQDFCVADLSGKLSVNGFPCQPTSSAGDEFLFSTKIATGGDPLANPNGSNVTELDVSEWPGVNTLGVSMNRVDFAPGGTNPPHVHPRATEVGLVTRGELLVGIIGSLDSGNRYYSKVVRAGETFVIPRGLMHFQFNVGKEDAAMVVSFNSQNPGIIFVPLTLFGSSPPIPTPVLSKALRVDASVVDLLKSKFAGGY

SEQ ID NO: 43008 - protein, 337 aa, Sorghum bicolor
  Clone ID: SORBI-28MAY03-C42_1.pep
MEWTAPKPASSPSSPPLLWDWGDHAATGSGSSSGDAPARRGAGKEREAKRARGEDGGGGAEVRCQVEGCGLDLTRVKDYHRKHRVCEAHTKSPRVIVAGQERRFCQQCSRFHALSEFDQKKRSCRRRLSDHNARRRKPQPDAFTFASARLPSSLFDDRRQISFVWNKAPVSHVRPFTSPWDSSSDLKLPHAKETREVSTKVGTITGQVHLDKSHMSNAIPTLSHGKDEPWPMKGPDMSITASKFDGAPDLQRALSLLSVGACGLPDPVHQTSCVIQFTGASENSGDLHLSHGGNSGPASCADGQHIAAQSQSQLVRFTMDTSNNVYEPSFFGVNQIN

SEQ ID NO: 43009 - protein, 132 aa, Sorghum bicolor
  unsure (1)..(132): unsure at all Xaa locations
  Clone ID: SORBI-28MAY03-C42119_1.pep
ASSFIHKAPXKIPEVIIPEDLVVNIALSTRYEINRAFANLRQIALGRDIKKFLMVIAGFWFLSVLGSCCNFLTLVYIVFVVLHTVPVLYEKYEDHIDSYGEKGWIEIKKQYAVFDEKVLSKVPRGPAKDKKH

SEQ ID NO: 43010 - protein, 363 aa, Sorghum bicolor
  unsure (1)..(363): unsure at all Xaa locations
  Clone ID: SORBI-28MAY03-C42345_1.pep
TRLQGSKVMKAKNVLMLIIICQYVPRLIRIRPLYLQITRSAGVITETARAGAAFNLLLYMLASHVLGALWYLLSIQRQDSCWRQHCRSNKTCNLSYLYCGDYDNDEGNAFLTKSCQPRNQPNLPDPYFGIYAPAIQNVSQSKSFFEKLFFCVWWGLQNLSSLGQALLPTSAAAQDLFAVFVSISGLVLFALLIGNVQTYSHAAALRIRGVCLKSRDTDQWMSYRHLPENLKERIRRYEQYRWQETSGVDEEQLLMNLPKDLRRDIKRHLCLSLLMRVPMFENMDDQLLDAMCDCLKPILYTEGSCVIREGDPVNEMLFVMRGNLMSMTTNGGRTGFFNSDVLKAGDFCGEELLTXALDPTSTS

SEQ ID NO: 43011 - protein, 173 aa, Sorghum bicolor
  Clone ID: SORBI-28MAY03-C42426_1.pep
MATNPGLFTEWPWKKLGNFKYLLVAPWVAHGVYLVATKGWKAADLGYMAIFPSLLLRMLQNQVWITVSRLQNARGRRQIVDRGIEFEQVDRERNWDDQILLSGILMYLGFMYIPGGQHLPLWRTDGAVLIALLHAGPVELIYYWFHRALHHHFLYTRFHSHHHASIVTEPISS

SEQ ID NO: 43012 - protein, 243 aa, Sorghum bicolor
  unsure (1)..(243): unsure at all Xaa locations
  Clone ID: SORBI-28MAY03-C4251_1.pep
RPEKKEPEIVRSPRAPTHSFKKPIGAKKPGNGTGGLGARKLTSKPNESLXQKPEEPAPILPSVTESTATRSKPHTSRFEYVQNAPAAPKTGSSSEDNHMSGHVAPPKSSNFFAEFGMDSGYHKKSTSSSSKVQIEESSEARQKFSNAKSISSSQFFGDQASFEKDAQVSLQKFSGSSAISSADLFGHPANNPRVDLSASDLINRISFQATQDLSSLKNMAGETGKKLTSMASNIITDLQDRIL

SEQ ID NO: 43013 - protein, 79 aa, Sorghum bicolor
  Clone ID: SORBI-28MAY03-C42648_1.pep
WLEALMNELIGVFRGSTPVFIVRWDACAPSDQTDLTKGRDDSSKAVEEASRRGERNPSRGAPGGPTWRPLVPPLTLGVF

SEQ ID NO: 43014 - protein, 210 aa, Sorghum bicolor
  Clone ID: SORBI-28MAY03-C39192_1.pep
PCFVWGQVQYAGVSSCSASLLNRLLFLHGGRYGSMAERILKARLVYGSPNTNRAVSFEYMNRQLVWNEFSEMLLLLLPLLNSSSVKKFLLPFSKDKSAGSSGDEADCPICRSSPSIPFIALPCQHRYCYYCLRTRCSATSSYRCPRCNEVVVAIQRQGSSWFTSWVKKNLARLHRVTDKGLSSTQFSCFNARLRIRIMICPCNCFKRGQS

SEQ ID NO: 43015 - protein, 291 aa, Sorghum bicolor
  Clone ID: SORBI-28MAY03-C3954_1.pep
SAHASVSVSQEEIVFNVGKSVVENKSDGLAFRRAGLQKEGSKVVYGVPKHGKKKKFMEVSKHYDAGQSDKISEGNASNRFVKHLMPLPRPRENTTKVDPIRGKRVGETRSRLPKPTKSQSVGGSSAPEKDSMPMHVQNSCVSQRSFSFAGSSTSTSNNEKPTLVKNNPALGGGLRTEVPSVSELQTASTVPSSKPNVSTTNRAKRKYVPTVSNANRGILKTSEKTSSDSGEPRMTTSDSTEPRRSNRRIQPTSRLLEGLQSSLIISKVPGEKVPRSNYRSASSRGRAQAHG

SEQ ID NO: 43016 - protein, 245 aa, Sorghum bicolor
  Clone ID: SORBI-28MAY03-C3879_1.pep
MIYTAIDTFYLTDEQLRDSPSRKDGIDEATETALRVYGCDLIQESGILLKLPQAVMATAQVLFHRFYCKKSFVRFSAKRVAASCVWLAGKLEESPRRSKHIIFVFHRMECRRENLPIEFLDVFSKKYSELRHDLIRTERHLLKEMGFICHVEHPHKFISNYLATLEAPPELTQEAWNLANDSFGSSLCVRTTLCVRFKSEVVACGVVYAAARRHRVPLPEDPPWWTVFDADEAGIQEVCKVLAHL

SEQ ID NO: 43017 - protein, 117 aa, Sorghum bicolor
  unsure (1)..(117): unsure at all Xaa locations
  Clone ID: LIB3481-031-P1-K1-A2.pep
SGRENLPIEFLDVFSKKYSELRHDLIRTERHLLKEMGFICHVEHPHKFISNYLATLEAPPELTQEAWNLANDSLRTTLCVRFKSEVVACGVVYAAARRHRVPLSEDPXWWTVFDADE

SEQ ID NO: 43018 - protein, 313 aa, Sorghum bicolor
  unsure (1)..(313): unsure at all Xaa locations
  Clone ID: SORBI-28MAY03-C39604_1.pep
ARGPDFLYIQSLGESGIVSSKLSNSLRNTDXGSHSKGNSLFLPDSYLSRFDLVNWKVLVEHPFAEIDQKMLSQNVCILDLRACPDVSPSMLIELMAGENSIISRVFGNTRRLQPDXPVTKAQAAAALTSGRMKEAIQEELNRRAAENQAHLSVIAEILEELISRGDIQQQWEEMMKKEQERALKVDNNLQHVLHELANERTDREEELADLLKERADLERQNQELINLRSEVDGMYDRLATENEEVMADQQTLENQLSDMTSKHQTVNEAKSYLEAEKEALTMLRTWVEDEAARVHERAETLEKALRRWRIPED

SEQ ID NO: 43019 - protein, 234 aa, Sorghum bicolor
  Clone ID: SORBI-28MAY03-C39800_1.pep
MAAAAAEQGVDGARKEKKEEEEEQVVNPWEVSAGKGGIDYDKLVDQFGCQRIDDALVDRIARLTGRPPHCFLRRGLFFAHRDLNELLDLYEKGEKFYLYTGRGPSSEALHLGHLIPFMFTKYLQEAFKVPLVIQLTDDEKFLWKNLTVQESKRLARENAKDIIACGFDIERTFIFSDFSYVGGAFYENMMQVARCVTMNKAIGIFGFNLEDHIGKVSFPPVQAVPSFPSSFPHL

SEQ ID NO: 43020 - protein, 394 aa, Sorghum bicolor
  Clone ID: SORBI-28MAY03-C43635_1.pep
MAASPYPTPTAPPPLMGILGFLLLLLLLILVSLSPSIPLVEAGAEAAGVLRQVVGGDDDDDGGNFFEPSSVTYDHRALILGGKRRMLVSAGLHYPRATPEMWPSLIAKAKEGGVDVIETYIFWNGHEPAKGQYYFEGRFDIVRFAKLVAAEGLFLFLRIGPYACAEWNFGGFPVWLRDIPGIEFRTDNEPYKAEMQNFVTKIVDIMKEEKLYSWQGGPIILQQIENEYGNIQGKYGQAGKRYMQWAAQMALALDTGVPWVMCRQTDAPEQILDTCNAFYCDGFKPNSYNKPTIWTEDWDGWYADWGEALPHRPAQDSAFAVARFYQRGGSFQNYYMYFGGTNFERTAGGPLQITSYDYDAPIDEYGILRQPKWGHLKDLHAAIKLCEPALTAVD

SEQ ID NO: 43021 - protein, 229 aa, Sorghum bicolor
  Clone ID: SORBI-28MAY03-C43703_1.pep
MDGCDCIEPLWPTDDLLVKYQYISDFFIALAYFSIPLELIYFVKKSSFFPYRWVLIQFGAFIVLCGATHLINLWTFTTHTKTVAMVMTIAKVSTAVVSCATALMLVHIIPDLLSVKTRELFLKNKAEQLDREMGLIRTHEETGRHVRMLTHEIRSTLDRHTILKTTLVELGRTLGLEECALWMPSRSGSSLQLSHTLRHQITVGSSVPINLPVVNQVFSSNRAIIIPHT

SEQ ID NO: 43022 - protein, 184 aa, Sorghum bicolor
  Clone ID: SORBI-28MAY03-C43994_1.pep
MALRTLHLPSRPPRPPSHRARPSSPPPRPPSPPPRQPKLPPGPGPQQQTRVATATKQQQPPLCKRSTPLLKVKCRASLHDCMDEETVETPKDQTTEIPIVAYPSVVFPGATLQLQAFEFRHRIMMHTLLQQGLRFGVLCSAGKTGTGRMADVGCVVHVVECERLTDDRFFLTCVGKDRFRVIDI

SEQ ID NO: 43023 - protein, 106 aa, Sorghum bicolor
  Clone ID: SORBI-28MAY03-C44093_1.pep
NQIIRIALEISVINQEQDLFPFLLGAGGSATVGRPTGCCVLDVCLEHVISFVLLGMEACSVLFFDRSGSSSPHAYRRCFWLQVAPRPHHGSSDHGRGAPGHGVRKQ

SEQ ID NO: 43024 - protein, 101 aa, Sorghum bicolor
  unsure (1)..(101): unsure at all Xaa locations
  Clone ID: SORBI-28MAY03-C44054_1.pep
ARGAPLRAVQDSLKLXGTIPCLMLILGGNLTKGVRKTKVPLMVVVAVICVRYLILPLIGVLVVRAARDMGFLPPHPLYQYTLMMHFAVPPAMSIGKSHICI

SEQ ID NO: 43025 - protein, 409 aa, Sorghum bicolor
  Clone ID: SORBI-28MAY03-C41266_1.pep
MEVEPARARAAALDPELLQLAELAPGALRENSIIADALYSQWPVLPETAKLVKSLIEDAKTGAVLNVVGSSASTNAASSSSLPSMFPAGSAPPLSPRSTSGSPRVMRRGSGAGPAPGGSPLKLVSEPVREVIPQFYFKNGRPPTKDLKEQCLSRTDHLFFGGEGLQIQEFRSVTKDICKLPSFFSSVLFKKIDVACTGTVSRDAFVEYWINDNKITMDMASQIFEILRKPGYTYLTQDDFKPVLKELLATHPGLEFLQGTPEFQERYAETVIYRIFYSINRSGNGHLTLRELKRGNLIAALQQLDEEEDINKVLRYFSYEHFYVIYCKFWELDTDHDFLIDKENLIRYGNHSLTYRIVDRIFTQIPRKFTSMSEGKMGYEDFVYFILSEEDKSSEPSLEYWFKCIDLDG

SEQ ID NO: 43026 - protein, 140 aa, Sorghum bicolor
  Clone ID: SORBI-28MAY03-C41312_1.pep
YITEGQIYIDRQLHNRQIYPPINVLPSLSRLMKSAIGEGMTRRDHSDVSNQLYANYAIGKDVQAMKAVVGEEALSSEDLLYLEFLDKFERKFVTQGAYDTRNIFQSLDLAWTLLRIFPRELLHRIPAKTLDQYYSRDATH

SEQ ID NO: 43027 - protein, 212 aa, Sorghum bicolor
  Clone ID: SORBI-28MAY03-C41766_1.pep
TRVAQVTFANPGVQEDAACGPLLDAVAIKELPAAYPTKDNLIKNDGFEIGPQVLKNSTVGVLLPPKQKDATSPLPGWIIESLKAVRFIDAAHFSVPAGQYAVELVAGRESAIAQVIRTVPNRAYNLSFAVGDAKNGCHGSMLVEAFAGNVTQKVPFESAGKGGFKAAAFRFVAAGARTRLTFYSSYYHTKVTDGVSLCGPVLDQVKVVPVKA

SEQ ID NO: 43028 - protein, 149 aa, Sorghum bicolor
  Clone ID: SORBI-28MAY03-C41798_1.pep
MEIDEAVRGCSDRRLRTKYGNAVYVVQRAFALYPFEEIAFSFNGGKDSTVLLHLIRAGYYLYKKDSGDIAQMNAVKNCPLRTIYFESPCAFPEINSFTYETVSTYGLPLETIHSDFKSGLEGLLKEKPTKAIFIGTRIGDPNAVIFWHC

SEQ ID NO: 43029 - protein, 269 aa, Sorghum bicolor
  unsure (1)..(269): unsure at all Xaa locations
  Clone ID: SORBI-28MAY03-C45199_1.pep
MKEEMVVGLSAPGPVGRWGAAPPQAMLERMKDYGQEGAFALWDDLSPEDRELLVRDIESLDLSRIDRIIRRSLGSQGIPLPAVEPVPESSVSKVEDRSPEDKERWWKKGLKAISEGKLAVVLLAGGQGTRXLGSSDPKGCFNIGLPSGKSLFQLQAERILCVQKLAAQSSESPSNTVPIHWYIMTSPFTDAVTRKFFETRRYFGLDPDQVTFFQQGTLPCVSADGRFIMETPYRVAKAPDGNGGVYAALKSKKLLEDMAARGVKYVDCY

SEQ ID NO: 43030 - protein, 158 aa, Sorghum bicolor
  unsure (1)..(158): unsure at all Xaa locations
  Clone ID: SORBI-28MAY03-C45334_1.pep
ANQKLAFKYYGPFKVIARVGSVAYTLELPSYSAVHPTFHVSQLKKAVLPNTQVSPILPADVELPRVPAAILQRRQTSTGEQVLVRWSDWPLEMATXESLEALRQAYPRAPAWGQAGSQAPGIVSSSPSPGPDATERAGPRRSARSRRPNRNVSGEEWA

SEQ ID NO: 43031 - protein, 119 aa, Sorghum bicolor
  Clone ID: SORBI-28MAY03-C45338_1.pep
SIWLHQFYYIFGFLFLVFLILIVTCAEISIVLCYFQLCSEDYLWWWRSYLTSGSSALYLFLYATFYFFTKLEITKFVSAVLYFGYMLIASYAFFALTGTIGFYACFLFTRLIYSSVKIE

SEQ ID NO: 43032 - protein, 251 aa, Sorghum bicolor
  Clone ID: SORBI-28MAY03-C45425_1.pep
MAPSAWAVALAALCIVALAPPAAGFYLPGVAPNDFEKKDPLPVKVNKLTSIKTQLPYSYYSLPFCKPDTIVDSAENLGEVLRGDRIENSPYTFEMREPQMCQIVCKISVGEKEAKLLKEKIEDEYRVNMILDNLPLVVPIQRVDQEGAYFYQHGFHVGAKGKYSGSKDEKYFIHNHLSFTVKYHRDEQRDISRIVAFEVKPYSVKHEYEGQWNDKKTRLTTCDPHAQRIITSSESPQEVEVGKDIIFTYDV

SEQ ID NO: 43033 - protein, 144 aa, Sorghum bicolor
  Clone ID: SORBI-28MAY03-C4544_1.pep
SRRGGGGSGMAAPNSSMLLDQHLSVSHCTHTVVHAIWTRRTHGRAPQRRPTGAGQSVPTWRRDPATYFSIAKHASSPWHSFISYRKKLQQFGGSGCRGKADFMTITDSLSAFFRLWIGSHGNDQALHSKSSKWLHQQQQTLTSS

SEQ ID NO: 43034 - protein, 148 aa, Sorghum bicolor
  Clone ID: SORBI-28MAY03-C45489_1.pep
LYKDTFITSLAEIPGLFLSAVLVDWFGRKASMWSMMFACCAFLGPLVLQQNELLTTILLFGARACAMGSFTVLCLYAPEVYPTVVRSTGAGIATAVGRIGGVVCPLVAVAMLRSCHQMEALIVFEVILCLAAVACIFFPVETKGRGMD

SEQ ID NO: 43035 - protein, 154 aa, Sorghum bicolor
  Clone ID: SORBI-28MAY03-C42703_1.pep
GNYTHPAGFTMGSPGVIGAAVGVDDVNRMKYKDNIYASTPQVETSDIWIQSAREMPPLQVPSYYNIPGQATAGAFVPNPANASFNATAQSSHAQFPGLYHPQQPPSIVSPHPMVHQQVPSAIGPNVGVGVAAPGPQVGAYQQPQLGHMNWRPSF

SEQ ID NO: 43036 - protein, 143 aa, Sorghum bicolor
  Clone ID: SORBI-28MAY03-C42736_1.pep
LGADEVFTESQLDMKNVKSLLGAMPEPALGFNCVGGNAASLILKLLKQGGTMVTYGGMSKRPVTVPTSYFIFKDLSLRGFWLQKWLNSDKTEDCRRMIDYLLGLVHEGKLKYEMESISFGEFSLALEKALGKHGSHPKQVIRF

SEQ ID NO: 43037 - protein, 79 aa, Sorghum bicolor
  Clone ID: SORBI-28MAY03-C42759_1.pep
PRPPAPAPAPAPHRPQLQLLQQEGVAMNVEQPVAAAASEMIRRNLAEQMAMTLTRDPSFKAALVTALSGRILELSPTKD

SEQ ID NO: 43038 - protein, 154 aa, Sorghum bicolor
  Clone ID: SORBI-28MAY03-C43132_1.pep
MAHDGGDNGGELPPPAKKKSPAEEEAEKRRKKLTPGSLMKGIIRSGSGDATPAEGDQVILHCTTRTMDGVIINSTRREHGGKGIPLRFVLGKSKMILGFAEGFPTMLKGEIAMFKMQPKIHYAEDDCPVAAPDGFPKDDELQFEIEMLDFFKAK

SEQ ID NO: 43039 - protein, 232 aa, Sorghum bicolor
  Clone ID: SORBI-28MAY03-C43255_1.pep
MAGAGNADDPKLLGVWTSPFVIRVRIVLNLKGLAYEYVEEDLGSKSALLVGSNPVHKTVPVLLHGGRAINESQIILQYIDEVYSGTGPAVLPSDPYERATARFWAAYIDDKVRSAWLGMVFTCKDEEERAEAVARAGEALDTLEGAFGECTEAGKKPFFGGDGIGFVDVVLGGYLGWFGAVAKIIGRRVIDPARTPLLAAWEDRFRAADVAKGVVPDDVDKVLAFLQVLLAR

SEQ ID NO: 43040 - protein, 233 aa, Sorghum bicolor
  unsure (1)..(233): unsure at all Xaa locations
  Clone ID: SORBI-28MAY03-C45765_1.pep
MSMPETFTVKVGEATPAAGGRPSAGPVYRSIYAKDGLMVLPQDIHSPWDFFSGAVKKYPINRMLGRRQVITDGKAGEYVWQTYEEVYQKVMRIGSAIRSLGVEPGAHCGIYGSNCPEWVMAMQACNCQGICYVPLYDTLGANAVEFIMDHAEISIAFVQESKIKSILAVVPKCTAHLRAIVSFGDFASEMKMEAEKLGVSCFSXEEFSSMGKQDYKLPNKCKDDICTIMYTSG

SEQ ID NO: 43041 - protein, 165 aa, Sorghum bicolor
  Clone ID: SORBI-28MAY03-C45882_1.pep
ARGPSGCFVSDATPGPRPPPRGRTSACGTRGRAGAAAERAKEAARAAAHPAQETARAVKERMVPAAGGPVAAMMAPGGKVLEMTKEGPGSVAETAQAIGDMAKQAARRSWDAAKETAHSVRGRVVPDEDDVDAARMERDRIAREMDRVERERNKREAREKGSGLP

SEQ ID NO: 43042 - protein, 147 aa, Sorghum bicolor
  Clone ID: SORBI-28MAY03-C4594_1.pep
MAAFNKLGSLLRHSALASGVAASSSPAVFNAARLMSTKLFVGGLSWGVDDMKLREAFSGFGDVTEARVITDRDTGKSRGFGFVNYTSSDAANAAISGMDGKEIDGRPVRVNIANDRPAGNRGGGGYGGGGFGGGGYGGGNQSYGGGY

SEQ ID NO: 43043 - protein, 138 aa, Sorghum bicolor
  Clone ID: SORBI-28MAY03-C46090_1.pep
YICRLLGEAALKTIAGNTSLTCTEVEPITGAQLNYPAILVPLRAEAFAVNRTVTNVGPAKSSYTAKIEAPKGLTVKVEPAELEFTKENERKTFTVTVSAAAGASSEQKLAEGALSWLSQDHHHVVRSPIVADSSLTLS

SEQ ID NO: 43044 - protein, 337 aa, Sorghum bicolor
  unsure (1)..(337): unsure at all Xaa locations
  Clone ID: SORBI-28MAY03-C46493_1.pep
MAFLFGAFLGLVVGVAVVMAFARFENSRAEQRRELAAIAAAFSKLTVQDLRKLIPPEFYPSWVSFTQKQKLKWLHQELVKIWPFVNEAASELIKTSVEPVFEQYKSFILASLHFSKLTLGTVAPQFTGVSILESDDSAITMELELQWDGNPNIVLDIQTTLGISLPVQVKNIGFTGVLRLVFKPLVAELPCFGAVCCSLREKSKVEFTLKVIGGEMTAIPGISDAIEGTIRDTIEDTLTWPNRIIVPIVPGDYSDLELKPTGVLEVKLVEARDLTNKDLVGKSDPFAVLYIRPLREKTKKSKTINNDLNPIWNEHYEFVVEDISTQHLTXKIYDDEG

SEQ ID NO: 43045 - protein, 169 aa, Sorghum bicolor
  Clone ID: SORBI-28MAY03-C44170_1.pep
AAGGALGMEMEPQFDRPYLASSLRDFWGRRWNLMVSAILRPSVYDPVRAGAGKAPAVLATFLVSGLMHEVMMYYLALRPPTGEMTAFFLLHGVCCVAEESCARRSAESGWRPPPRPVATLLVMVFVAGTAFWLFFPPICREGTEELLLEEWAAVGAFFNDAGRKLLPYV

SEQ ID NO: 43046 - protein, 271 aa, Sorghum bicolor
  Clone ID: SORBI-28MAY03-C44226_1.pep
MGIVEEAHNLRVVGEGKRGVIVLAHGFGTDQSVWKHLVPHLVADYRVVLFDTMGAHEANPDYFDFARYATLEGYALDLLAILQELGVQSCIYVGHSVSAVIGALASISRPDLFTKLVLLSASPRYLNDVDYYGGFEQDELDELFEAMRSNYKAWCSGFAPLCVGGDMESVAVQEFSRTLFNIRPDIALSVAQTIFQSDVRSLLPLVSVPCHIIQSTKDLAVPVVVSEYLHKHLGGDSIVEVMPSEGHLPQLSSPDIVIPVLLRHIQHDIAV

SEQ ID NO: 43047 - protein, 107 aa, Sorghum bicolor
  Clone ID: SORBI-28MAY03-C44249_1.pep
GEAKRRFQRIQEAYARGSDKGKKAMYDAGLFDPLDDDDQDFSDFMQEMLVMMDNVKNEKPDTLEDLQKMLEDIVNGDGVGGRVPPPAADGARRTRVAPYPQPQQARR

SEQ ID NO: 43048 - protein, 176 aa, Sorghum bicolor
  Clone ID: SORBI-28MAY03-C44795_1.pep
LDEEGKSILPGNFERHWGIFSFDGQAKYPLNLGLGNSVLKNAKEVPYLPSRWCVANPARNLDGVSDHMKLACSMADCTTLYYGGSCYGIGEKGNVSYAFNSYYQQQKQDPKSCDFGGLGMITYLDPSMGECRFLVGVDDSKSSAVASCGGGCCGVCCGMWVLAFWVFMYLRMMGSA

SEQ ID NO: 43049 - protein, 150 aa, Sorghum bicolor
  Clone ID: SORBI-28MAY03-C44834_1.pep
DAKYAPKKQQCVLELSCGPPSSRPPPIPLDASVLKEPVLKGRHAGFPAISLHDDDVVYIMDKHKFLDKKASVVAVDMKNQTVKGAADFVSGVFFGLTQAYIPSGISRYMGLWSSTRSEENDAETSKNGIAKGKQAVPEEGEAWRRGRRWR

SEQ ID NO: 43050 - protein, 71 aa, Sorghum bicolor
  Clone ID: SORBI-28MAY03-C47049_1.pep
LNEKEKKEFFRSICILILPHARHRQTKASSLLGCKSSSTKSNITVGQQQRRMTLESPRPALSSETVESCKD

SEQ ID NO: 43051 - protein, 109 aa, Sorghum bicolor
  Clone ID: SORBI-28MAY03-C47439_1.pep
APSPAPAPAPMPMPMPMARPGPSQGYIDEHYTPSYYNSNYNRSPAYEPEPYYYSRPQPAPYSYQYQYQPSSSSEDYYYSAPPQRSAFSPPRDAYGEMFNDENANSCTVM

SEQ ID NO: 43052 - protein, 280 aa, Sorghum bicolor
  unsure (1)..(280): unsure at all Xaa locations
  Clone ID: SORBI-28MAY03-C4732_1.pep
VRPASAPRPEHVGSVGHPFRXCRGMSAAQRRGEHDWGSTLVEAVFLPIEAYHLEDRLGPRIPHDQRFSVPRIPALVELCIQAGVDLPEYPTKRRRKPIIKIGRKEFVDANEDDLPEPEPDRFKQPLLEELHYDEIIAPSNPEETAALAEETLEAWEAVRDGALKLMKGYAVRVCGYCPEVHVGPTGHKARNCGAFKHQQRNGQHGWQAAVLDDLVPPRYVWHMPESGEELQRELKTFYGQAPAVVEICIQGGAKVPEKYKATMRLDIGIPSSLKEAEMVV

SEQ ID NO: 43053 - protein, 122 aa, Sorghum bicolor
  Clone ID: SORBI-28MAY03-C47485_1.pep
LVAQRGLGQQLAEAAPQARGPSIVQGPEADSMGTGSSLEQGSQVVFEPLEPVESLANGVPSDLGSSSVEAKGFEVQQGVSSCGSERLNGKPTAELNDDFWEDLLHEGGLGAGNAVGQDDMKM

SEQ ID NO: 43054 - protein, 193 aa, Sorghum bicolor
  Clone ID: SORBI-28MAY03-C47487_1.pep
TRLFTAPSRRYKVLEEYHTTFVETVPFKTIAMFTLFQTMYLLVCFGITWIPIAGVLFPLMIMLLVPVRQYILPKLFKGAHLTDLDAAEYEESPAIPFSLAAQDIDVALGRTQSAEILDDMVTRSRGEIKRLNSPKITSSGGTPVAELKGIRSPSIFEKAYSPRLTELRHERSPLGGRNSPRTPSKLGEGSTPK

SEQ ID NO: 43055 - protein, 94 aa, Sorghum bicolor
  Clone ID: SORBI-28MAY03-C47611_1.pep
NSYIAWDFSLQQGALNMVLDIGFHVEHISPSGEKTLILPPRRYEADQGNFCTVSSGSYKLVWDNSYSSFFKKILRYKVDAVPPVVEPALPAIVL

SEQ ID NO: 43056 - protein, 89 aa, Sorghum bicolor
  Clone ID: SORBI-28MAY03-C62282_1.pep
PRSWGWPCSLAFCRPAHKGLHVSEICDCSYPSPLFPQFVACSMSNCVPCHPIHFDPFLSKLHLVVVLPSFRYLLYLLVPVHVPGACPGV

SEQ ID NO: 43057 - protein, 151 aa, Sorghum bicolor
  Clone ID: SORBI-28MAY03-C45512_1.pep
KAHKDIAHFETAYVVKLHRIATLAPTQQVFTFNHPNFSPSASNQRYTKLQFEMLPDMGSCLVHGFAGYFDSVLYKDVHLGIEPNTATPNMFSWFPIFFPLRKPIYVPQGSPIEVHFWRCCAPTKVWYEWAVTTPTPSPVHNSNGRSYWVGL

SEQ ID NO: 43058 - protein, 73 aa, Sorghum bicolor
  Clone ID: SORBI-28MAY03-C45522_1.pep
SARGRVYPLVVAAHPMEPNQIALGMSDGKVHVVEPLDGDPKWGTAPPQDNGVHPAISAAPSAATNQASDQPTR

SEQ ID NO: 43059 - protein, 113 aa, Sorghum bicolor
  Clone ID: SORBI-28MAY03-C45549_1.pep
VVMLELLTGRKAFDSCRARSQQSLARWASPQLHDIDSLDQMVDPTLEGLYHAKSLSRFADAIALCVQPEPEFRPPMSEVVQSLVRLVQRASMGTTLSSEWNSCRFDESGDHTF

SEQ ID NO: 43060 - protein, 370 aa, Sorghum bicolor
  Clone ID: SORBI-28MAY03-C4556_1.pep
MTWRAMKHFFGGAMGVFTTRTLLNSVGVSQSRAASGAVAINWILKDGAGRVGKMLFARQGKKFDYDLKQLRFSGDLLMELGAGIELATAAFPQLFLPMACIANVVKNVAAVTSTSTRTPIYKAYAKGENIGDVTAKGESVGNIADLLGTGMSILISKSNPSLVTSFAVLSCGYLLSSYYEVRSVVLNTLNRARFTVAVDSFIRTGYVPSLKDGNSQETIFNPPWRHEPVAIGSRFGEAFQEPASFIAIKPLFEDERYIVTYNPTKDKVYALLKDQAKPDDILKAAFHAHVLLHFINASHANLNARKRMNANRSYQYNPLNMDFVPHIEESCKIVMSSYGVFKKKAREQGWIMSESLLNPGRARLCGVVPQ

SEQ ID NO: 43061 - protein, 157 aa, Sorghum bicolor
  Clone ID: SORBI-28MAY03-C45662_1.pep
LSQSYEVLKRQKKSAENEQSMTKDVAARDEKSPEDVDLSKPTDPEEAAKEPELNGTTKEANESPAEEPEVPTPEPMESDNVQVATTVATGDDLLGQLEALKQRFMELTAGYGVPQLERLYSRIMKGAIELTSKESNEDHRRLVVRYLLTFVENSNNF

SEQ ID NO: 43062 - protein, 385 aa, Sorghum bicolor
  Clone ID: SORBI-28MAY03-C4829_1.pep
MFGIQTRDVADDFNSRRRTLWNTPTASMPTNTHTIRYNTAKKSLFNVHLMSVKFEDLYGFMVKGNVDDVNVLNEVRERIREQGRGWWALEASKGANWYLQPKISSNEGVISVTSLKLSVLTNTITLRRLIRKGVPPVLRPKVWLSVSGAAKKRSTVPETYYDELIRATEGKTTPATRQIDHDLPRTFPCHPWLNSDKGQASLRRVLVGYSFRDSEVGYCQGLNYVAALLLLVMKTEEDAFWMLAVLLENVLVSDCYTDTLSGCHVEQRVFKDLLAKKCPRIAAHLEAMGFDVSLVATEWFLCLFSKSLPSETTLRVWDVLFNEGAKVLFHVALAIFKMREDDLLRIQHIGDVIDILQTPTHHLYAPDELLTFAFDKIGSMTTNTI

SEQ ID NO: 43063 - protein, 140 aa, Sorghum bicolor
  unsure (1)..(140): unsure at all Xaa locations
  Clone ID: LIB3480-050-P1-K1-F7.pep
HASGQIDHDLPRTFPCHPWLNSDKGQASLRRVLVGYSFRDSEVGYCQXALLLLVMKTEEDAFWMLAVLLENVLVSDCYTDTLSGCHVEQRVFKDLLAKKCPRIAAHLEAMGFDVSLVATEWFLCLFSKSLALETTLSVWD

SEQ ID NO: 43064 - protein, 176 aa, Sorghum bicolor
  Clone ID: SORBI-28MAY03-C49301_1.pep
MEPGQSGTEQTSPRGTDWEVVQLTASAYAAAPAPRRPEPSEESEAKKYGAKGDDLAAGLLMSGHFSVSQSEVESLLVGADSKEPPKELSSPDAVSNEGDGEKYQETCKHKLEDDVPSIPSFDKGKDVSLGDMAFDDGKALKGMSLVGEEPVGFSSPIYSSIEAENELSWSATESRK

SEQ ID NO: 43065 - protein, 285 aa, Sorghum bicolor
  Clone ID: SORBI-28MAY03-C4931_1.pep
MATAFESPTSSPAAAPFHDDPFLHFDGSAPAADGFPASPDAYAPSPFGMPHSNGDLHDDPFAAPADSNGGPILPPPTEMGREEGFLLREWRRQNAIHLEKKEKNEKELRSQIIGDAEEFKKAFVEKRKLNVETSKGQNRDREKLFLANQEKFHAGADKQYWKAISELIPHEIANIEKRGARKDKEKEKKPGIVVIQGPKPGKPTDMARMRQILLKLKHTPPPHMKPPPPPAAATGKDGAPAAAGKDGAKPAAPANGSVPEMEKAAAVAPVPAAAPPAATEPIAAA

SEQ ID NO: 43066 - protein, 165 aa, Sorghum bicolor
  unsure (1)..(165): unsure at all Xaa locations
  Clone ID: SORBI-28MAY03-C48503_1.pep
MGLQQSKEELLYQQVNYGNVDGIRTLRGQGVGLEWIDKEGKTPLMVACMRPDLFDVAKVLIELGANVNAYRPGSHCGTALHHAAKKGLQQTVHLLLSHGANPFIPNDDCNTALELAREKGHVNVVRAIEGRLSLFCGWMRENYAPAFLDAIAPQFMTRKIXAVIL

SEQ ID NO: 43067 - protein, 216 aa, Sorghum bicolor
  Clone ID: SORBI-28MAY03-C49411_1.pep
MGGGNGDGTTPLGEPLLAKKGRAYRPRCPGCRVDRLNAEREGVFPLKDLFLIWLVTITCTLPIQSLFPFLYFMIRDLHIAKQTQDIGFYAGFVGASYMFGRALSSTIWGIVADKYGRKPVIVLTLVAIVIFNTLFGLSLNYWMALITRCLLGVMCGYLGPIKAYATEVVRKEYNHLALAVVSSSRGIGLIIGPAIGGYLAQPADKYPSIFSQTSIF

SEQ ID NO: 43068 - protein, 377 aa, Sorghum bicolor
  Clone ID: SORBI-28MAY03-C49472_1.pep
MATTQASDAAADKGLPLAVDATMADEYASQSKLLQEFVKIPTIGKAWIFNSKDDDMSKAVVSIGQTDLLANKRRQFLLNSHISKSPKSVDFKWSPFPTEISGASAVIPSPSGEKLLLVRNSEDDSPTKLEIWGPCQLENEIHIAKSVHGSLYTDEWFGGISWNQEETFIAYVAEEPPQPKPVFNDYGFKKEGSSEKDCKSWKGQGDWEETWGETYSKKRIPALFVVNISSGEVRPVKQIPHEVSVGQVIWAPSSSYSLVFVAWSSDNGFQETPRKLGIKYCYNRPCALYAAPDPFREEAEKSSTEGNKSETTTMIKLTGDLISAFFPRFSPDGKYLVFISAKSAVDSGAHNATNSMHRIEWPADGNLDGSLGIADVV

SEQ ID NO: 43069 - protein, 215 aa, Sorghum bicolor
  Clone ID: SORBI-28MAY03-C4948_1.pep
ATEQGFAVGMRAALHINPYYGKTSTEGMISHFEAVLPMGPTIIYNVPSRSAQDISPEVIVAISGYTNMAGVKECVGHERIQQYADKGITIWSGNDDECHDSRWKYGATGVISVTSNLVPGLMHSLMYKGENAMLNEKLLPLMKWLFCQPNPIAVNTALAQLGVARPVFRLPYVPLPLEKRIEFVRIVEAIGRENFVGEKEAQVLDDDDFVLISRY

SEQ ID NO: 43070 - protein, 193 aa, Sorghum bicolor
  Clone ID: SORBI-28MAY03-C9427_1.pep
VGSPNVGKSSLVRILSSGKPEVCSYPFTTRGILMGHIVSNHERFQVTDTPGLLTRHDDDRNNIERLTLAVLSYLPIAVLYVHDLSEDCGTSVADQYITYKHIKDRFGDRLWLDVISKCDLLGKKEPISFSDADDDVAQYRRLGPEGALRVSVQSEIGVKELKERVHELLTSQMARIKASKAEHETQEIGTSVL

SEQ ID NO: 43071 - protein, 252 aa, Sorghum bicolor
  unsure (1)..(252): unsure at all Xaa locations
  Clone ID: SORBI-28MAY03-C9309_1.pep
HASGSGNHAAAVALAAKLRGIPAHIVIPRNAPACKVENVKRYGGHIIRSDVSIESRESVCKRVQEETGAVLIHPFNDKYTISGQGTVSLEILQQGPEIDTILVCSSGGRXISGVTLAAMAINPSIRILAAEPKGXADDSAQSKAAGKIITLPSTNTIADGLRAFLGDLTWPVVRDLVGDVIVVDATAIVAAMRVCHELLEVAVEPRGAIGLAAALSDEFKQSSAWHESSKIGIIVSGGNVDLGTLWESLYKQ

SEQ ID NO: 43072 - protein, 105 aa, Sorghum bicolor
  Clone ID: LIB3478-042-P1-K1-F1.pep
VCKRVQEETGAVLIHPFNDKYTISGQGTVSLELLEQVPEIDTIIVPISGGGLISGVTLAAKAINPSIRILAAEPKGADDSAQSKAAGKIITLPSTNTIADGLRAF

SEQ ID NO: 43073 - protein, 256 aa, Sorghum bicolor
  Clone ID: SORBI-28MAY03-C9460_1.pep
MGWGISRLIGLKAAVLLSVACFFQGLGVTLISFPLIYASVIAILISIASHPSIDLPLLLGKASDGSFPLWSWIMFSPFLLFIHLFVLLRRFVKNEPLYTEVADGVFVGGWPSSVEHLPPGDPAIIDCTCELPKSSTISNNAYLCVATWDTRAPQPSQIESAVRWAVRKRSQNKPVYVHCAYGHGRSVCVMCALLVALGLAEDWKAAEQMIREKRPYISMNTLHRKSLEEWSKHLLSSKRSGESDVSSVIHSDYNQK

SEQ ID NO: 43074 - protein, 180 aa, Sorghum bicolor
  Clone ID: SORBI-28MAY03-C5023_1.pep
MAATEALADKNAVFRKLRAKSDNKMCFDCNAKNPTWASVTYGVFLCIDCSAVHRSLGVHVSFVRSTNLDSWTPEQLRMMVYGGNNRAQAFFKQHGWTDGGKIEAKYTSRAADLYRQLLAKEVAKSSTEDGNNSWPSSPVAVSQGPNQAPAFPDLKLTEVSKENVSEKKEPEIGRSPRAPT

SEQ ID NO: 43075 - protein, 324 aa, Sorghum bicolor
  Clone ID: SORBI-28MAY03-C5077_1.pep
VLSGNHYIYYSSDARSVGAIFNNIYEFTGLIADDQFISAENLTENQRVFADTLVKQAYDDWINAVEYDGKALLSFKQTKKTVTTRSETAKASASYPASNDLMNSQKQLAGGPVNTEQSSLKNTREGGTGIPSMGNQVAREYAGNPQHVAPSITMQYDMSSLVPGGQFSGSSVQTQTSRSSNMLALRPMQQPQNFEFSGLGQSTQPSGLNPFDDWSRSQENRGGGADDYLMDEIRARSHEILENDEMQQMLRLLSMGGAPTGLNNVDGFPSYPSPAPAFSFEDNRARSSGKAVVGWLKIKAAMRWGIFVRRKAAERRAQLVELED

SEQ ID NO: 43076 - protein, 82 aa, Sorghum bicolor
  Clone ID: SORBI-28MAY03-C50453_1.pep
FIYIFGRYRNLSYASSIFFFQSCPCCNVCLTNELILFLHYVIFLSDVDMLRTPCLCDIPFFCHEDIRLPCLSGLESFSCEGA

SEQ ID NO: 43077 - protein, 201 aa, Sorghum bicolor
  Clone ID: SORBI-28MAY03-C50945_1.pep
MKYVLVTGGVVSGLGKGVTASSIGVVLKACGLRVTTIKIDPYLNTDAGTMSPFEHGEVFVLDDGGEVDLDLGNYERFLDIKLTRDNNITTGKIYQAVINKERRGDYLGKTVQVVPHITDEIQDWIERVAMVPVDGKEGPPDVCVIELGGTIGDIESMPFIEALRQFSYRVGPGNFCLVHVSLVPVLDVVGEQKTKPTQHSV

SEQ ID NO: 43078 - protein, 252 aa, Sorghum bicolor
  unsure (1)..(252): unsure at all Xaa locations
  Clone ID: SORBI-28MAY03-C5099_1.pep
PRVRTTDLVXRSIAVQTEIGGVTIRIGGMAKGSGMIHPNMATMLGVLTTDAQVSNDVWRGGGRTSVDGDTSTNDCVIAMASGLSGLSRIQSLDSIEAQQFQACLDAVMQGLAKSIAWDGEGATCLIEVTVSGANNEAEAAKIARSVASSSLVKAAVFGRDPNWGRIACSVGYSGIQFDANRLDISLGVIPLMKNGQPLPFDRSAASRYLKDAGDAHGTVNIDISVGSGGGNGKAWGCDLSYKYVEINAEYTT

SEQ ID NO: 43079 - protein, 116 aa, Sorghum bicolor
  Clone ID: SORBI-28MAY03-C51211_1.pep
DSLHTSRFHQTRLNTPDNNRYGLLQRQKSGISEDGRLSRRSSCSSLDCMSEGPKSSDDGAFGKYVVDDNSSAVNNNPSVKFHAELVNNTGSLKSEAQLGFVNSKEDGEDGEQLPDL

SEQ ID NO: 43080 - protein, 197 aa, Sorghum bicolor
  Clone ID: SORBI-28MAY03-C47886_1.pep
MAAAAVLAAILALFSRAASATAATAAAKADRIGSLPGQPPVNFSMYSGYVTVDAAAGRALFYWLIEAAGVPAESAPLVLWLNGGPGCSSVGYGASEELGAFRINADGRTLYLNPYPWNKVANMLFLDSPAGVGYSYSNTTSDLYTAGDNKTAHDSYNFLVNWLERFPQYKYRDFYITGESYAGHYVPQLSQLVYRNN

SEQ ID NO: 43081 - protein, 244 aa, Sorghum bicolor
  Clone ID: SORBI-28MAY03-C47734_1.pep
DSPATLSPPLLPPAKHLPHLPLLASEPMQCRVVVRGVSIPCKGGKRKVRKVLQNSNGVFRCEFHARRNRVVATVSARPVPSRLLSKLRRPANRAELWPDHPPPPPPAAAAETESQPQEPKNNQPDNPSNPNEPPDKGGPDPPEAAAQDPGTPPEPRQGPGEAPNPPRDCKHHAGADEAGGDTGAGTAAAAARPRPSDAKGEAKVRQQPGAPHAPPGGDELQPGAAERERVLLRSRPGTSAGAGA

SEQ ID NO: 43082 - protein, 112 aa, Sorghum bicolor
  Clone ID: SORBI-28MAY03-C48103_1.pep
EKPKPQPEKPPTPPPQCNCHCCKPPPEKPKPPPPCNCHCCKPPPPPEKPKPPAEKPPPCKCECSHDKDDCKHHCPPCPPCPPCPPCPPPNYWPPQPWPACRCPEQDSQCSIM

SEQ ID NO: 43083 - protein, 159 aa, Sorghum bicolor
  Clone ID: SORBI-28MAY03-C48397_1.pep
MAILVITMVDLQCCRCRAKITKILECLKEEFCIEKIEFEDKVNKVIVRGKFDGEKLKTVVLCKAGKIVKEIAVVEKWPPPPPPPPPPPPECKAAILVITMVDLCCACRTKITKILEGLKEEFCIEKFEFEDKLNKVIVRGKFDAEKLKKTILCKAGHIV

SEQ ID NO: 43084 - protein, 204 aa, Sorghum bicolor
  unsure (1)..(204): unsure at all Xaa locations
  Clone ID: SORBI-28MAY03-C51927_1.pep
MRGKKPLKDLRLSVPAQETPVDKFLTASGTFKDGELRLNQSGLRLISEENGGEDESTKLKVEDVQLSMDDLEMIQVIGKGSGGIVQLVRHKWVGTLYALKGIQMNIQESVRKQIVQELKINQATQCPHIVMCHQSFYHNGVIYLVLEYMDRGSLADIVKQVKTVLEPYLAVLCKQVLEGLLYLHHERHVIHRDIKPSXLLVNRK

SEQ ID NO: 43085 - protein, 133 aa, Sorghum bicolor
  Clone ID: SORBI-28MAY03-C52300_1.pep
MAKHLYKTPIPSTRKGTVDRQVKSNPRNKLIHGRHRCGKGRNARGIITARHRGGGHKRLYRKIDFRRNQKDISGRIVTIEYDPNRNAYICLIHYGDGEKRYILHPRGAIIGDTIVSGTKVPISMGNALPLSAV

SEQ ID NO: 43086 - protein, 186 aa, Sorghum bicolor
  Clone ID: SORBI-28MAY03-C52216_1.pep
MSNREVVQAAQLQAEGGIPEWVTAIVKSEVGDDGTGDVHFEAFQMSEICVKLFKDGVLETEVQDADDPRLSKMRKEVVAGGKDTMEVDNDFFLVPVKISDHQGPLSVGFPIENRGSPLGMSALRSHLERMKHLAFVRRISDFHLLLKLATFLDVKADMPTIAACVKTQSRVPEGYQFLIESFASQG

SEQ ID NO: 43087 - protein, 223 aa, Sorghum bicolor
  unsure (1)..(223): unsure at all Xaa locations
  Clone ID: SORBI-28MAY03-C52347_1.pep
HEAPTAPMSPPPPPPAAAXPGLGRPPSQPPPPAAPASRAPGPRTPRPRPPPXPAPAVPAPSLRPAPCPRSLYVRSGPPPAPPPLPPAPAASPPPPPRPWPPSPPIPTRRPASAPPPPPPPAPPRRRGSPRRLRPRSPPPPPPGRLPQPRPPPPPPPPPPTPPVPASGPPPATPGRAPHPGSAAPGPPDEPPQQXPPPPPPPPTLRSFAAECLIYHYAACRRGV

SEQ ID NO: 43088 - protein, 111 aa, Sorghum bicolor
  Clone ID: SORBI-28MAY03-C52433_1.pep
GGRPAGMGSGVRALMRRKQVDSERTRAAGSAHQLRKELSVTQLVAIGVGSTIGAGVYVLVGTVAREHSGPALTLSFLIAGIAAALSAFCYAELASRCPSAGSAYHYSYICV

SEQ ID NO: 43089 - protein, 200 aa, Sorghum bicolor
  Clone ID: SORBI-28MAY03-C52547_1.pep
MERVFSVEEIPNPYWAPPHPQSAAAGAVAAPGGGGGAVDAAGAMNRCPSEWYFQKFLEEAVLDSPGPVPGVGRGSVVAGAEAPESKPLGPAAASSSVVDPVEYNAMLKQKLEKDLAAVAMWRASGAAPPDRSAVASSLPSVDVPHAAPLKPIGGTESLVQNKLAGAPGVGSGPHVVQTADIPIKQTTSSSSREQSDDDDM

SEQ ID NO: 43090 - protein, 145 aa, Sorghum bicolor
  Clone ID: SORBI-28MAY03-C52753_1.pep
WFDLYGRGGTSCCSSHEEHVFVGEIKGRGQGETEVSGFHNWIQFYLEEAKGNVDYQGYIFPRRRGESPDSETQLLTVQFEWLGVLKSVSSTLIGVSPEFEVALYTLCFFVGGEDNRVDIGPYSVNIKCYRLGNNKIGSAFPIAEN

SEQ ID NO: 43091 - protein, 255 aa, Sorghum bicolor
  Clone ID: SORBI-28MAY03-C49506_1.pep
ARGGSTLFKSLTTIIDHPAGIVTMLANSLPGSATFFLTFVALKFFVGCARELSRLVPLIIFHLKRKYLCKTEEDVKAAWAPGDLGYNTRVPNDMLIATVVLCYSVIAPLIIPFGVAYFALGWLIAKNQILRVYVPSYESYGRMWPHMHTRIITALMVYQTTMIGFIPLKKFYYVPVLVPLLPISIIFAYVCHMRFYPAFAKTPLEVVAQHDLKETPNMETIYTSYIPPCLKPEKLEDLDAFEDAQSHKTSRAPSV

SEQ ID NO: 43092 - protein, 286 aa, Sorghum bicolor
  Clone ID: SORBI-28MAY03-C49534_1.pep
MYPYRMSNVMIGYLNLATLLASIPIIGAGLWLAKGSTTTCSSILQTPLLVIGFIVLLISLAGFVGACFHVAWALWLYLVAIILLIAFLLGLTAFGFAVTAGGGGTQVYGRPYREYHITDYSSWLQKHMQDIKYWRPALACVVGSKACPKIENWTPMDYLQHDLTPIQSGCCKPPTACQYSGGMPVGAQDEDCYRWNNAPDILCYQCNSRKAGVMEQIRQDWHKISILNVIVLAALICIASCCCCAFRNARRSLSEYPYGVNQMSKINPRWDYYWWRWFRGRREQLY

SEQ ID NO: 43093 - protein, 124 aa, Sorghum bicolor
  Clone ID: SORBI-28MAY03-C499_1.pep
YPMQYISFHYWALQGQCQNDMKGLVFDNQYPDQPKIPGDFILKYIFQINVDRNKWIDLSVIFSMIFIYRILFFLMIKINEDVLPWIRGHIARKRMQKKGPSPSFGKTPSLRGYVVDPELGSNEG

SEQ ID NO: 43094 - protein, 53 aa, Sorghum bicolor
  Clone ID: LIB3478-052-P1-K1-E8.pep
IASAALFFFFFSEQSVMCHWACLRCQFAHIVTLHAVCIPVLELASVSKRMIPV

SEQ ID NO: 43095 - protein, 87 aa, Sorghum bicolor
  Clone ID: SORBI-28MAY03-C50107_1.pep
TKRLALTPAKKEIKITYSLSPNCDCIHILDYISSCGCAVVTSLSMRCANCSSSTFGTRFCHFFPFNLPVVHPTSPAPHLLTLLFHRK

SEQ ID NO: 43096 - protein, 406 aa, Sorghum bicolor
  unsure (1)..(406): unsure at all Xaa locations
  Clone ID: SORBI-28MAY03-C5418_1.pep
ARGFSNLRSRGSSLCDIAILVVDISPGLEPQTIESLNLLKSRDAVFIVALNKVDRLYGWKKCPNAPRGKALKQQNEDVKREFNMRLTDIVTQFKMQGVNTALYYKNKEMEDTFNIVPTSAVSGEGIPDLLLLLVQWAQKTMEEKLTFVDEVQCTVLEVKVVEGHGTTIDVVLVNGILHEGDQIVVCGMQGPIVTTVRALLTPHPMRELRVKGTYLHHKEIRAAQGVKISAQGLEHAIAGTALYVLGPDDDLDKLXEAVMEEMTRVRSRIDRSGEGVYVQASTLGSLEALTEFLKSPAVNIPFCDFSIGPVHKKDVMKASVMLERKKEYATILAFDVKVMPDARELAEESGVRIFVADIIYHLFDQFTAYIKNLKEEKKKESAEKAVFPCVLKIMPNCVFNKKDPIV

SEQ ID NO: 43097 - protein, 197 aa, Sorghum bicolor
  unsure (1)..(197): unsure at all Xaa locations
  Clone ID: SORBI-28MAY03-C5443_1.pep
MGSLEARYRPAGAAEDTAKRRTQKSKSFKEVEKFDVFVLEKSSGCKFRSLQLLLFAIMSAAFLTLLYTPSVYEHQLQSSSRLVNGWIWDKRSSDPRYVSSASIQWEDVYKSIQNLNVGEQKLSVGLLNFNRTEFGAWTHMLPESDFSIIRLEHANESITWQTLYPEWIDEEEETEIPSCPSLXDPSFPRATHFDVVA

SEQ ID NO: 43098 - protein, 121 aa, Sorghum bicolor
  Clone ID: SORBI-28MAY03-C54923_1.pep
VHGRGELLVEEHFSGREREPVPGPDEHARSVRERGWHSVQRWVPGHGRQQAEHERLPRRRRRRRHAEHGWRGGAAAAARCRGHWHGLIGPRNEVGDRNPKRSTTACSIMLHSWLLCCMQGK

SEQ ID NO: 43099 - protein, 413 aa, Sorghum bicolor
  unsure (1)..(413): unsure at all Xaa locations
  Clone ID: SORBI-28MAY03-C5511_1.pep
GAPFSAILADFLGRGIFNVDGDSWLFQRKLAAAELASPALRCFAAGVVASELRCRLIPLLYSAAGDGDSSGERLLDLQDVFRRFAFDCICRISFGLDPGCLELSLPMSAFADAFDTASMLSARRATAPMHVLWKLKRLLNVGEERXLRDAIRLVDTLAAEVIRQRRKLGTAASGDDLLSRFMGSINDDKYLRDIVVSFMLAGRDTVASALAPGFLLLSDHPDVATAIRDEVSRVAGDDDRDGHAAASSEKLKDMHYVHAALHECMRLFPPVQFDSKFAAGDDMLPDGTFVARGTRVTYHAYAMGRMESVWGPDCAEFRPDRWLHDGRFVPESPYRYPVFQGGVRVCIGRELAIMEMKSVIVSVVQSFDIEAVGRSSHRPKFAPGLTATFAGGVPVRVRRRARARVSELRRPPR

SEQ ID NO: 43100 - protein, 119 aa, Sorghum bicolor
  Clone ID: SORBI-28MAY03-C55281_1.pep
IPWMTDEELGQFAEKFEKTGFTGPLNYYRMLVTNWRLTAPWSGSKITVPAKFILSKNDVGLQSFGTEEYVKSGGLKENVPDLEVSIIEGHHFVQQEEAESVNSEILSFLNKFATEGGSA

SEQ ID NO: 43101 - protein, 447 aa, Sorghum bicolor
  unsure (1)..(447): unsure at all Xaa locations
  Clone ID: SORBI-28MAY03-C554_1.pep
MIEAELEMLKGNMERIQAEKDDALAMVHAKDAEVSVAVTRSHELELEVEKTETEMVTSKELVEKLQALVAQMEQKQNIMVAEVSRLQSEMDQLVKTNEAAVVAHDSEKKMIQAELEMLKGSMDKIKSEKDDALGMVHAKDAEVSAAVTRSHELELEVKKMETEMAATKEXVEKLQSTVADVEQKHRLMSAEVARFQSEMDQLVKVNEAAVVAHDSEKKMIQAELEMLKGNVERIQAEKDDALGMVHAKDAEVSAAVTRSHELELEVEKMETEMVASKELVEKLQALVAEMEQKQNIMVAEVARFQSEMDQLVKVNEAAVVAHDSQKKMIQAELEMLKGSMDKIKSEKDDALGMVHAKDDEAGKLRDELKKLHSGMAELRACCDDLDGKSSSLHDEKILVLKKLEQEKDEAEKLKFKLQELESYNRDNDRESGVLXGKLQAGTNKSMT

SEQ ID NO: 43102 - protein, 195 aa, Sorghum bicolor
  unsure (1)..(195): unsure at all Xaa locations
  Clone ID: SORBI-28MAY03-C57199_1.pep
MPTTHALRLCPLLSTVRSTPPRATAAARQGASPALLVARCSSAGTPSAAQALKINSIPTKPVEGQKTGTSGLRKKVKVFQQENYLANWIQALFNSLPPEDYVGATLVLGGDGRYFNKEAAQIIIKIAAGNGVQKIIVGRDGLLSTPAVSAVIRKREANGGFIMSASHNPGGPDNDWGXIKFNYSSGQPAPETITD

SEQ ID NO: 43103 - protein, 142 aa, Sorghum bicolor
  Clone ID: SORBI-28MAY03-C51433_1.pep
MGICASSKRVQQEEDSDENVVYVMDEQGGGGGPDGDGHGRKVASLFSQKGKKGPNQDAVILCQGFGMEDGVFCGVFDGHGRCGQYISKLVRDYLPFMILSHRNALLLGSSEDDDYAAVFSDASPVASTAASSTDGSGRSSPA

SEQ ID NO: 43104 - protein, 158 aa, Sorghum bicolor
  Clone ID: SORBI-28MAY03-C51328_1.pep
HVLIHCKNHSKRMLVWLLASVVLTISALFVLLLGMPFSKPLYTVSYMLLTGGVSGFLLLLLYYIVDVIHIKKPFVLFQWMGMNALIVYVLAACELFPTLIQGFYWRSPENNLVDVTESLLQAVFQSKRWGTLAFVLLEIVFWCLAAGFLHMKGIYLKL

SEQ ID NO: 43105 - protein, 187 aa, Sorghum bicolor
  unsure (1)..(187): unsure at all Xaa locations
  Clone ID: SORBI-28MAY03-C51660_1.pep
MAPAAAASRVAVSSPVFGSDGGARSSEIKGNNNVSFGNKSWVGGTLAWESSSVRPRHVNKVLCMSVQQASKSKVSVAPLDLESAKEPPLNTYKPKEPFTATIVSVERLVGPKAPGETCHIVIDHGGNVPYWEGQSYGVIPPGXNPKKPGAPQNVRLYSIASTRYGDYFDGRTRSLCVRRAVYYDPET

SEQ ID NO: 43106 - protein, 257 aa, Sorghum bicolor
  Clone ID: SORBI-28MAY03-C51803_1.pep
MATSNGKAAQGEEGKTPPPAGSIGGYESLHRLLEANLSPELFQEASRLLLGLNCAQPLEAISLPDATTTLAETHNFDVQAFRFSADKEFLRQPRVVRVGLVQNSIAVPTTCHFADQKKAIMDKIKPVIDAAGASGVNILCLQEAWTMPFAFCTREKRWCEFAEPVDGESTQFLQELAQKYNMVIVSPILERDVNHGETIWNTAVIIGNNGNIIGIHRKNHIPRVGDFNESTYYMEGNTGHPVFETAYGKIGVNICYG

SEQ ID NO: 43107 - protein, 116 aa, Sorghum bicolor
  Clone ID: SORBI-28MAY03-C56371_1.pep
GIKQWDEFVETFDVSKSSQLPKLLVWDRNEEYELVDGSERLEEGDQASQISQFLEGYRAGRTTKKKISGPSFMGFLNSLVSLSSLYILIFVIALLVVMVYFAGQDDTPQPRRIHEE

SEQ ID NO: 43108 - protein, 155 aa, Sorghum bicolor
  Clone ID: SORBI-28MAY03-C56424_1.pep
IGRFHPDGCLEIIARKKDIVKLQHGEYVSLGKVEAALIVSPYVENIMIHADPFHNYCVALVVAAHIELESWASQQGIKYSDFSDLCQKQEAVKEVLGSLAKAAKQARLEKFEIPAKIKLIPEPWTPESGLVTAALKLKREVIRKTYENDLAQLYA

SEQ ID NO: 43109 - protein, 152 aa, Sorghum bicolor
  Clone ID: SORBI-28MAY03-C56715_1.pep
TRLPRVYWFRTLAVSFLPSAMDSSHLLTYPTSFTTAAWFSSFSSTSPVLLSFASSLPPCVHPMELHCTWAPCGGVAAGCSRVVGILDGRCPRPRRGRPSPAGRHRRGFIPQDHAFSCAPWNPRCVSPPHLLPDGLPRTDLQLTISCSSCMAT

SEQ ID NO: 43110 - protein, 157 aa, Sorghum bicolor
  Clone ID: SORBI-28MAY03-C568_1.pep
RAMGVGGGPSGEAGGAEHAEAEDDAGEEGEYEDESIVHHTASIGDVEGLKKALEDGADKDEEDSEGRRGLHFACGYGELQCAQALLEAGAAVDAVDKNKNTALHYAAGYGRKDCVTLLLESGAAVTLQNLDGKTPIDVAKLNNQDDVLKLLEKHAFV

SEQ ID NO: 43111 - protein, 234 aa, Sorghum bicolor
  Clone ID: SORBI-28MAY03-C56869_1.pep
ARGYYGALVAPINLPNSRLLFCSRSSMFQWQVGSNFWSEHPLGVQCIVQIVSFKGEIFAIDFLERLHRVQLEPQLSTQEVAVVWDADIFLGLWNAPWLVVCGDMLLLVDFSVSINQFSGIAGTFNVFRLDFQVEPAKWVKVDDLGDNALFISFDRRNPTFSCPGPDKWGGKRNCIYIASPSADSKELWSVVEVGQVVLDPKLCTNGAEKYLPRAQLMQLQNLWELPSFVYGVGQ

SEQ ID NO: 43112 - protein, 212 aa, Sorghum bicolor
  Clone ID: SORBI-28MAY03-C5688_1.pep
MDEADDELRTLKVGFTAAGEEQFRKLVAEKLRGFKRDVDHTLVEYVTIMLKNGKRKDLASKELRVFLGDDTAVFISWLWDHLSLNMYLYVQAQEQTQEVKDDEAPKEVSGREKSSDVLPRSKCQTHSEHTVESSAASTRKRNKREWKGIGREGNEKFPLRNVLTDILHGEEKRSQKSNEIRHPPSKQPERQKRDRDDEPQQTKRASHHAPCL

SEQ ID NO: 43113 - protein, 273 aa, Sorghum bicolor
  Clone ID: SORBI-28MAY03-C569_1.pep
MGADCRYELAQAAYVKLALHALKHPATAVNGLLVGRLVEPSSSPAVVSVIDAVPLSHHPHHLPLLPTLELALTLVEDHFATQGEGLAVVGYYHANPRCDDTDLPPVAKRVGDHIFRYFPRSAVLLVDNKKLEEAVKGKSRDPVAQLYTRDSSKSWRQAGSDGSSQLVLKGPSTNVVLADHVTTRDGGIFGEFAGRRDAISWDWLFPGRPAGLFPFPLSPPSRLLARLGVLSLVLLSSGLCSGAVLCWHVFQFASGFVSVTVPDAIFDVVAALV

SEQ ID NO: 43114 - protein, 366 aa, Sorghum bicolor
  Clone ID: SORBI-28MAY03-C5257_1.pep
TRGKPRAAMYGLIPDDWGAYARPWVAELAAPLECLKALHLRRMVVTDDDLAELVRARGHMRPGLKLDKCTGFSTDGLRLVARSCRSLRTLFLEECQINDKGSEWIHDLADGCPVLTTLNFHMTELQVMPADLEFLARSCKSLISLKISDCDVSDLIGFFQFATALEEFAGGTFNEQGELTMYGNVRFPSRLCSLGLTFMGTNEMPIIFPFSAILKKLDLQYTVLTTEDHCQLIAKCPNLLVLAVRNVIGDRGLGVVADTCKKLQRLRIERGDDEGGLQEEQGGVSQVGLTAIAVGCRELEYIAAYVSDITNGALESIGTFCKKLYDFRLVLLDREERITELPLDNGVRALLRGCTKLRRFALYLRP

SEQ ID NO: 43115 - protein, 151 aa, Sorghum bicolor
  unsure (1)..(151): unsure at all Xaa locations
  Clone ID: SORBI-28MAY03-C53075_1.pep
XYGGRRDIMEMVAPAGPMYQAGTLSGNPLAMTAGIHTLKRLTEPGTYEYLDKITGELVRGILDVGAKTGHEMCGGHIRGMFGFFFTGGPVHNFGDAKKSDTEKFGRFYRGMLEEGVYLAPSQFEAGFTSLAHTSQDIEKTIEAAEKVLKRI

SEQ ID NO: 43116 - protein, 289 aa, Sorghum bicolor
  Clone ID: SORBI-28MAY03-C5357_1.pep
RYKKELGIKAFVKKEVQEVRTVDERKASEITQLTMPKLCVRLNSLYYGISQLSKLEDSINERWAWKKSEKTNIRRTSEKSKSAIPQKNQFDGSRKEINTAIDRLCEFTGTKVIFWDLQQPFIENLYRNGVAQARLDTITEVLDLVLNQLCDVIVEQLRDRVVTGLLQASLDGLLRVILDGGSTRVFSPNDAPFLEEDLETLKGFFISGGDGLPRGTVENLVSRVRPVIDLIKQETRVLIDDLREVTQGGKSKFGVDSKTLLRVLCHRNDSEASHYVKKQFKIPSSAPSA

SEQ ID NO: 43117 - protein, 193 aa, Sorghum bicolor
  Clone ID: SORBI-28MAY03-C5385_1.pep
SCPSSCSFYNLSPSYTPVTPEPGLNQASSPTSGHPQAYHGNQRHVSATYVAPWAQPQSKTTGSQQLTPTQAQLSYSSFAYPPPPWASQDNTELNPFVASSSSSSQHQSTSSTPIMPPNLRPLQQSHSFGVPLRTASLDSPINGNLKQPLSAGARRPSYVPSNKFFDDLFERNSDGSLKVGSTIGGGTTSPYKA

SEQ ID NO: 43118 - protein, 163 aa, Sorghum bicolor
  unsure (1)..(163): unsure at all Xaa locations
  Clone ID: SORBI-28MAY03-C58544_1.pep
MAGDDHVVVDVDGLAKSKEAEVTKKPSEVANSPAAAAASPSAVVDLVHDEEEGGGEEEPLIQAAECRICQEEDSVKNLEKPCACSGSLKYAHRACVQRWCNEKGDTTCEICHEAFCPPAXYKPGYTAPPRPQPDETTIDIDGDLIMDLRDPRILAVAAAQRRL

SEQ ID NO: 43119 - protein, 139 aa, Sorghum bicolor
  unsure (1)..(139): unsure at all Xaa locations
  Clone ID: SORBI-28MAY03-C5768_1.pep
AVPGARRGPHCEALPSGCVGGRAEAGALAARDLSPPSHSPRVRIIEFFKRFPNVDMTYVVRAGDDISTGDNVTVQVTLERDMTNLPSEVGSVHAPRFPKPTEECXWLVIGDXAIKRDALPKKARVKLELSAPASSGRKD

SEQ ID NO: 43120 - protein, 323 aa, Sorghum bicolor
  Clone ID: SORBI-28MAY03-C58545_1.pep
MAKKRKRTDAPAEAAGAEKPDDSAPARPERTLFGFKDPAPDAEPAASAGDGAAVAPFRNREKVLITCSRRITYRYRHLMQDVLSLLPHAKKDSKVESKQSKGSALNELLELRSCSSCLFFECRKQKDLYLWMVKSPGGPSVKFLVNAVHTMEELKLTGNHLKGSRPLLTFSTNFDEQPHWKLVKEMITQIFATPKDHRKAKPFHDHVFAFSIVDGHVWFRNYQISVPHNEIDKVDKGGLDKMTLIEVGPRFCLNPIKIFGGSFGGPTWYENPYYISPNQIRALEKRQKAGKYAKKVKAKVRRKMHEMENTLEPDEFAELWKGE

SEQ ID NO: 43121 - protein, 226 aa, Sorghum bicolor
  Clone ID: SORBI-28MAY03-C58640_1.pep
MASGAPLPRSRAARPRARSPRSTPPPPGAASTSRPPLPSASRTPAVRSSRRRSAPPQSRPVRRSPRIHELVWLSSFISFFFLYPSTFNLLEVAAVDKPKLHMWETGIMRITRHPQMVGQVIWCLAHTLWIGNSVAVAASVGLMGHHLFGAWNGDRRLVSRYGEAFEVLKNRPCVVPFAAIVDGRQKLPKDYHKEFFRLPYVAITILTLGAYFAHPLMQASSYQLPW

SEQ ID NO: 43122 - protein, 161 aa, Sorghum bicolor
  Clone ID: SORBI-28MAY03-C59484_1.pep
MAGEDEDEAAAIERQLEQQLQEQRSSLAAVDEALAADPSNADLLEVHEELLAAIKDAEEGLLHLKRCRLLKQVDEIFPDEASISQSPEVAIEPLDPDDGEPEPLEPHDFSVGSKCRFRHNNGRWYNGCIIGFEGSSDARISFLTPTSENMSMCKFFLQQRC

SEQ ID NO: 43123 - protein, 266 aa, Sorghum bicolor
  Clone ID: SORBI-28MAY03-C59318_1.pep
MVRLVLLVAAAGPPVFILLLTAGGASLAAAVAAGLRSEAARHFFNIVVFVVCPPPLAAFFAATTTTVGCAALRWLPPVILLPASFGGLFGGWVVVVATAPPALRGRLLGGCSAADLGNIFLIIIPALCQEKGSPFGAADVCQNIGLAYSSLSMAIGAVFVWSSAVYIVRLASSFAAGDADAQTNETKVLNSGNAIGSVAEENCSASNDCADECTLPLILTSIRPTKDKHSMLERARKVLSSISEAVDLKKLFAPSTIAVVHWFDEL

SEQ ID NO: 43124 - protein, 179 aa, Sorghum bicolor
  Clone ID: SORBI-28MAY03-C56029_1.pep
TRVEGTLPAHVSTVVKGTPGYLDPEYFLTHKLTDKSDVYSLGVVFLEMLTGMKPIEHGKNIVREVNSACQSGSVSEIIDGRMGLYPPECIRRFLSLATKCCQDETDDRPSMWEIVRELELILRMMPEEDVILLETSETDSTDVSKSLSTSATGTLFISSQASGSLDASSGMISGRVTPR

SEQ ID NO: 43125 - protein, 141 aa, Sorghum bicolor
  unsure (1)..(141): unsure at all Xaa locations
  Clone ID: SORBI-28MAY03-C56093_1.pep
RCFGVRAPLPAPHESSELIGGGAIPSVTLIMGANLLNGVQGGASVPPSVIAGVIVVRYILLPLLGTALVKGAVWLGLIXQTPLYQFILHLQYAVPPAMNIGTIMQLFGVGESECSVIFVWVYALASVAVTIWSAFFMWMLS

SEQ ID NO: 43126 - protein, 191 aa, Sorghum bicolor
  Clone ID: SORBI-28MAY03-C56167_1.pep
ADFGLARILLKSGEPESVSAVARSCGYMAPECGRGAKVNQKVDVYSFGVVLLELATGRVANDSSKDAAECCLVEWAWRRYKAGGPLHDVVDESMQDRSVYAEDAVAVFVLGVMCTGDDAPSRPSMKQVLQQLARYDRTASVAGACRDGGDVEVGQVPKGKHGRHQADKRSYDAGAFLGGDEESGDFVARPV

SEQ ID NO: 43127 - protein, 174 aa, Sorghum bicolor
  unsure (1)..(174): unsure at all Xaa locations
  Clone ID: SORBI-28MAY03-C5587_1.pep
TRDLGYTYDAEYDRDLPWLRPKITKLVPHGKESGAAARSSAAAPVFPXLALTKGQVVEVPAVAVPAREAGKEQLLVIDGIEFDPQANNKFDVAINLPADKASQVGPQYKEYAGSFAVVPGSGGGETRIGKVTLCITDVLYDLDAEDDSSVDVVIVPRTDAKVTINVRPIIKNRN

SEQ ID NO: 43128 - protein, 168 aa, Sorghum bicolor
  Clone ID: SORBI-28MAY03-C60082_1.pep
MAQPSVILATASYDHTIRFWEAKSGRCYRTIQYPDSQVNRLEITPDKRFLAAAGNPHIRLFDVNSNSPQPVISYDSHTTNVMAVGFHCDGNWMYSGSEDGTVRIWDLRTGTCQREYESRAAVNTVVLHPNQKELISGDQNGNIRVWDLAANSCSCELVPEVDTAVRSL

SEQ ID NO: 43129 - protein, 217 aa, Sorghum bicolor
  Clone ID: SORBI-28MAY03-C602_1.pep
MKGGGDKVDYVFKVVLIGDSAVGKSQILARFARNEFSLDSKATIGVEFQTRTLVIDHKSVKAQIWDTAGQERYRAVTSAYYRGALGALLVYDITKRQSFDHIPRWLEELRGHADKNIVIMLVGNKSDLEEERAVSSEDAKEFAEKENLFFLETSALQATNVENAFQTVLTEIFKIHSKKNMAADPKANGAAPSLAGKKVIVPGPAQEIPKSKCCSSM

SEQ ID NO: 43130 - protein, 296 aa, Sorghum bicolor
  Clone ID: SORBI-28MAY03-C6047_1.pep
MEAPPVALFDSLKAAKPFFLLAGPNVIESEEHVLKMAKHIKGITTKLGIPLVFKSSFDKANRTSSKSFRGPGLEEGLKILEKVKATYDLPVVTDVHESHQCEAVGRVADIIQIPAFLCRQTDLLVAAAKTGKIINIKKGQFCAPSVMMNSAEKVRLAGNPNVMVCERGTMFGYNDLIVDPRNFEWLREANCPVVADVTHALQQPAGRKLAFCKLDGGGVASGGLRELIPCIARTSVAVGVDGIFMEVHDDPLNAPCDGPTQWPLRNLEELLEELIAIARVTKGKKPFKIDLTPFQE

SEQ ID NO: 43131 - protein, 114 aa, Sorghum bicolor
  Clone ID: SORBI-28MAY03-C6076_1.pep
MASKVVSILVLAFLLLAAVAVPVSAGPRQRGKNGGGGAGGGGGSPSGGGNLKPWECSPKCASRCSQTQYKKACLTFCNKCCATCLCVPPGFYGNKGACPCYNNWKTKEGGPKCP

SEQ ID NO: 43132 - protein, 311 aa, Sorghum bicolor
  Clone ID: SORBI-28MAY03-C6050_1.pep
MHDRSYKPQPAEAGSGGTAGDGGGGGGNVDRVLFKNLVEMVPLVESLMDRRVNPAYSRRASLVYTPAPPKKASDLKSVKLPQSVSAKKRRDPGDAAKKSAPDSNGDSGSVVPFSLSGAENKPKDEVAMLREQIDDLQKKLLEKEEALRSAESSVAEMNAAYATIDELRRLVADKEALIRSTNSQLHDAKIMLADKQASLEKLEWEVKMSNKKVEDLQGDMSNMGFEISSLMAFFEKISENVSSDSYDDTIPLSHELEALQSTSEIDKIEVDKIEQERMMYAEALAAARENPDEEHLNIAAEARSRLQVLVL

SEQ ID NO: 43133 - protein, 158 aa, Sorghum bicolor
  Clone ID: SORBI-28MAY03-C6078_1.pep
MAMAASSRLLWASRAAAYLRISTFPRAFSTVLKDLKYADTHEWVKVEGDSATVGITDHAQDHLGDVVYVELPEVGISVSQGKNFGAVESVKATSDINSPVSGEVVEVNNKLSEEPGLVNASPYEKGWIIKVKLSDSGELNSLMNDEKYSKFCEEEDNH

SEQ ID NO: 43134 - protein, 349 aa, Sorghum bicolor
  Clone ID: SORBI-28MAY03-C57322_1.pep
MHPAASPPRPPSGARPPATPLMSLGAAVYSYFSTATAPPRPRRCILSFRAAASPAALDRRRRPQNVAGDFFVDQRCIDCQTCRWMAPQVFKRVDGKAAVAAQPSSEEERTKALQALLSCPTSSIHTEKPPKDILQVQNMFPLPIDDKLLPGVYLCGYNSEDSYGATSYLVIHPQGNILIDSPRYTSKLANNIEKLGGARYMFLTHIDDVADHRKWAEQLKCERIIHMGDVEEATADVEWKLEGNGPWNIGTDFEFIHTPGHTPGSVCLYYKPPKVLFTGDHVAKSEESDDLNLFLMYSKQSVSLQLESIRKLLEVEFEWLLPGHGYRIRYKDVQAKNAAMESLLANYLS

SEQ ID NO: 43135 - protein, 435 aa, Sorghum bicolor
  Clone ID: SORBI-28MAY03-C5739_1.pep
MSGPLDRFARPCFEGFVHNDERKESRSDADNSEGDKKTKIGSFKKKAINAGNKFRHSLRRRSKKKERGESIKDIRDVKELQDVETFRQCLIDEDLLPQQHDDYHMMLRFLKARKFEVEKAKNMWSDMLKWRKEFGVDKIEEFDYTELDEVTKYYPQFYHGVDKEGRPVYIELIGKVDASKLLQVTTLDRYVKYHVKEFERCFQMRFPACSIAAKKHIDSSTTILDVQGVGFKNFSKSARELITRLQKIDSDNYPETLCRMYIINAGQGFKMLWSTIKSFLDPKTVSKIHVLGNKYQHKLLEIIDECELPEFFGGKCNCIEGCQRSDKGPWKDPNIIKRVLNGEANYGRQIVTISSTDGKIISYARPGHPTRKGSDASAESGSEVEDVVSPTASRNLITHPILTPVHEESKLSAHGSAFAAHASIEESIPVVDKVL

SEQ ID NO: 43136 - protein, 179 aa, Sorghum bicolor
  Clone ID: SORBI-28MAY03-C57931_1.pep
MSTHQGWLLQSGHSVVDISGSKMVLHITHRAFSFRCFAANGRGFGADSTNKRKIKSKKRPKDVALEPSEVISGNPKNREQWVPELRSGSENKSGKQVMDKKFLEKVEAVRRSALEKKKAEENKDYQAIDYDAPIESDKSTIGFGTKVGIGVAVVVFGLVFAFGDFLPYGSVSPSKESAV

SEQ ID NO: 43137 - protein, 213 aa, Sorghum bicolor
  Clone ID: SORBI-28MAY03-C6119_1.pep
MGQGTPGGMGKQGGAGDRKPGDGGDKKDKKFEPPAAPSRVGRKQRKQKGAEAAARLPNVAPLSKCRLRLLKLERVKDYLLMEEEFVAAQERLRPQEDKAEEDRSKVDDLRGTPMSVGSLEEIIDESHAIVSSSVGPEYYVGILSFVDKDQLEPGCSILMHNKVLSVVGILQDEVDPMVSVMKVEKAPLESYADIGGLDAQIQEIKEAVELPLT

SEQ ID NO: 43138 - protein, 108 aa, Sorghum bicolor
  Clone ID: LIB3476-015-P1-K1-D1.pep
VAGGSMEIIDESHAIVSSSVGPEYYVGVLSFVDKDQLEPGCSILMHNKVLSVVGILQDEVDPMVSVMNPALPILYKGSRGGRVLGRTRAMFRGRCQMRMPITHLVRHW

SEQ ID NO: 43139 - protein, 148 aa, Sorghum bicolor
  Clone ID: SORBI-28MAY03-C61577_1.pep
LASRDRKFAEHYNVLEQILAVLIQFVKDKKLEHQHQFDDLKKTWLIKRCRTMNAKLSYLEHHLLRDTYTKDTVPALHRIRKYLVEATKEASNSYNEAVSRLREYQGVDPHFDVIARQYHEIVKKLEGMQWTIHQVEMDLKPHHDHAAV

SEQ ID NO: 43140 - protein, 172 aa, Sorghum bicolor
  Clone ID: SORBI-28MAY03-C614_1.pep
MSYRLGEAAGREEGDEEPFETASSVSSGDSDSDDEEEGDQFPGGGGGSVAGGEASCDHQDRRAFVPQPLRRMNSDSIYDMTSMMSQLPAKKGLSRYYEGKSQSFACMSEVRCLEDLRKKDNPYKQKIKSCKSYVALGGMMAKKQPASTSCVNLDLVAANGFRTPPIRNGYHQ

SEQ ID NO: 43141 - protein, 122 aa, Sorghum bicolor
  Clone ID: SORBI-28MAY03-C6182_1.pep
MADRKGGAARKEEVVTREYTINLHKRLHGCTFKKKAPNAVKEIRKFAQKAMGTTDVRIDVKLNKHIWSSGIRSVPRRVRVRIARKRNDEEDAKEELYSLVTVAEIPAEGLKGLGTKVIDEAD

SEQ ID NO: 43142 - protein, 131 aa, Sorghum bicolor
  Clone ID: SORBI-28MAY03-C61630_1.pep
RYDYEECESQSANKMMDHLKDVIANSKPGEKYGDYTLQFADDFSYTDPVDGSTVSKQGLRFVFTDGSRIIFRLSGTGSAGATIRLYIEQFESDISKHSLDAQTALKPLIDLALSVSKLKDFTGRDKPTVIT

SEQ ID NO: 43143 - protein, 152 aa, Sorghum bicolor
  Clone ID: SORBI-28MAY03-C62480_1.pep
MARYRSGLQGDLSSLDDSMEDSNGYLRFDVGGIEELENYFIFNDRHRGMRMDIDGMSYEELLALGERIGTVNTGLSDNALSTCLNRSLYMPTASGSHEDCERKCSICQEEYLAGEEVGKMACKHYYHLSCIQHWLRQKNWCPICKSVALKIN

SEQ ID NO: 43144 - protein, 94 aa, Sorghum bicolor
  Clone ID: SORBI-28MAY03-C59648_1.pep
ARRDACSPRRGPGGLAGLLPLRLPIFPVFPSPVGSSPGVVLGFVLPATFHLKVFGAEIGWTGLVADVAVIVIGTALAVSGTWTSLVQIFSSSNL

SEQ ID NO: 43145 - protein, 172 aa, Sorghum bicolor
  Clone ID: SORBI-28MAY03-C597_1.pep
MRAASSPLPAAVLAAPSAAAALVVKPLPRAAANGGGSTGRRDVVLAGTGLGAALVLALGPVCGAARAADDEYVSETKEVIGKVRSTISLDKSDPSVADAVAELRELSNSWVAKYRREKSLLGRPSFREMYSALNAVSGHYISFGPTAPIPAKRRARILEEMDTAEKALLRGR

SEQ ID NO: 43146 - protein, 276 aa, Sorghum bicolor
  Clone ID: SORBI-28MAY03-C5976_1.pep
GSAPINLSDRLNQVLRWALGSVEILLSRHCPIWYGYNGRLKLLERLAYINTIVYPITSIPLIAYCVLPAICLLTNKFIIPEISNYAGAFFILLFASIFATGILELRWSGVGIEDWWRNEQFWVIGGTSAHLFAVFQGLLKVLAGIDTNFTVTSKATDDDGDFAELYVFKWTSLLIPPTTVLVINLVGIVAGVSYAINSGYQSWGPLFGKLFFAIWVILHLYPFLKGLMGKQNRTPTIVIVWSILLASIFSLLWVKIDPFISPTQKAISRGQCGVNC

SEQ ID NO: 43147 - protein, 97 aa, Sorghum bicolor
  Clone ID: SORBI-28MAY03-C59921_1.pep
MATKPAQVLVAVVVLLLLCAATPRGADAATACDATQLTPCAGAIIGSSPPTAACCSRLKEQQPCLCTYARDPNLQRYVNSPNGKKAMAACKVPVPSC

SEQ ID NO: 43148 - protein, 258 aa, Sorghum bicolor
  Clone ID: SORBI-28MAY03-C59967_1.pep
MGIGAVSDELLGTFVPIAVYWLYSGLYVALDGVGRLDGYRLHTREEAATKNIVSKAAVVRGVLLQQVFQVAVSLTLFAVIGDESGTGQKQPPALVIALQFIAAMVVMDTWQYFMHRYMHINKFLYKHIHSKHHTLVVPYSFGALYNHPLEGLILDTIGGALSFLVSGMTPRTSIFFFSFATIKTVDDHCGLWLPGNILQALFSNNSAYHDIHHQLYGTKYNFSQPFFVMWDKILGTYMPYSIEQRKGGGVESKPAKLD

SEQ ID NO: 43149 - protein, 142 aa, Sorghum bicolor
  Clone ID: SORBI-28MAY03-C65084_1.pep
QMGSFSRLIGMIPGMNKVTPAQIREAEKNLKFMESMINVMTPEERERPELLAESRERRKRVAKDSGKTEQQVGQLVAQLFQMRAKMQKMMGAIQGKESPDMDELMESMKAEEQAAAGTGRRRRKYGNLRQRQLDAMRGFRRR

SEQ ID NO: 43150 - protein, 398 aa, Sorghum bicolor
  Clone ID: SORBI-28MAY03-C6490_1.pep
TAHGTRLHLLVLHHRRGGAPQEWAAARLLDVLTRRQDASEAHKLSSTNVDKVACLIIALYIELIQCVARGATLQAKTALERLASVQEQINKIAQERESAIREEFASHLEEKEEEIRKLVAKIREEESEESVLTERLLVAESKTHGHNKETAGLKDEIKELTSKLEFLRDRAVSYEKQARMLEQEKNHLQEKFLSECKKYDEAEQRYKSAERDVKKATELADAARTEAIASQKGKDEAQRLSMEKVAVIERVQRQVDRLEQEKVNLLGEVQRMRNSESDAWSKVTLLESRVAEREKEMDDLLSCSNEQRSSTLHVLESLLATERAARAEANKRAEALSIQLQSAQGKLDILHQELTSIRLVETALDSKLRTITYGKRFRDNEVRLDSIQDMDIDPPERS

SEQ ID NO: 43151 - protein, 142 aa, Sorghum bicolor
  Clone ID: SORBI-28MAY03-C66170_1.pep
THTNAHRPAYAPGSSNVTYLATPEPKAVADIQQGPRGKLYSPRSHLIRCQRCTELLPLVRRDPRGGSSLMIIYSRYQVESYSGRMLIRFGSIVARSFLISFAETRGEARENDRRSRRSQRRRRPALDARESGTSKEPTADRP

SEQ ID NO: 43152 - protein, 96 aa, Sorghum bicolor
  Clone ID: SORBI-28MAY03-C66596_1.pep
KFLLFLFWSKKLLSSQCLEAPGLITPVFLGLVSSKPASKAQPDLRSIIGLCLQIFFPAWTGALDLSRPGLELSFLGSFHSNRGTGLSNFHLTVALR

SEQ ID NO: 43153 - protein, 220 aa, Sorghum bicolor
  Clone ID: SORBI-28MAY03-C66722_1.pep
MASLTDLVNLDLSDCTDKIIAEYIWIGGSGIDLRSKARTVKGPITDPSQLPKWNYDGSSTGQAPGEDSEVILYPQAIFKDPFRKGDNILVMCDCYTPQGEPIPTNKRYNAAKVFSHPDVAAEVPWYGIEQEYTLLQKDVNWPLGWPVGGYPGPQGPYYCAAGADKAFGRDVVDAHYKACLYAGINISGINGEVMPGQWEFQVGPSVGISAGDEIWVARYI

SEQ ID NO: 43154 - protein, 113 aa, Sorghum bicolor
  Clone ID: SORBI-28MAY03-C67138_1.pep
AATKAYVDQFSRCLYVEYKSKGIDVQCQVPLYVATKMASIRKSSFLVPSADTYARAAVRHIGYEPRCTPYWPHSVLWFLISILPESLIDSVRLGMCIKIRKKGLAKDAKKKSL

SEQ ID NO: 43155 - protein, 95 aa, Sorghum bicolor
  Clone ID: SORBI-28MAY03-C67448_1.pep
SSSLATAYITQLQRRSLDPPPYVQFHYCCWAWPAAEEASAAAAAMSRSFGQGMRLCGGKQQSHCWGHRYGHSPTGGICPSLLEAAAGAVESSPRA

SEQ ID NO: 43156 - protein, 93 aa, Sorghum bicolor
  Clone ID: SORBI-28MAY03-C18279_1.pep
STVRDAMNVEEEVGKLKEEIQRLGQQQPDGSYKVKFGVLFNDDRCANIFEALVGTLRAAKKRKVLTYDGELLLQGVHDNVEITLLPPPAVAAA

SEQ ID NO: 43157 - protein, 108 aa, Sorghum bicolor
  Clone ID: SORBI-28MAY03-C18299_1.pep
MAPKKDKAPPPSSKPAKSGGGKQKKKKWSKGKQKEKVNNAVLFDQATYDKLLSEVPKYKQITPSVLSERLRINGSLARRAIKDLMARGLIRMIAVHSSQQIYTRATNT

SEQ ID NO: 43158 - protein, 101 aa, Sorghum bicolor
  Clone ID: SORBI-28MAY03-C68529_1.pep
MGDGVAFEAARKIIMHPLYAPRSSPWLDLKVFYIRVSNCVVDESAPDHLTLNHIPLSPDTVIEVNGQRSSMHTEFISSSLRRDRVDKRTEEATALISKWSP

SEQ ID NO: 43159 - protein, 214 aa, Sorghum bicolor
  Clone ID: SORBI-28MAY03-C68865_1.pep
KRFSYCLTPYFHNNGASSHLFVGAAASLSGGGGPVMSMAFVESPKDYPYSTFYYLPLVGITVGETKLAIPSTAFDLQEVEEGFWEGGVIIDSGSPFTSLVEDAYEPLMGELARQLNGSLVPPPGEDDGGMALCVARGDLDRVVPTLVLHFSGGADMALPPENYWAPLEKSTACMAIVRGYLQSIIGNFQQQNMHILFDVGGGRLSFQNADCSTI

SEQ ID NO: 43160 - protein, 274 aa, Sorghum bicolor
  Clone ID: SORBI-28MAY03-C69583_1.pep
MWTDSPLLRDAGAAVLTGVTAGVVLRFWEEVANRALLDQKLCRKLVHITVGLVYFLMWPLFSSDDAFAPFLAPLILVINIIKVTVIGLGLVKDEGMVNSMTRHGDHRELLKGPLYYACAITVTTIVFWRTSPISIAVICNLCAGDGVADIFGRRFGHVKLPHNPEKSYAGSIAMFLAGFIASVLFMCYFNIFGFVEKSWTMVAAFGVISLVAAVVESLPISTCLDDNLTVPVASVLFSALVFYSIGARNLCCMSGEDWRSISATVGMMFAGSSS

SEQ ID NO: 43161 - protein, 130 aa, Sorghum bicolor
  Clone ID: SORBI-28MAY03-C69699_1.pep
GLKLGSESAGITYKPHRNLGIAIFSLATLQVFALLLRPDKKNKYRLYWNIYHHSVGYSVIVLSAINIFKGLDILQPASGYKTAYIVILATLGGIALCLEAITWPIAIRKRRRNAADKAAVGNGNGWQQGA

SEQ ID NO: 43162 - protein, 116 aa, Sorghum bicolor
  Clone ID: SORBI-28MAY03-C69044_1.pep
IKRRSGYCPGARSRSLMLLFVFSCLLPDLCVGPWALPGLLRAAPPWALEVRRPDGSSAGRRSLHAVIVCCAPPFPSMTPMRVVGVTRFCSARLPGAPLECAGMLGAHGVCFLFGVY

SEQ ID NO: 43163 - protein, 205 aa, Sorghum bicolor
  Clone ID: SORBI-28MAY03-C69997_1.pep
MKQQQLCHYDDDGKDRRKKKSTEADAGSGRGCSSTTPSSEHRKNKKKEVQLQQVSPASSSRFLLNSSRLMMQPQLLAPPVELFAEPSASGAGSSSSSSEIGRGHVVAGDNTVVVRSCSTRTGQNQVVVLRVSLHCKGCAGKVKKHISKMEGVTSFDIDIATKKVTVVGDVTPLGVLNSISKVKSAQFWTDTRSYLSTPPRASATF

SEQ ID NO: 43164 - protein, 161 aa, Sorghum bicolor
  Clone ID: SORBI-28MAY03-C6311_1.pep
ALAQARAASEADGGIGSGKKRSRGGKRKREKKFAEQARAAKAEEAERSVFNFINSHLVSQDVPEVSTTKVRKGSSVETHGHAKKEDRRSLVAYDEEVKELRIRVEKLEEMKNRNRKDKAVFEAASRKLEETRKALADAEATHASATNAVTRKEKEKKWLKF

SEQ ID NO: 43165 - protein, 222 aa, Sorghum bicolor
  Clone ID: SORBI-28MAY03-C6368_1.pep
FGLGDCKAPKVLGDIFESIAGAIFLDSGCDTSVVWKVFQPLLDPMVTPDTLPMHPVRELQERCQQQAEGLEYKASRTGNVATVEVFVDGIQIGVAQNPQKKMAQKLAARNALVVLKEKETAAKKDTEKDGEKKNGSQFTRQTLNDICLRRQWPMPQYRCINEGGPAHAKRFVYAVRVNTSDRGWTDECIGEPMPSVKKAKDSAAVLLLELLNRNYCDKPDGK

SEQ ID NO: 43166 - protein, 333 aa, Sorghum bicolor
  unsure (1)..(333): unsure at all Xaa locations
  Clone ID: SORBI-28MAY03-C6377_1.pep
MANASKHLQPSSNAGNDRKYQGTLVASPAKAIAPKCVNRIMPSKQLILGGDSIGHVASFLIKVVALEAVRRVSKARCPFIWNSVQALQILVYPPFSWIQRWAPLRFLVQGIQKLSMPLLFLSVTTTVSELSSKRDDEPDNNTEHSETPSETNEVASTSGTSDAADGTXEIVQENSRVLLFRELEKQGITLPERFTEDELRRFYVAANGDFSSLLSSVKKTIRWRETFHILTLQELDKWSHLVFWHGFDTMLRPCLVIRLGLACSSIPPRDRPRFGQAVVSQIDHGVVNLTNEEDSRITVLLDCHGSSPFRFPMQMMRSFITVVQENYPNRLGV

SEQ ID NO: 43167 - protein, 76 aa, Sorghum bicolor
  Clone ID: SORBI-28MAY03-C64621_1.pep
ICVLDFIVRVLLYIRKDCIEVYMAGVLEFLPEGKACVLYSHGLMYLWQAVRVKHKKFISPFQHLPVGCVLVKPCCE

SEQ ID NO: 43168 - protein, 296 aa, Sorghum bicolor
  Clone ID: SORBI-28MAY03-C7113_1.pep
MLVRDTVEEVTKPNLSDLFPVLARLDLQGRRRRSAEFVARFYDFFDPIIARRIEARGGGGEKIDDDFLDVLLQLHSMGQLSLQTIKSFLLDLFAAGTDTNAITVEWTMAELLRHPAVMAKVRAELREALGSKPHPDESDVGRLPYLRAVVMESMRLHPPSPMLMPHLAMAGGAEVGGFEVPAGTKVIINLWAIMRDRATWAEPEAFVPERFVGASDAEFRGKDRLEFMPFGAGRRSCPGTPMATRVVTLLLASMLHAFEWRLPEGMQPGDVDVRDRFGTSLNMVTPLKAVPVPSQR

SEQ ID NO: 43169 - protein, 245 aa, Sorghum bicolor
  Clone ID: SORBI-28MAY03-C7120_1.pep
KSPKAAPRSPKAATHPTFATSVKKPIGAKKVGAKTGGLGVRKLTTKPNESLYEQKPEEPKPAVPALAASTTAKGGPSLHSRFEYVENVPSADLRTGGSGSRVTGHVAPPKSSDFFQEYGMGNGFQKKSSNASKTQIEETDEARKKFSNAKAISSSQFFGTQNREEKEAQLSLQKFAGSSSISSADLFGRNDVDNSNLDLSAADLINRISFQASQDLSSLKDIAGETGKKLTSLASNFISDLDRIL

SEQ ID NO: 43170 - protein, 244 aa, Sorghum bicolor
  Clone ID: SORBI-28MAY03-C71731_1.pep
MGTRQRVLAPWAVLLLTALQLAGASHVVVHRSLEAEAAAAPPSVPASIVSPLLRTGYHFQPPMNWINDPNAPMYYKGWYHLFYQYNPKGAVWGNIVWAHSISRDLINWIALEPAIYPSIPSDQYGCWSGSATMLQDGTPAILYTGINRPDINYQVQVLAFPKNASDPLLREWEKPAAYNPVAAPVGGINATQFRDPTTAWYADGHWRMLVGSVRDTPGMAIVYRSRDFRRWTKAKHPLHSALTG

SEQ ID NO: 43171 - protein, 243 aa, Sorghum bicolor
  Clone ID: SORBI-28MAY03-C71858_1.pep
MEGSTTTEGHVVGIPVSTRAYGIEEPDFPAEETPDRGEFPSSFQYSSHSHDATSSTTTTTTDRPTSNQQQQAASRKGDRIAQGIKEHVTLGPKLSETVKGKLSLATKILQAGGVEKMFRQWFSVDKNEKLLRASQCYLSTTAGPIAGMLFVSTARVAFRSDRSLAVPTPCGDSAGLRVPYKVTIPLRKVKAVRPSENKHRPEQKYVHLATNDGFEFWFMGFVTYNKSLHHLERAVAYAQQAAQ

SEQ ID NO: 43172 - protein, 179 aa, Sorghum bicolor
  Clone ID: SORBI-28MAY03-C733_1.pep
VVLRVHNERWEGVPFILKAGKALNSRKAEIRVQFKDAPGDIFRCKKQGRNEFVIRLQPSEAMYMKLTVKKPGLEMATEQSELDLSYGLRYNDVKIPEAYERLILDTIRGDQQHFVRRDELRAAWEIFTPLLHDIDGGKLKSVPYKPGTRGPQEADELSKRMGYVQTHGYIWVAPTLSNI

SEQ ID NO: 43173 - protein, 309 aa, Sorghum bicolor
  Clone ID: SORBI-28MAY03-C7331_1.pep
MASAAVLRNAGSRRLFSYPALRATAISGPAALPDAPAAAAAAPAQPPPMAGTLWARSMATFTRTKPHVNVGTIGHVDHGKTTLTAAITKVLAEAGKAKAVAFDEIDKAPEEKARGITIATAHVEYETANRHYAHVDCPGHADYVENMITGAAQMDGGILVVSAPDGPMPQTKEHILLAPLAGVPSLVCFLNKVDAVDDPELLELVEMELRELLTFYKFPGDEIPIIRGSALSALQGNNDEIGKNAILKLMDAVDEYIPDPVRQLDKPFLMPIEDVFSIQGRGTVVTGRVEQGTIKTGEDVEILGLTQSG

SEQ ID NO: 43174 - protein, 239 aa, Sorghum bicolor
  Clone ID: SORBI-28MAY03-C7338_1.pep
MAAAAWLCGLLWLLAHAAAVASAADGADGGWEPLIRMPTGKGGDAAARAVEEDDEVGTRWAVLVAGSSGYGNYRHQADVCHAYQILRKGGVKEENIVVFMYDDIAHNILNPRPGVIINHPKGENVYNGVPKDYTGDQVTTENFFAVLLGNKSAITGGSKKVIDSKPNDHIFIYYSDHGGPGVLGMPNLPYLYAGDFIKVLKKKHACNSYSKMVIYVEACESGSIFEGLMPEDLNIYVTT

SEQ ID NO: 43175 - protein, 241 aa, Sorghum bicolor
  Clone ID: SORBI-28MAY03-C6771_1.pep
GTPFAFFPQSTPHFTPPPSRPRRPTPATSAPHRPPPIVPRFVDQRTMEGSFQLNPNASPFIPGSLGSFAHKAPEKQGGPIIFAGSSSKGEPSGSSFDPSQHEENDMDEVALANMVFSMFPNVSADFIDELLKANDFDINLTVDMLHELNSQDMLPDDAEAINDLPDDAEATNDLHNGQGVPDADKAVVSKSSRKMNEDLQNEKSATSDVKSVHEEFSEINLLHNDLGLPDDDKSVGNSVAK

SEQ ID NO: 43176 - protein, 101 aa, Sorghum bicolor
  Clone ID: SORBI-28MAY03-C67803_1.pep
MGKSKKSKARGGGDDLLDSSDADSVGSSSTALSDLSISYATEHVNSQEFVLDKYIDALYEKRGSTREAALVKLVDAFESFMLHGLVENRYATLLSQFNNSI

SEQ ID NO: 43177 - protein, 194 aa, Sorghum bicolor
  Clone ID: SORBI-28MAY03-C67945_1.pep
MSFNDDEPIIPPSNSGPRPTPIVPGRVQLVSKNNNMAPLEENTQKVLLELTGGDSTSDRSGLDLVAVLDVSGSMQGEKIDKMKTAMKFVVKKLSSIDRLSIVTFMDTATRICPLRQVTDASQPELLGLIDALNPGGNTNITDGLQTGLKVLADRNLSSGRVVGVMLMSDGQQNRGGNAADVKIGNAPVYTFGFG

SEQ ID NO: 43178 - protein, 224 aa, Sorghum bicolor
  Clone ID: SORBI-28MAY03-C6797_1.pep
ARGGRGGFSGSNDERESTLNQLLVEMDGFGTTAGVVVLAGTNRPDILDKALLRPGRFDRQITIDKPDIKGRDQIFRIYLQKLKLDNEPSFYSQRLAALTPGFAGADIANVCNEAALIAARSEKTQITMQHFESAIDRIIGGLEKKNRVISKLERRTVAYHESGHAVAGWFLEHAEPLLKVTIVPRGTAALGFAQYVPNENLLMTKEQLFDMTCMTLGGRAAEEV

SEQ ID NO: 43179 - protein, 232 aa, Sorghum bicolor
  Clone ID: SORBI-28MAY03-C75_1.pep
MGRGKVQLKRIENKINRQVTFSKRRNGLLKKAHEISVLCDAEVAVIVFSPKGKLYEYATDSRMDKILERYERYSYAEKALISAESESEGNWCHEYRKLKAKIETIQKCHKHLMGEDLESLNPKELQQLEQQLESSLKHIRSRKSHLMAESISELQKKERSLQEENKALQKELAERQKAAASRQQQQGAVGPADTDPGPDKLIIVLLHDEAGSAGSAASTKHMLPAADNRRER

SEQ ID NO: 43180 - protein, 498 aa, Sorghum bicolor
  unsure (1)..(498): unsure at all Xaa locations
  Clone ID: SORBI-28MAY03-C7582_1.pep
AAYALAVTSSEATDLAGLLHLVKFYKSRRFDADIGMPRPNDFHDVPVYXCLEAIPHAVALVRSSDKNSPKGAIEFILQLLKYNDNNGNIYSDVYWLSAMVQAIGELEFGQQGMGFLSSLLKRXDRLLQFDNFMPGYNGVLTVSCIRTLARIARRVSSSVCLDRICDLIAPFRDMDKPWKVRIEASRVLIDLELHHKGLDAALLLFLKYVDEEKSLRGATKLAVHVLRICQASIVPYANDQINLTTLIGLLHLLAGTKAYNNVFLRHHVFCILQVAAGRSPTLFGVPKIVTSPPVVKDICSDQHTKADSSIPQPSKPQEPSTSTPSVREVLPTSGPTKDADNISNCSERRNVVKIRVKLTASSSKASDADHRGHSHGGRNENEPGPCSSMSVDAPMVGAANEPLNVSNHNIEEQNSCHDRESRMSASVSNAKLMDRHDINKELQCTADSRLDALPKDQFSPAVNPPEVLDKPGSQLEGVSTSYDGNQAPESVNGGEMKE

SEQ ID NO: 43181 - protein, 325 aa, Sorghum bicolor
  unsure (1)..(325): unsure at all Xaa locations
  Clone ID: SORBI-28MAY03-C7650_1.pep
MDEAAVDDLIRRLLEARGGRTPRNAQVTDADIRRLCAAAKDVFLQQPNLLELEAPIKICGDVHGQYSDLLRLFEYGGYPPDANYLFLGDYVDRGKQSIETICLLLAYKLKYPENFFLLRGNHECASINRIYGFFDECKRRFNVRIWKIFTECFNCLPVAALIDDKIFCMHGGXLSPELKNMDQIRNISRPVDVPDVGLLCDLLWSDPEKELDGWGENDRGVSYTFGADIVAEFLQKHDLDLICRAHQVVEDGYEFFANRQLVTIFSAPNYCGEFDNAGALMSIDDSLVCSFQILKPSEKKGKAGTSNMSKPGTPPRKIKISVTRI

SEQ ID NO: 43182 - protein, 68 aa, Sorghum bicolor
  Clone ID: SORBI-28MAY03-C7533_2.pep
YDIQILTSISTVDDLNYPEKTETYYVVNVPYIFSACWKVVKPLLQERTKKKVKVLTGCGRDELLKIWT

SEQ ID NO: 43183 - protein, 196 aa, Sorghum bicolor
  Clone ID: SORBI-28MAY03-C7533_1.pep
PAGPGILPRLTQQFRRPVTQCIKVLDMTGLKLSALSQIKILTSISTVDDLNYPEKTETYYVVNVPYIFSACWKVVKPLLQERTKKKVKVLTGCGRDELLKIMDYSALPHFCRHEGSGSSKHSSTDVDNCFSPDHPFHKELYDHIKEQASRRELIKMGSLHVSIPEPDPDDAKIVEVIQAEFQKIGEQDESPNGHKD

SEQ ID NO: 43184 - protein, 246 aa, Sorghum bicolor
  Clone ID: SORBI-28MAY03-C7676_1.pep
MAMGAAVRAAAADAVVTFLWVLCASALGASTAAVTSCLGVQEGAGGHYALLVTASLLAVLLFAFDRLCGALGGASFNPTDFAASYAAGLDSPSLFSVALRFPAQAAGAVGGALAISELMPAQYKHTLAGPSLKVDPHTGALAEGVLTFVVTLAVLWVIVKGPRNAILRILLISVSIVSLIVAGAPDTGPSMNPANAFGWAYVNNWHNTWEQLYVYWICPFIGALLAGWIFRAVFLPPAPKPKTKKA

SEQ ID NO: 43185 - protein, 196 aa, Sorghum bicolor
  Clone ID: SORBI-28MAY03-C7677_1.pep
MHPILAGIPQSLRPAVLIASTCALLLLATALLLPRAPPPPPPLLTTDASASASASASADADAVRLDARVARRNGNEVLWQLPRPSSPLRAALFAAPGCTIRATDFFDASPGCPRCTGLPEERRFTREALSRGYAVLAVSSRAKCWSLDDDDAAAGGGGGAGEDGSELAAVQSIIEWWTTEKYPQLAGLPLVGIGAS

SEQ ID NO: 43186 - protein, 192 aa, Sorghum bicolor
  unsure (1)..(192): unsure at all Xaa locations
  Clone ID: SORBI-28MAY03-C7024_1.pep
MAAANAGDVDVVDFDSDDDDLMDDDALEAYPASAPRLRSTIAASGDSSAAARKTKGRGFREEPSSSRPLAGRSDFDSLGSDYGPGPLRSIEGWIILVTGIHEEAQEDDLHNAFREFGQVKNLHLNLDRRTGFVKGYALVEYESXDEAQAAIKAMDGTELVTQIINVDWAFSSGPVKRRNVRWRSRSPVRRRY

SEQ ID NO: 43187 - protein, 161 aa, Sorghum bicolor
  Clone ID: SORBI-28MAY03-C70322_1.pep
MATPKLSPVSPVRRDDKPCAPSSSSSTVLRVQDASAAEAYEQYLRLPELSSLWKAGCFPEWAGEGLVKPALQALEVTFRFASLALSDPRGYASRRELARRLESLAAREVELVSALCEGDDRSAPLAELSASGGVLPRERSASEVWQLPGSAAAVVCHVSEA

SEQ ID NO: 43188 - protein, 127 aa, Sorghum bicolor
  Clone ID: SORBI-28MAY03-C71004_1.pep
MATLVISEQRSHQLHHSSGRRKKASSASPHFSSPQSTRGYHAGNCRAFHSGITIGILPSPPTQGVARTRSSPEPKTPKQQAHHGKKRSRAISISPSTSPPSRPELWAGPGFCNSPPPSSLPIPKFSL

SEQ ID NO: 43189 - protein, 157 aa, Sorghum bicolor
  Clone ID: SORBI-28MAY03-C71032_1.pep
NIPPAVNQVEVNPCCRQNKLRVFCREKGIQLCAYSPLGGKGAPWANNSVMNSPLLRQIALTKGKTVAQVCIRWVYEQGDCVIAKSFNEKRMRENLDIFEWQLTEDECRRISALPESRGTYDFFVHESGPYKTAQEFWDGEIVAGQANNDALSLDPTN

SEQ ID NO: 43190 - protein, 363 aa, Sorghum bicolor
  Clone ID: SORBI-28MAY03-C7874_1.pep
MGFDDKGSLSSSEIYRKMSYEVIDMERGKLEPKEKVCEEPEKGIYFMKLDETNITTQKGAKDKRKETFAEGNAQEECKYYSTSGGCKFGKACKYLHREGKEAKTEVEKAELNFLGLPLRPGEKECPYYMRTGSCKFATNCLFLRPDPTNASSKEPGLEHENADTPLQNVQGSCQPSLQIWPDHRTLNEQHVPFLAPAQSYGGGMVPPQGMYPSPDWSGYHQVPLNPYYPPGVPFPHFPAAHMNHPMYKAADVPGNQPPPSDEYPERPGQPECQHFIKSGFCKYRMKCRFHHPRSGQSAPLTGLSPIGLPIKPDQPVCTYYGRYGFCKYGPACMFNHPFNFGPPVPAAGPPLPGQYPTPGNFTV

SEQ ID NO: 43191 - protein, 111 aa, Sorghum bicolor
  Clone ID: SORBI-28MAY03-C797_1.pep
MMTRKVAGGEAEEMKRRNAELERAVAEAAAREERLRRELEAALARLAVAEEAEERLCVQLGELEAEAVEQAIEYQERVRALSERLAFADGVLRSSGIRGFAAAGASTSRMD

SEQ ID NO: 43192 - protein, 145 aa, Sorghum bicolor
  Clone ID: SORBI-28MAY03-C8116_1.pep
MLIWLKGLAASSGGRVGYTSSGRLSFSLRSFFRSLMSSSSPSSSSEKGTSRASSNAFLIAPQSSSDSSEVCTKHESAQAASSGESSTTFLFDLMASIIAGNISSDSEASSCSSFRLGSDRRAKMSPSSEVMVKQGTQYYLNEKVA

SEQ ID NO: 43193 - protein, 190 aa, Sorghum bicolor
  Clone ID: SORBI-28MAY03-C8118_1.pep
MEPMNVDNGGCGGLDAQIEQLMQCRPLAEQEVKALCEKAKEILMEESNVQPVKSPVTICGDIHGQFHDLVELFRIGGKCPDTNYLFMGDYVDRGYYSVETVTLLVALKVRYPHRITILRGNHESRQITQVFGFYGECLLRYGNANVWKTFTVLFVFVPRTALVESEIFCLHGGLSPSLVILLSLRRLDRV

SEQ ID NO: 43194 - protein, 127 aa, Sorghum bicolor
  Clone ID: SORBI-28MAY03-C81565_1.pep
CIGDGSFQVTAQDVSTMLRCGQKSIIFLINNGGYTIEVEIHDGPYNVIKNWDYTGLINAIHNGDGNCWTMKVRTEAELKEAIATATGAKKDCLCFIEVIVHKDDTSKELLEWGSRVSAANSRPPNPQ

SEQ ID NO: 43195 - protein, 163 aa, Sorghum bicolor
  Clone ID: SORBI-28MAY03-C8206_1.pep
AGRPGEAAPSNSFLSSREGKSARGAQRRARERVTSSSSRVSRSAAMATRAAARFLQRRLLSSGGKVLSEEEKAAENVYIKKMEQEKLEKLARKGPSSGQQASSTTGSAANDVKVGAGPTESASASVSSDKNRNYAVLAGTVAALSGLGWYLLSKPKKSEEVVD

SEQ ID NO: 43196 - protein, 224 aa, Sorghum bicolor
  Clone ID: SORBI-28MAY03-C8222_1.pep
ARGGTRISFFTDLLVVGENRQTFDLEGDSGSLIILTGQDSEKPRPIGIIWGGTANRGRLKLRCDHGPENWTSGVDLGRLLDRLELDLIITSESLKDAVQQQRLAMVAAANSAVGESSTAAVPVPEEKVEELYEPLGIKIEQLPRHDVSASGTEGEEAAVVNVEERQFISNFVGMSPVRGDQDAPRQIANLNNPSEEELAMSLHLGDREPKRLRTDTESDLDLEK

SEQ ID NO: 43197 - protein, 215 aa, Sorghum bicolor
  Clone ID: SORBI-28MAY03-C73606_1.pep
MAQARVRLTPAAYTPAAAFLSGSNPRPAHLTFFPKLTPTSISATAAANAPPPHIVVVGSANADIYVEVDRLPLIGETVAARAGRSLAGGKGANQAACGGRLALGPTYLVARVGDDANGRLLEGALADAGGVRTDRVARAADAPSGHAVVMLMPDGQNSIIIVGGANMEGWAAGIGPEDLELIRKAGVLLLQREIPDWVNAQAAQAAKSAGVPVIM

SEQ ID NO: 43198 - protein, 78 aa, Sorghum bicolor
  Clone ID: SORBI-28MAY03-C7378_1.pep
RRGAARALLGGLVHIGLGDPVVNKCCPVLEGLVELEAAVCLCTTIKLKLLNINLYLPLALQLLLTCGKTPPPGYTCTI

SEQ ID NO: 43199 - protein, 75 aa, Sorghum bicolor
  Clone ID: SORBI-28MAY03-C7310_1.pep
MDEEMDEDVVFRNITGTSSTPQAISLLCSQSQPCSGVSLIDVNVEYAGKNNKTMAVCSNAKGTAKGSVEALACLA

SEQ ID NO: 43200 - protein, 107 aa, Sorghum bicolor
  Clone ID: LIB3476-032-P1-K1-B7.pep
LSIWRGIQEIMDEEMDEDVVVKAVDCSNQSEVDIKLKQFIKGYSDGSKGGDGHLLMLKLKEWPRPSVLEAFLLCQRPEFIVNFPLGDFIHPRWGLLNLAAKLPPNAL

SEQ ID NO: 43201 - protein, 186 aa, Sorghum bicolor
  Clone ID: SORBI-28MAY03-C7402_1.pep
MAALKASFRGELSAVSFLDSSRGPFVQHKVDFTFQRKGKRAISLRRTCCSMQQAPPPAWPGRAVAEPDRRSWDGPKPISIVGSTGSIGTQTLDIVAENPDKFRVVALAAGSNVTLLADQVKTFKPKLVAVRNEALVDELKEALADCEEKPEIIPGEQGVIEVARHPDAVTVVTGIVGCAGLKPTVA

SEQ ID NO: 43202 - protein, 143 aa, Sorghum bicolor
  Clone ID: SORBI-28MAY03-C86063_1.pep
MGGRRSRGGGASGLLVWAVAIAAAAAVSQAQLQVGFYDTLCPAAEIIVQEEVSKAASGNPGVAAGLLRLHFHDCFVRGCDGSVLLDSTAGNQAEKDAAPNASLRGFEVIDSAKTRLEQACFGVVSCADILAFAARDALALVGG

SEQ ID NO: 43203 - protein, 211 aa, Sorghum bicolor
  Clone ID: SORBI-28MAY03-C8138_2.pep
MSNKLGNMFSALCLDAEDDRVEVPQAPPSTDETAPSKPDKNEQNDTTAVKYEEAALVSSSGDYRMPLVWIDLEMTGLDITKDRILEIACIITDGKLTKQIEGPDLVIGQSKDCLDNMGEWCKTHHAASGLTERVLQSELSEHDAEAKVLDFVRKHINSGTPLLAGNSVYVDLLFLKKYMPQLAAVFSHVIVDVSSIMALCVRWYPKERKQT

SEQ ID NO: 43204 - protein, 179 aa, Sorghum bicolor
  unsure (1)..(179): unsure at all Xaa locations
  Clone ID: SORBI-28MAY03-C8138_1.pep
PXPPLGFFFFLLIGYGWLIRIKQRIHVSDMAQPITVALTHRRATPRPRFAIPQSPDRGSAAATLLDARPTPAGRWRRSCSPATSTAPAHPRSHLWSLRGRACSSATAEAARLRRPAARATPARRLPAAGTVPARRRRARPLLSRGAALLWSAAEPPCSACSSSSDLNIDFHNFIFLFYF

SEQ ID NO: 43205 - protein, 85 aa, Sorghum bicolor
  Clone ID: SORBI-28MAY03-C862_1.pep
YICCILPFVVQSTLFFFYFAHFSTLAAFIFCTVHASPSAGFNLCCACLNDLQPFRITSLSPLKANGPIKIQVMFHTSFSKNGPDP

SEQ ID NO: 43206 - protein, 252 aa, Sorghum bicolor
  Clone ID: SORBI-28MAY03-C8863_1.pep
PSAEEALADPYFKNIANVDREPSAQAVTKLEFEFERRRVTKEDIRELIYREILEYHPKMLREFLEGTESSGFMYPSAVDHFKKQFAYLEEHYAKGSTGTPPERQHNSLPRPSVVYSDNRSQTTANITEDLSKCIIRENTQKPHQHSAYVASKFPPHVPQGVVARPGKAVGSVMQYNPYPASAAEQYEQRRIARHPAVAPNNIPSGSSYPRRSQTCKSETGDAERMDVNQAGQPKPYAANKLPATVDGRGGHW

SEQ ID NO: 43207 - protein, 161 aa, Sorghum bicolor
  Clone ID: SORBI-28MAY03-C8873_1.pep
GRLLEVSLHRFIKHQLWRQRRRFQSPVLCALRSPHRGNRLVRVRGAEAMAAAKVKSVALSVTHKCRNILAAGWEAHLNTVKADAKGSNSEIYSSRVHYMIQKGTPYLIVPENDMHNINIIIDERGSLAVCSPIRGRVAGLLKSLKKTPPRVAMTGDVLRLK

SEQ ID NO: 43208 - protein, 314 aa, Sorghum bicolor
  Clone ID: SORBI-28MAY03-C8816_1.pep
MTAGQPLRTEPAAQPPRVYHSTPPPPPPPALQADIVPSYPPPESDGDESWVWSQIKAEARRDADAEPALASFLYATVLSHPSLDRSLAFHLANKLCSSTLLSTLLYDLFVATLAAHPSLRAAAAADLLAARSRDPACAGFSHCLLNYKGFLAIQAHRVAHVLWAQHRRPLALALQSRVADVFAVDIHPAAIVGKGILLDHATGVVIGETAVVGDNVSILHHVTLGGTGKAVGDRHPKIGDGVLIGAGATILGNVRIGAGAKVGAGSVVLIDVPPRSTAVGNPARLIGGKKGEDVMPGESMDHTSFIQQWSDYII

SEQ ID NO: 43209 - protein, 128 aa, Sorghum bicolor
  Clone ID: SORBI-28MAY03-C88948_1.pep
MGIASSSSSNPESRAMALAKAKEIVASAPLVVFSKTSCPFCVRVKQLFEKLGASYKAIELDVESDGPELQNALKEWTGQRTVPNVFINGKHIGGCDDTMALNNDGKLVPLLTEAGAIAGSTSKTTVTA

SEQ ID NO: 43210 - protein, 180 aa, Sorghum bicolor
  Clone ID: SORBI-28MAY03-C77224_1.pep
VQAVGGPAMAFDFTTKGLLQAGVQGELWRLRDSSGKAAGMIGWMPEKAVTFVDNHDTGSTQKLWPFPSDKVMQGYAYILTHPGVPCIFYDHMFDWNLKQEISTLSAIRARNGIHAGSKLRILVADADAYVAVVDEKVMVKIGTRYDVSNVIPSDFHPAAHGKDYCVWEKGSLRVPAGRHL

SEQ ID NO: 43211 - protein, 130 aa, Sorghum bicolor
  Clone ID: SORBI-28MAY03-C7807_1.pep
MAGRANIPTNNSALIAIIADEDTVTGFLLAGVGNVDLRKKTNYLIVDNKTTVKQIEDAFKEFTAREDIAIVLISQYVANMIRFLVDGYNKPVPAILEIPSKDHPYDPAHDSVLSRVKYLFSAESVASDRR

SEQ ID NO: 43212 - protein, 232 aa, Sorghum bicolor
  Clone ID: SORBI-28MAY03-C7830_1.pep
TREERDSVSASESSGSESDEDLIFGDSSVDNEVVADYMEGVGGSDELLSSKWITGMNLGDADTVEQMYTDDDDDNDRFVKKGKEKLEGYALMTASEQYGMKRPSSVEKGNGKRMVCKRDLPSMQAMGLEDMFMVKNVWMPNRSMKGSKTGSSSSQLSRSWPNNEGRKSKKYQSRPGEKKQHRKELIAKKRQQRMLSRGVDLGQINTKLRQMVVDQVDMLCFHPMHSRDCSQR

SEQ ID NO: 43213 - protein, 209 aa, Sorghum bicolor
  Clone ID: SORBI-28MAY03-C7870_1.pep
ARGLFSAARVWWMFRVFGHDKIWVLDGGLPQWRASGYDVESSASSDAILKASAAGEAIEKVYLGQSVGRTTFEAKLQPHLLWSLDQVKENIKTQTHQLIDARSKPRFDGAVPEPRKGIRSGHVPGSKCVPFPQVLDSSQKLLPPDELRKRFEQEGISLDQPLVTSCGTGVTACVLALGLHRLGKTEVAIYDGSWTEWGAHPDTPVATAV

SEQ ID NO: 43214 - protein, 178 aa, Sorghum bicolor
  Clone ID: SORBI-28MAY03-C90947_1.pep
HEGNRELYINLLIKNIFVDSISSQLTHFTEGFADILVNPKRREEFFECLDLEDLDRLLGGNNNAINLQDWKSHTQYNGYKEKDRQITLFWKAVERMSLERQRQLLFFWTSVKYLPSDGFCGLSSKLYIYKTSDSPDRLPSSQTCFYRLCLPPYTSLKMMENQLQKITQEHVSCSFGTW

SEQ ID NO: 43215 - protein, 216 aa, Sorghum bicolor
  unsure (1)..(216): unsure at all Xaa locations
  Clone ID: SORBI-28MAY03-C9119_1.pep
MSSKEKPTLGGTRIKTRKRNIAAPLDPASFSDAIVQIYLDNGGDLELVAKSIESSDLNFSRYGDTFFEVVFVGGRTQPGTIKPEEGDRHPYSVLDCAAQRETILPFVLYIQKTLRRRPFLIKNLENVMRKFLQSLEFFEENERKKLAIFTALAFSQKLSGLPPETVFQPLLKDNLVAKGIVLSFITEFFKEYLKENSLDXLIALLKKGKMEDNLLD

SEQ ID NO: 43216 - protein, 274 aa, Sorghum bicolor
  Clone ID: SORBI-28MAY03-C9125_1.pep
VFEASLRATLARIGTNFSVSGFGSSLDKSPAAAIDENADLPLAGRAALDIAAIRLSDLPDKSKKLLTVLEQSKDPRFHALPLTSQRVAAFSDTVNELVYDVLISKVRQRLSEVARLPIWSSVEEQGGLPLPSFSAYPQAYVTSVGEYLLTLPQQLEPLAEGISGNEAGNDEAQFFATEWIFKVAEGATALFMEQLRGIHYITDRGSQQLAADIEYLNNVLSALSMPIPPFLSTFHACVSTPRDQVRDLIKSDGGSQLDLPTAHLVCKIRRITLD

SEQ ID NO: 43217 - protein, 317 aa, Sorghum bicolor
  Clone ID: SORBI-28MAY03-C920_1.pep
MAATATATAMAIATISPSAPIPSAPFPSLPLRLRSQPLLAASRRLLLPVPKASSWDESVAEEGGDTEESAAAGDEEDEDEKPRPEPVSSSEFQFAAPPEGYVEPAAFDELPPESPEDVAAAYESLYGPAFSGESLLGNNVYEVKVVDPIDMDREQRPNDDFTERVVQVNRVTKVVKGGRQLSYRAIVVVGDMKGHVGVGVGKAKEVTEAITKAAMNGRRNLVTVPLTKYSTFPHRADADYGAARVMLRPACPGSGVIAGGAVRVVLEMAGVENALGKQLRSKNPLNNARATIKATQMMKQFKDVAEERGVPMEELWK

SEQ ID NO: 43218 - protein, 371 aa, Sorghum bicolor
  Clone ID: SORBI-28MAY03-C9344_1.pep
GGGHLVYLEIRDSKLVEVKHAQLEHEISCLDLNPIGENPQYSSLAAVGMWTDISVRIFSLPDLELIRKENLGGEIVPRSVLLCTLEEVSYLLCALGDGNLFSFLLNASTGELTDRKKVTLGTQPISLRTFSSKGTTHVFASSDRPTVIYSSNKKLLYSNVNLKEVNHMCPFNTAAFPDSLAIAKEGELSIGTIDDIQKLHIRTIPLNEQARRICHQEQSKTLAFCSFKYNQSVEESETHLIRLLDHQTFESLCVYPLDQYEFGFKIIRLHLADDFSVKVNDVGRYVILLEIMYLNLIINSHAVEDGSLQLIVEKETKGAVYSLNAFNGKLLAAINQKIQLYKWMSREDGSHELQSECGHHGHILALYTQTR

SEQ ID NO: 43219 - protein, 232 aa, Sorghum bicolor
  unsure (1)..(232): unsure at all Xaa locations
  Clone ID: SORBI-28MAY03-C9251_1.pep
SFDEAPWPTLTAEAKDFVKRLLNKDYRKRMXVIEELASVWDHXADNLKGMLDMIIYKVMRAYIQSFVRQELGLSPLVTTLTVNQHFYVREQFELLGPNKNGYISLQNLKSALVKNSTDAMKDSRVVDFVNTAGALPYRKLDFEEFAASAISVYQMEALETWEQHARRAYDLFDKEGNRPIVIEELASELGLGPSVPVHVVLQDWIRHADGKLSFLGFIKLLHGVSSRFIPKA

SEQ ID NO: 43220 - protein, 106 aa, Sorghum bicolor
  Clone ID: SORBI-28MAY03-C9356_1.pep
LQGEMEHDYDIGTTIRDKIIPHAVSWFTGEAVQGDDFADLGDDDEDDDEDDDDEEDEEDEDEDEDDEEDDEEESKPARKSGSGRKHKGPQKVSQGNAEQPAECKQQ

SEQ ID NO: 43221 - protein, 165 aa, Sorghum bicolor
  Clone ID: SORBI-28MAY03-C82379_1.pep
MALAEGNNGAVVFSEEQEALVLKSWAVMKKDSANLGLRFFLKVFEIAPSAKQMFSFLRDSDVPLEKNPKLKTHAMSVFVMTCEAAAQLRKAGKVTVRETTLKRLGATHLKYGVADAHGRVARCARLHALEAARPALVGRRRRWPPWGEASCHRAAALKQEMKPDA

SEQ ID NO: 43222 - protein, 144 aa, Sorghum bicolor
  Clone ID: SORBI-28MAY03-C8268_1.pep
KNKQKVDGASVGAGTSAPSSSADIPKSDPSSSIGAKLVAAQPVSIRATDLMEATVPCWDDVDVPNTKVAAGQHSKRKSIGYILDEWDEEYDKGKTKKVRKSKQDFGGPNPFQEEADYISERRMKQKSYQGKSWNKPNTIEELRI

SEQ ID NO: 43223 - protein, 437 aa, Sorghum bicolor
  Clone ID: SORBI-28MAY03-C82794_1.pep
GGFGKKDWTGKKNQGSELYGWLARAEDYNSPGIIADYLRKNGDLKSVNDLAKEGARKTDRLVANLANQIEVKNRYLQELESKYSEATASLEKMMGQREQLLQSYNEEISKMQQLARRHSQKVSAGNQELRSELEAKMNDLDVRSKQLDELAAKSDYDRRNLEQEKQKNAIKSSHLKLATLEQQKADENVLKLVEEQKREKHAALKKILMLEQQLDAKQKLELEIQQLKGKLKVMEHMPGNEDSASKNKINELSEALQEKIDELDGLEALNQTLVIKESKSNIELQEARKELENGLLDLSGGQAHIGIKRMGELDLKAFSKACQKERTEDAEVTAAFLCSKWEAEIKNPDWHPFRVVTVDGKEMEIIEDDAKLRALKEEHGEEIYALVTKALLEINEYKSKGSYPVGELWNFKENRKVTLKEAVQFVLRQWRTNRRKR

SEQ ID NO: 43224 - protein, 179 aa, Sorghum bicolor
  Clone ID: SORBI-28MAY03-C8322_1.pep
MIGKIIGDITGSNKHAQLKGNVVLVRKTVLGLDVTSIAGSLLDGVGEFLGRGVTCQLISSTVVDPNNGNRGKVGAEASLEKWLLNPPPLLSGENKFHVTFDWEVEKQGIPGAIIVKNNHASEFFLKTITLDDVPGHGTVVFVANSWIYPQSKYRYNRVFFSNDTYLPSQMPAALKPYRD

SEQ ID NO: 43225 - protein, 271 aa, Sorghum bicolor
  Clone ID: SORBI-28MAY03-C96108_1.pep
HEDYNAGCKTAMSNVVMSVAVMVTLLFLTPLFHYTPLVVLSAIIISAMLGLIDYQAAIHLWQVDKVDFCVCVGAYLGVVFGSVEVGLVVAVSISLLRVLLFIARPRTTVLGNIPNSMVYRRMDQYAAAQTVPGVLVLRVDAPIYFANASYLRERISRWIDDEEERTKGKGEMGVQYVVLDMGAVGSIDTSGTSMLDELKKSLDRRGVQIVLANPGSEIMKKLDSSKVLEQIGHDWIFPTVGEAVASCGYALHSHKPAGVLKDSAAARESMV

SEQ ID NO: 43226 - protein, 203 aa, Sorghum bicolor
  Clone ID: SORBI-28MAY03-C9463_1.pep
MESEADRAAAPAPAPAVAAETSDDAIQEESPATAPSSDGKPGSGAAPELEVQLFRRGRPVAVFRSQLGGYTQDQLEVGDILEQHGLKSVFAFDPAARKRGVAIRFNPRNGRSLLTYAPGSTIFLDGEPKDSLLKPITKMVIGVAAMTVVAAVLLKEAKMPEWLQSSKLGTVSFPPWVLACMVIVFLRLRKRTKDVMKKFGWVS

SEQ ID NO: 43227 - protein, 514 aa, Sorghum bicolor
  Clone ID: SORBI-28MAY03-C9629_1.pep
MWSRSPSPDVEYKEDEEKVTREAEAQYDEDIERRSTAEEEAGIDMSDDDEHSSGGEKVESGPAYDLAPVADDCMDHSEARGITVHDHSGGEAASDAQRSPKAVSERELAVVPSDQDAGPVKRSPEPSEQEFIGMVDHSLEHSSDDRKETASESDQSYEIVFDDKRRPHPPETGFVGTRDHSHELISDVWKEIVSRNDQPRLAAHADEEGLDTTDRSNGLVSYQKKVTFSTTNDQAYAAFSDEKSVPETPEQEFSLTDRRNGVVPDAKNISETKEDEEQDSANDDLDNAARQAYISVTGKAKVYDEDGEDPEAKWKDLTDEEEDELESLWEHQDLIEQLKLELKKVRSIGLPTILEESETPKAPMEDLKPWRIDAKFLREDPMDELNKFYKSYRERMRKFDILCYQKMYAIDFLQLRGPQQSSNSLKSLSPTVASILSHNFRSSRRRSPEDPSERFLKELRYDLETVYVGQMCLSWEFLRWQYEQARDLPESDSYHSHQYNVVAGEFQQFQVVVQ

SEQ ID NO: 43228 - protein, 193 aa, Sorghum bicolor
  Clone ID: SORBI-28MAY03-C96783_1.pep
TGSQSTRPLLPLHASQRICTSSSSSCQIAVPPLPKSRRSNTASTAPRGKQSKANHRRERRTGTETRPFVRFSPELARSLMDAAALQASSSPSSPSSPSKLRDKLRTTVCCCFGAGGGGAERTRWRRRGAAAGEFRYDALSYALNFDEGEDDDAYADPAAAFRYRNFNARLPPSPAAAAAVGTQRPRATAIAIA

SEQ ID NO: 43229 - protein, 295 aa, Sorghum bicolor
  Clone ID: SORBI-28MAY03-C97180_1.pep
MDGGGQPPDTEMTDAGAGGGGQQPPPAQQQPQQAAGGGGMMENIQATLSHGGRFIQYNIFGNVFEVTAKYKPPILPIGKGAYGIVCSALNSETAEQVAIKKIANAFDNKIDAKRTLREIKLLRHMDHENIVAIRDIIPPPQREAFNDVYIAYELMDTDLHQIIRSNQALSEEHCQYFLYQILRGLKYIHSANVLHRDLKPSNLLLNANCDLKICDFGLARTTSETDFMTEYVVTRWYRAPELLLNSSEYTAAIDVWSVGCIFMELMDRKPLFPGRDHVHQLRLLMELIGTPNEAD

SEQ ID NO: 43230 - protein, 183 aa, Sorghum bicolor
  Clone ID: SORBI-28MAY03-C9727_1.pep
MSVASVAALRTAASGSGRCHGAGSPQVGLNGGRFLMMQRRELVTKAGIALAVSCSMATSPAPANGSAQGLEVLPFKADGYNFWTWRGRRIHYVEQGAGQPIVLIHGFGASAFHWRYNIPELAKKYKVYAIDLLGFGWSEKALVDYEATIWMEQVSDFLREIVKEPAVLVGNSLGGFTTLFTAT

SEQ ID NO: 43231 - protein, 251 aa, Sorghum bicolor
  Clone ID: SORBI-28MAY03-C9646_1.pep
ARGISTSTPTTVDATMVGNRTWFGGLFNGSGKRRQVSAEKIVLDLTPLQEQRLQNLKERLNIPYDENRHEHQESLRALWKISFPDTELTSFVSAQWKEMGWQGMNPATDFRGCGYVSLENLLFFARTYPQASFKRLMLKQQGTRATWEYPFAVAGVNISYMLIQLLELNSVRPKSLPGINFIKVLTEHEDAFDVLYCIAFEMMDAQWLAMRASYMQFKEVLEATKQQLERELSLEDLNGIHDLPACNLLYK

SEQ ID NO: 43232 - protein, 75 aa, Sorghum bicolor
  Clone ID: LIB3480-011-P1-K1-G8.pep
ESLRALWKISFPDTELTSFVSAQWKEMGWQGMNPATDFRGCGYVSLENLLFFARTYPASFKRLMLKQQGTRATWE

SEQ ID NO: 43233 - protein, 291 aa, Sorghum bicolor
  unsure (1)..(291): unsure at all Xaa locations
  Clone ID: SORBI-28MAY03-C8730_1.pep
RRRWKGAAAAAAPRPRSRGGGGXAPGGRRRSVGVSVRRRVQVDATTTAPAPLQSLLAACRRAFGGPGTVPAPDDVALIRDILDKMGPEDVHLRAVTKAAAAASFPRTHPNPIITRTTIYKCKNFSIVIFLRPXHPGMTVFSKLLLGSLHVTSYDWLVDAGGGPPAVVGGGGNDRLLRLAKRVVDADLSAPCDALVLFPESGGNMHRFAAATACAVLDVLGPPYSGDRDCTYYQDLPYRHHHHDNDDADEAAGDGDVPATATDGERLGWLLETRKPKELQMYEVPYRGPPIL

SEQ ID NO: 43234 - protein, 148 aa, Sorghum bicolor
  Clone ID: LIB3476-053-P1-K1-C10.pep
ERAAARGKQTLERRRRGRRRVHLHAPPHAHADAPSPATRCIPPPPLDRGLGAAAAAPFHRRLHQHVRSYKPPPAEQTEASSRNRSRSRSRSAFSSKIYKSGLAVGFKLTAETVSLFRPQIPWRRRKACKNRGAAGNEQEHAWGAEPAR

SEQ ID NO: 43235 - protein, 182 aa, Sorghum bicolor
  unsure (1)..(182): unsure at all Xaa locations
  Clone ID: SORBI-28MAY03-C8993_1.pep
MDFELRQAREKLEREQRERMQRAKAKAERERRAKAEAARRREALEASHRERRLDAARAQEEADQKMEEVMQLGKGVSFSHMFEALRYDGPGDKIKLPPSSFKELSDEGALDKGPMYFRLSKVRDTVPGTSMEQDADATCCGVLEFTAGEGSAELPLHVWNNLFRXDTPEVPLIEVKYFSLPK

SEQ ID NO: 43236 - protein, 307 aa, Sorghum bicolor
  Clone ID: SORBI-28MAY03-C89_1.pep
MASEVEDARRPPGTSRLEGSCLVGKGMASEVEDDAAAAGAPLVANGAADVRRRRDQAKAILSKQAVKIATKAEQHDSFIFKVTHLLGVLGFGGFCYLLGARPQDVPYVYCLFYIIFVPLRWIYYRYKKWHYYLLDFCYYANTFLLVMILFYPKDEKLFMVCFSFAEGPLAWALIVWRCSLVFSSFDKLVSVLIHLLPGIVLFTIRRKEIEQHNPTELDTTKCARMKKVHWVPPPSTLPKERNPGVRKLKPDVRLDFAGYWCQPLFLLSVLCVVFLYSAQVVISISLGVMIMGLGNRCVPMLVRLGPR

SEQ ID NO: 43237 - protein, 112 aa, Sorghum bicolor
  Clone ID: SORBI-28MAY03-C9092_1.pep
HEALFCSLPSSPPLSTPVVHPHRDRRQHRPPAGRSGGRRTPLPPPLPPPLSLFPRRQKGRRGCGRRRGCDPCGWHVGAARVPWPLSSPPSFDMGCSMPPPTGERLLLGLLKP

SEQ ID NO: 43238 - protein, 215 aa, Sorghum bicolor
  Clone ID: SORBI-28MAY03-C10306_1.pep
QPNQEIAMLSPAHLAFAAAFLLVFRSSAPAAAARPIFDGKPSPSEATATARWLAAQNTWGVLSTISSDLSGAPFGNVVSYSDGVPGEGRGIPYFYLTTLDPTARDALEDERTSFTLSEFPLGTCGKIDPENPTCAKLTLNGKLKMVDLQSSEADLAKLALFTKHAEMKDWPKNHHFKIFKLEIENIFLIDWFGGPKPISPSQYLEFGRNQSVMSS

SEQ ID NO: 43239 - protein, 483 aa, Sorghum bicolor
  Clone ID: SORBI-28MAY03-C10468_1.pep
MENSEGPSPDSGDRTAPVQDVDAQTTPGYNSRRPNLSLQIPARTLDTSVQTSTRVTISPSPSSTRVGLPPRPNSTRTKSSIKNINPQNSFRARSSAQEGDRVVLLNPGTSSEGQQDNPTTARSFSFRKVISSLSAKRTHSLPVTPVGTTDKTASPANQLDTLPTTSTEGVEAKIRRSLSVPGNRKNRSLRRADSIGVIRVIPTTPRPVPVDATTSNDVIEETIDVPENGGEDIPEEEAVCRICFIELNEGGETLKMECSCKGELALAHQDCAVKWFSIKGNKICDVCKQEVQNLPVTLLRIPTQTANRRVANAAQQRAAQQYRFWQDIPILVMVSMLAYFCFLEQLLVTNLQSRALAISLPFSCVLGLLSSMIASTMVSKSYLWAYASFQFAIVILFAHIFYNVLRVNPVLAVLLSSFTGFGIAISTNSLLVEYLRWRARRNHRLAQQAANAAQHQESGNDGANDNDGARQQGRDANSGNNAV

SEQ ID NO: 43240 - protein, 244 aa, Sorghum bicolor
  unsure (1)..(244): unsure at all Xaa locations
  Clone ID: SORBI-28MAY03-C10125_1.pep
MAAESENGNCNAWAARDPSGVLSPYKFNRRAVQSSDVALKIIYCGVCYADVGWTRNMHHDSKYPVVPGHEIAGVVTQVGADVKXFKVGDXVGVGNIXVSSCRGGENCNLSLENHCPKGVYTFNGIDTDGTVTKGGYSTHIVVHERYCFQIPDGYPLAKAAPLLCAGITVYTPMMRHNMYQPGKSLGVIGLGGLGHMAVKFGKAFGLKVTVLSTSESKRDEAITLLGADNFVISSDTQQMESLKN

SEQ ID NO: 43241 - protein, 240 aa, Sorghum bicolor
  Clone ID: SORBI-28MAY03-C10623_1.pep
YGFLCADQNKRALLDWPKLLAIIEGIAHGLNYLHMHSRLRVIHRDLKPSNILLDHEMNPKISDFGLAKIFSSYNVEGNTTRRVVGTYGYMAPEYASEGIFSIKSDVFSFGVLVLEIISGKRNSGSHQCGDFINLIGYAWQLWDDGRWIDLVDASLAPKNHSAEMTKCIKIALLCVQENATDRPTMAEVVAMLSLSSETAMIVAEPKQPAYFNVRVGNEVTSTATESCSINDVTISVTTPR

SEQ ID NO: 43242 - protein, 216 aa, Sorghum bicolor
  Clone ID: SORBI-28MAY03-C109197_1.pep
MSRRTAALALACLAVTTAALADGALLPWFGDGRRGGRDEAAAVSPLSDVGLLADPFRILEHVPFGFDRDDVAMVSMARVDWRETPDAHEIVVDVPGMRREDLEVGVRGYRGLRVSRARRRGGGPEGDHWHREERSYGRFWRQFRLPENADLDSVAASLDNGVLPVRFRKLAPEQIKGPRVVGIPGGDGDGGDAKKSIGAGAGAGPGDDHQTKKVEL

SEQ ID NO: 43243 - protein, 198 aa, Sorghum bicolor
  unsure (1)..(198): unsure at all Xaa locations
  Clone ID: SORBI-28MAY03-C109236_1.pep
LLRRLQEGAGRRAGGPPGHRAQRADARRPQPPRIRIKDDECLLRRPDITSPLPTAASAVAVAAGCVARLQELRGGRAHRFVVFXVVVALPRARAGMVAVPAAGVADPSASLPADDCRYAVYDHDFTVEDATATGEAQAAPRSKIFFVAWSPEAAAVRSKMVYASSCDGFRKELDGVQVDLQATEPSELTLDVLNDHAS

SEQ ID NO: 43244 - protein, 230 aa, Sorghum bicolor
  Clone ID: SORBI-28MAY03-C10948_1.pep
KHVNLVSELSRIVEERKLMLVSQTEQELACTSGQAAAFEAATSLLNNERVSDIDRLRSVMLYALRYEKESPVQLMQLFNKLASHSAKYKSGLVQFLLKQAGIDKRTGDLYGNRDLLNIARNMARGLKGVENVYTQHQPLIFQTMEGIVKGRLRDVDYPLVGNHFQQGRPQDVVIFVVGGTTYEEARSVALYNAANPGVRFFLGGSVVLNSKRFLEDLGEAQRISKSSTII

SEQ ID NO: 43245 - protein, 157 aa, Sorghum bicolor
  Clone ID: SORBI-28MAY03-C29975_1.pep
MADTADAPLLTSHHKQAKLANKAPSIDDTIETYIGATGSMQLLKAVLLAFAWAFDAQQVFISVFTDAEPEWHCTGASASCSPAAPPASPCALPSGAWAWDRPAETTVVSEWALKCGGPALVSLPASSFFAGCLAGGFLLTTLADSLLGRKKMLLTSL

SEQ ID NO: 43246 - protein, 132 aa, Sorghum bicolor
  Clone ID: SORBI-28MAY03-C30728_1.pep
MSVRVASAPAAARSAGGVAAWPYLEHMARWERQVERRQLFLRSYHFSRDAESPRSPRARARRVVWVGLRRLRRAAATGLRRLRARLRLCFGWATRRRGSSSLPRRSKTGGLRYGRLSGAGKPRAAAESVFFW

SEQ ID NO: 43247 - protein, 287 aa, Sorghum bicolor
  unsure (1)..(287): unsure at all Xaa locations
  Clone ID: SORBI-28MAY03-C44539_1.pep
FSNPGLRSAASAAATAAEMAIRYWPMAAAAVGFRLVLVLFGGDLHLASRPEVSTPLTSLRRLAEGYWLKQASVSPYSGSMYHGSPLLLSVLGPLTNSRADGHHAHIXADFLAAMLIRATGHKLQMARSRSLKLLDLTKAVNDTVNVSAGDVASLIYLWNPCARVTCVGSCTSPIENLMVVIMIYGACSRLAPLAAFGYVMATHLSLYPAILVVPVILLLGYGPDAPPPKVFLIKDNDKTTRQRVVQQFSWKPVLHFIFWLFIWSCHVLLLSSVILKKVGGLHEMFEK

SEQ ID NO: 43248 - protein, 60 aa, Sorghum bicolor
  Clone ID: SORBI-28MAY03-C10995_2.pep
MACENGRVAATNGDGLCMATPRADPLNWGKAAEELMGSHLDEVKRMVAEYRQPLVKIEGA

SEQ ID NO: 43249 - protein, 128 aa, Sorghum bicolor
  Clone ID: SORBI-28MAY03-C10995_1.pep
MECETGLVRSLNGDGLCMSAQAAPRGADPLNWGKAAEDLSGSHLEEVKRMVAEFRDPVVKIQGASLSIAQVAAVAAGAGEARVELDESARERVKASSDWVMSSMMNGTDSYGVTTGFRRIRHRHRRPR

SEQ ID NO: 43250 - protein, 74 aa, Sorghum bicolor
  Clone ID: SORBI-28MAY03-C11154_1.pep
MPRIPLIKFPKRNLKAPSAPAPSQPADQHATLMSRSDVPSPPSHTAVGGPASLLPKRKPLTEEEIEAIMLGGSI

SEQ ID NO: 43251 - protein, 277 aa, Sorghum bicolor
  Clone ID: SORBI-28MAY03-C11267_1.pep
ARGGPLALARDKLADGSGEPFFVLNSDVISEYPFAELIKFHKCHGGEATIMVTKVDEPSKYGVVVMEEATGRVERFVEKPKVFVGNKINAGIYLLNPSVLDRIELRPTSIEKEVFPQIAADQKLYAMVLPGFWMDVGQPRDYITGLRLYLDSLRKKSAARLATGTHVVGNVLVHESAKIGEGCLIGPDVAIGPGCVVEDGVRLSRCTVMRGVRIKKHACISNSIIGWHSTVGKWARIENMTILGEDVHVCDEVYSNGGVVLPHKEIKSSILKPEIVM

SEQ ID NO: 43252 - protein, 194 aa, Sorghum bicolor
  Clone ID: SORBI-28MAY03-C11194_1.pep
DPIQGSNDRSIDMDRPDHHQHQFFMPAPTPVQVPQPQQQQQICVPMMDEPSSFLAGMGGGGGGPSSSSARGERKRRFTEEQIRSLESMFHAHHAKLEPREKAELARELGLQPRQVAIWFQNKRARWRSKQLEHDYAVLRAKFDDLHARVESLKQDKLALTTQLNELSERLREREDRAAGGATTASSSSCNVGGA

SEQ ID NO: 43253 - protein, 147 aa, Sorghum bicolor
  Clone ID: SORBI-28MAY03-C11237_1.pep
TFGISTPPATRFSSISISAWSPGRTPRARRPERRFRPRAPLRFCLLDCPAKDAAFYNPSFFGKPLTKNQVGLAKVDSWSSRAGSRRSTTAPRIGSRITLRRGRQCSQCFPKFLLASPSFHGGRGALPSAGGHPSDLTYLAGGGAAEV

SEQ ID NO: 43254 - protein, 138 aa, Sorghum bicolor
  Clone ID: LIB3480-059-Q6-K1-C6.pep
RNEKLKSFACSVQDGPSLLDMLLLSQWDNFAWKGHLDYDVTACQLKVIGGGRNFVGQLNNKWNPFSLKEYDKFFESFECLKPNSMKSYDGLLLGIAQGENDRPEVAPSASPPKDGLLVIANTYPVEYGHIFLVPSAIQ

SEQ ID NO: 43255 - protein, 311 aa, Sorghum bicolor
  Clone ID: SORBI-28MAY03-C112824_1.pep
MEDAIPPIPATTRVAVVTGGNKGIGLEVCRQLASNKGLIVVLTARNDQRGASAVQKLKEAGHSNVIFHQLDTTDALSISRLADFLKSRFGRIDILVNNAALGGVEYVQDPAYSSTSSELELRGMNKQQMAEWMFSKVKETLDAAKEGLRTNYYGNKAVTQALLPLLKASSDGRIVFVSSDYGLIGQLKDEELKKELDDIERLTEERLDEMLATYLKDFEAGALAARGWPTNFSAYKVGAVAMNAYARITARMHPELRVNCANPGYVRTDMSVYSGSLTPAEGASNLLKVALLPEGGPTGSYFSDGQVASFV

SEQ ID NO: 43256 - protein, 158 aa, Sorghum bicolor
  Clone ID: SORBI-28MAY03-C1128_2.pep
MATGPRSLHALLGGGAVADLLLWRRRNASAAAVVGATAVWFVFERAGYSFPSVLSNALLLLVAILFFWAKSASLLNRPLPPLPNLEVSDAIVEKAADHALVWINRLLAVGQDIAIKRDRKVFIKVILILWVVSFVGMLFNFLTLIYIGVMLCLLAPPL

SEQ ID NO: 43257 - protein, 225 aa, Sorghum bicolor
  Clone ID: SORBI-28MAY03-C1128_1.pep
MRHPPSTNPIRSDFVEMKPAVEVEADERAAEIKKAAAAKKAAEEVEVEEVLDGEEEDGDEAVDGDDDGNEEDDGEGGEEDDEEEVEGEEKEAAGVVEISDEDDDDDGEADDDDGDDDDDDDDDDDDDDDEEVDGEDEQEEELGTDYLVQPLGRAEDEEHSSDFEPDENGDGAEEEEIDEEEEEDADDGAKAQSSTKRKRSGDDDEDDDGDDDGDDDDDGRPPSKR

SEQ ID NO: 43258 - protein, 151 aa, Sorghum bicolor
  Clone ID: SORBI-28MAY03-C9755_1.pep
LDPLGQFSDQQIWEVLDKCQLLEAVQEKEQGLDSLVVEDGSNWSMGQRQLFCLGRALLRRCRILVLDEATASIDNATDAILQKTIRAEFRDCTVITVAHRIPTVMDCNMVLAMSDGKLVEYDKPTKLMETEGSLFRDLVKEYWSYTSNGNI

SEQ ID NO: 43259 - protein, 222 aa, Sorghum bicolor
  Clone ID: SORBI-28MAY03-C9770_1.pep
MESSSPSVPFPLLQAPVESTYRACTIPYRFPSDNPRKATPVEIQWIDLFLNSVPSFKQRAENDPTVPDAPAKAEKFAQRYTTMLEELKKNPESHGGPPDCILLCRLRELVLRELGFRDIFKKVKDEENAKAMSLFEGVVKRNDEIEDDGKRVENLIRGILAGNIFDLGSAQLAEVFAKDGMSFLASCQNLVSRPWVIDDLDAFKSKWTKKSWEKAVIFVDNS

SEQ ID NO: 43260 - protein, 165 aa, Sorghum bicolor
  Clone ID: SORBI-28MAY03-C9991_1.pep
FDCPGQIELFTHVPVLRNFVEHLKRKNFNVCAVYLLDSQFVSDVTKYISGCMASLSAMIQLELPHINILSKMDLVSNKKEVEEYLDPNAQVLLSQLNRQMAPRFGKLNKCLAELVDDYSMVNFIPLDLRKESSIQYVLSYIDTCIQYGEDADVKVRDFEPIEDED

SEQ ID NO: 43261 - protein, 225 aa, Sorghum bicolor
  Clone ID: SORBI-28MAY03-C9850_1.pep
MQAAAAAVAWAPGPSASTSSSSSPSAFRVGVPSTAVPASSAPRLVAASAPLGRRRRRQVVQAVANPDPAIKLPLTAENVEMVLDEVRPYLMADGGNVALHEIDGNMVRLKLQGACGSCPASVTTMKMGIERRLMEKIPEIVAVEPIADEETGLELNQENIEKVLDEIRPYLAGTGGGELEFVTIEEPIVKVRLTGPAAGVMTVRVALTQKLREKIPKIAAVQLLP

SEQ ID NO: 43262 - protein, 244 aa, Sorghum bicolor
  unsure (1)..(244): unsure at all Xaa locations
  Clone ID: SORBI-28MAY03-C115_1.pep
MPEVTAVSIDPNFSSYLFSEYLCSTSDKKLSEGVYLGRNKRKYSNNDEPSDSLKAMDSIKVVNGLECKISCKTSKVSYVLDTEDFLFRLRKRRKILRGGNVPDSLQISKIYAAKVQRFNRFLSKPXGSFGIQMYRNLVLLGSQLLRLNNDXSTIRRRVPFRNNRWEXTYRVNTAKRSEHVGHSSQALLCRKMCIYVLAACCLFXDYPFTGXFDGRSIXHQVXLTNHHXCCCWYRSSVLFAVVLH

SEQ ID NO: 43263 - protein, 314 aa, Sorghum bicolor
  Clone ID: SORBI-28MAY03-C117115_1.pep
MGQDAVAANGTAGGGRRRARPHAVVMPYPHEGHVIPAVHLALRLAERGFAVTFVNTESVHHQIGAGGDIFAAVRAGGGGATTTTTELDVRYELVSDGFPLGFDRSLNHDQFMEGILHVLPAHVEELLRRVVVDPPTTCLVIDTFFVWPATLARKLGVPYVSFWTEPALIFNLYYHMDLLTKHGHFKCKEPRKDTITYIPGVASIEPSELMSYLQETDTTSVVHRIIFKAFDEARDADYVLCNTVEELEPSTIAALRADRPFYAVGPIFPAGFARSAVATSMWAESDCSRWLDAQPPGSVLYISFGSYAHVTKQE

SEQ ID NO: 43264 - protein, 146 aa, Sorghum bicolor
  Clone ID: SORBI-28MAY03-C1179_1.pep
RPGRDARDVAGSNSLHHLLPLQHLSRLPPRPSDPARGSEKQQQPPEELAEAAAEDDHGVLGYHAHLPPRRRRRIPLHAPLLQPRALHKPIPFDLGDYSCNLLLDDVCNRLPCSDEAIDQPHPERRVSSVSSLNRMKARPAVPLFSL

SEQ ID NO: 43265 - protein, 167 aa, Sorghum bicolor
  Clone ID: SORBI-28MAY03-C12313_1.pep
MHSFGHRANAVATFGVTILAAMCFAASFSDNFNTPTPTASVKILNINWFQKEANGNDEVSMTLNISADLSSLFTWNTKQVFVFVAAEYETPQNALNQVSLWDGIIPAKEHAKFLIHTTNKYRFIDQGSNLKGKEFNLTMHWHIMPKTGKMFADKIVMTGYRLPEQYR

SEQ ID NO: 43266 - protein, 234 aa, Sorghum bicolor
  Clone ID: SORBI-28MAY03-C125221_1.pep
GENLFCPVLLWISARTEKAKTLYIQDGFRKVDPDRWEFAHASFLRGQTHLLRNIVRRGSSGSAGGGGGGGGGKRKDAPASVNPVEPSAEDIAMVATEVVRLKQHQRTIDDRVAAMWRRVQETERRPKQMLAFLLKVVGDRDRLHRLVGDGGTAAAPGPDNNGFASGGAAAAEEGGEKRARLLLDGDNMVALGPEAVDFAGFYSGGGVFGFGDVAVDAAAGSGGGGCSFAFGGGY

SEQ ID NO: 43267 - protein, 114 aa, Sorghum bicolor
  Clone ID: SORBI-28MAY03-C12571_1.pep
LASVKERGKQADFVLCIGDDRSDEDMFENIADIINRNVVDPRTSLFACTVGQKPSKAKFYLDDTFEVVTMLSALADATGPELETDSADELAASISSLDIGDEQSESSDRPIGGS

SEQ ID NO: 43268 - protein, 271 aa, Sorghum bicolor
  Clone ID: SORBI-28MAY03-C10500_1.pep
MHHDPNPFDEGGAEDNPFSNGGGGGGKQQYGFRPTEPVGFGGAGRGGDAVVDVPLETMGDSKSKSRELSSWESDLKRREADIKRREEALKNAGVPMEEKNWPPFFPIIHHDIANEIPANVQKLQYLAFASWLGIVLCLSWNFIAVIVCWIKEGDSKLFFLATIYALLGIPLSYLIWYRPLYRAMRTNSAFSFGWFFLCYLIHIGFCIIAAIAPPIVFHGKSLTGILAAIDTFSEHVIIGILYFVGFALFCLETLLSIGVLQKVYMYFRGNK

SEQ ID NO: 43269 - protein, 149 aa, Sorghum bicolor
  unsure (1)..(149): unsure at all Xaa locations
  Clone ID: LIB5049-008-R1-XP1-D5.pep
NGGGGGGKQQYGFRPTEPVGFGGAGRGGDAVVDVPLETMGDSKSKSRELSSWESDLKRREADIKRREEALKNAGVPMEEKNWPPFFPIIHHDIANEIPANVQKLQYLAFASWLGIVLCLSWKLIAVIVCWIKEGDSKLFFLXTIYALLG

SEQ ID NO: 43270 - protein, 307 aa, Sorghum bicolor
  Clone ID: SORBI-28MAY03-C10987_1.pep
MAAVAGPLCTWLVAACLSAACDAEEYKQKHCCPGGSGAGGGVMLGQRRRLGARRRGLARSGMAMAVALQAERSVIEKKKPDIKQRRVVVTGMGVVTPLGHDPDVFYNNLLDGVSGISEIERFDCSNFPTRIAGEIKSFSTDGWVAPKLAKRMDKFMLYLITAGKKALENGGLTEELRNELDKTRCGVLIGSAMGGMKVFNDAIEALRVSYKKMNPFCVPFATTNMGSAILAMDLGWMGPNYSISTACATSNFCILNAANHIRRGEADVMLCGGSDAPLIPIGLGGFVACTALSQRNSDPTKAYRPWD

SEQ ID NO: 43271 - protein, 244 aa, Sorghum bicolor
  Clone ID: SORBI-28MAY03-C111402_1.pep
MNMFTPKTVAFFGASTGVCLSPLKHSLAAGHNCIALCRIPSKLEAHVSPKTHSNLRIVQGNAHDIKVVASCLKKDDGSIVDAVVSTIGGKPIIHKMTIDDPNCCRIGMSVILDALTQTRAEGAVGRPHITVFSTTGMSDFGRDYPLLLYPIYAIALKVPHEDKKIMETKLADSGEVFTIVRGSLLVDGESETPVRVGIEDPKNGIESLEIGYTISREDAGKWLADNLLVKTRSEYVIKIASITY

SEQ ID NO: 43272 - protein, 235 aa, Sorghum bicolor
  Clone ID: SORBI-28MAY03-C13558_1.pep
LAGSCLRRRYFEEIRDGSSAQACGTNVQSNLLSSSFAIHDGLSTVRSGGVGSGTDAITIASLRYGDMNLLPENSIATSSCLGESGTFNSLDDVCGVNPSQGGTFVKVYKSGSLGRSLDITRFSSYYELRSELERLFGLEGQLEDPVRSGWQLVFVDRENDILLVGDDPWQEFVNSVWCIKILSPQDVQQMVRGGGDLLSAPGARMLQSSVCDDYSAGHDMQNLTGIIAPVVPLDY

SEQ ID NO: 43273 - protein, 124 aa, Sorghum bicolor
  Clone ID: SORBI-28MAY03-C13347_2.pep
IPITPWSSRSRLLKLNCTVSAGRKRRHLQPPGLQRSSEQDEGGHGELRRHPHRHHPPLSRRLPQVRLQGRVLALPLAHLPRLSSGDHLRDLRHHQGLAWYQLWTINIPSVSVSFFLLSNSRVSA

SEQ ID NO: 43274 - protein, 124 aa, Sorghum bicolor
  unsure (1)..(124): unsure at all Xaa locations
  Clone ID: SORBI-28MAY03-C13347_1.pep
AGRXTRISPLTPWSSRSRLLKLNCTVSAGRKRRHLQPPGLQRSSEQDEGGHGELRRHPHRHHPPPSRRLPQVRLQGRVLALPLAHLPRLSSGDHLRDLRHHQGLAWYQLWTINIPSVSELRRRM

SEQ ID NO: 43275 - protein, 93 aa, Sorghum bicolor
  Clone ID: SORBI-28MAY03-C13570_1.pep
MKLETAATVALLLVLLLAPPSLRVSMAGSAFCDGKCGVRCSKASRHDDCLKYCGICCASCNCVPSGTAGHKDECPCYRDMTTGHGNRTRPKCP

SEQ ID NO: 43276 - protein, 375 aa, Sorghum bicolor
  unsure (1)..(375): unsure at all Xaa locations
  Clone ID: SORBI-28MAY03-C11939_1.pep
MSSRSPSRPSGDVNVDVDVDERSMGRLRSLRTQIRSRRHLSGPTDASMPTPSPHSVRSRHLPPGPTAASMPTASTPVDPTAASISTTATPVDLFQFSTGGPSYATVVRFGLRTVPKPQPQQESGSESDLELDSPPRLTALEDEDDKLDIPTSPGGSSEDEMDRCGSTPPPSIDIGPAVLPTFGSDTEEWHFSDDQEDLYFKSLVDNFVSAVGDVYKSMLPEDTICKEADNQLQSNRYAMSALKHYNNSEDNKVKYELIDAITSGGMIDMNGGYGHVNFTAKANQENSKEELFFAELRFHHNTYIATCVLSLEGEKSVGGLCGSKYDNHKNGFFIDAKHCCAPAGPGXCGRGLKHPKNGALYEGGHVACSDYYHGC

SEQ ID NO: 43277 - protein, 132 aa, Sorghum bicolor
  Clone ID: LIB3478-036-P1-K1-D7.pep
IEEWHSPYDQEDPYFESLMDNFLSASGDVCKSMLPAKNTIYKERSHQQQSIDYAVSALKHYNNNENNKVKYELIDAITSGGMIDMNDGYGHVNFTAKANQENSKEELFFAELRFHDNNTYIATCVLSLEGEK

SEQ ID NO: 43278 - protein, 239 aa, Sorghum bicolor
  Clone ID: SORBI-28MAY03-C13670_1.pep
MGSNGREHRCGVPRPPPLSLYRDWEEEEVVKVGRRQQSPLEQSTSISATAGIANKKRLSKQVSMKETTREVKWEKRRRQIQRQRSSMRLNEADDRAGSRTVCHVDSEASSSAERVSSKRITDEDLDELRGSMDLGFRFDEHKGGQDLCDTLPALDIYFAVNRQLSEPKMRFSTSSAPSLLATKSSPNLCGTPSPGSPSTHSNNPLESWKICSPGDNPQLVKTRLRHWAQVVACSVKHSS

SEQ ID NO: 43279 - protein, 479 aa, Sorghum bicolor
  Clone ID: SORBI-28MAY03-C13763_1.pep
RVSGVVTNAPIMLNVDCDMFANNPQVALHAMCLLLGFDDELHSGFVQAPQKFYGGLKDDPFGNQMQVIYEKVGFGVAGLQGIFYGGTGCFHRRKVIYGVPPDSTTTIGIKDSPSYKELHKKFGSSKELIESARSIISGDMFRTPTEVVADLTSLIEAAKQVSACSYETGTSWGQEVGWVYGSMTEDVLTGQRIHAAGWRTALLNPDPPAFLGGAPTGGPGSLTQYKRWATGLLEILLSRHNPFLLAAFKRLDLRQCVAYLVIDVWAIRAPFELCYALLGPYCVIANHSFLPKASEPGFVILLALFLGYNVYNLGEYKDCRLSVRAWWNNHRMQRIVSSSAWLLAFLTVVLKTLGLSETVFEVTRKEQQSTSDGGADAVADPGRFTFDSSPVFIPPTALTMLSIVAVVFGAWRLVAGEGEGVPSPSGPGVGEFVCCGWLVLCFWPFVRGLVSKGSYGIPWNVRLKAALLVAAFVHLSTWK

SEQ ID NO: 43280 - protein, 406 aa, Sorghum bicolor
  Clone ID: SORBI-28MAY03-C14243_1.pep
MKKLHWLVRFLFGPVPVYFSALAILIVLTNAQYFGLVGVGVAPRAAKLASTTPVVSVMKYCDIFRGEWVPDAEAPYYNHKTCHMIQEHQDCLKYGRPDLGFLKWRWRPSGCDLPRFDPLQFLQFVRGKSLALVGDSLARNHMQSLLCLLSQVAYPKDLSANPSDQNKVYHYRAYNFTISMFWSPFLVRAREPDHDGPAHTGHWSLYLDEADDKWVSQISRFDYVLVSAANWFSRPSLFYEKRRLIGCSFCSRQYGVPDLTLYYSQRRAWRVALRAINDLEHLRGRVIVRMLSPMSHFENGTWDHGGDCKRTQPLRGDQTTMEGRDLHFYTAQMEEFRAAEKVASDKGRRLMLMDATAAMLMRPDGHPSRYGHWANEKVQLYNDCIHWCLPGPIDIWNDMLFQMLLA

SEQ ID NO: 43281 - protein, 100 aa, Sorghum bicolor
  Clone ID: SORBI-28MAY03-C114400_1.pep
PSMASGGGKRKPAAPVVAKTMLLLLLQVMAAPTAVMAARTLQGEDVLLYTTPVLGLNTIAREFGNPVACGESCVFIPCISSVVGCKCVNKACYFMPSISS

SEQ ID NO: 43282 - protein, 145 aa, Sorghum bicolor
  Clone ID: SORBI-28MAY03-C11421_2.pep
HASGKKIVTETQGVPGMRTEDVLAKAADEARCPGSSTVLVAHFDGQVLHASNIGDSGFLVIRNGEVHKKSKPMTYGFNFPLQIEKGDDPFKIVQNYAIDLQEGDVIVTASDGLFDNVLNVEVAGIVCVSLEADLRPTEKADLLVA

SEQ ID NO: 43283 - protein, 164 aa, Sorghum bicolor
  Clone ID: SORBI-28MAY03-C11421_1.pep
IILPPGSSTVLVAHFDGQVLHASNIGDSGFLVIRNGEVHKKSKPMTYGFNFPLQIEKGDDPFKIVQNYAIDLQEGDVIVTASDGLFDNVYEEEVAGIVSKSLEADLRPTEIADLLVARAKEVGRCGFGRSPFSDSALAAGYLGYSGGKLDDVTVVVSIVRKSEV

SEQ ID NO: 43284 - protein, 94 aa, Sorghum bicolor
  Clone ID: SORBI-28MAY03-C11504_1.pep
MASAAARSGLRSLAARAAPLRRRMSSSVHDDAYETAKWEKITYAGIVTCTLLAAYNLSKGHPHFDEPPAYPYLHIRNKEFPWGPDGLFEKKDHH

SEQ ID NO: 43285 - protein, 252 aa, Sorghum bicolor
  Clone ID: SORBI-28MAY03-C1151_1.pep
PGDHAGEAQEVLDTSDTTSKDNEEQTVTADEPKEKKQRVEDPPVSEQTVQKETTDEPKRSIDKPKEPSEKNIDDLIDEDLKEIGDRKKRLFSSLESGCNGCIFIQMHKRAGDPGPVEIVQNMMSSAVSTRKHMSRFILRVLPAEVTCYASEEEITKAISPLVEKYFPKECPSGHKFAVLYEARSNTGIDRMKIINAVAKSVPQPHKVDLSNPDKTIVVQIAKTICMIGVVERYRELSKFNLRQLTSPESEKK

SEQ ID NO: 43286 - protein, 177 aa, Sorghum bicolor
  unsure (1)..(177): unsure at all Xaa locations
  Clone ID: SORBI-28MAY03-C1444_1.pep
MASSSKRSLPCVVVLLLAVVFHHGCSSXDGPQTVRRRHGEQHRRQQXMIERFQRWKAAYNKSYATVAEDRRRFLVYARNMAYIEATNAEAEAAGLTYELGETAYTDLTNQEFMAMYTAAPSPAQLPADEDEDDAAEAVITTRAGPVDAVGQLPVYVNLSTAAPASVDWRASGAVTPV

SEQ ID NO: 43287 - protein, 206 aa, Sorghum bicolor
  Clone ID: SORBI-28MAY03-C14453_1.pep
MLARCPLTVNVVALLVNFSSACFTGNAPLTAVQLLWVNMIMDTLGALALATEPPNDDLMNREPVGRTGKFITNVMWRNILGQSFYQFFVMWYLQTQGKNFFGLEDSGTDIVLNTIIFNSFVFCQVFNEISSREMEKINVLKGMTRNYVFMAVLTSTVIFQFIMVQFLGEFANTTPLTIHQWLASVLLGLAGMPIAAAVKLIPVGSS

SEQ ID NO: 43288 - protein, 189 aa, Sorghum bicolor
  Clone ID: SORBI-28MAY03-C14640_1.pep
VKTTLVPAVVASLVSGVERLLDEGARHVVVPGNLPAGCIPITLTMYPSEDRSEYDPRTGCLKKYNAVALYHNAMLRIALDRLQRRRPESRIVYGDYYTPYIQFARTPHLYGYKRGALRACCGGGGPYNYNMSASCGLPGATTCEDPDAHVSWDGIHLTEAPYRFIANTWVKGPYAHPPLATVVIEDMVD

SEQ ID NO: 43289 - protein, 78 aa, Sorghum bicolor
  Clone ID: SORBI-28MAY03-C14685_1.pep
NHKQVDMATKGQKVAIKIIANNSDEQQRSFGRHFDMEDELVSRISRRSIDILKQNYREDLSIEDWKLVVKLKAILKIQ

SEQ ID NO: 43290 - protein, 251 aa, Sorghum bicolor
  Clone ID: SORBI-28MAY03-C15219_1.pep
ARGLSVVLGISSGKKAVKDFSPDIVSWMNFAVFINAWNLCSNVSVIPGTDQSSQNSWWIVDNLLKTCIDEQLTDTNQMLTSPGSNIPLLAWMVTEPITWHLLVIQSCMRSMTPQGKKKKKGGPSERPNTPHLQAIRSSVQCMADILQGVQKCLSDQVKPEDQALDILVSHLQGTSAEGPGQITRLLDESAAAASSEVGGRIAHSLEPWSCACVMRRLVQAENETIAELRKICTSKLKLLASASASLNLVLH

SEQ ID NO: 43291 - protein, 252 aa, Sorghum bicolor
  Clone ID: SORBI-28MAY03-C1564_1.pep
ARGKIAHMPTYFVPDSMSVWNLLREFRIRQVHMAVVLNEYGGTIGIVTLEDVVEEIVGEIFDENDSKEEIQKKTAARGRRGDGTFDVDANTSIDHLSEELGIKIPEGHQYETVSGFVCASFGYIPEEGGKMLVILEKDYREENGEYQEDRPERLALPVLPRASGPQIVEANARKVGKVLFKPISSECVGVDNKGVNRLVSKKIIKRKKQGYDDSSGDEYPDTTENGCPAEALSYSDGNSALLEDASRSCAKR

SEQ ID NO: 43292 - protein, 341 aa, Sorghum bicolor
  Clone ID: SORBI-28MAY03-C11948_1.pep
HEDGDVAIEGPEFRNKSPEEMRDIIPKIRVLARSLPLDKHTLVTNLRGMFREVVAVTGDGTNDAPALHEADIGLAMGIAGTEVAKESADVIVLDDNFTTIINVARWGRAAYINIQKFVQFQLTVNIVALVINFVSACITGSAPLTAVQLLWVNMIMDTLGALALATEPPNDDMMKRPPVGRGESFITKVMWRNIIGQSLYQLAVLGVLMFAGEQFLSIKGADSKSVINTLIFNSFVFCQVFNEINSREMEKINVFRGMVTNWIFIAIIAVTVVFQVVIIEFLGTFASTVPLNWQHWLLSIGLGSVSLIIGAILKCIPVTKSNEVPASPNGYAPLPSGPDDI

SEQ ID NO: 43293 - protein, 75 aa, Sorghum bicolor
  Clone ID: LIB3480-025-P1-K1-B2.pep
RTRGVTAAFQVVIIEFLGTFASTVPLSWQLWLVSVGLGSISLIVGVILKCIPVKSDGTRASPNGYAPLPSGPDNI

SEQ ID NO: 43294 - protein, 204 aa, Sorghum bicolor
  Clone ID: SORBI-28MAY03-C12613_1.pep
TRDQQEHEGFVQLDRVKLSGSNKKLSILQLGIKQNNNKVQQKLHGVTHFSRIQMPISSDPLTGLYVTASGLDSEILSLQRKFGQWREDGSSEEHSDLLFYEYVEAVKLTGDNLVPAGQVVFRAKVGERYQLPHKGIIPRELGVIARYKGQRKIADPGFQNPRWVDGELLILDGKFIRDGPVIAFFYWTSNFHLFEFFRRLRLSD

SEQ ID NO: 43295 - protein, 314 aa, Sorghum bicolor
  Clone ID: SORBI-28MAY03-C13328_1.pep
LGSYDIGQIAPGRCSDPFGFGTKKCTVGNSSVEPYIAAHNMLLAHASATRLYREKYQAVQKGVVGINIYTMWAYPLTNSTADLEASQRFLDFYCGWILEPLVFGDYPSVVKKNVGSRLPSFRKVQSEAIRGTIDFIGINHYLSVYVNDHPLEKGIRDFVLDVAADYRVSRTDPPVGQHAPTSIPADPRGLQLMVEYLSEAYGNLPIYIQETGYATRNGSLHDTDRVDYMKNHINSTLTALRNGANVKGYFAWCFLDVFEYLTGFSSQYGLYRVDFEDEALPRQARLSARWYSKFLKKGIRVEDELDDAGSHVEQ

SEQ ID NO: 43296 - protein, 212 aa, Sorghum bicolor
  Clone ID: SORBI-28MAY03-C12899_1.pep
MGPTGTSSAAILFCCICVVVSLSSSMVVVRSAVPEETPKFNVVSEENPKAIAAAKEIPKSTVVPEETPKSTTTLEENPKSTAIPEETPNSTDAPKETPKFISMGALECSANITMTKPARKLGAVVEGVCPVRFDHTRGISAVAGSCRDRPRPSPERCCGALKTFACPYSDLINDNDHNGCASDMFYQIIVRGRLRPGLFSQMCVEGPLGLSC

SEQ ID NO: 43297 - protein, 87 aa, Sorghum bicolor
  Clone ID: LIB3480-053-P1-K1-A6.pep
KKLPYDFFFKSKIVWVKVNFYGEQATVLEINFGVSFGASVEFGVSSGMAVDFGFSSRVVVDFGVSSGTTVDFGISFAAAIALRVFLR

SEQ ID NO: 43298 - protein, 119 aa, Sorghum bicolor
  Clone ID: SORBI-28MAY03-C16099_1.pep
KRFRPEVPLMTCGKRGQKTVIVYKLSKQGLIYVRMFYKSPDWDSVCRHQHGATPSRTSCLLSFCAVFADAISKSSHGSRMALLTCPVVSVFLAPCFAGQNELRCTLVQQEDQSAHGGYF

SEQ ID NO: 43299 - protein, 71 aa, Sorghum bicolor
  Clone ID: LIB3480-053-P1-K1-G8.pep
RSRRRSTMGVGDEEQMKNKQEEASRTTMVLSVSNGQRGGGRQPINRTSSTGSGQKPGLCYKPVIKALPTRP

SEQ ID NO: 43300 - protein, 129 aa, Sorghum bicolor
  unsure (1)..(129): unsure at all Xaa locations
  Clone ID: SORBI-28MAY03-C16406_1.pep
MSPKKNGNLCSIGAHNRRVRSSATNKDKSVWGGSLKRPRSLCWSTGERWYPHGFDALTXKLLACGDGAALAXDKGVLQLILESDSQEFXKLWKEDANQQSWIATVIRETXEVSSCFVGFSMMYTSRFCN

SEQ ID NO: 43301 - protein, 441 aa, Sorghum bicolor
  Clone ID: SORBI-28MAY03-C16621_1.pep
MASWCEEAVALLQRPAVAEMAVDVLLCAVPIWAAVMIGLVVGWSWRPRWTGLLFLGLRTRLRILWVWVPPGLGARRLWLACTALSACSVAPRLLSSAFRRCRGKHQDRASPEDDAAADRDGGGCADGSRTNFEGEHDTVTEKDLEHLLQLLDNKESGDTAWQNLMERRTSNMTYKAWRREPEEGPIMYCSRTIFEDATPGLVRDFFWDGDFRLKWDPMLAYSKSLDEFPQSGATIVHWIKKFPFFCSDREYIFGGRIWESGKTYYCVTKGVPYPSLPKKEKPRRVELYFSSWRIRAVQSPKHVGQQSACEVTLVHYEDMGIPKDVARVAVRHGMWGAVKKLQSGFRAYQQMRDTENTLSHSAIMARMTTKISITASNGPLDHDLSIADKIGDENDNSHAVQHGFDWKWVVVGGAVAAVCVLNTGLVGKVLLLGAARRQAKK

SEQ ID NO: 43302 - protein, 82 aa, Sorghum bicolor
  Clone ID: SORBI-28MAY03-C16688_1.pep
SAKSNMLLIHSLALAPSVFFASTSSAGASLTGCCTSVSWATCSEEASELAGSLPLTGAGKATETELSKDDSAGSSTVLSCLQ

SEQ ID NO: 43303 - protein, 157 aa, Sorghum bicolor
  Clone ID: SORBI-28MAY03-C16655_1.pep
MEALATTPRPLFARASPAALLLVATAAAARRRSAAHICRASAAAGEETPPAAPKAAEAAAAPKKILKKKPVYSMKKGQIVRVDKEKYLNSINYLSVGHPPFYKGLDYIYEDRGEVLDIRNFETGEYALIAWVGIPTPPAWLPTYMLIKSDKLDYERI

SEQ ID NO: 43304 - protein, 113 aa, Sorghum bicolor
  Clone ID: SORBI-28MAY03-C16913_1.pep
VRNIVGALFIVTLILGAPCVLAGEIAEKVSTVVAKADDCNKQCEGKGTPADIDHCKEKCSLTEHFSYATIGVGACRQNCDKLKNDQSSFNSCEEKCREKYEGRLSQIKQGQNL

SEQ ID NO: 43305 - protein, 516 aa, Sorghum bicolor
  Clone ID: SORBI-28MAY03-C14403_1.pep
TRLRLGLQMDGGEAIQYLQAPNGALHSLGVVDEASTSATVRNMGGYMPSLLFAPRANSTVNETQVETPDSLDLTHSTSNSQHVQHHLQLSPEPSAMTESSFGVSSDVVTATTTSERSHSRHPKKCRFKGCSKGARGASGLCIAHGGGQRCHKSGCHKGAESSSAYCKAHGGGRRCEELGCTKSAEGKTDYCIAHGGGRRCEHPGCPKAARGKSGRCIKHGGGKRCSVKGCIRSAEGKAGLCISHGGGRRCQYPDCGKGAQGSTLYCKGHGGGKRCIFDGCSKGAEGSTPLCKAHGGGKRCMFEGGGVCAKSVHGATEYCVAHGGGKRCSVPGCTKSARGRTDCCVKHGGGKRCKVDNCGKSAQGSTEFCKAHGGGKRCTWSTGCEKFSRGKSGFCAAHGTLMARQREQEVVKNVGSMIGPGLFSGIVVSSATAASSMTNEHSSSGVSTASDCDGTMRSQSMIPPQVLVPRSMMPWSSEPVDGGREGGHVVPEGRVHGGGLLSLLGGSFRNADVEKL

SEQ ID NO: 43306 - protein, 261 aa, Sorghum bicolor
  Clone ID: SORBI-28MAY03-C13862_2.pep
HEAVPFYTGFLPLLFWSGHGRLARQMTLLMAFCDYLGNSLKDMVSAPRPCSPPVRRVTATEDEKENAMEYGLPSSHALNTVCLMGYLLHYVLTYGEHGSVIVAAGLSLAFLLVMLVGIARIYLGMHSLTDVVAGIGFGIVILAFWLAVDDHVDAFIVSGKNVATFWAGLSLLMCFAYPKPEFPTPSFDYHTAFNGVAFGIVYGIQQTYFHFHTPDAPLIFSAQLPLSTFAGRILIGIPTILIVKFCSKALSKWLLAVMCST

SEQ ID NO: 43307 - protein, 150 aa, Sorghum bicolor
  Clone ID: SORBI-28MAY03-C13862_1.pep
TPSFDYHTACSPPNLIQVYGIQQTYFHFHTPDAPLIFSAQLPLPTFAGRILIGIPTILIVKFCSKALSKWLLPVMCSTLGIPIVSSCYVPALKVDSSGKNKQAAGYLQRLFSHFPQKAYDVDTGIRFVQYAGLAWSVVDLVPAIFSHLNL

SEQ ID NO: 43308 - protein, 384 aa, Sorghum bicolor
  Clone ID: SORBI-28MAY03-C14436_1.pep
HEDSNPLKKMTGFNAFWFTHHLFVIVYALLVVHGICLYLSRKWYKKTTWMYLAVPVLLYVSERIIRLFRSHDAVRIQKVAVYPGNVLALYMSKPPGFRYRSGQYIFINCRAVSPYEWHPFSITSAPGDDYLSVHIRTRGDWTSRLRTVFSEACRPPTDGESGLLRADLSKGITESNARFPKLLIDGPYGAPAQDYREYDVLLLIGLGIGATPLISIVKDVLNHIQHGGSVAGTEPDGSGKAKKRPFMTKRAYFYWVTREEGSFEWFRGVMNEVAEKDKDGVIELHNHCSSVYEEGDARSALIVMLQELQHAKKGVDILSGTSVKTHFARPNWRSVFKHVAVNHENQRVGVFYCGEPVLVPQLRQFSADFTHKTNTKFEFHKENF

SEQ ID NO: 43309 - protein, 313 aa, Sorghum bicolor
  Clone ID: SORBI-28MAY03-C14290_1.pep
CSRSLPLCARPQRTRRACTYHQSSRRPRPRRARPDASGAGSPPPDPAAAAAVKEDAWEVRPGGMLVQKRSPDPDRPPAGALVPTIRVKVKFNGVYHEIYINSQASFGELKKLLSAQTGLHPDDQKLVYKDKERDSKAFLDMAGVKDRSKMVMLEDPAAKAKRLLEERRTSKAERAAKAIARVALDVDKLATKVSALETIVSKGGKVVDADVVTLTEALMTELVKLDAVAAVDEEVKVARRAQEKRVQKYVETLDAVRAKNKAAPVSKATNNNTNNKARSPHLPPRPPPAAAHQNHQRRQFQPPAPTTATALVP

SEQ ID NO: 43310 - protein, 77 aa, Sorghum bicolor
  Clone ID: LIB3480-016-P1-K1-B5.pep
GGIGGGAGDDEPSPNVKPVPTIRVKVKHAGVTHEIYISSEAYFGELKKLVAAKTGLHPDDQKVLYKDKERDFKAFLD

SEQ ID NO: 43311 - protein, 108 aa, Sorghum bicolor
  Clone ID: SORBI-28MAY03-C17383_1.pep
MAPKKDKAPPPSSKPAKSGGGKQKKKKWSKGKQKEKVNNAVLFDQATYDKLLSEVPKYKQITPSVLSERLRINGSLARRAIKDLMARGLIRMVAVHSSQQIYTRATNT

SEQ ID NO: 43312 - protein, 227 aa, Sorghum bicolor
  Clone ID: SORBI-28MAY03-C17416_1.pep
MLFLQCQQQPRVPSPPASAPPFRPRVAAAPLSVRVTGGRRGRQAVVAMASADARLAGIASSIRVIPDFPKPGIMFQDITTLLLDPKAFRDTIDLFVERYKDQGITVVAGVEARGFIFGPPIALAIGAKFVPLRKPKKLPGEVISEEYSLGYGTDKIEMHVGAVQANDRALVVDDLIATGGTLCAAVKLLERVGAKVVECACVIELPELKGRDKLGDRPVFVLVEADA

SEQ ID NO: 43313 - protein, 173 aa, Sorghum bicolor
  Clone ID: SORBI-28MAY03-C1765_1.pep
MPPKAKKDAAPAERPILGRFSSHLKIGIVGLPNVGKSTFFNIVTKLAIPAENFPFCTIEPNEARVNVPDERFDWLCKLYKPKSEVPAYLEVTDIAGLIRGAHAGDGLGNAFLSHIRAVDGIFHVLRAFEDPEITHVDDTVDPVRDMETISEELRLKDIEFMKKKLEDLDKSMK

SEQ ID NO: 43314 - protein, 107 aa, Sorghum bicolor
  Clone ID: SORBI-28MAY03-C17359_1.pep
MAKLLLGLLLVLVIIGTTSADNCAKDAEAMKQECKKFEVFPANPKLQPSPACCAVWQRADIPCLCKRVTPEVEKVWCMEKVVYVANYCKKPFTPGYKCGSYTVPKSL

SEQ ID NO: 43315 - protein, 209 aa, Sorghum bicolor
  unsure (1)..(209): unsure at all Xaa locations
  Clone ID: SORBI-28MAY03-C1787_1.pep
SELRSPRVIDSLSPLAIHTRDLLADPRCTLVVQVPGWSGLXNARVTIFGDVIPLPVEQQEWAHQQYVSKHQQWASQQWGNFYYYRMHTISDIYFIGGFGTVAWIDVNEYEALQPDKIAMDGGEHNLKELNSMFSKPLRELLSTDEGEVDDVAVISMDSKGIDIRVRHGAQFNIQRIAFEVDHSVETLDEATEALRRIISKSRWHTRAQL

SEQ ID NO: 43316 - protein, 340 aa, Sorghum bicolor
  unsure (1)..(340): unsure at all Xaa locations
  Clone ID: SORBI-28MAY03-C1790_1.pep
HEAESLVESRNIVQAPLGLFPQPWPPSAAASEGSKFFKVVEYFRLVGRTMAKALQDRPLLDRPFVRAFYKLLLGQELDLYDILSFDTEFGKTLQELQILVARKQFLESCSSENQKIEELCFRGAPIEDLCLDFTLPGYPDYVLKEGGENAVVNIYNLEEYISLVVDATVKTGIMRQVEALKAGFNQVXDISTLQIFSPQELDYLFCGRRELWEPETLPEHIKFDHGYTSKSPAIVNFLEIMAEFTPEQQHAFCQFVTGAPRLPPGGLAALNPKLTIVRKHSSAANNTSNPTGATESADDDLPSVMTCANYLKLPPYSTKAIMLKKLLYAINEGQGSFDLS

SEQ ID NO: 43317 - protein, 72 aa, Sorghum bicolor
  Clone ID: SORBI-28MAY03-C18032_1.pep
LLPSPPSSPSYQKLIAPPFVTANMGKLCCSQEDDEPAFNLLGLLVTIVLALLLLMLCTPPRRRRCVAYYPCC

SEQ ID NO: 43318 - protein, 154 aa, Sorghum bicolor
  Clone ID: SORBI-28MAY03-C18073_1.pep
MSSQLIEDHRSGAEVHAGHELCERKSREFMVELGLPDGLLPLPTLDEVGYNRSTGFVWLRQAAGVTHTFDSIGKQVWYDKEVTAFVEPGRMHSLTGVKSKELLIWVTISEIVLSPSGTKIVFRTPAGLGRAFPITAFQLKPAAAEEEAAAAAAN

SEQ ID NO: 43319 - protein, 213 aa, Sorghum bicolor
  Clone ID: SORBI-28MAY03-C14614_1.pep
MSSSRVLLVSAVLVGLVTLSSCRSLGELSEQKTYSSAPSYGGSPTPTYGSGGGYKPTPTPTPSYGTTPTPSYGTTPTPSYGTTPSTPSTPAYGVPEIPKHGFVGSCDYWKSHPDMIIAVAGSLGNIGKTFGAACSLIVGKKLENLHDALSNTRTDGVGSLLREGAAAYLNSIVNKKFPFTTQQVKDCIVVAVTSDGAASAQAGIFKKANEYHY

SEQ ID NO: 43320 - protein, 127 aa, Sorghum bicolor
  Clone ID: SORBI-28MAY03-C15873_1.pep
TRANSNQSNMLILQESCTDASGSYVVYAPVDVVAMNVVLNGGDPDYVALLPSGFAILPDGPPGMAPHGEGAALETGGGSLLTVAFQILVDSVPTAKLSLGSVATVNSLIACTVERIKAAVCVEGNPQ

SEQ ID NO: 43321 - protein, 97 aa, Sorghum bicolor
  Clone ID: SORBI-28MAY03-C16034_1.pep
TARGVGNLPSKAPIFIGPCVLPADSLIFFDQLLRQQSSSVHRNCETTNLVLDMVGASGTKIQAELLRLTGQMKADLEQNSCHILDQTLPSINATVMR

SEQ ID NO: 43322 - protein, 351 aa, Sorghum bicolor
  Clone ID: SORBI-28MAY03-C16293_1.pep
MMMLIDCSGCRTPLQLPHGAPCIRCAICGAVTHVAPAPPADPNRGAVQQAPGWGPPPPPVHGRKRAVVCGISYRYSRHELKGCINDAKCMRHLLMTRFNFPDDSIIMLNEEQTDPYKIPTKHNIRMAMYWLVQGCQPGDSLVFHYSGHGAQQRNYSGDEVDGFDETLCPLDFETQGMIVDDEINTALVRPLPHGVKLHALIDACHSGTALDLPYLCRMSRSGQYVWEDHRPRSGVWKGTSGGEAISFSGCDDDQTSADTSALSKITSTGAMTFCFIQAIERGQGTTYGSILNSMRSTIRNTGDSAGVGGGAVTSLITMLLTGGSLSAGGLRQEPQLTACETFDVYAKPFSL

SEQ ID NO: 43323 - protein, 155 aa, Sorghum bicolor
  Clone ID: SORBI-28MAY03-C186_1.pep
HVPGTIEPTSKSWGLSVSFISIILLPIVGNAAAHAGAIIFALKNKLDITLGVALGSATQISMFVVPLSVIVAWIAGIQMDLDFKLLETGCLFVSVIVTAFTLQDGSSHYLKGILLLLCYIVIGACFFVTRQPASHANNNGAGLLLPTDTLGAQVA

SEQ ID NO: 43324 - protein, 132 aa, Sorghum bicolor
  unsure (1)..(132): unsure at all Xaa locations
  Clone ID: SORBI-28MAY03-C18601_1.pep
RLNLWSTALLSALYFFFIWIFRDRNYDCLLAIWTWELLSRLKTLLPLSPLAIKQLASPFPPFSRYAGHTVMPAGKAHPRVAFVFNFSFYLHXCWLLICYVFSVHLEHTCDDLDLDCTLFGLILIRIVLIWYC

SEQ ID NO: 43325 - protein, 274 aa, Sorghum bicolor
  Clone ID: SORBI-28MAY03-C19114_1.pep
MSHNHSDTIPLHPSSAQSDMDEIESLIHAAPSPATVLPARPPSPTRASIPVSSSPAPAPVPTKPPLPAASIPISVSVSPVPASVSVPIGADGFGPPPNTLTEPVWDTVKRDLARIVSNLKLVVFPNPYREDPGKALRDWDLWGPFFFIVFLGLTLSWSASVKKSEVFAVAFAVLAAGAIILTLNVLLLGGHIIFFQSLSLLGYCLFPLDVGALVCMLKDNVILKIVVVTITLAWSSWAAYPFMSAAVNPRRKALALYPVFLMYISVGFLIIAID

SEQ ID NO: 43326 - protein, 172 aa, Sorghum bicolor
  Clone ID: SORBI-28MAY03-C19045_1.pep
MLAHRRLLLLLLAAAAAATGGTAFAKKTAYEVLADYDFPPGILPKGVVSYTLDNATGAFTATLDGSSSCEFSIEGSYTLRYKTDITGTIATDHLTDLEGVSVKVLLFWLDIVEVTRSGDSLEFSIGIVSADFGIDNFLESPTCGCGFDCDDRLVLQKQPGGATAKLRLRGAF

SEQ ID NO: 43327 - protein, 93 aa, Sorghum bicolor
  Clone ID: SORBI-28MAY03-C19143_1.pep
ARGSGDFRIRKKHVVVTKKKKQAQHQHQHRGAAAASESEDDSSTSTSGGSDKSSVVQSFTPSTPPATANSFRTGKRRKGVPHRSPFGNLMVEF

SEQ ID NO: 43328 - protein, 226 aa, Sorghum bicolor
  Clone ID: SORBI-28MAY03-C18963_1.pep
MSRGGSHGELGQRIDYVFKVVLIGDSAVGKSQLLARFARNEFNLDSKATIGVEFQTRTLNIDARTVKAQIWDTAGQERYRAVTSAYYRGAVGAMLVYDITKRQSFDHVARWLEELRGHADKNIVIMLIGNKSDLGTLRSVATEDAKEFAERENLFFMETSALEAVNVENAFMTVLTEIYRVVSKKNLVANEESDSSGNSSLLKGTKIVVPGQEPPPTSKATCCMSS

SEQ ID NO: 43329 - protein, 152 aa, Sorghum bicolor
  unsure (1)..(152): unsure at all Xaa locations
  Clone ID: LIB5050-001-R1-XP1-E12.pep
GGMAGAGDKVDYVFKVVLIGDSAVGKSQILARFARNEFSLDSKATIGVEFQTRTLVIDHRSVKAQIWDTAGQERYRAVTSAYYRGALGALLVYDITRRQSFDHIPRWLDELRAHADKNIVIMLVGNKSDLQEQRAVXPENAKELAEKDNPFF

SEQ ID NO: 43330 - protein, 292 aa, Sorghum bicolor
  unsure (1)..(292): unsure at all Xaa locations
  Clone ID: SORBI-28MAY03-C18_2.pep
AGRAGLSPSPTAPASAAAASCAPRSLCFLRRRSSRFAAERNRRPTMAAAISLEAGGGLAHDLGSAAVTAGVALALLKFFEEIAKRGVFEQKLSRKLVHISVGLVFLLFWPLFSSGWYAPFLAALAPGVNVIRMLLLGLGLMKNEAMVKSISRSGDYRELLKGPLYYATTITFATSXLWRTSPVAIALICNLCAGDGIADVVGRRLGKEKLPYNPNKSYAGSIAMAVAGFLASVGYMHYFHTFGFIEETWYMALGFLVVSVAATLVESHPISTELDDNLTVPLTSFLVGSLIF

SEQ ID NO: 43331 - protein, 316 aa, Sorghum bicolor
  unsure (1)..(316): unsure at all Xaa locations
  Clone ID: SORBI-28MAY03-C18_1.pep
MFSLGPLGAHTSPLSCSTYHAPLLQSRRLSPSPTAPASAAAASCAPRSLCFLRRRSSRFAAERNRRPTMAAAISLEAGGGLAHDLASDPVNCNEICSILXVTQERSYTVPNAXKLSRKLVHISVGLVFLLXFWPLFSSGWYAPFLAALAPGVNVIRMLLLGLGLMKNEAMVKSISRSGDYRELLKGPLYYATTITFATSVLWRTSPVAIALICNLCAGDGIADVVGRRLGKEKLPYNPNKSYAGSIAMAVAGFLASVGYMHYFHTFGFIEETWYMALGFLVVSVAATLVESHPISTELDDNLTVPLTSFLVGSLIF

SEQ ID NO: 43332 - protein, 206 aa, Sorghum bicolor
  Clone ID: SORBI-28MAY03-C16930_1.pep
MQMAASLGLNPEALFASYSSAYSSSSPFVSDYAASFPAAVDSATAFSAELDDLHHFDYSPAPIFTAVGAGAGGDRNEKMMMWCEGGGDEKRLRSSGRIGFRTRSEVEILDDGFKWRKYGKKAVKNSPNPRNYYRCSSEGCGVKKRVERDRDDPRYVITTYDGVHNHASPGAAAIIQYGGGGGNSGFYSPPHSGSPSAASYSGSFVF

SEQ ID NO: 43333 - protein, 271 aa, Sorghum bicolor
  Clone ID: SORBI-28MAY03-C17_1.pep
LIAGGPFVLPLAHKHNVKILPADSEHSAIFQCIQGLSKGALRRIILTASGGAFRDWPVDRLKDVKVADALKHPNWNMGKKITVDSATLFNKGLEVIEAHYLFGAEYDDIEIVIHPQSIIHSMVETQDSSVLAQLGWPDMRIPILYTLSWPDRIYCSEVTWPRLDLCKLGSLTFKAPDNVKYPSMDLAYAAGRAGGTMTGVLSAANEKAVELFIDEKISYLDIFKVVELTCDAHRNELVRSPSLEEIIHYDLWARRYAASLQPSSGLSPVPA

SEQ ID NO: 43334 - protein, 126 aa, Sorghum bicolor
  Clone ID: SORBI-28MAY03-C17245_1.pep
MAMTVEVLAGLAFMFSTSILLQILACALYNNWWPMLAALMYVLVPMPCLFFGGGSTHFLTSREGGGWMNAAKFLTGASAMGSLAIPAILRHAGLIETGAMFIEFTSFFILVCTVLCFHRATLDEDW

SEQ ID NO: 43335 - protein, 176 aa, Sorghum bicolor
  Clone ID: SORBI-28MAY03-C17266_1.pep
MASEKSKILVVGGTGYLGRHVVAASARLGHPTVALVRDTAPSDPAKAALLQSFQDAGVTLVKGDLYDQASLVSAVKGADVVISTLGSLQIADQTRLIDAIKEAGNVKRFFPSEFGLDVDRTGIVEPGKSILAGKVGIRRATEAAGIPYTYALAGYFAGYALPNIGQLLAPGPPTDK

SEQ ID NO: 43336 - protein, 171 aa, Sorghum bicolor
  Clone ID: SORBI-28MAY03-C20098_1.pep
MVKYSREPTNPTKSAKAMGRDLRVHFKNTRETAFALRKLSLTKAKRYLEDVIAHKQAIPFRRYCGGVGRTAQAKSRHSNGQGRWPVKSAKFILDLLKNAESNAEVKGLDVDTLYVSHIQVNQAQKQRRRTYRAHGRINPYMSSPCHIELILSEKEEPVKKEAESQIATRKA

SEQ ID NO: 43337 - protein, 141 aa, Sorghum bicolor
  Clone ID: SORBI-28MAY03-C2014_1.pep
VRSNTAAAPPVKEIRRTMRIQALRCHVLYSHDGSKLNVIPVLASRSQALRYLYIRWGVELSNITVVVGECGDTDYEGLLGGVHKTIILKGSFNTAPNQVHANRSYSFQDVVSLEKQGIASIEGYGPDNLKSALRQFGISKD

SEQ ID NO: 43338 - protein, 168 aa, Sorghum bicolor
  Clone ID: SORBI-28MAY03-C20201_1.pep
LTGINSFQDINKVLAMSRIMVAWQPIGISMGVFDICHRYLKERKQFGAPLAAFQLNQEKLVRMLGNIQAMLLVGWRLCKFYESGKMTPGRSSLGKAWTSQKAREVVSLGRELLGGNGILADFLVAKAFCDLEPIFSYEGTYDINSLVTGREITGIASFKPAMSAKSRL

SEQ ID NO: 43339 - protein, 177 aa, Sorghum bicolor
  Clone ID: SORBI-28MAY03-C20885_1.pep
MLNNAPEYLQNVVELCQNRVVVFDNMTNDRRLQAQQLDKLLDVVDSVCANNGGKPFSDQMFTRIKEVHDREKEVHTLGYSEEQISELKKEIHRTRDEQLAHITSMVEEKLNCTVEKLQQQLMEEQNARLEAEKVAYEARLKSEAEIQKLKESLKKAQRENEEFRRMAQSQGSKCAIL

SEQ ID NO: 43340 - protein, 179 aa, Sorghum bicolor
  Clone ID: SORBI-28MAY03-C20368_1.pep
MAGGGASSAWGPSPALVTALVALLGLGLAAYIVGPQLYWHAAEALTAAAACPACDCNCDARPLLDLPEDCAKHFKGVKSRASGEETEKSFTELLVEELKQREEEATQAQQEADVKLLEAKKLASQYQKEADKCSSGMDTCEEAREKSAVALVQQKKLTSLWEQRARELGWKPENTKAHL

SEQ ID NO: 43341 - protein, 165 aa, Sorghum bicolor
  Clone ID: SORBI-28MAY03-C20896_1.pep
PSAILSLIFIGRINRRSSVVALTVAAGALSLACVVIPEGSAARMAAELLSFFSTITAFNLILIYSIELFPTSVRNSAVGLVRQALVLGGVVAPMLVALGRERSFWSFGVFGLCIGCLGLFAACLPETRGRSMSDTMEEEEHKEAAAAACTGATDIIATKDDSDLV

SEQ ID NO: 43342 - protein, 93 aa, Sorghum bicolor
  Clone ID: SORBI-28MAY03-C2015_1.pep
MGFIMEFAENLILRLMEDPDKRDQVRREHVYKMKERCERTKAAWNLPLRPYGFWTFERFNSQLSWDPQISQAAGRRDPYDDLITRHSGSPPSS

SEQ ID NO: 43343 - protein, 124 aa, Sorghum bicolor
  unsure (1)..(124): unsure at all Xaa locations
  Clone ID: SORBI-28MAY03-C44176_1.pep
FLKARQFSQQTWDMVVIGPETVTISMLMTSPKTFXVNSHQMLESEDMQQLLRVFSMGGASGSLPDDTFNFQSYMPSPLPNQTERSHSSGKAVVGWLKIKAAIRWGIFVRKKAAERRAQLVELED

SEQ ID NO: 43344 - protein, 214 aa, Sorghum bicolor
  Clone ID: SORBI-28MAY03-C44165_1.pep
MSKDCGNHGDDDLRRSCRRLLAILLVLALLVALIALIIYLVLRPTHPRFFLQDASLRQLDLSNTTTTTSAAGALSTTLQVTVASRNPNDKVGVYYDRLDVYASYKYQQITVAASLPAVYQGHGDVDVWSPVLSGPDVPFAPYLADALRQDCQAGYLILQVKIDGRVRWKVGSWISGHYHLFVTCPAFLVTTGGNGAPGASGFKFQTTTYCHVEV

SEQ ID NO: 43345 - protein, 156 aa, Sorghum bicolor
  Clone ID: SORBI-28MAY03-C44196_1.pep
FRKIPNGVNGLEERMHIIWDRHEETGKISVTDYVRVTSTECAKIFNIFPRKGAILEGSDADIIILNPERSFVMGAHTHHSRSNTNVYEGRKGKGMVEITISRGRVVWEDGVLNITPGSGRYVMMPPFGYVFDGIQRSDAAYRASLRAPVQRGKASA

SEQ ID NO: 43346 - protein, 156 aa, Sorghum bicolor
  Clone ID: SORBI-28MAY03-C22874_1.pep
RGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 43347 - protein, 555 aa, Sorghum bicolor
  unsure (1)..(555): unsure at all Xaa locations
  Clone ID: SORBI-28MAY03-C2305_1.pep
TRLTSNMLSSTLPSNIGAPRPNLRTLWLSKNMFEGTIPASLGNASDLEDIDLSENHFTGQIPSSLGNLSGLYDLILEDNMLEAKENEGWEFFHALANCRILKVLSLSLNQLQGVIPNSIANLSTSLTNLIMGGNYLSGTVPSSIGKFNKLIKLSLDGNNLTGTIDEWVRNLTSLQHLNLEVNNLIGTFPPSISSLTNLTYLSLANNKFTGFLPPSLGNLQRMTNFNLSHNKFQGGIPVAFGNLQQLVIIDLSWNNISGEIPATLGQCPRLTIIEMGQNLLVGIIPTTFDKLYSLSMLNLSHNKLSGPLPDYLNDLKLLSKLDLSYNNFQGEIPRTGIFDNATVVLLDGNPGLCGGSMDLHKPSCHNVSRRTRIVNYLVKILIPIFGFMSLLLLVYFLLLHKKTSSREQLSQLPFVEHFEKVTYNDLAQATRDFSESNLIGRGSYGSVYSGKLKENKMEVAVKVFDLDMRGAERSFLAECEALRSIQHRNLLPILTACSTVDSAGNVFKALVYELMPNGNLDTWIHXIEGTRELQATXLDXKVGIAVNINCALDYL

SEQ ID NO: 43348 - protein, 152 aa, Sorghum bicolor
  Clone ID: SORBI-28MAY03-C2317_1.pep
MFYGAMVWDPWLIVSQIVCLQCLYYLSLGVAMALLVGTRVPRLTLLYLFDFATLTPRTPTGWCAIASFLLAAVAGAGFMLYVIERAKKCLDFAATLYIIHLFICIVYGGWPASITWWVVNITGLAIMALLGEYLCIRRELKEIPISRLRASV

SEQ ID NO: 43349 - protein, 172 aa, Sorghum bicolor
  Clone ID: SORBI-28MAY03-C23186_1.pep
MVTFDANELGSLVYLHAALSECLRLYPSVPFEHKVAAAADVLPSGQELKAGDKVLVFNYSMGRMKGVWGKDCMEFRPERWLNEEGTKLRYEPSYKFISFNAGPRTCLGKEMAFVQMKTVAAAVLWNFAVEVVPGHVVEPKLSIILHMKNGLAVKVRRRDGTAAPSSCVTACI

SEQ ID NO: 43350 - protein, 118 aa, Sorghum bicolor
  Clone ID: SORBI-28MAY03-C23315_1.pep
MAVGSGLALYHVLGVATCVALLYFTFGEVDLRHTSLPSMPASASVPGSWSSSSRAAAAVAAPFVERRGAQLFLDGRPFYANGWNSYWLMDQAVEPRSRVCVSRMFRTGGGISTGIFLR

SEQ ID NO: 43351 - protein, 188 aa, Sorghum bicolor
  Clone ID: SORBI-28MAY03-C241_1.pep
LRGRPVALARPDSTPPPTPPVRFHRRAPLPARDFATLAPPHDPARPAPTARGDLPPPPPPAAPAPAARPPPGGGTRPAPRMSADSRTPRVTARWLAVASSARLSTKAAAGNLSFDMQCKHCEKESINSSLLNLLTYPWIEKRVNEGTLNLHGGYYNFIDCTFEKWTLLYREGLEGGSKYAIKNRSTWS

SEQ ID NO: 43352 - protein, 138 aa, Sorghum bicolor
  Clone ID: SORBI-28MAY03-C19235_1.pep
MLKQTAVVASQRRPKRRTKEKRKMVAPMDPMLWHKVAAVSGIAALGLGTYGAHMFRPKNPAYKEVWHTASLYHLVHTAALLGAPITKRPNVFGGLLTAGIVLFSGTCYTVAYLEDRKLSSPAPLGGFAFIAAWASLLF

SEQ ID NO: 43353 - protein, 132 aa, Sorghum bicolor
  Clone ID: SORBI-28MAY03-C19489_1.pep
MARGVAAGAKGGAAGGDKKKGSVTFTIDCTKPVEDEIMEIATLEKFLQERIKVAGGKAGNLGEGVTVTRDKTKVTVTSDGPFSKRYLKYLTKKYLKKHNVRDWLRVIASNKDRSVYELRYFNIAENEGEEED

SEQ ID NO: 43354 - protein, 154 aa, Sorghum bicolor
  Clone ID: SORBI-28MAY03-C19590_1.pep
PKVELKKIPPTRARSPKLGRHKPASSATAASADGSCEAPRSTANSGKVNEVMENNKPRVPARKPVQRPVTKAPSQVSATTKAEARPAVTKAKISNSKPKVSRAKVAQAQDTPVEVPPSVPSAPEELVVEHGVGEATGLDLAPQLVASNEVPVHG

SEQ ID NO: 43355 - protein, 210 aa, Sorghum bicolor
  Clone ID: SORBI-28MAY03-C19883_1.pep
MGWATRFVAAVCFFAAGVLFVPEALLGSPSGAGAVTAAKLAHVLAFATSWGAALWATFIGGIIMFKNLPRHMFGNLQSKMFPAYFTLISACAAISVAAFAYLHPWKTASTVERYQLGFLLSALGCNLSNLLVFTPMTIEMMKKRHKIERDLSIGEEVGWSKNQQVAKSNPTLAAMNKKFGMIHGLSSLANIMSFGSLAMHSWYLASKLEL

SEQ ID NO: 43356 - protein, 345 aa, Sorghum bicolor
  unsure (1)..(345): unsure at all Xaa locations
  Clone ID: SORBI-28MAY03-C24739_1.pep
MDEASTSASGAATRRAFPPARSGVFYRFTQQNLPAWKPAMTPGCLIAMFLIIGIIFVPFGLLCLQSSNHVAEIIHRYDVDCVPNAYRGNRQAYIKDSSILKNCTLQAKVLEHMRAPIYVYYELENFYQNHRRYIKSRSDKQLRFGAKYTAESCSPVQWDNNGSPIVPCGLIAWSLFNDTYDFTRGSKEIKVNRXNISWKSDREHKFGTDVFPSNFQNGTLIGGGKLDPTVPLSEQEDLIVWMRTSALPKFRKLYGVIEDDLHADETITILIGNNYNTYTFGGKKSIVLSTASWLGGKNNFLGHAYIVTGSLSIFISILFALIHVKYPRPQGDPNCLSWNRKNSNS

SEQ ID NO: 43357 - protein, 230 aa, Sorghum bicolor
  Clone ID: SORBI-28MAY03-C24743_1.pep
MYHPTTGGVRGGRDQFKWDDVKGDKHRENYLGRSAWAPRGGCLEPWAPCWDTRDKKSDTEDALKEEIRRVKEEEEQAMREALGLAPKRSNRPKGNRLDKHEYAELIKRGSTAEDLGAGHAEAAQVQGLGLYKAHRDEGESSSLNLDPPEMEPEQADPPPAPKQEDSEDDKKGKRRRERDERRGEKERKRDKHGDGKERRRDKHERRHDLEDRSKRHRKDKQKRRHDSDSD

SEQ ID NO: 43358 - protein, 204 aa, Sorghum bicolor
  Clone ID: SORBI-28MAY03-C25039_1.pep
MWLHTHLIQDMLSICRETFKGSVRYAWTSVPTYPSGVIGFLLCAKEGPSVNFLTPINPIEKVEGATKAGREIRFYNSEMHRAVFETIARALRPGGVLCNQAESMWLHTHLIQDMLSICRETFKGSVRYAWTSVPTYPSGVIGFLLCAKEGPPVNFLTPINPIEKVEGATKAGREIRFYNSEMHRAAFVLPTFAKRELEAYCAST

SEQ ID NO: 43359 - protein, 182 aa, Sorghum bicolor
  Clone ID: SORBI-28MAY03-C25107_1.pep
MGREGVVAGPAAEGSKSRPECINSSNPYHECSDYCLRKIAEARQRLDDELPDSWNRPPEQRTVHPDCINASNPYHECSDYCFRRIADAKSGLERGEGQPPADVATAAGTSDAAEQQRPEDNDADKQEGAGADDGYLQMTEKQKKLFELRLKMNEARKANQQAMVAEKKRMEPRGESRGVSKQ

SEQ ID NO: 43360 - protein, 175 aa, Sorghum bicolor
  Clone ID: SORBI-28MAY03-C25270_1.pep
GVVVEGETSPVKSDVVIFGTGFKGDDKIKNMFTSEYFRNIAVGSESTTVPLYRECIHPKIPQLAVIGYSESIANMYTSDIRAKWLARFLDGGFRLPNVAAMQKDVLEWEKYMKRYSGRYFRRSSILILHTWYNDQLCRDMGCNPRRKKGFFSELFEVYGPGDYANLLSNSKSKEQ

SEQ ID NO: 43361 - protein, 132 aa, Sorghum bicolor
  Clone ID: SORBI-28MAY03-C25262_1.pep
KRAKGEVNVEYMRSVADLMVLRGRPHFTAVRAYLASDVTKAGFGDLDFGWGKPVYGGPAKGGVGAIPGVASFFIPFKNAKGEDGIVVPMCLPGLAMETFVQEMGKLLSPPAGAGAGAEQKQQDTFPVIRSAL

SEQ ID NO: 43362 - protein, 119 aa, Sorghum bicolor
  Clone ID: SORBI-28MAY03-C25326_1.pep
YGATSHSLPGTVGIVQPMSPLAPGLASLPGGISAAPGVDPALGQALTALLATQQGAGLNLTSILGVGANGSGLPPQGATGALGGSGVPGMQGGYMGGYGGSGGYGGAASGGPGRNYMGH

SEQ ID NO: 43363 - protein, 205 aa, Sorghum bicolor
  unsure (1)..(205): unsure at all Xaa locations
  Clone ID: SORBI-28MAY03-C2093_1.pep
RPHTRLITPICPHYAEHVWQKIVKKGGIVIKSGCPDADXPPDPTLKIANEYLQNSIXVSMRKLLQERESGSKKPKKGAAPXPPSEEKKMSIGLIYVXEHHSGWKEQSLRVLQSKFDSQSCYFAPDKKIAQALKGCPIGQEMNXKQVQQLCMPFIKMKKDKARDVGTQALYLKLPFSEMEVFRENLEPIKRQLEHEHLYLFTAPHI

SEQ ID NO: 43364 - protein, 152 aa, Sorghum bicolor
  Clone ID: SORBI-28MAY03-C2170_1.pep
MAGMGDMPMRPARPGPPMQHRGPPPMARLRPEPIDREKTCPLLLRVFTRVAGHHQNEEFAVRGKEPKDEVQIYTWKDATLRELTDLVKEVALPARKRNARLSFAFVYPDKNGRFVVRQVGSTFAYGHGRGDDAKTLAELGFQIGDYLSVAIM

SEQ ID NO: 43365 - protein, 441 aa, Sorghum bicolor
  Clone ID: SORBI-28MAY03-C2246_1.pep
KDIIRNVHTRRGLLMLVPEAVEILGGVVDELEEARERLVSEVNKPPRGKSKQGGLPLSSRATRAAWPSSTNITNGGEQGISMQRSVNSSYPTGSGNAFQVGGATETVVEELVSPPVGNTVREINMQGLYASLTRETTETSMHTTHSPPVVNTVQGINMQGLHASLTRKTTETSMHTTRTPPVVTTVQGINMQGLHASLTRETTETSMHTTHNYDPTHIIERSTGTIMEECVDPPIIANNVHEQMQRVQSANVVEGVQSPNVGKINEMEQSFILSGENEEPFTYIYSMLINWGRQQDTKAYIKGKIKGLITSVKSFQYKQCTKYELYVYIDDGSFISEAFIDSDIVNNMLGLSPGEVTAALSGQFEFASPSEVKETLKRFQRFLVKFEGMMIIELNKNSSIPVVRELNEGCSSSTAWLLLRRLKTVSSQKRVQTLDIMDTTP

SEQ ID NO: 43366 - protein, 296 aa, Sorghum bicolor
  Clone ID: SORBI-28MAY03-C2277_1.pep
MAASAARPLALLASASASLGVGRRAWARLPVSSSSLRSAPSSLRGRRSFAASAGGAVMGKPGPGAVDADAGMDAVQRRLMFEDECILVDEQDNVIGHESKYNCHLMEKIEAGNALHRAFSVFLFNSKYELLLQQRSATKVTFPLVWTNTCCSHPLYRESELIEENYAGVRNAAQRKLFDELGIVADELPVDQFIPLGRILYKAPSDGKWGEHELDYLLFMVRDVKLNPNPEEVADVKYMNRDQLKELLRKADAGEDGVKLSPWFRLVVDNFLMGWWDHVEQGTLQGAADMKTIHKL

SEQ ID NO: 43367 - protein, 137 aa, Sorghum bicolor
  Clone ID: SORBI-28MAY03-C25905_1.pep
MTKAIPKIGSRKKVRIGLRRNARFSLRKSARRITKGVIHVQASFNNTIITVTDPQGRVVFWSSAGTCGFKSSRKASPYAGQRTAVDAIRTVGLQRAEVMVKGAGSGRDAALRAIAKSGVRLSCIRDVTPMPHNGCRP

SEQ ID NO: 43368 - protein, 377 aa, Sorghum bicolor
  Clone ID: SORBI-28MAY03-C2597_1.pep
LRLSCPNLQHVNLDGCDHLQSAAFCPVGLESLNLGICPKLSVLRIEAPNMSILELKGCGVLSEASINCPRLTSLDASFCRQLVDDSLTRMAEACPLIEHLILSSCLSIGIDGLSSLHCLHKLTLLDLSYTFLINLKPVFDSCPQLRVLKLSACKYLSDSSLDALYREGALPLLVELDLSYSSIGQNAIEDLLACCTNLVNVNLNGCTNFQELVCGSDDSSSVDMPVDFCPPSSSPIKSEEISERSGRLLEVLSCTGCPNIKKVVIPSIANFLHLSKISLNLSTNLKEVDLTCSNLFMLNLSNCSSLEVLKLDCPRLTNLQLLACTMLQEEELESAISRCSALEILNVHSCPKINALDFGRLRLVCPSLKRIQSSLIS

SEQ ID NO: 43369 - protein, 73 aa, Sorghum bicolor
  Clone ID: SORBI-28MAY03-C2602_1.pep
HLSAPAKKTIVGVVFSLRRRPLVSGQAHLHSYQSSSDCTGWVIAYQGLSACYFSRVEGAQYQVSKYVGGGLLV

SEQ ID NO: 43370 - protein, 172 aa, Sorghum bicolor
  Clone ID: SORBI-28MAY03-C26319_1.pep
MVSLRCTTAHHSLLGSPTCLVRPRRRACPVVRAAVAVEAGAEAKVSLIRIGTRGSPLALAQAHETREKLKAAHSELAEEGAIEIVIIKTTGDMILDKPLADIGGKGLFTKEIDDALLQGRIDIAVHSMKDVPTYLPEGTILPCNLPREDVRDAFICLTANSLAELPAGSVVG

SEQ ID NO: 43371 - protein, 87 aa, Sorghum bicolor
  Clone ID: SORBI-28MAY03-C26358_1.pep
PCYKAHTSPSSKLGDYIGTMHLAMHLSFRISLRTFLLTLAPRAYVTYYQARGLSGHTSPCGDCACFFDDYTFQKSKVGTLHQERNLF

SEQ ID NO: 43372 - protein, 139 aa, Sorghum bicolor
  Clone ID: SORBI-28MAY03-C26559_1.pep
EPISNDNFGLNCRNIVAWARSHIESGNIHAIVDESLDRGYDLQSVWKIAEVAIMCVKPKGAQRPPISEVLKEIQDAIAIERGPQEMQRCTIQQQLLVSNSNRSMGGASSSANNNSGSVAVDLEQNGASFDELLMRPGLR

SEQ ID NO: 43373 - protein, 110 aa, Sorghum bicolor
  Clone ID: SORBI-28MAY03-C24219_1.pep
EVVSVFSLFFLPVHHTFATAGSDGAFNFWDKASHPTPTPKQRLKAFSRCPLPIPCSTFNSDGSIFAYAVCYDWSRGAENHNPAAAKTSIYLHSPQETEVKGKPRLTTGRK

SEQ ID NO: 43374 - protein, 256 aa, Sorghum bicolor
  Clone ID: SORBI-28MAY03-C24257_1.pep
MLGGRPLFVLFGSSIVQYSFSNGGWGAALADIYARKADILLRGYIGWNTRRAVQVMDKVFPKDSAVQPSLVIVYFGGNDSIAAHSSGLGPHVPLDEYIGNMRKIAEHLKSLSEKTRVIFLSCPPLNEEMLRNSTSSTILSEIVRTNETCRLYSDACVALCKEMNLKVVDLWHAMQKREDWMTACFTDGLHLSEEGSNIVVEEILKVLKEAEWEPCLHWKAMPTEFAEDSPFDLVSSSGDATVNPSEWTIHRKIPWD

SEQ ID NO: 43375 - protein, 215 aa, Sorghum bicolor
  Clone ID: SORBI-28MAY03-C24346_1.pep
MAEERVTGTVKWFNVDKGFGFITPDDASEDLFVHQSSIKCDGYRSLKEGEAVEYTVGSGQDGRTKAMDVTAPGGGNLAGGERPDGGHGGGGRYGGGGGDRGYGGGGDRGYGGGGGYGGGGDRGYGGGGDRVYGGGGDRGYGRGGGGGYGGGGGGGRGCFKCGEEGHMARDCSQGGGGGGYGGGGGGGYGGGGGGRECYNCHQEGHISRDCPEKMR

SEQ ID NO: 43376 - protein, 229 aa, Sorghum bicolor
  Clone ID: SORBI-28MAY03-C24730_1.pep
HAARFTKVTPHLARARWFVLVQSQSHSSRFSLLFSPPEGMAGRRSSLSMVASHRLFAPAVHPVGGAAADHGVELDEADVIWGGGGQTSSSPSSSSSFLSSAADPYARSPPVAAPSSKQKPRGAGGAPAPGPASVPVNIPDWSKILGAEYAGSCAAARAAGWAAHDDRADFFTDDCGTGGRRWVPPHEVVQGRDRAAASFSVREGVGRTLKGRDLRRVRNAIWEKTGFQD

SEQ ID NO: 43377 - protein, 168 aa, Sorghum bicolor
  Clone ID: SORBI-28MAY03-C26883_1.pep
NGNNHAALASTSGVLTWEKPIYSDFQILSSESEYAAWTLVNGYALNHATIATHRLESDIRNINKFNKFVEDNGFKLNSEGGILKVSPDGLLQQSSTVADSSLFTFADGITESIPRSYIEFAERLLLPQFKDLQDEEVKEYHRRDGFEVGNADKIFESTSRDQLTRTSA

SEQ ID NO: 43378 - protein, 91 aa, Sorghum bicolor
  Clone ID: SORBI-28MAY03-C27155_1.pep
LATLRMPWSGMNPMQVVGAVGFQDRRLDIPKEVDPLVARIIFECWQKDPNLRPSFAQLTSALKTVQRLVTPSHQETQSPHVHQEISVNLTP

SEQ ID NO: 43379 - protein, 124 aa, Sorghum bicolor
  Clone ID: SORBI-28MAY03-C27236_1.pep
MSSHTIGDAALGDNDECKDRPLILRNKAPRWHEQLQCWCLNFKGRVTVASVKNFQLVAATQPSAGAPTLSSQATPVPPPEHEKVILQFGKVAKDMFTMDYRYPLSAFQAFAICLSSFDTKLACE

SEQ ID NO: 43380 - protein, 163 aa, Sorghum bicolor
  Clone ID: SORBI-28MAY03-C27273_1.pep
MAHGGGGGRAKVTPNLAVDGEGTRTLNLTVLQRLDPAVEDILITAAHVTLYDFDTDVNQWSRKDVEGSLFVVKRNAQPRFQFIVMNRRNTDNLVEDLLGDFEYQLQAPYIMYRNAAQEVIGIWFYNSQECQEVANLFNRILNAFSKVPPKPKIPSVQSEFEES

SEQ ID NO: 43381 - protein, 114 aa, Sorghum bicolor
  Clone ID: SORBI-28MAY03-C27387_1.pep
MGGEAPEPRRLTRALSIGGGDGGWVPEEMLHLVMGFVEDPRDREAASLVCRRWHRVDALSRKHVTVPFCYAVSPARLLARFPRLESLAIKGKPRAAMYGLIPDDWGAYARPWVA

SEQ ID NO: 43382 - protein, 124 aa, Sorghum bicolor
  Clone ID: SORBI-28MAY03-C25332_1.pep
PGWLPSPLFPIYVHNIHKSKHGSDSGTYDDEGRFMPVNFENMFSKYARTSPDRLTYRELWSMTEGFRDAFDLFGWVAAKLEWTILYVLARDDEGYVSREAMRRVYDGSLFEYVERQRAQHAKMS

SEQ ID NO: 43383 - protein, 156 aa, Sorghum bicolor
  Clone ID: SORBI-28MAY03-C25388_1.pep
GRGRPDFDSLNRLKIVTMILYEVLRLYPPVILLTRRTYKEMELGGITYPSGVSLLLPIIFIHHDPNIWGKDASEFNPQRFEDGISNATKHQAAFFPFGWGPRICIGQNFALLEAKMALCTILQRFSFELSPSYTHAPYTVITLHPQHGAQIRLKKL

SEQ ID NO: 43384 - protein, 206 aa, Sorghum bicolor
  Clone ID: SORBI-28MAY03-C25470_1.pep
MRRSLSLLARQQVAQQRRLLSNVPESTVYGGPRPQESAAARRVTVTTLRGKHRRGEPITVVTAYDYPSAVHVDSAGIDVCLVGDSAAMVVHGHDTTLPITLDLMLEHCRAVARGAPRPLLVGDLPFGCYESSAAQAVDSAVRVLKEGGMDAIKLEGGAPSRITAAKAIVEAGIAVMGHVGLTPQAISVLGGFRPQGKTVDSAVKVV

SEQ ID NO: 43385 - protein, 163 aa, Sorghum bicolor
  Clone ID: SORBI-28MAY03-C25866_1.pep
MEAKMERFFESVGNFFTGGDNIPWCDRDLIAGIERELADAANDEQRNASLMRLSWALVHSKQTDDVNRGISMLQASLDNSGSPLETKEKMYLLAVGLFRIGDYSKSRQLADRCLEIQPDWRQAMSLKKAIEDKIAKDGVIGIGIAATAVGLLVGGIAALARKK

SEQ ID NO: 43386 - protein, 238 aa, Sorghum bicolor
  Clone ID: SORBI-28MAY03-C28063_1.pep
GALVDKILDKTGMKGTGKWTVQQAAELAVAAPTIAASLDGRYLSGLKDERVAAAGVLEEEGMPAGLLETINVDKKVLVDRVRQALYASKICSYAQGMNLLRAKSVEKGWNLNLAELARIWKGGCIIRARFLDRIKRAYDRNPELANLIVDRDFAREMVQRQNAWRWVVARAVEAGISTPGMTASLSYFDTYRSSRLPANLIQAQRDLFGAHTYERIDCPGSFHTEWTKLARRSNGAAI

SEQ ID NO: 43387 - protein, 169 aa, Sorghum bicolor
  Clone ID: SORBI-28MAY03-C28110_1.pep
TREEECQGFFVQKDYKMFPPTVDWDNINWSTRRPQMDFPVQSAICTLEDVDVIKEGKARIAGYALSGGGRGIERVDISVDGGKTWIEARRYQKDNVAYVSDGPQSDKWAWVLFEATLDIPANAEIVAKAVDSAANVQPEKVEDIWNLRGILNTSWHRIKIQNSSGRSKL

SEQ ID NO: 43388 - protein, 335 aa, Sorghum bicolor
  unsure (1)..(335): unsure at all Xaa locations
  Clone ID: SORBI-28MAY03-C28237_1.pep
GGRGIVSHNPSDRPCKFFLSGTECSYGDRCRYPHSYCSXDSVTMLTPLKGHDKGVTGIALPAGSDKLYSGSKDGTVLMWDCQTGQCAGIIPVGREVGCMIIEGPWLFVGMPDAVKVWNMQTAAEMSLTGPTGQVYALAVASELLFAATQDGRILAWRFSAATNCFEPAASLDGHKLAVVSLIVGGMRLYSASMDKTIRVWDLATLQCIQTLSDHTDVVMSVLCWDQFLLSCSLDQTIKVWAATESGNLEVTYTHKEDQGALALSGMPDAQSKPVLLCSLNDNTVRLYDLPSFNDRGRLFSKQEIRAIQMGPGGLFFTGDGTGELKVWQWVDGAQT

SEQ ID NO: 43389 - protein, 97 aa, Sorghum bicolor
  Clone ID: SORBI-28MAY03-C28292_1.pep
IKDPVKEEQLKGRPGYEHLGDPTHILIEAELPADVIDARLTQAQEILEELLKPVDESQDNIKRQQLRELAMLNSVYREDSPHQNGSASPFSNGGTKQ

SEQ ID NO: 43390 - protein, 148 aa, Sorghum bicolor
  Clone ID: SORBI-28MAY03-C28633_1.pep
ARGKNNPDDRRIIMSAWNPSDLKKMALPPCHMFAQFYVENGELSCQMYQRSADMGLGVPFNIASYSLLTYMIAQVCDLSPGDFVHVIGDAHVYRTHVRALEEQIQKMPKPFPILKINPSKKDIDSFMASDFKLVGYDPHQKIEMKMAV

SEQ ID NO: 43391 - protein, 194 aa, Sorghum bicolor
  Clone ID: SORBI-28MAY03-C28838_1.pep
MHQPRARYPPGYGSGGGGGAGRGGGGGNGGGGGGGGGNHNYYGRNPQPQQQHHHQQQQQQQQHVHRNSSHQQQWLRRDQAPAVAGAASGNAAAKTAPQLDAIGSSSHERQAPLNIPAPDTRYRTEDVTATKGNEFEDYFLKRELLMGIYEKGFERPSPMPLESLPLAPSGSDILARAKNGTGKTAAFCIPALEK

SEQ ID NO: 43392 - protein, 303 aa, Sorghum bicolor
  Clone ID: SORBI-28MAY03-C2659_1.pep
MAGALLSSPHTLPSPISQSSLRPRSRAPLGAGAARVLPPRRKACVLASCSREPPDRNRGLEVERRRLLMSGLVSSFAIVLPISEAYAVMETDEDVKMNTQVDEINAYSFLYPVELPGKKFSFKWVESRKPERYSSAAPLSPDARQPFVSERVVMLLYAVISTSFGPPSSRFLPSKDKSSWDPKDVADCILSDRSTLKVTTGQRMTESSVLDAHATEVDGEPYWYYEYLVRKSPTKSAPEPNLFRHNVACTAERDGFLYSLNASTLSKQWESMGPFLQQTVASFRLLPPTENYVPPYKDPWRFW

SEQ ID NO: 43393 - protein, 228 aa, Sorghum bicolor
  Clone ID: SORBI-28MAY03-C26668_1.pep
MGKSHNVRTRTRADYSRNSKMGTRFDSAQDLSKKFYSINEMTKELDVLLAYIEKDGGFRDACITFQQRPFSMFEDGLQNLLELLQVFKGKVEEQCSKIEDMRNKMFQVSTRQTYMKGIVSQSSDNQYWDIWNRQKLSPEFEVKRQIILKANQNLTNQLVELERHFNNLEMNRSSETGRVASNRRVVYSNKTRLRRRRRAAASTGRGPKVGSRTPGAFRPRSEFSDFAS

SEQ ID NO: 43394 - protein, 147 aa, Sorghum bicolor
  Clone ID: SORBI-28MAY03-C26720_1.pep
MPGAQLIPVAGRGFLYIGMYAEKLEMLSVAFAGDTDDGMVYVLNGCKNLKKLEIRDSPFGDAALLAGAHRYESMRSLWMSSCEITLGACKTLAAAMPNINVEVISEAGASVGATDDGISNARKVDKLYLYRTIAGPRSDTPGFVSIL

SEQ ID NO: 43395 - protein, 138 aa, Sorghum bicolor
  Clone ID: SORBI-28MAY03-C26733_1.pep
LYAALASVLYNKHDSLNGHRIVMFSYGSGLTSTMFSLRLNNGQHPFSLSNIASVLDVTEKLQSRHEPLPEKFVETLKLMEHRYGAKDFETSRDTSLLQPGTFYLTKVDSMYRRFYSQKLAEETGGGKTKCCNGFANGH

SEQ ID NO: 43396 - protein, 202 aa, Sorghum bicolor
  Clone ID: SORBI-28MAY03-C26805_1.pep
TRLTAALPHCPNFPFHKEENFWLLLADVASNDVWLSQKVSFMDEATAITAASKAIQETQEALGASAKEIGNAVKEAVDRVKKGSRLVMGKFQAPAEGTHNLTSFCLCDCWIGCDTKTSFKLKVLKRSRAGTRGHVPEEGPAAATEDGIEEEEEEEEEEYDDYESEYSDDEEDDKNKGKGKGKVVNGSAHQGAESDIDSGSDE

SEQ ID NO: 43397 - protein, 154 aa, Sorghum bicolor
  Clone ID: SORBI-28MAY03-C29169_1.pep
VGEAAPVLPRGLEWAGFVLNSRMLWKEADGKPDWVKDLDAVGENGEEIENPLALLNDPSSVEPLGNCGKKVLLWWLRVEARADSKFPQGWVIEPPLEVVVPAKRTPWPETTTELPSELLDDKQEQEDRRLSRANKSSRPRGTTKRKADPQGQEN

SEQ ID NO: 43398 - protein, 410 aa, Sorghum bicolor
  unsure (1)..(410): unsure at all Xaa locations
  Clone ID: SORBI-28MAY03-C29237_1.pep
TRDFLFSDGKNHSPIHRKTKDGKSKVPDVFVRIVQHSNNLHLSTYSETSTKDGLTVTCSKRGGEAYLPNHSKWLQTVAKKPDARGFKFVPITSLLTGIPGSGYLSHAINLYLRYKPDLQDLQYFLEFQVPLQWAPMFNELVLGPQKRKGSYPSMQFRCLGPKLHVSTSQVSSSQKPVVGLRLYLEGRKCNRMAIHVQHLSSVPSMIGDSVASSMSEWRESKDSDPGYIEAIQWKNYSCVCTSAVKYNPEWHKRAPGGVFVVTGAQLVTKGTWSKKVLHXRLLYTHIPNCTIQRTEWTNAPASSQKGSFLTTISTTLSSPFTQRDTHQQAKHEPVQLNSGVYPDGPPVPLRSRKLLKFVDISEVVKGPHDVPGHWLVIAAKLVKEGGKIGIHVKFALLGYEGQSQGDSFMS

SEQ ID NO: 43399 - protein, 134 aa, Sorghum bicolor
  Clone ID: SORBI-28MAY03-C29418_1.pep
TLGATDSPVATPASAGPRVRPLASALLGPAGSLPAQHSRQYAINLAEGSSSGRDSSRKWESQGLDLNSGPGSIDLEGKDERMPLPVRQNLIPPPHGFAEDQGRIYQMPVVGTKRKEPDGSWDSERSTYKQLSWQ

SEQ ID NO: 43400 - protein, 240 aa, Sorghum bicolor
  Clone ID: SORBI-28MAY03-C2942_1.pep
RPVPLQMELGGKDACIVLEDADLDLVAGNIVKGGFSYSGQRCTAVKVVLIMESIADAVVQKVNAKLAKLKVGPPEDDSDITPVVTESSANFIEGLVMDAKEKGATFCQEYRREGNLIWPLLLDHVRPDMRIAWEEPFGPVLPVIRINSVEEGIHHCNASNFGLQGCIFTRDINKAILISDAMETGTVQINSAPARGPDHFPFQGLKDSGIGSQGITNSINMMTKVKSTVINLPSPSYTMG

SEQ ID NO: 43401 - protein, 176 aa, Sorghum bicolor
  unsure (1)..(176): unsure at all Xaa locations
  Clone ID: SORBI-28MAY03-C29449_1.pep
NWATGACTNREYVLRRGPGARPRAPLIIGCDLRHMSLAADDIRANKGVIAVNQDPLGVPGKKVRMEGSSEIWAAPLSXYRTAVVLLNRHAKDQATITAHWDDIGLPAGTPVEATDLWLHETVDATFTDTMSFDRRGPPRAGCARARLPPPAGDLPTPRRPVPARTDGAAWRRHHHR

SEQ ID NO: 43402 - protein, 175 aa, Sorghum bicolor
  Clone ID: SORBI-28MAY03-C29519_1.pep
GPKIDIGVFDALKRKFQCATLQLDFQLPIRFKLAYSAEDEAKIERPVMIHRAILGSVERMFAILLEHYNGKWPLWLSPRQAIVCSVSSGSVEYAKQVLATLHEAGFHADIDASDRTIQKKVREAQLAQFNYILVVGAQEAETGNICVRVRDNADLATMSVDGFVTRLKEEIAAFR

SEQ ID NO: 43403 - protein, 137 aa, Sorghum bicolor
  Clone ID: SORBI-28MAY03-C29511_1.pep
MASGQDSREELDRMAEEGQTVVPGGTGGKSLEAQEHLAEGRSHGGSKGGQTRKEQLGHEGYVEMGKKGGQTRSEQLGHEGYQEMGSKGGQTRREQLGHEGYQEMGKKGGLSTKEESGGERAAREGIEIDESKFRTKS

SEQ ID NO: 43404 - protein, 373 aa, Sorghum bicolor
  Clone ID: SORBI-28MAY03-C2743_1.pep
MHPASSKPMEVAAVACRAGLLARARPGSRPRTRRFAVGPAPSAARRRLLVASLGVGEPLPAQSLLCEEAVALEVGVGEPLPARSLGEDAVALEVGEDDDLDSLVSAENLLPPAAAADVPEDRTVRVKFVLRKQCAFGQHFLVVGDEAALGLWDPAKATALEWSEGHVWTATTDLPANRSIEFKFLLRDASGHVRWQHGTNRTLQITETPNTMVVHEDWDHGNKQKVSEEEELSIGAEDVEFSEDLEGTNGAMPVDNNPQKHENLETDRSAVVVADAPLQWEMVAANGTDQPQLMLDKHQTILEEVPGEQNGPPSAGDYAGNGDDDDDDTTLYQGGDLLQNRPTSIFENDLAWAGKAMQQLLRILGFQIGTTRT

SEQ ID NO: 43405 - protein, 212 aa, Sorghum bicolor
  Clone ID: SORBI-28MAY03-C27705_1.pep
FSSYHQNSARFAFVYFEDERDGNDAIRALDGYPFGPGRRRLSVEWSRGDRAARRDGNKPEANTKPTRTLFVINFDPINTRVSDIERHFAPFGNLSSVRIRKNFAFVQFETLEEARKALDATHATTLLDRVISVEYAFRDDSERSDRYDSPRRGGGYGRRGDSPVYRSRPSPDYGRPASPVYGSYDRSPVRDRYRRSPAYRSRSPRVNRRAYD

SEQ ID NO: 43406 - protein, 222 aa, Sorghum bicolor
  Clone ID: SORBI-28MAY03-C27833_1.pep
METMAALARTAPPLAGSTRRPSCALRPTASLSFAAASTTPRGRLGLALSTASAGSGRAARARAVPRRIVASSEVEQSYIMIKPDGVQRGLVGEIISRFEKKGFLLKGLKLFQCPKDLAQEHYKDLKDKPFFPKLIDYITSGPVVCMAWEGDGVVASARKLIGATNPLQAEPGTIRGDLAVQTGRNVVHGSDSPDNGKREIALWFKEGELCQWESVQTPWLIE

SEQ ID NO: 43407 - protein, 499 aa, Sorghum bicolor
  Clone ID: SORBI-28MAY03-C2796_1.pep
HEGLLSEEPLDVETELALGFLDHLLLGTPASPLRRILLESGLGEAIVGGGVEDELLQPQFSIGLKGVSEDNIQKVEELVMQTLNNLAEEGFATEAVEASMNTIEFSLRENNTGSFPRGLSLMLRSIGKWIYDMDPFEPLKYEQPLQQLKARIAEEGSKAVFSPLIEKFILKNLHRVTVEMQPDPEKSSRDEAREKEILKQVKASMTQEDLAELARATKELKEKQETPDPPEALKAVPSLSLQDIPKEPIHVPIEVGEINGVKVLQHDLFTNDVVYSEVVFDMGSMKKEHLQLLPLFCQSLLEMGTKDMDFVQLNQLIGRKTGGISVYPFTSSVRGKEDPLTRIIVRGKAMAPRVEDLFNLMYTILQDVQFTEQQRFKQFVSQSKARMENRLRGSGHGIAAARMDAKLNAAGWISEQMGGVSYLEYLRDLETKIDQDWDSISSSLEEMRKSLFSKNGCLINLTSDWKNLEKSSQHIAKFLDSLPSNPSLGSDPWLSRLPS

SEQ ID NO: 43408 - protein, 115 aa, Sorghum bicolor
  Clone ID: SORBI-28MAY03-C278_1.pep
IKALLPPSQMAMVGSSLEQEVEPGVGRTFQIETAFLCSEGRQIREELEWILEPVPFSSYGGQVYPARGRSRCGGGDKTVRPGRWPGRRQRWQEKARGDGGGAATEEKSAVSREER

SEQ ID NO: 43409 - protein, 50 aa, Sorghum bicolor
  Clone ID: LIB3480-034-P1-K1-D5.pep
FQTSEVWSLLVVKRLIFCSFFYLSRICGWRQICDACIRLFRYCYYLLDGT

SEQ ID NO: 43410 - protein, 136 aa, Sorghum bicolor
  unsure (1)..(136): unsure at all Xaa locations
  Clone ID: SORBI-28MAY03-C30544_1.pep
SVRLPIASALCHPRNFITKIARYDKVVNIPHCVAVSGLLRPIALHLPWRGRPRXGSCAVPGVVSHNEILEMYKKYINPDFKWTNFTLEEQAKVIVARRSNNEMDASKLKAEFPQLLSIKDSLIKYVFEPNRKVPAI

SEQ ID NO: 43411 - protein, 310 aa, Sorghum bicolor
  Clone ID: SORBI-28MAY03-C30175_1.pep
MAVSSPAMASPPLTAPGTHRGPGFSTLCLSPSPSWYPPLSASSSPAISTVLKPKPRGLGLRCQAAEESSPPARGKPPLKVMISGAPASGKGTQCRMIVEKYGLVHVSTGDLLRAEVSSGTKIGKKAKEYMDNGKLVPDQVVTDMVVSRLSQPDVQERGWLLDGYPRSFGQAQSLENLKIRPDIFIVLEVPDDVLIDRCVGRRLDPVTGKIYHLTNFPPENEEISVRLITRSDDTFEKVKSRLDTYKRNSEAILPTYSDLLNQIDGNCLAEVVFQEIDSLLQKICVNTSANKLTKTNGKRPDSVDTVSKNE

SEQ ID NO: 43412 - protein, 191 aa, Sorghum bicolor
  Clone ID: SORBI-28MAY03-C2997_1.pep
MAAAGRNAGVLALFDVDGTLTAPRKVVTPEMLEFMKQLRQHVTVGAVGGSDLVKITEQLGNTVITDYDYVFSENGLVAHKNGQLIGTQSLKSFARVNLPLAFGGLTRLDVAPLGCPITCGSCFLFRCRVIHVSPVGTYWGREERDEFETDGTVRHTRPSPVAALRQCCALFIPTCSPAGRATFVVAPQGCL

SEQ ID NO: 43413 - protein, 72 aa, Sorghum bicolor
  Clone ID: LIB3481-016-P1-K1-G8.pep
VSKFQVFPQGWDITYCLRYLEEFQEIHFWWDKTYKGGNDYEIFESERTVGHTGMLAVWERLIFLCLRICNVT

SEQ ID NO: 43414 - protein, 208 aa, Sorghum bicolor
  Clone ID: SORBI-28MAY03-C30908_1.pep
TRDLTKLQSSAVGYGVVPCLVKLLSEGSVDAKSKAATSLAQLSQSTMALLKSKLPRWLCVPSSAESYCIVHSCQCTVKSTFCLVKAGAVNPLVQILEGEERGADGAVLEALGTLMQDEIWENGSRVIEKASGIHALLRIAEAGELSSQDRAIWMLERMFRLEAHRERYGEITQALLIDLAQKGDPALKPMIGKILAHLELLQTQSSYF

SEQ ID NO: 43415 - protein, 428 aa, Sorghum bicolor
  Clone ID: SORBI-28MAY03-C31106_1.pep
NHCILYLTRAAAHGDVRPFFGGLGVLLVVAFSGHRPTGVHQGAGFGLQAPAVQPVRALWRLHNQYTLPGAMGPIQVRYADGERERHVSVTSFLRAIEHKLFVASLNKQATPKEIEEIFAPYGHVEDVYIMRDGMRQSRGCGFVKFSSKETAVEAMNALNGTYIMRGCEQPLVIRFADPKRPRPGESRGGPAFGGPGFSPRSDAALVIRPTANLDESRGRHMPPESWRPSSPRSMAPNQYNNFGSDNPLALSCGTVTSADNNAAFRPPMFPGNGSLSNQTAVPTSSHMGMNTSIVQGHHIGGQQIPPLQKPPGPPQNFPVQLQNAQPGQPLQGPIPQIGQLQVPQSAGPVSFGQNISSMQLPGQPPASQPLMQQNASLGALQAPPSVQSNSMQAVPGQQQLPTSVAPQVLQQSMQQMPSQAPQVLLQQQ

SEQ ID NO: 43416 - protein, 368 aa, Sorghum bicolor
  Clone ID: SORBI-28MAY03-C31133_1.pep
MEALWKQASRLKDQVARQGVFKQFGYGNSDNAFTDESEVKLHQRLEKLYLSTRAAKHFQRDIVRGVEGYIVTGSKQVEIGNKLSDDSQKYGVENTCTSGDTLSKAATYFGKARSQMEKERGNMLKAFGTQVAEPLRAMVMGAPLEDARHLAQRYDRMRQEAEAQVVEVSRRQNRVRESAGNGDMISKLEAAEYKLEELKSNMVGLGREAIAAMSAVETQQQRLTLQRLIALVEAERAYHKRVLEILDQLEQEMVSERQKIEAPPTPAAENYMPPPPPPSYDEVNGAFASTSVNESVQSVDFFLGEALDSFKAESEFELTLSAGDIVIVRKISSNGWAEGECKGKAGWFPHAYIERQERVLASKVPHIF

SEQ ID NO: 43417 - protein, 205 aa, Sorghum bicolor
  Clone ID: SORBI-28MAY03-C31181_1.pep
MDKEQLGTLLRDLDALQQRPDDLASTIHRMRERLLAMMNPAAGAASRSKIKDMSAEVVDNNPYSRLMALQRMGVVENYERIRDYSVAIVGIGGVGSVAAEMLTRCGIGRLLLYDYDTVELANMNRLFFRPEQVGMTKTDAAVQTLSGINPDVVLESYSLNITTVKGFDTFLASLKAQSSHGRSTGVDLVLSCVDNYEARMVVNQA

SEQ ID NO: 43418 - protein, 216 aa, Sorghum bicolor
  Clone ID: SORBI-28MAY03-C3109_1.pep
MKLEVMPMPKQRVLEAEQREEAMEMSGLDLWKHEKPPRICPLPPPLPPAAAACDETTLVPPLNFAMVDDGIFRSGFPDTSNFRFLKTLNLRSIVYLCPEPYPETNMEFLEKNGIRLHQFGIEGRKEPFVNIPDDKIREALKVVLDPRNQPLLIHCKRGKHRTGCVVGCLRKLQKWCLSSVFDEYHRFAAAKARITDQRFMELFDVSSLKHLTPSHC

SEQ ID NO: 43419 - protein, 59 aa, Sorghum bicolor
  unsure (1)..(59): unsure at all Xaa locations
  Clone ID: LIB3478-022-P1-K1-F7.pep
ILKXLQITLRAYVKTEEDLWTLSGKSVTITNKSHLLKHQGYPKITTGKLVLNEDTQDDI

SEQ ID NO: 43420 - protein, 189 aa, Sorghum bicolor
  Clone ID: SORBI-28MAY03-C28676_1.pep
MHRGGARGMGSVEEDVEEYSWREVVLPHLVPVVSDGAPPELERETGERRRGRDLLVAVDFGPNSKHAFDWALAHIARMADTVHLVHAVSSVHNEIVYDKSRELMEDLAVEAFKTLLVRTKARLVEGDAGKVICREADRLKPAAVILGTRGRGLIQSVLQGSVSEYCFRNCKAAPIIIVPGKEAGEQSVL

SEQ ID NO: 43421 - protein, 147 aa, Sorghum bicolor
  Clone ID: SORBI-28MAY03-C28853_1.pep
MLAFLFRGPSFYQRLIHMSEDKVKFRNTGPVHPLTRQPVADRKRFGGVKFGEMERDCLLAHGSAANLHERLFMLSDFSQMHICQTCERVANVVMRSVPGGKKIRGPYCGFCKSSENIVRINVPYGAKLLYQELFSMGICLKFDTEVC

SEQ ID NO: 43422 - protein, 204 aa, Sorghum bicolor
  Clone ID: SORBI-28MAY03-C28866_1.pep
HEGQAQGEAAAADNDDDDGSNEAEAASWLLAEPDNSHEDSAAATAADTLFAESDAYLGVDLDFARCMDGVKAIGVPVAPPELDIAAGSFFYPEHSMNHSLSSSEVAVVPDAQAAGVPAVVSRGKEREARLMRYREKRKNRRFDKTIRYASRKAYAETRPRIKGRFAKRCSAEADDDALEHDEGACFSPAGSAHAASDGVVPSFC

SEQ ID NO: 43423 - protein, 138 aa, Sorghum bicolor
  Clone ID: SORBI-28MAY03-C28883_1.pep
SGTEGLLFVTTSARIAAGRIYIKEQDSEESRVTSSRSSRRYLHGKWGKVSQMKELPSSLPTVSIAAMDEIDVSMSCDSSLNVNSAQNVLQEIRTQTPPEMFDLTKIVCGTYIDARLMILRGVNGSALLFTRANPTSDP

SEQ ID NO: 43424 - protein, 341 aa, Sorghum bicolor
  Clone ID: SORBI-28MAY03-C323_1.pep
MAPLLSPPLLADTGTKFHAASAPVSCSGSPQRYAIAGLAGAGRRDRDCRRRTRGRTSLRVKAVAAESRSSEGGIAEDYYAVLGVMPDATPKQIKKAYYNCMKSCHPDLSGNDPDMTNFCMFINEVYTVLTDPIQRAVYDEIHGYAATATNPFLDDSAPRDHVFVDEFSCIGCKNCANVCSKVFQIEEDFGRARVYDQSGSTELIQEAIDSCPVDCIHWTSAAQLSLLEDEMRRVERVNVGLMLAGMGGSVDVFRMASSRWEKRQAKVLEKVRRRMSQDDSSKGGSWSDIWGAPTRYEKNEEEAKERAKRAAAAARRWREYSRKGADKPPTFKLPEAVPNKE

SEQ ID NO: 43425 - protein, 260 aa, Sorghum bicolor
  Clone ID: SORBI-28MAY03-C32323_1.pep
RLGIGSRSSLWPPPAADWARLPRPRPGDCGLAASVWAVSEVDALGGVDGSIEQLSARISKLNKKFQQESRRYTETIDDLRALHDKKGQKILRKQQMYAGFTDKLNACQKALDLRWKKFQRNAGLLKRQLTWLFNEHLGKKGISGHINVDYKNEVLSVELTMPQDASRDTIRDTRGLSGGERSFSTLCFTLSLHGMTEAPFRAMDEFDVFMDAVSRKISLNTLVEFAVEQGSQWIFITPHDISMVKAGDRIKKQQMAAPRG

SEQ ID NO: 43426 - protein, 244 aa, Sorghum bicolor
  Clone ID: SORBI-28MAY03-C3235_1.pep
AACAASHDRLPSLGATGFIGRRLVHKLLSDDHKVCVLTCTTHAATAGSPPSPCPGPTATAQDASGEIHSFDESSPSGNDYLAEVCREWETTACQVNQEDVRLALLRIGVVLGRDGGALAKMIPRATAFAGGPPGAGRRWVASSPPGDLVNLIYESLTNPTYKGVINGTAPNPVRLSELCERLGRIVGRPSWLPVPEFALKAVLGEGASVVLEGQKVLPAKAKHLGFSYRYPYVEDALKAIARDL

SEQ ID NO: 43427 - protein, 236 aa, Sorghum bicolor
  Clone ID: SORBI-28MAY03-C32748_1.pep
EIILLNYAGTMVFAEKMVLAVFGGLIVLWMTRNLTDDMPGWGALFHNKVGDGTVTIMMATLLFIIPSRKNKGEKLMDWNKCRKLQWDIILLLGAGFAIAARGRASARPETLSDGLRFLKGAETAVIVPVACIVSGVITEFTSDDATTTLVLPLFAELAKAINVHPAFLMVSGAVGAQLSYLLPTGSPSNVIGFSSGHITIKDLVITGLPLKVVGIAALTILMPTLGSQVFSTDSKF

SEQ ID NO: 43428 - protein, 64 aa, Sorghum bicolor
  Clone ID: SORBI-28MAY03-C32760_1.pep
EDKKCKGESRFPAQVRIRIRKLCKPLEEDSFRPVLHHYDGPKFRLELSIAETLSLLDLCEKEGI

SEQ ID NO: 43429 - protein, 140 aa, Sorghum bicolor
  Clone ID: SORBI-28MAY03-C32886_1.pep
DIYGGHRINVEPIGTLGEDSRSDIRSRGERDIDNQQALQAEEKDVVSSVATVLSDLCGPGEWMPMAKLHTELLDQFGNVWHPSRVRKYLTQDDWSPTETKGRPWFGLLALLRKYPEHFVINTRSKGRMTSEFVSLVSLLS

SEQ ID NO: 43430 - protein, 413 aa, Sorghum bicolor
  Clone ID: SORBI-28MAY03-C6996_1.pep
MAASGEGASLPSPAGGEDAHRRRVSYFYEPSIGDYYYGQGHPMKPHRIRMAHSLVVHYGLHRLLELSRPYPASEADIRRFHSDDYVAFLASATGNPSVLDPRAVKRFNVGEDCPVFDGLFPFCQASAGGSIGAAVKLNRGDADITVNWAGGLHHAKKSEASGFCYVNDIVLAILELLKFHRRVLYVDIDVHHGDGVEEAFFTTNRVMTVSFHKYGDFFPGTGHITDVGAAEGKHYALNVPLSDGIDDATFRDLFQCIIKKVMEVYQPDVVVLQCGADSLAGDRLGCFNLSVKGHADCLRFLRSYNVPMMVLGGGGYTIRNVARCWCYETAVAVGVEPDNKLPYNDYYEYFGPDYILHIQPKSVENQNTTKDLENIKNMILESLSKIEHVPSTQFHDRPSDPEAPEEKEEDMDK

SEQ ID NO: 43431 - protein, 195 aa, Sorghum bicolor
  unsure (1)..(195): unsure at all Xaa locations
  Clone ID: SORBI-28MAY03-C70154_1.pep
TDNPRRDLTTPISRPRADVLTSAAKSAEMHRXALAVGLPADNVGFNVKNVSVKEIRRGNVAGDSKNDPPKGAESFNAQVIVLNHPGQVGAGYAPVLDCHTAHIACKFSELLEKIDRRTGKSVEASPKFIKSGDAAIVKMVPSKPMCVEAFTDYPPLGRFAVRDMRQTVAVGVIKSVAKVDKAGKVTKAAAKATKK

SEQ ID NO: 43432 - protein, 218 aa, Sorghum bicolor
  Clone ID: SORBI-28MAY03-C70911_1.pep
MAALSVPLRAAAVAAGSRAAGADPVKVLCVRSTGSAHFGCAFPSITASSSVARNIEPLRAIATQAPPAVPQYSSGEKTKIGINGFGRIGRLVLRIATSRDDIEVVAVNDPFVDAKYMAYMFKYDSTHGPFKGSIRVVDDSTLEINGKKVTITSKRDPTEIPWGNFGAEYVVESSGVFTTIDKASAHLKGGAKKVVISAPSADAPMFVVGVNEKSYDPK

SEQ ID NO: 43433 - protein, 119 aa, Sorghum bicolor
  Clone ID: SORBI-28MAY03-C71332_1.pep
IKDNLSHDSDLYNILSMVSLVGVVAYVIAFSFGMGAIPWIIMSEILPVSIKSLAGSFATLANWLTSFGITMTANLLISWSAGGTFASYMIVSAFTLVFVIIWVPETKGRTLEEIQWSFR

SEQ ID NO: 43434 - protein, 151 aa, Sorghum bicolor
  Clone ID: SORBI-28MAY03-C3344_1.pep
MAGGTTVCVTGAGGFIASWLVKLLLSRGYTVHGTVRDLSDEKTNHLKRLENAAGNLRIFKADLLDYDAMAAAVVGCQGVLHVATPVPSENLTDPELQMLGPAVTGTTNVLKAASAANVQRVVVVSSMVAVEISPKDWPEGKIRDESCWSDK

SEQ ID NO: 43435 - protein, 719 aa, Sorghum bicolor
  Clone ID: SORBI-28MAY03-C33537_1.pep
HEAQMEGGCPVDYNTITDLFLQRNMIREATAFLLDVLKPTWPEHAFLQTKVLEINLVTYPNVADAILANGMFSHYDRPRIAQLCEKAGLYLRALQHYSELPDIKRVIVNTHAIEPQALVEFFGTLSREWALECMKDLLLVNLRGNLQIVVQAAKEYSEQLGVDACIKLFEQFKSYEGLYFFLGSYLSSSEDPDIHFKYIEAAARTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSRPPVEPLVDECEKRNRLRLLTQFLEHLVSEGSQDVHVHNALGKIIIDSNNNPEHFLTTNPFYDSRVVGKYCDKRDPTLAVVAYRRGQCDDELINVTNKNSLFKLQARYVVERMDGDLWDKVLQPENEYRRQLIDQVVSTALPESKSPEQVSAAVKAFMTADLPPRRIELLEKIVLQNSAFSGNFNLQNLLILTAIKADPSRVMDYVNRLDNFDGPAVGEVAVEAQLYEEAFAIFKARGLNVQAVNVLLDNIRSIERAEEFAFRVEEDAVWSQVAKAQLREGLVSEAIESFIRADDAAHFLDVIRAAEEANVYDDLVKYLLMVRQKAREPKVDGELIFAYAKIDRLSDIEEFILMPNVANLQNVGDRLYDEELYEAAKIIYAFISNWAKLAVTLVKLKQFQGAVDAARKANSAKT

SEQ ID NO: 43436 - protein, 228 aa, Sorghum bicolor
  Clone ID: SORBI-28MAY03-C33592_1.pep
PDPLPDPLPRPWRRVLPLPRRLGPARCCGAGAPPRLPPRFPSLESLALKGRPRAAMYGLIPEDFGAYAAPWVAQLAAPLDCLKALHLRRMTVTDEDIAVLVRARGYMLQVLKLDKCSGFSTDALRLVARSCRSLRTLFLEECTIADEGSEWLHELAVNNSVLVTLNFYMTDLRVEPADLELLAKNCKSLISLKMSECDLSDLIGFLQTSKGLQEFAGGAFSEVGEYTK

SEQ ID NO: 43437 - protein, 361 aa, Sorghum bicolor
  Clone ID: SORBI-28MAY03-C33632_1.pep
MPELRSSTRQARLRSKKLDDLQTAEPPAKPAPPAPQRAAKRAPTRAARGRKGAAGKGVPPAPKPRRKGVQIADLEADPACEEPPKAVKKLEVAPKAVKGLQAAAPKNLPLKKVPEVGVLKMDGESAEKIVGAEDESTTTPVPERVQVGNSPEYITDRKLGKGGFGQVYVGRRVSGGNARAGPDAYEVALKFEHRNSKGCNYGPPYEWQVYNTLNGCYGIPSVHYKGRQGDYYILVMDMLGPSLWDVWNSMGQTMSANMAACIAVEAISILEKLHSKGFVHGDVKPENFLLGQPGSPDDKKLYLIDLGLASKWRESHGHHVDYDQRPDIFRGTIRYASVHAHLGRTGSRRDDLESLAYTLIF

SEQ ID NO: 43438 - protein, 84 aa, Sorghum bicolor
  Clone ID: SORBI-28MAY03-C33777_1.pep
GAPVLEEKKMGVKGVGRKTTDESEHISWRDGVIVPCGKLVPSANKDGPLEYNEYAVYDPKQVSICFLVGVKYEEQNMEVVPDEE

SEQ ID NO: 43439 - protein, 137 aa, Sorghum bicolor
  Clone ID: SORBI-28MAY03-C33790_1.pep
VIRKLSEEVFSIVGRDPLIEVAIALEKAALSDEYFVKRKLYPNVDFYSGLIYRAMGFPTEFFPVLFAIPRMAGWLAHWKESLDDPDTKIMRPQQVYTGAWLRHYTPVRERVLPSQSEELGQIATSNATRRRRAGSAL

SEQ ID NO: 43440 - protein, 172 aa, Sorghum bicolor
  Clone ID: SORBI-28MAY03-C31593_1.pep
MTCIMSASKQNKRQTNCTNSEQCRPGKKTKFDSSHCLVSLKPHIGLKWDQYLRKVVPEKEQVGILWSDMAPFMESQKHCSGLADVTYVPPETFSLKSLRGVLSYEVWSTFLTEAERKFLIQFLPSETDAEENVYSLLTGKNHHFGDPFLSWSSSLCYGDIHPDALLNKEKHI

SEQ ID NO: 43441 - protein, 150 aa, Sorghum bicolor
  Clone ID: SORBI-28MAY03-C3141_1.pep
LQLASYSAIIQIRPVRAMALRVLARKLRFPATSVLQRASTPVVSPPASSRLLTSHSSQSGGAKRAVNETRNARPRWRNYKKLEKRFLRDMEKDMKNFKELSLAMDNLPRNVVLTSSVGLAVLTTGWAYAIGVFDWNRMGDSEPSDQQGVV

SEQ ID NO: 43442 - protein, 59 aa, Sorghum bicolor
  Clone ID: LIB3481-018-P1-K1-F11.pep
SGDMEKDMKNFKELSLAMDNLPRNVVLTSSVGLAVLTTGWAYAIGVFDWNRMGDNEPSA

SEQ ID NO: 43443 - protein, 275 aa, Sorghum bicolor
  Clone ID: SORBI-28MAY03-C32105_1.pep
HEGYKRFYSTSLLEASDFLKNDCLVMNCTVGVVKNRMETPKDIQIHVPRSDMGHCFKELLSRGIGCDITFEVRDEKVRAHKWILAARSPVFKAQFFGPIGKPDLHTVVVEDVEPVVFKAMVNFMYTDELPSISELAGSASTWTSTVVVQHLLAAADRYGLDRLRILCESKLCDELTPETVATTLALAEQHHCAELKSACLRFAAVRENLGAVMGTEGFDYLEETCPSLLSDLLATVAEVDDDPASLDRKRGVCGNQVLAPVESVEATERRTRRRL

SEQ ID NO: 43444 - protein, 303 aa, Sorghum bicolor
  unsure (1)..(303): unsure at all Xaa locations
  Clone ID: SORBI-28MAY03-C32121_1.pep
MDLGPSLPDDVLAGVLRRLAPRGLAASRCVCKAWRRVVDDRCLLRADLLPLSLGGIFLNLHDLRFTQFLSRPTTGAVVSGRLDYTVXRGSLSNNTYQAIRMPTEDEFYLGKSINGIYCASLFQGSQLQVWFLNDQCVHGQTEWVLKHGRDIFPFLPNLNYDEQCDGPWILQDFYYCRQEEHNACGEAYDVVYNNEAILEEKFVWDSDNDNVLEPGSRCKDSYINFLGFHPYKEVVFLSDKFDRVLAYNWSSSRVQDLGKVFPKFYIDWNLHFHHTLVVASFPYTPCWLGELPEKLNLEAQLED

SEQ ID NO: 43445 - protein, 325 aa, Sorghum bicolor
  Clone ID: SORBI-28MAY03-C34069_1.pep
MAEGFGRWESDPLFPAAECVQDSADRMEGVYRLLLHERKVMQDGTSDAKFHAPIQYERDVITALGTTKWQLEQFEREVNAAAFSDKSKSRENAILKFRQFIRAIADQISQVEESLKSLRLGSSRTPKHSSEYDGDGLASFLSGSTKDDHAYQYHSTGTDEIVELKLDNVPLVNGYHSTQEHTTYEHRNSDKDVEGAGSACEGDHSNSNMYVLDADDSISWRLFCKNKLSRQYRSFIRNIWFTKRGRESFTKRRKDGEDMDSLRNGKLPSFNLPQSERVMYFWPEVIKRRICRSGYFTDHNRPQIRLVTAVLIALAVLCLLVSHVK

SEQ ID NO: 43446 - protein, 316 aa, Sorghum bicolor
  unsure (1)..(316): unsure at all Xaa locations
  Clone ID: SORBI-28MAY03-C34081_1.pep
MATKAKSSSSSCLSFLKDALLLPSKNPKLFVPVFFLVTASLLLLQITNVFCIQPRTADILHQLDEIKNMDPSSSDYAKLMAEIIKETRELVVISITLLIISFAESFARQIIAFFATSTTYAGDRYSLPELFTEVIMKGRRVRGPLITVAMVGVLNVACMLLLVALLQLAMRHMXVLYMAVLFVLPFLAFLYLNVVFFVAVAASVADADHRGVSALRLAWRLMTKVWRKEGCVLVVVVHLVATVPSPLYAVALACLKKSMPMGLALLSVYTLLGGLVQLFYYAAAMVYYYQAMESKEKEVMAHDDYVKIPTGEATTV

SEQ ID NO: 43447 - protein, 75 aa, Sorghum bicolor
  unsure (1)..(75): unsure at all Xaa locations
  Clone ID: SORBI-28MAY03-C3409_1.pep
KGKEVYVGXLDSLRRVKEAVKEVGAGLECGIGVDDFDEWQEGDIVEAFNTVKKARTLEEASATVTAALKDAGVQL

SEQ ID NO: 43448 - protein, 149 aa, Sorghum bicolor
  Clone ID: SORBI-28MAY03-C34251_1.pep
QQSPFNEGKMSSSISIYEEQTTALRMKLKGACRWPHSPCFTSQLLVDWTRGVDLEWLLLEGEQSIKCPSCTQYAGSNYTESAHRLTISNRWLTLPYASRFFYACYHLPAKQRIMCSLHTGRCRHTRAPHRGRAKRKLASGCCWRVRASC

SEQ ID NO: 43449 - protein, 243 aa, Sorghum bicolor
  unsure (1)..(243): unsure at all Xaa locations
  Clone ID: SORBI-28MAY03-C34410_1.pep
MEEQQVKPLDLPPTSLDNQDSAATPVTSADPVRPAATDSPSKVAGAAPAAVSSPTAAPAEDAAGREAPASVFSASGLSSWAKNLKIPQPSSGQESPTGKNTFARLTSGLGLRMSPKAPQQDEGAEGSTSPTTGQPGVFGSLTKGIVDSSKNAVKAVQVKARHMVSQNKRRYQEGGFDLDMTYITENIIAMGFPAGDLSSXGFLGYFEGFYRNHMEEVIRFFEMHHKGKYKVYNLCSERLYDAS

SEQ ID NO: 43450 - protein, 355 aa, Sorghum bicolor
  Clone ID: SORBI-28MAY03-C34342_1.pep
MAALGAKMERLSSIDAQLRMLVPGKVSEDDKLIEYDALLLDRFLDILQDLHGDDLKEMVQECYEVAAEYETKHDLQKLDELGKMITSLDPGDSIVIAKSFSHMLNLANLAEEVQIAYRRRIKLKKGDFADENSAITESDIEETLKRLVVDLKKSPAGVFDALKSQTVDLVLTAHPTQSVRRSLLQKHSRIRNCLVQLYSKDITPDDKQELDEALQREIQAAFRTDEIRRTQPTPQDEMRAGMSYFHETIWKGVPKFLRRVDTALKNIGINERVPYNAPLIQFSSWMGGDRDGNPRVTPEVTRDVCLLARMMASNLYCSQIEDLMFELSMWRCSDELRMRADELHRSTKKDAKHYI

SEQ ID NO: 43451 - protein, 268 aa, Sorghum bicolor
  Clone ID: SORBI-28MAY03-C33057_1.pep
MDSLWHLGDELRGQPKVVEDRQWSLMTSKLAEITRSKGERMNDLDYARMNTVPDAKQWDKTSFQHHDQSRMDHINLGLMNLDLKMNDLKMNEAPTAMKLPFHNMPYNMNPMYPKGSNANVNVNAFKMNVGVNKYSNSPNGKDANGKNNGGSNNNGGNSNGSANGNSAVDKRFKTLPTSEMLPRNEVLGGYIFVCNNDTMQEDLKRQLFGLPARYRDSVRAITPGLPLFLYNYTTHQLHGVFEAASFGGSNIDPTAWEDKKCKGESRFP

SEQ ID NO: 43452 - protein, 139 aa, Sorghum bicolor
  Clone ID: SORBI-28MAY03-C33142_1.pep
MSAKVPRCLGVTSSGMADWASIQTDILGIIIKKLPIPDYIRFRAVCTSWNNVCKDVSYRPRVDPWLMLPPDQNPLGAQFFCIPERKNQSIRLPSTASLFESVWAPVGSSNGWLIYFSRTYGTMQLVNPISGKHIQLPPL

SEQ ID NO: 43453 - protein, 151 aa, Sorghum bicolor
  Clone ID: SORBI-28MAY03-C33233_1.pep
MASETDDKAKMESLTSAAAFVEGGIQDACDDACSICLEAFCESDPSALTGCKHEFHLQCILEWCQRSSQCPMCWQSISMKDPTSQELLEAVERERNIRTNQTRNTTIFHHPALGDFELQHLPVGNDAELEERILQHLAAAAAMGRAHHLGR

SEQ ID NO: 43454 - protein, 255 aa, Sorghum bicolor
  Clone ID: SORBI-28MAY03-C33390_1.pep
RILLLPNGTDIYGSKYKGIWISLTVLSRALCGNYVNFGVFELYGDRALADALDISLKMTLSVPLSDILAFRKLSKAYFGYMEVLFNNHIKFVLNLDTHTFIHIVSSLESGLKGLDTGISTQCASAIDSLAAFYFNNITSGDSPPSPASVNLARHIGECPNLFPQILKTLFEIMLFEDAGNQWSLSRPILSLIMTSEQMFTELRAHILASQTVDQQQRLSQCFDKLMTDVNRNLEPKNRDRFTQNLTAFRRDFRLK

SEQ ID NO: 43455 - protein, 357 aa, Sorghum bicolor
  Clone ID: SORBI-28MAY03-C35094_1.pep
MAGERMSTSSGGFAGLVACVATVCLLLPTGSRAQLKVGFYNTTCPNAEALVRQVVTAAFANNSGVAPGLIRLHFHDCFVRGCDASVLLSVNPAGGNTERQSRANNPSLRGFDVIDAAKAAVERSCPRTVSCADIVAFAARDSVNLTGKLFYQVPAGRRDGRVSNETEADTNLLGPDSTAQVLIDGFRRKNLTVEDMVVLSGSHTIGRSHCASFLATNRRRLADGTISAAYQALLEALCPPSPGQFDPNTTEIDVSTPAVLDNNYYKLLPLNLGLHFSDDQLIRNATLAPLANAFAADETLWKQKFAAAMVKMGNIDVKTGTTDEIRLNCSVVNPSSSSAAAAGVIEMLFPADEVATS

SEQ ID NO: 43456 - protein, 439 aa, Sorghum bicolor
  Clone ID: SORBI-28MAY03-C3534_1.pep
MGNCIDTTARVDHSMNNAAYPSKVTSKTSLSSVPSTIKSNSTRSTLTLPSMRDRSELPTPRTEGEILSSSNLKAFTFNDLKNATKNFRPDSLLGEGGFGHVYKGWIDEHTLAPSRPGSGMVVAVKKLKPEGFQGHKEWLTEVDYLGQLHHKNLVKLIGYCSDGDNRLLVYEFMPKGSLENHLFRRGADPLSWAIRLKVAIGAARGLSFLHDAENQVIYRDFKASNILLDSEFNAKLSDFGLAKAGPTGDKTHVSTQVMGTHGYAAPEYIATGRLSAKADVYSFGVVLLELLTGRRALDKSKPGFEQNLVDWARPHLGDKRRLYRIMDTKLGGQYPKKGANAIASIALQCICGDAKLRPPMSQVLEELEQLQDAKYGSPSPLVDIRTASHAAPKSPMSTTPKSPMSTTPKSPMRVQPSPRRSLGAAAASPLAGYRTAQVH

SEQ ID NO: 43457 - protein, 114 aa, Sorghum bicolor
  Clone ID: SORBI-28MAY03-C35717_1.pep
MPLQNIDIEDNVLWKKEEARSKEENLSNGSLRTSKRKSSFPNKSEYVENGTHATPVQPRQPSYMAATESAKAKLRAQNSPRLDSDSSAEKNGFTRRHSLPSSTKSRAIKAEWKR

SEQ ID NO: 43458 - protein, 232 aa, Sorghum bicolor
  Clone ID: SORBI-28MAY03-C35358_1.pep
MGIGDGSSNGNQQLVHKEIRDETTPLLPVKVEEDEGFHEFNGASFSGAVFNLSTTIVGAGIMALPASIKMLGIIPGILLIIIVALLTEASIDMLVRCSHQGKITSYGWLMGEVFGQWGRIALQGSVIINNVGVLIVYMIIIGDVLSGTTSGDVHHRGILEGWFGAHLWNSRSIVLLATALLVFAPLVSFKRLDSLRYTSALSVALAVVFVVITAGIAIIKLFNGTVAMPKLF

SEQ ID NO: 43459 - protein, 165 aa, Sorghum bicolor
  Clone ID: SORBI-28MAY03-C36190_1.pep
KPEGVIATGKFSNILKFIVKEVDPSTGEAEDDGVEDEYQLEDLEIVSADYMLKVGVSNFRNAWESMDPESERVDEYGLGVRESLAEAVSAVISILGMQPCEGTDVVPSNSRSHTCLLSGVFVGNVKVLVRLSFGISAPKEVAMKLAVRSDDPEISDKIHEIVANG

SEQ ID NO: 43460 - protein, 224 aa, Sorghum bicolor
  unsure (1)..(224): unsure at all Xaa locations
  Clone ID: SORBI-28MAY03-C36222_1.pep
ARGPRAPPPTLTPRAPARHAAAPPRPRAAQPRTQPRRPNPARRLPSRAQRRLPKFRGEAPRQGLRGRPPRGRGPHARPLRQRSDPRRRSDLVPDEMVGSSEDEPCSGDXATDLGQEHSSRLADRELKEMLLKKYSGCLSRLRSEFLKKRKKGKLPKDARSALMDWWNTHYSWPYPTDRTACYAHLDRRWDRKLGRPNPRRNRTLDSRRELPWELFLCIKLVKLE

SEQ ID NO: 43461 - protein, 332 aa, Sorghum bicolor
  Clone ID: SORBI-28MAY03-C33898_1.pep
KRPLMKDILQAFESAKDADHDNIGWGNSLDVMVDRPAMANRINWLHFKDKLEVGDKVRSRRLKNSCSPETMEIPDGTIVGIEDEGERDPYILVRVHGLHGPLKVRCSTVERVTYGFAAGDWVRLREEDKKRSQVGILHSIGRDGAVTVGLIGMDTLWKGNYSDLQMAQAYCVGQFVRLKAHISNPRFEWQRKRGGGLVTGRISHIHPNGCLVVKFPGKFNLGEVCSCLADPYEVEVVSFDKCEGIVKKYEHLEDFHWAVRPLFIAIGFFTALKLGVFVGKSIARPRSRKVASISDQSSDYQQQQQVQNSANGAWLPPPVANMLFGDVVGTSG

SEQ ID NO: 43462 - protein, 124 aa, Sorghum bicolor
  unsure (1)..(124): unsure at all Xaa locations
  Clone ID: SORBI-28MAY03-C33912_1.pep
FEGHXAAVLCVQWSPDRASVFGSSAEDGFLNVWDHEKVGTKKNTNVPAGLFFQHAGHRDKIVDFHWNSSDPWTIVSVSDDGESTGGGGTLQIWRMSDLIYRPEDEVLTELENFKAHLASCAPRT

SEQ ID NO: 43463 - protein, 163 aa, Sorghum bicolor
  Clone ID: SORBI-28MAY03-C33929_1.pep
ADTVTCRKFAERAYKYRPLKVVEFDRPYPQCIAYLDLKREECSRLFPAGRIYSQAFHLAGQGFFLSAHCNMEQQSTFYCFGLFLGMQEKGSMSVTVDYEFAARTRPSGEFVSKYKGNYTFTGGKAVGYRNLFAIPWQTFMADDSLFFIDGMLHLRAELTIKQP

SEQ ID NO: 43464 - protein, 114 aa, Sorghum bicolor
  Clone ID: SORBI-28MAY03-C33967_1.pep
TAPPPLAILRAIVMAPLQISLVEERELRHLSSAVARALQSLLGMPSRQLNLSRGPLSLGHPIGRSRPRIILTLLGILRQKNGKFGVAGVCNGGGGASALVLELMQSSSHIHSSL

SEQ ID NO: 43465 - protein, 374 aa, Sorghum bicolor
  Clone ID: SORBI-28MAY03-C34030_1.pep
ARGSDALSFPAASQVSLGNQMGSDNLQATSQQQQQQMDAVQDMQHQQLPMSYNQQQLPPQHSQQLQQPQATVKLENGGSMVSIKSEQQMGQPDQNGPGAQMMRSASVKLEPQQLQAQMMRSLSSVKMEQQTSDPSAFLQQQQQQQQQHHLLQLTKQIRNCPDLVSMGGPNTIANPQAAAAAQLTLLQQQRILHMQQQHQQQQQQQILKNLPLQRNQLQQQQQQHQQQQQQQQLLRQQSLNMRTPGKSPPYEPGTCAKRLTHYMYHQQNRPQDNNIEYWRNFVNEYFAPNAKKRWCVSLYGSGRQTTGVFPQDVWHCEICNRKPGRGFETTVEVLPRLCQIKYASGTLEELLYIDMPRESQNTSGQIILDYTKAI

SEQ ID NO: 43466 - protein, 200 aa, Sorghum bicolor
  Clone ID: SORBI-28MAY03-C36359_1.pep
RYAHEHEPVKDLLGAVKAIRPTALIGSAGVGQSFTKEVIEAMSSINERPIILALSNPTSQSECTAEQAYTWSQGRAIFGSGSPFDPVKYNDKLFVPAQANNAYIFPGFGLGVVISGAVRVSDDMVLAAAEGLAEQVTPEHIEKGLIYPPFSIIRKISANIAARVAAKAYDLGMASQLPRPKDLVKYAESCMYSPVYRTYR

SEQ ID NO: 43467 - protein, 122 aa, Sorghum bicolor
  Clone ID: SORBI-28MAY03-C37080_1.pep
PSMRHGGRRHPRHRRSPRRHGPSTWRTPPAALTGQLPPAAPARARGTEMGARQHGAVEMAARLDISAGGRRDAAPPGRRVTSADGMPRSAMLPGRVASGACVGEVVHQGSRAQVAARSQMPG

SEQ ID NO: 43468 - protein, 194 aa, Sorghum bicolor
  Clone ID: SORBI-28MAY03-C37203_1.pep
MDSRISVLCSLVLASSLLHCARSDGNDGQLLKGINSYRSSLKVPALTENTNAACLAEQLAKQFKGQQCTNTTGANTVIGTEQQFPDYPKYLDHCHLNASVTEDGQVMPACVPGLVPAVVLTNYTKSQYNRFLNDTQFSGVGIANEGDWVVVVLSTSTGSGDYSPAPPGSNWAASALPFTQLVLLLIGFVILLIK

SEQ ID NO: 43469 - protein, 105 aa, Sorghum bicolor
  Clone ID: SORBI-28MAY03-C36811_1.pep
QSEAGESNVFHQEKDAAVDGAPSGTDGAVAEAPVEETTENVGEATFSYDRLISKSTDPVRGIDYKRREAYLSDSEFQTVFGMTKDAFYQQPNWKQELQKRKADLF

SEQ ID NO: 43470 - protein, 165 aa, Sorghum bicolor
  Clone ID: SORBI-28MAY03-C37733_1.pep
LVPHVLALQVMMRPVDNTLGHVREVQDRQHHEHREHHGRLHRHPHGEPRPLPQRLEVHQAQHLQALGVEQSMAVVLGQRKRRWSRSHRRRGRLSRPQAFRRRRRRRCALSCCLRGGIIWPHGGVCCGEESPSPAVARTRWRDAVKVVSDARSREDHGGRCIWGLV

SEQ ID NO: 43471 - protein, 329 aa, Sorghum bicolor
  Clone ID: SORBI-28MAY03-C3697_1.pep
AVAYCHEKGVYHRDLKPENVLVDAKGNIKVSDFGLSALPQNQRKDGLLHTTCGSPNYIAPEVLLNKGYDGSMSDIWSCGAILYVMLTGNLPFDDQNVVVLYQKILKGNAHIPKWLSQGAQDILRKILDPNPITRIDVDGIRAHDWFKQGYAAAVPFNDDEDISIDEDSLHMTERNGIQDKIAINQINAFQLIGMSSCLDLSGFFEKEDASERKIRFASNYSPAYLFEKIESIVRKMGFQVHKSNGKLKVIQDCKGLAKSRGQELLLISAEVFEINESLYVVELKKSSGDCSLYRKLCETLSEDLGTRKSQQFLKQDSIRQEIGRYNSSF

SEQ ID NO: 43472 - protein, 49 aa, Sorghum bicolor
  Clone ID: LIB3481-027-P1-K1-E10.pep
HFYHLLELFQFQLRTCFVCRSGIGLSSNLKSLVDVRKLKHMKKLDWSKH

SEQ ID NO: 43473 - protein, 165 aa, Sorghum bicolor
  Clone ID: SORBI-28MAY03-C34787_1.pep
DLVSMAYLKAVVKETLRLHPPAPLLLPRKSMVDCDIDGYRIPSGTRVIVNSWAVCRHLESWEKAEEFMPERFMDGGSASAAAIDIKGNDFQFIPFGAGRRMCPGMNFGLATVEIMLANLMYCFDWGLPDGMEKEDIDMTEVFGLTVHRKEKLMLVPKLPGTASYA

SEQ ID NO: 43474 - protein, 165 aa, Sorghum bicolor
  Clone ID: SORBI-28MAY03-C34894_1.pep
VGELCIRSPSLFKEYWKRPEVTAESFIDGGFFKTGDTVTVDEEGYFIILGRTNADIMKFGGYKLSALEIEAVLLEHDAVLECAVLGLPDEAYGEVICAIIVPKEDAKKTAEQDSKPVLTLEALTSWSKDKLAPYKIPTKLYLWDSLPRNAMGKVNKKELKKLLGA

SEQ ID NO: 43475 - protein, 298 aa, Sorghum bicolor
  Clone ID: SORBI-28MAY03-C34963_1.pep
MAAAATAATAEIGTAVTATSSEMEATATAITTAAAAGPPPAIPDKYMHKNRLQSFAERTYKKPPVYKVESEGASHQPKFRCTVEVGGQQFSSAGSFDRKKEAEQDAARIAYEILSAVGEDDIKEAFGLIDQDAVFCKSILNEFAVKTKTTWPSYSLVYIEKPLTLFAAIVVFDGNSYTGESARNKKDAEQNAARAVIKSILAKHNTCMVGIVRSKKQLITAVKSSGSSPATFTPIQFTRPVSHAAFGGPDHVAPMLQNASSSLAVQGGTNAVPAVGTSANPSSANVGHSKSKKRKGRV

SEQ ID NO: 43476 - protein, 225 aa, Sorghum bicolor
  Clone ID: SORBI-28MAY03-C35074_1.pep
ARGEKDRQEMIRQGLLEPPKPKVKMSNLMKVLGSEAVQDPTRLEMEIRTAAAEREQAHVDRNIARKLTPSERREKKERKLFDDPTNTVETIVCVYKIRDLSHPQTRFKVDVNAQENKLTGAAVITDSISVVVVEGGKKSIKRYNKLMLNRIDWATAVGGDEDAEVEADKPVNSCVLVWQGTVAKPTFHRFTVHNCRSEAAAKKVFIDAKVPHYWDLAVNFSEDSS

SEQ ID NO: 43477 - protein, 251 aa, Sorghum bicolor
  unsure (1)..(251): unsure at all Xaa locations
  Clone ID: SORBI-28MAY03-C38554_1.pep
HEGSMARLPKLRVFAEKENLKIISIADLIRYRRKRDRLIERASVARLPLKWGNVRAYCYKSVIDGIEHIAMVKGDIGDGQDILVRVHSECLTGDIFGSARCDCGDQLAMAMEMIEKAGRGVLVYLRGHEGRGIGLXHKLRAYNLQDDGRDTVEANQELGLPVDSREYGIGAQILRDLGVRSMKLMTNNPAKYSGLKGYGLSIAGRVPLITPITSENRKYLETKRTKMGHVYGLANVQANQPSGSQSTEEKH

SEQ ID NO: 43478 - protein, 261 aa, Sorghum bicolor
  Clone ID: SORBI-28MAY03-C38794_1.pep
ARGITVEHAAFMAEELGFGVVDAVIKALDDSGYSKQTAQSVMIPPANSSVLVKFKQETKYNLVYMIEENVRDAAPSSLADIKKFASAVSVSTTSVFPEDHYYLTNQTNNLVKSLKSAGLQVYAYVLMNEFGTQPNDFFADATVQINAYVHVRGANVDGVITDFPGTAHRYKLNSCTSMGKNAPPFMSPPKPGDLLTTMPPFAQPPAAAPMPLLTDADVAEPALPPVSNTTTPASPSDAALMMRTDVSILITLLMLCASLLI

SEQ ID NO: 43479 - protein, 244 aa, Sorghum bicolor
  unsure (1)..(244): unsure at all Xaa locations
  Clone ID: SORBI-28MAY03-C39812_1.pep
TPSPKSRSSGRPVQTPRPATAAAAGGGRRSCPLSCTRRGPTAASRTRRLASPRGSPGSGATTTPPSPPPSPPSPPGTAGPRAPPPATTTPASPSSSPPXAGRAGGPDRHVRAPAAGDLGAPGGPRRPRPGRPDAAPRRPXRRGAPTTSGYRGSPTTWGRPRSPPARPAASARCPRSGTRRPRPTCSASQDTYTKLSSVLSIPAPPTITAAAAPPPPPPRRRRGSSPSGRRRPRSPSNSSSSATS

SEQ ID NO: 43480 - protein, 313 aa, Sorghum bicolor
  Clone ID: SORBI-28MAY03-C38961_1.pep
MGAFLSSAATKEDQQWVHGEAPRPDSSKKMRLSTPLCSHGHPRLIPGLPDEISMQILARMPRMEYLKAKMVSWSWKAAVTGAELYRLRKELGVAEEWLYILMKMADDQKLVWHAFDPVSNQWQRLPLMPGISHSRVYGLGLGDLVSAGISIFDIIRGWLGQKELLGSIPFCGCAVGAVDGCLYVLGGFSRASTVKCVWRYDPAVNSWQEVSPMSTGRAFCKTSLLNNKLYVVGGVSKGKNGLAPLKSAEVFDPATGVWAEVPDMLFSKSQALPMALADLLKPIATGVTSYRGKLYVPQSLYSWPFAVDVGGEI

SEQ ID NO: 43481 - protein, 173 aa, Sorghum bicolor
  Clone ID: SORBI-28MAY03-C39815_1.pep
LSSRSGGTETRGGEGMEIQSSGRSIEGLMEKVLSVNILSSDYFKELFKYKTYHEVVDEIYNQVDHVEPWMTGNCRGPSSAFCLLYKLFTMKLTVKQMHGLLKHQDSPYIRAIGFLYLRYVAEPKTLWSWYEPYIKDGEEFAPGSNGKSTTMGVYVRDLLLGQVYLLKLFPRSS

SEQ ID NO: 43482 - protein, 157 aa, Sorghum bicolor
  Clone ID: SORBI-28MAY03-C40867_1.pep
LLTWALDPTSTSSLPSSTRTVKTMSEVEAFALRAEDLRFVATQFRRLHSKQLQHTFRFYSQQWRTWAACFIQAAWHRYCRKKIEDSLRAKEKRLQFAIANDSSTSLSFMAALYASRFAGNMIRILRRNATRKARLQERVPARLLQKPAEPNFSAEEQ

SEQ ID NO: 43483 - protein, 172 aa, Sorghum bicolor
  Clone ID: SORBI-28MAY03-C36237_1.pep
AVIQVGAQTETELKEKKLRVEDALNATKAAVEEGIVVGGGCTLLRLSSKVDAIIETLENDEQKVGAEIVRKSLSYPLKLIAKNAGVNGSVVTEKVLANENFRYGYNAATGKYEDLMAAGIIDPTKVVRCCLEHAASVAKTFITSDAVVVDIKVPEQAPAPANPMAGGSGFGF

SEQ ID NO: 43484 - protein, 314 aa, Sorghum bicolor
  Clone ID: SORBI-28MAY03-C36303_1.pep
MAGRSKYDNPFEEGGADEVNPFADQAKRGGSSAQSSYSGGAFYTTQSQRPSAPPSTRLSPLPPEPADFYNDFATPVDIPMDTNKDMKTREKELLAKEAELNRREKEIKRREDAAARAGIVLEEKNWPPFFPIIHNDIGNEIPVHLQRTLYVAFASLLGLVLCLFWNIICVTAAWAKGSGPKIWFLAIIYFILGCPGAYYLWYRPLYRAMRNESALKFGWFFLFYLVHIAFCVYAAVSPSILFVGKSLTGILPAISLIGDSVIVGIFYFIGFGLFCLESLLSMWVIQRVYLYFRGSGKEAEMRREAARGAARAAF

SEQ ID NO: 43485 - protein, 107 aa, Sorghum bicolor
  Clone ID: SORBI-28MAY03-C36334_1.pep
MASRSSALEGGGAAIQRRNNAVKRHLQQRQQEADFHDKKVIASTYFSIGAFLVLACLTFSLLILPLVLPPLPPPPSLLLWLPVCLLVLLVVLAFMPTDVRSVAASYL

SEQ ID NO: 43486 - protein, 150 aa, Sorghum bicolor
  Clone ID: SORBI-28MAY03-C36353_1.pep
YVDDGEILVGFHGIKLCGIDHLPWYIFFKVNLAPSSQIGGAKIPPGNLLICGSSLKFGRRWCCREVAIACRNTTSLVLVCTYTVRPICFVPYFWDIWVVLNPVPWQPYLLTSSARACECSMFICTYTFCFIGKKEKNLATINVILLYKRS

SEQ ID NO: 43487 - protein, 202 aa, Sorghum bicolor
  Clone ID: SORBI-28MAY03-C41604_1.pep
FQEKIHGSYTTFVESLVDQFAAVSYGDFVFGRQVAIYLHRKVEPAVRLAAWNALSNAYVLELLPPLDKCIGNAQGYLEPLEDDENFLESYAKSWTSGVLDKALQRDSMAFTLVKHHLSGFVFQSSDSGKTLRNKLVKSLIRCYAQKRHHEVMLKSFVLQGIAQDSKSSGNELDRRFEILKDACEMNSSLLGEVQRLRACLGQ

SEQ ID NO: 43488 - protein, 169 aa, Sorghum bicolor
  Clone ID: SORBI-28MAY03-C4227_1.pep
MGGSQYDDEWVLPSADITLVLVGKLGYGKSATGNSILGREAFVSEYSHASVTNTCQLGSTTLKDGRTINVIDTPGLFDMSISSDEAGKEIVKCMNMAKDGIHAVLMVFSATSRFSREDASTIETIKVFFGEKIVDHMILVFTYGDLVGESKLKNMLNNAPEYLQVILLP

SEQ ID NO: 43489 - protein, 158 aa, Sorghum bicolor
  Clone ID: SORBI-28MAY03-C42341_1.pep
MAEQSQPHEEGGASPKHESLMEKLADKLHVGGGGKGDSSSSSDSDNDERPRPSAPPADEVKQTSFSDSAATAAAEAKAKVFRLFGREQPIHKALGGGKPADVFLWRNRNISAGVLGGATAIWILFELLGYHLLTFVCHGLIFSLGVLFLWSNASSFIH

SEQ ID NO: 43490 - protein, 141 aa, Sorghum bicolor
  Clone ID: SORBI-28MAY03-C4148_1.pep
MSEEKHHHFFHHHKKDGEEQPTGEYGYSETVAAEVVTTGEDEYEKYKKEEKEHKHKQHLGEAGAIAAGAFALYEKHEAKKDPEHAHRHKITEEVAAAAAVGAGGYAFHEHHEKKKDHKDADEASGEKKHHHRFRPPHRTTC

SEQ ID NO: 43491 - protein, 122 aa, Sorghum bicolor
  Clone ID: LIB3481-035-P1-K1-D1.pep
GVRDGEEQPTGEYGYSETVAAEGGTTGEDEYEKYKKEEKEHKHKQHLGEAGAIAAGAFVLYEKHEAKKDPEHAHRHKITEEVAAAAAVGAGGYAFHEHHEKKKDHKDADEASGEKKHHHLFG

SEQ ID NO: 43492 - protein, 308 aa, Sorghum bicolor
  unsure (1)..(308): unsure at all Xaa locations
  Clone ID: SORBI-28MAY03-C4255_1.pep
MECLTTSFARNVGKEHSFVCSSKLVSENQWVPRRICCYVSSSTNSSQWCKFTNMAYPMSPIIRKRSHWRSFAASLNLEDGPAPSDSTSSSSEQTTADADGTTNGDASEDLLSQKLSSDELKALLADSERSKLLRRLSEANQYNRFLKRQLQIKDDAVVKFKGELAVLELELQALVXQPEEIANFDVPLGSRRINGKYIQSHLLSRLEAVHDKIVEHIKDVDSLKTKEISVYWVGMAENVQIMGSFDGWSQGEAMSMEYSGDYGRFSATLKLRPGRYEIKFLVDGEWRLSPEYPTAGDGMTQNNILIVE

SEQ ID NO: 43493 - protein, 133 aa, Sorghum bicolor
  Clone ID: SORBI-28MAY03-C42633_1.pep
VVRVIAQTFLQVLKPSTKQKFRFEGDSYKKTLAEFLQVVPAFLGGKCSCPQCEKPRNSSVIQAGEGSKSQPRLVSVDDGSPVTDFDFDEEEIPSAYSCENAIRAAIIGLLMMCIFVAFLAGMNDPTSVSPSAQ

SEQ ID NO: 43494 - protein, 46 aa, Sorghum bicolor
  Clone ID: SORBI-28MAY03-C37741_1.pep
LQSRMISLTDELIATKLKHVQLQEELNALYCQEEIVDMREDENEEA

SEQ ID NO: 43495 - protein, 142 aa, Sorghum bicolor
  Clone ID: SORBI-28MAY03-C37755_1.pep
MAPRLQLRAAAVLALLMAVVSVAALSAAPASAAGVAVGDLAVAHLAGAVVIRRGGRTCRGTVGECMEYLGADAEGEADVAGMATGGSKRRVLQGGSGYIGYDALRRDNVPCSQRGASYYNCQPGAEANPYSRGCSAITQCRG

SEQ ID NO: 43496 - protein, 189 aa, Sorghum bicolor
  Clone ID: SORBI-28MAY03-C37994_1.pep
MELHKYWGVGGRRCGSCEAAPAAVHCRTCVGGSSSFLCTTCDARPAHARLAHERVWVCEVCELAPAAVTCKADAAVLCAACDADIHDANPLARRHARVPVAPIGSEAAAAAVEAMLFGTGDAAEADDQHNNAAAAAEQHQHQHHAHHAHALNLNVEAKDMKLDYLFSELDPYLSVEIPRFHHADSVVPN

SEQ ID NO: 43497 - protein, 113 aa, Sorghum bicolor
  Clone ID: SORBI-28MAY03-C38103_1.pep
MGGCCCCSSRTSEAVRAPVDIYRQQNLEEHEPLSSAFDGSSPASAIVAVDTNLDTSTPDTYRAPPAPLPYDVVLAVPDNPGLEKPDTKSKTDDRPEAFDALQSFGVAGPCEQN

SEQ ID NO: 43498 - protein, 348 aa, Sorghum bicolor
  Clone ID: SORBI-28MAY03-C38184_1.pep
MASLLTLPALALSNPATASDAVRLRSAAFRCWALRRRGWAAVAAVASPNSVLSEHAFKRLQLGSDDEDEEGTYGSDANEGFEAGEGFQGDEEELAIARLGLPDELVATLEKRGITHLFPIQRAVLIPALEGRDLIARAKTGTGKTLAFGIPMIKQLIEQDNGQITRRGRTPRVLVLAPTRELAKQVEKEIKESAPKLGTVCVYGGVSYNVQQNALSRGVDVVVGTPGRIIDLINGGSLQLGEVQYLVLDEADQMLAVGFEEDVETILQQLPANRQSMLFSATMPSWVKKLSRRYLNNPLTIDLVGDQDEKLAEGIKLYAIPLTATSKRTILSDLITVYAKGGKTIVFT

SEQ ID NO: 43499 - protein, 224 aa, Sorghum bicolor
  Clone ID: SORBI-28MAY03-C44607_1.pep
MGRRPARCYRQIKNKPYPKSRYCRGVPDPKIRIFDVGQKKRGVDEFPLCVHLVSWEKENVSSEALEAARIACNKYMAKHAGKDAFHLRVRAHPFHVLRINKMLSCAGADRLQTGMRGAFGKPTGTCARVAIGQVLLSVRCRDAHAPQAHEALRRAKFKFPGRQRIITSGKWGFTKFSRAEYLRLKSEGRVVPDGSNAKLLTWHGSLANRQHGRAVYPPSVAGSA

SEQ ID NO: 43500 - protein, 310 aa, Sorghum bicolor
  Clone ID: SORBI-28MAY03-C45_1.pep
EGIQERSRMFRARGLQRLLKPASSGFLVNGGFFSSLAADSQRLAGKVAVITGGASGIGKATAAEFVRNGARVIIADVQDDLGHAVATELGADAVRYTRCDVTDEAQVAAAVDLAVQLHGRLDVMYNNAGIGGDMAASSLGAIDLADFDRVMAVNARGVLAGVKHAARVMVPRRTGSIICTASTTAVLGDMAPTPYCVSKVAVVGIVRAVAGQMARSGVRVNAISPHAIPTPLAMATMAQWFPDRSVEEHRRILERDMNEMAGPVLEAEDIARAAVYLASDEAKYVNGQNLVVDGGYTVSKALNMPAPAAR

SEQ ID NO: 43501 - protein, 246 aa, Sorghum bicolor
  Clone ID: SORBI-28MAY03-C45031_1.pep
LFFFFSQGEGEARPRYHNTTTRGRTRPPLPPHIPVPCAGAGLLRTGLQIRRHSGLGIQATLGLILCVDHLLLSMETTEPLQDIMCEFRAGKMSLEGTRVVPDTRKGLVRVGRGEEGLVHFQWLDRGQNIVEDDQIIFPDEAVFEKVTESSGRVYILKFKHDSRKFFFWMQEPNANGDAQTCMQVNAYINRPLDAEADLRVPIEAEMSEDTADDDISSRAGNLVESMTADLAGEVTSAAGPVRLEDL

SEQ ID NO: 43502 - protein, 146 aa, Sorghum bicolor
  Clone ID: SORBI-28MAY03-C45164_1.pep
MISEPLDGGGGVGPSRQLGGLPVSGEHHRGAGWPLAARENQTLREGMDSMKQRVAELEKECSAMREDIERLGRSRSASKSRFPFALTAKPVCSTKDKEAAPESSKSKAKAAATGSEDKLAVVKGGAATDGAAQPKHRKHKMNLSAC

SEQ ID NO: 43503 - protein, 205 aa, Sorghum bicolor
  Clone ID: SORBI-28MAY03-C45290_1.pep
PQVHSWADAAALIAPCRTPTGSRVQRPARTPGITPPGSTPTWRRTSGCCPSATPSPHPSRNLAAIKEFTPGPIEMRFCEDSASQHKPSLNYWFRARGKLSDDQALHRCVVAYASDLLYSGVSLNPHREKGLKTYSLSLDHSIWFHKPVKADEWLLYVIESPSAHGGRGFVTGRMFNRQGELIMSLTQEALIRKEKPRGRNLRPKL

SEQ ID NO: 43504 - protein, 152 aa, Sorghum bicolor
  Clone ID: SORBI-28MAY03-C45454_1.pep
PEVDCYDLFSAVAGPDCCLNTSTTCIFLQHGPQSTSIKNMIHMSQLVRKSSIRKYDYGNEKENMKHYNQTRPPAYDLSSIPRHVPLFFTHGGQDFLGDVPDTRHLLRTIIREHDSDDIEVMYMPDYAHGDFVMGYNAPQLIYKPMVEFFKRH

SEQ ID NO: 43505 - protein, 147 aa, Sorghum bicolor
  Clone ID: SORBI-28MAY03-C74220_1.pep
NDESRFHTVAYLSQIWWFEVRGEVDFFFPEGTYSLFYRVHLGRPFKRLGRRVYSSEHIHGWDIKPVRFQMSTSDGQHVQSKCYLTDPGIWINHHVGDFIVKDSSRPINIRFAMIQIDCTHTKGGLCVDSVVVKPQYLTQKKAPWTYV

SEQ ID NO: 43506 - protein, 83 aa, Sorghum bicolor
  Clone ID: SORBI-28MAY03-C40323_1.pep
SEHVLSPSPDLPDRDHAESQSAGLWWPVGVGGDWAAAEDGFMVDVDVDDGSSLFGPPSPGLPFARVDAAAFGDMLASYLHKPF

SEQ ID NO: 43507 - protein, 303 aa, Sorghum bicolor
  Clone ID: SORBI-28MAY03-C40992_1.pep
MATTTAARAPPLLVAAVAVAVAVLVEVATAAAPRKPVDVPFQKNYVPTWAQDHIHYVDGRREVQLYLDKSTGTGFQTRGSYLFGHFSMHMKLVGGDSAGTVTAFYLSSQNSEHDEIDFEFLGNRTGQPYILQTNVFTGGKGDREQRIYLWFDPTKEYHSYSVLWNLYMIAFFVDDVPIRVFKNTSSDLGVRYPFSQPMKLYSSLWNADDWATRGGREKTDWSNAPFVASYRGFHVDGCEASAEARYCATQGARWWDQPEFRDLDAAQYRKLADVRRRYTIYNYCTDRDRYAAMPPECARDRDV

SEQ ID NO: 43508 - protein, 141 aa, Sorghum bicolor
  Clone ID: SORBI-28MAY03-C41085_1.pep
YYKTNGHDRCYGNSTGPPCTGWVEMMVPVFSRAAWRCAWHMIQNDLVYAWGMDYKLGYCAQGDRSRNVGVVDSEYVFHRGIPTLGDDGKATVSASSLGRDRLAVRQRSYTELQVFNRRWKKAVAEDGCWTDPYPKSAATTA

SEQ ID NO: 43509 - protein, 206 aa, Sorghum bicolor
  Clone ID: SORBI-28MAY03-C4117_1.pep
TSAHASDLFKLASVAQLSFNRVVDILGKTFGRRHRVRVPQGAMGWQGPPQSPGSYIVKKILRLEVPTETYPNFNFIARLLGPRGNSLKRIEASTGCRVFIRGKGSINDSGKEEQLKGRTGYEHLSEPLHILIEAELPANVIDARLAKAQEILEELLKPVDESQDYYKRQQLRELAMLNSPLREESPHPGGAPPSPFSNGGMKRVKQ

SEQ ID NO: 43510 - protein, 191 aa, Sorghum bicolor
  Clone ID: SORBI-28MAY03-C46210_1.pep
LRPQQHFSPCPGFRIVVLDAYDFSCLGWPNDHPVTAAAMKLLDEKNPNTDKNSPDGLVGVDRRFVKFNGAVGKEQLSWLNGVLQDASTHHQNVIICSHLPMDPGASSPAALMWNYDEVMAIVHRYNCVKACFAGHDHKGGHSVDSHGVHHRTLEAALECPPGTSAFGHVEVYPDRLLLVGVDRMANTEIPF

SEQ ID NO: 43511 - protein, 217 aa, Sorghum bicolor
  Clone ID: SORBI-28MAY03-C47713_1.pep
MEALMATDKCFSPARAMSPMPIMRPTPTPSPEHASQYLEDLLQEQQKLGPFMQVLPICGRLLNQEIMRISNLLSNSGVRGNERLPPIASPNHMHPLPRVPNFCGNGFGPWNGMHPERNGFPRGAMGWQGAVQNHSSYIVKKIVRLEVPTEAYPNFNFIGRLLGPRGHSLKRVEATTGCRVFIRGKGSIKDPVKEEQLKGRPGYEHLGDPTHILIEAE

SEQ ID NO: 43512 - protein, 320 aa, Sorghum bicolor
  Clone ID: SORBI-28MAY03-C4790_1.pep
MGILSLITGKAGASGFGSASTAEQVTDGVDASRLTVVITGGASGIGLETSRVFALRGAHVVIAARNTEAASEARKTIMEKNPTARIDVLKLDLSSLKSVRAFADQFNSMKLPLNILINNAGVMFCPFQLSKDGVEMQFATNHLGHFLLTNLLLDTIKATAKSTGIEGRIVNLSSVAHHHTYPKGIDFDKLNDEKIYNDKMAYGQSKLANLLHANELSRRLKAEGANITVNSVHPGLIMTNLMRHSFVLMKVLQVATYILWKNVPQGAATTCYAGLNPQLKGVTGKYFADCNVEKTSKLARSEELAKQLWDFSEELIKSAK

SEQ ID NO: 43513 - protein, 144 aa, Sorghum bicolor
  Clone ID: SORBI-28MAY03-C48033_1.pep
TDDGDSVLELLKVGGVYKQSSDMDKKKVLLGESMVTVVRTDDGGALDLIEERVAYWCKVKLDLSAMYDKLETEAAGAKSGGDVTEALALREASVEAINRAMYHDIYNAVLLALKLRRGGDSGNGGSSAMENSPPTPLHPAKTPV

SEQ ID NO: 43514 - protein, 169 aa, Sorghum bicolor
  Clone ID: SORBI-28MAY03-C4828_1.pep
SYSHHLDSDIGVSVVDRFTYYTLAFFEKLNMYSNASLNSLFTSYNPSMLMSTAYYRMDLYERPLNEVPVTNFFGSVMKTLHTDSAYTGFLAAHDNETPMDIGDNLDDQFMLKDRATARRSNIEKEAQLTPHGWTEVLLEQLEGRNTDTVVIYGLGAMGILLALSTWLSM

SEQ ID NO: 43515 - protein, 310 aa, Sorghum bicolor
  Clone ID: SORBI-28MAY03-C47356_1.pep
MDSRPRETDAPGDPANGAAPPQAAAVTSATATGDVEIIRPRNDKRGYRRVVLPNSLECLLISDPDTDKAAASMNVSVGYFCDPDGLEGLAHFLEHMLFYASEKYPEEDSYSKYIAEHGGSTNAFTSSEHTNFYFDVNSDSLHDALDRFAQFFIKPLMSPDATLREIKAVDSENQKNLLSDPWRMSQLQKHLCAENHPYHKFSTGNWNTLEVKAKEKGLDTRLELIKFYDSHYSANLMQLVVYGKDSLDNLQNLVENKFCDIRDVGRKPFSFPGHPCTREHLQILVKAVPIKQGHTLRILFPITPNIRRYK

SEQ ID NO: 43516 - protein, 164 aa, Sorghum bicolor
  Clone ID: SORBI-28MAY03-C11834_1.pep
CIVYMRTDMSISKSSPSYLAKLQWDEVQATVQKIQGIFEQCLAVHDKLEASLRDLSRTGDIQSCKAARKAADAQFKELSKDLKPLLMTLQSSPQSYQIWPKVEDLIAKEREMQEKLMTRHSTVVDSFEKKLRGQDVENRIALQQQKVAALRQEVESLLEYISEI

SEQ ID NO: 43517 - protein, 154 aa, Sorghum bicolor
  Clone ID: LIB3478-035-P1-K1-A2.pep
MSISKSSPSYLAKLQWDEVQATVQKIQGIFEQCLAVHDKLEASLRDLSRTGDIQSCKAARKAADAQFKELSKDLKPLLMTLQSSPQSYQIWPKVEDLIAKEREMQALIQYPDITTAAVAKQALEGHCIYDGGYCKLHLSYSRHTDLNVKAHDER

SEQ ID NO: 43518 - protein, 185 aa, Sorghum bicolor
  Clone ID: SORBI-28MAY03-C12261_1.pep
MAPSAALAPAAFRSAFSTPLASNPTRNRINIEGAFCLPCSTRKRASYRPFRVYSLFGGKKDKDENGDEPSKAGIFGNMQNLYETVKKAQMVVQVEAVRVQKELAATEIDGYCEGELIKVTLSGNQQPIRVEITEAAMELGAEKLSELVNDAYKDAHQRSVQAMKERMADLAQSLGMPAGLGDGLK

SEQ ID NO: 43519 - protein, 241 aa, Sorghum bicolor
  Clone ID: SORBI-28MAY03-C12380_1.pep
LDMIKGNNIQVLMDSHLEGNYSTDEATTLVDLASQCLQYEPRDRPNTKKLVSVLEPLQIKSEVPSYEMLGIPRYEEEASPPPQPQHPLSPMGEACSRMDLTAIHQILVSTHYRDDEGSNELSFQEWTQQMRDMLEARKRGDFAFRDKDFKAAIDCYTQFVDVGTMISPTVYARRSLCHLMCDQPDAALRDAMQAQCVYPDWPTAFYMQAVALSKLNMQSDATDMLNEASQLEEKRQKNTKP

SEQ ID NO: 43520 - protein, 218 aa, Sorghum bicolor
  Clone ID: SORBI-28MAY03-C12503_1.pep
RPGRAYGSTSRFDFQNAIEKLPNNIFEKSYPLREFDLPKRISAFFYKAAELSLVGFVAGSVQGGMSKVLSARKERRLSVTIPSISTNALGYGAFLGLYANLRYQLLCGLDQYMVKRFDVLGVAIFFSTAARLMNIQIGEASRRTWLGEEADPQYSDRLLRAYKRPVEVYMDQQDSRWFISKDAIVSGLGLLGIKQGGPEAALSKPRRKRVVRKKVASG

SEQ ID NO: 43521 - protein, 202 aa, Sorghum bicolor
  unsure (1)..(202): unsure at all Xaa locations
  Clone ID: SORBI-28MAY03-C50931_1.pep
MAAAAPPLLLAGLALAVVAAAVWPSLAAAPAALQDPAELLRRAKEPAFADWMVGVRRRIHENPELGYEEFQTSELVRRELDALGIPYRHPFAVTGVVATVGTGGPPFVALRADMDALPLQESVEWEHKSKVPGKMHGCGHDAHVAMLLGSAKILQEHRDELKGTVVLVFQPAEEGGGGAQKMIEAGALXNIDAIFGLHIADS

SEQ ID NO: 43522 - protein, 430 aa, Sorghum bicolor
  unsure (1)..(430): unsure at all Xaa locations
  Clone ID: SORBI-28MAY03-C51133_1.pep
SESDVTWEWMERWTALIPPITVEHLPARGENSELGETVTEQVTELSQCDEDIVELDSDLSFPKLVADDVKEKVETSDSSALEAPASVPDESPKMEIKHDPESELIETTNVDAEQVTDQKADNDVDEFFMSLDQQYTQADASRDPCPLPGKFESSNEDSGDAYNSEQTQEMEGKRFVARKSCNPAFAAAQLKFEELSTNSTVSRSNSSSHLDGVNKSRVHTPSSQEDYSSKQDGTGIQESSVGHDTKMIVAASECGTEISISSTLDSPDRSEGDGGEIVMEIGALENRNYVTGKADKDSNIVHSEVKSAPEVEAQPQKEVEQNGHVPALEIEAQPQKELVQESHVEPEMSADLHEQFEKSVASYATPEGTPMSRTTIAESHGTPSSEVSVNTKKSRSKKPKSHASKRSLASPGSESVGRSSTDNFSXESRH

SEQ ID NO: 43523 - protein, 196 aa, Sorghum bicolor
  Clone ID: SORBI-28MAY03-C51139_1.pep
IPRTRLMRDGAQAPRGGGGFFSARSLSNYMRIVSSGASTAASTLRSAGASLVNSMANHEEDSSRDQVQWAGFDKLECGGGLLRQVLLLAYKSGFQVWDVEHADDVRQLESRHDGAVSFIQVLKDPIFTTNSGDRFADAWPLLALACEGTHTGSGNNHDTNVPVFDGTNGAFHSIGSENLPTVIRFYSLRTHEYVHT

SEQ ID NO: 43524 - protein, 250 aa, Sorghum bicolor
  Clone ID: SORBI-28MAY03-C51159_1.pep
MAAAAAAADADAAEVERLYELGERLSSAKDKSEHAADYEAIIAAVKGQSVKAKQLAAQLIPRFFRSFPALATRAMSAMFDLVDMEELAIRIQAIRGFPLLGKDTEFVSKIADVLGQLLTSEENVERDAVHKALMSLIRQDVKNSLQPLFKHVEQGSEIREKIISFLRDKVFPLKAELLKPQAEMERFITDLIKKSVQDVTGSEFELFMGFLRSLSIFGDTAPRESFQELIEIIQAQADLNSQFNVSDIDH

SEQ ID NO: 43525 - protein, 322 aa, Sorghum bicolor
  Clone ID: SORBI-28MAY03-C51165_1.pep
MAMATSCGSMTKPPITFKTPFVNKQASNWIPATISNGTGGMFTVASRNSRNGFQVRAVTGDPGSRNASDVKFPTDYTQLLMQAKEAAESAFKDGKQLLEIEFPTAGLQTVPGDGEGGNEMTGSMLLIREFCDRFVPAEKSTRTRVFFPEANEVSFARQSAFEGCSLKLDYLTKPSLFEDFGFTTKVKMADRVKPEDETFLVAYPYFNVNEMLVVEELYNEAVVGTNRKLIIFNGELDRIRSGYYPSFFYPKLAELSKTFLPKLDTVYYIHNFKGVKGGTLFRCYPEPWKVLRKASSGSYICLHQQEEMPSLKEVALDILPSV

SEQ ID NO: 43526 - protein, 169 aa, Sorghum bicolor
  Clone ID: SORBI-28MAY03-C45586_1.pep
DMGAGAVNAARALDPGLVFDAGYSDYLRFLCAVPGVDNAAVLRAVGAPCPPPPSPRAGAGAARWCTDLNAASVTVASLLGSRRVDRRVTSVGAQNETYMAYVRAPGGVAVRVSPSQFAIAPGAARTLRIVLNTTAPGNAFSFGEVVLKGDKKHRVRIPLAVYPAAALSP

SEQ ID NO: 43527 - protein, 366 aa, Sorghum bicolor
  Clone ID: SORBI-28MAY03-C45708_1.pep
HEERFGQSPVFIASTLVEDGGLPQGAAADPAALIKEAIHVISCGYEEKTEWGKEIGWIYGSVTEDILTGFKMHCRGWKSVYCTPTRPAFKGSAPINLPERLHQVLRWALGSVEIFMSRHCPLWYAYGGRLKWLERFAYTNTIVYPFTSIPLLPDGTIPAVCLLTGKFIIPTLNNLASIWFIALFLSIIATSVLELRWSGVSIEDWWRNEQFWVIGGVSAHLFAVFQGFLKVLGGVDTSFTVTSKAAGDEADAFGELYLFKWTTLLVPPTTLIIINMVGIVAGVSDAVNNGYGSWGPLFGKLFFSFWVIVHLYPFLKGLMGRQNRTPTIVVLWSILLASIFSLVWVRIDPFIPKAKGPILKPCGVEC

SEQ ID NO: 43528 - protein, 176 aa, Sorghum bicolor
  Clone ID: SORBI-28MAY03-C45742_1.pep
MAQDIYLLFLILFIALNLQSVLSWRMQNSTNDINSDDQCPPQPHPLGMCNSRVAAYGYPCEEYNVTTDDGYILSLKRIPHGLSNATGNSTENTRQPVLLFHGLMVDGFCWVLSTPKQSLGFILADGGFDVWIANCRGTRSSRRHTTLTPEDPAFWDWTWDQLADYDLPAVLQFIYN

SEQ ID NO: 43529 - protein, 79 aa, Sorghum bicolor
  Clone ID: SORBI-28MAY03-C46082_1.pep
RANMSTPVSPCSSPLRQFKQTNARCMRSPPHPMLSPGLGNTLSYTQNQTRRIPAPAISDPWLDVGQMKLQTPNISPKRF

SEQ ID NO: 43530 - protein, 461 aa, Sorghum bicolor
  unsure (1)..(461): unsure at all Xaa locations
  Clone ID: SORBI-28MAY03-C46685_1.pep
MWRLKVAEGGGPWLKSCNNFRGRVVWEFDPELGTPEERAEVERVRREFTERRFEKRESSDLLLRMQYAKHKHLQVDPPPTKLAENVEVTEEIILAALRRALDQHSSLQAEDGCWPADYSGILFIMPLLVFALYTTGSLDTVLSKEHRREICRYIYNHQNEDGGWGKQVLGPSTMFGSCLNYVALRLIGEKPTNAALTKGRQWILSHGSAAAIPQWGKIWFSVMGLYDWSGNNPIVPELWLVPHFLPIHPGRFWVFCRMVYLPMAYLFGRKFIGTITPTILELRDELYSVPYSEVDWEKARDTCAKVDLIYPRTMAQNLVWTCLNKVIEPMLNCWPVNKLRDIALKNIMKHIHYEDETSKYICTCPINKALDMICCWAENPNSDSFKKHLPRIYDMLWIAEDGMKAQVYDGNPTWETSFIVQAYCSTGLVNEIGSTLRKAHEFIKSSQICENHPDYXTYYRH

SEQ ID NO: 43531 - protein, 103 aa, Sorghum bicolor
  Clone ID: SORBI-28MAY03-C53530_1.pep
NNNNKLNSSHLNYLPHTNAACSDYVVVANNNYDNGVNKRKRMMMMTAAGAMDEGAGSNGFSKKLKAVLPTDSKNSSYCNQQVVDTSGLFQYSSLLSYPFLEMQ

SEQ ID NO: 43532 - protein, 155 aa, Sorghum bicolor
  Clone ID: SORBI-28MAY03-C53712_1.pep
TRQIAHKLKEISMQAKDRQKKRRAKGIKVDKEGDLTLEDLDDATATATADAARDKTTSKKKKSSHKKHTNTHDNDNTDKNGEPDAGGDQLGSSHTENEQIAEPRPKRSKRLMKSITDDKELAAAAVVPEEPANEAENHRTHDYDGTEEVQDGTPA

SEQ ID NO: 43533 - protein, 103 aa, Sorghum bicolor
  Clone ID: SORBI-28MAY03-C53484_1.pep
ERTEPSTPAPTSESPTQVGASNRDPGDRTEGTKSTCHEPLTPDSNCQNGSPVASPNHERAAKRQRGSGTEFLDSESEFSLPRHIFESSSGSEFQQYSMSYSGQ

SEQ ID NO: 43534 - protein, 107 aa, Sorghum bicolor
  unsure (1)..(107): unsure at all Xaa locations
  Clone ID: SORBI-28MAY03-C5396_1.pep
EQAERDRXGDSLDFEIKRWSAGKEGNLRALLSTLQYILWPECGWQAVSLTDLITGAAVKKQYRKATLCIHPDKVQQKGATLQQKYIAEKVFDILKEAWNKFNSEELF

SEQ ID NO: 43535 - protein, 121 aa, Sorghum bicolor
  Clone ID: SORBI-28MAY03-C5401_1.pep
MASTGRSMLLSLLLFAVTLSLLEMYRAKFASSELMTIAGGFVCSLLFLLLLTFIGNYQEASGDRTGWGAVVVAQLVALIVAGTVHRVCITTCFLFSAGLLYEVDKLSGMILARSESKVRRH

SEQ ID NO: 43536 - protein, 256 aa, Sorghum bicolor
  Clone ID: SORBI-28MAY03-C5638_1.pep
MDGGGSGPAPNAARTADEVFRDYKARRAGMIKALTTDVERFFKLCDPEKENLCLYGYPNETWEVTLPAEEVPPEIPEPALGINFARDGMNEKDWLALVAVHSDSWLLSVAFYFGARFGFDREARRRLFSMINNMPTIFEVVTGAVKGQPLHGAPGSSSKSNKPSSKVQSRAESRSKAKVPKDEEESGDDDGDEEAEEHDNTLCGTCGTNDGKDQFWICCDNCEKWYHGKCVKITPARAEHIKQYKCPDCTNKRARA

SEQ ID NO: 43537 - protein, 300 aa, Sorghum bicolor
  Clone ID: SORBI-28MAY03-C48323_1.pep
MAGQQMPGWPRQQKEAAAVSMVQLSTFTRVPSIPRDQSYRDFPVTVRVTAAPPDFVQGERTLVDVVAAIDLRWSMGFDDKYGPRPNDRLVRVKEAMAKVIDNLGVDAQNRLAVVGFNQEVATSTELLEMTAQGQQSAIETVNALKVLGRPSTFSVGLNEAKKILDGRSLAEKRRSLGFIIFVSNGDDVTFLEKDIPTAYPIHAFGLTAQHSPSKLKAMANQTLGSYTPIENDDLETKLAEKLDQLSVRLTSVVAVDTTIDLTTLHHGVVVSKLESSWAYNDALVFYKSEIGGGKTSGKVV

SEQ ID NO: 43538 - protein, 180 aa, Sorghum bicolor
  unsure (1)..(180): unsure at all Xaa locations
  Clone ID: SORBI-28MAY03-C48492_1.pep
MDPAAPGRFDRLQSSFKISVQCLLTACSREXVVNEAFSSFTDAEKARLHLMVTLVLKNMHVNIMDEFNDFCEETQVAAALDKIDDFVEEQNLDALASEKTTVEEIQEKVSRAKKDEVEHLTGLLKKVEKSKNAMKARIELLKKGEDSTAATDVLNKLTRWNSALVLCHDEPLTLCAPEQQ

SEQ ID NO: 43539 - protein, 231 aa, Sorghum bicolor
  unsure (1)..(231): unsure at all Xaa locations
  Clone ID: SORBI-28MAY03-C5042_1.pep
MATVPVVLVLHVLLGAAAAACAVAVDAAAAAAGSSKVAAAGSSKVPAIYVFGDSTADVGNNNYLPGGGVPRANFPHNGVDFPTSRPTGRFSNGYNGVDFLASSLAFHRXPVNFAXAGSGILDTTGSSIIPLSKQVEQFAAVQRNISSRVGTGAAGTLLSRSLFLVGXGGNDLFAFFSRKNSTPSDADKRRFVANLVALYQNHVKALYVLGARKFAXIDVPPIGGGAYPSLH

SEQ ID NO: 43540 - protein, 172 aa, Sorghum bicolor
  Clone ID: SORBI-28MAY03-C4932_1.pep
MNRKPGDWDCRSCQHLNFSRRDICQRCSEPRGVADRGSGGGGDYANFGGRGGSSFGGGFGAGSDVRPGDWYCSCGAHNFASRSNCFKCSAYKEEAAVNSGAGGFDSDMSRSRGYGFGSGAARTNRPGWKSGDWICTRSGCNEHNFASRMECFRCNAPRDSGSAAMTYENYLH

SEQ ID NO: 43541 - protein, 206 aa, Sorghum bicolor
  Clone ID: SORBI-28MAY03-C50428_1.pep
RIIQKEQYCESESIVATRENLLIDPSCGAESIDVSDVLESLMEERGETSYMPGSVEDFLAASAEEEVQYSSPIALSPWGEPNYYQGDAVDSALWGIQDDMWSLLSPRPMLQPSSGIGTEKETYDINEVAVTHVNSELFQRGSAIADEGVNSPDNANRGSQLSHHHRGRYSQISESWLLSSNHSRSRSDRFGSGGSSRSTSKGQSRG

SEQ ID NO: 43542 - protein, 461 aa, Sorghum bicolor
  Clone ID: SORBI-28MAY03-C57335_1.pep
HEGFFGGPSSPAAPADPSSRPATSTGPPPSCAGAAPYRPGAALAFAAAPSCPPGRPSQHLFLHPRRSVLVRSSGRPFIATCFVHHAPSVGCRLGTTPKWGHLRDVHKAIKLCEPALIATDPSYTSLGQNAEAAVYKTGSVCAAFLANIDGQSDKTVTFNGRMYRLPAWSVSILPDCKNVVLNTAQINSQVTSSEMRYLESSNMASDGSFITPELAVSGWSYAIEPVGITKDNALTKAGLMEQINTTADASDFLWYSTSITVKGDEPYLNGSQSNLVVNSLGHVLQVYINGKIAGSAQGSASSSLISWQKPIELVPGKNKIDLLSATVGLSNYGAFFDLVGAGITGPVKLSGTNGALDLSSAEWTYQIGLRGEDLHLYDPSEASPEWVSANAYPINQPLIWYKTKFTPPAGDDPVAIDFTGMGKGEAWVNGQSIGRYWPTNLAPQSGCVNSCNYRGSYNSNK

SEQ ID NO: 43543 - protein, 79 aa, Sorghum bicolor
  Clone ID: SORBI-28MAY03-C57626_1.pep
GENIEADYHGIRFSAWIHIHISELIFMVGVSQVSKSGRRTHLYQVLVVLDSLVLKAQLLALNIFQKQVTDNYDVFSLNS

SEQ ID NO: 43544 - protein, 323 aa, Sorghum bicolor
  Clone ID: SORBI-28MAY03-C5764_1.pep
MATPGEQKAPAAAAAAEEVVSVEMPAPDGWTKKFTPKRGGRSEIVFVSPTGEEIKNKRQLSQYLKAHPGGPASSEFDWGTGDTPRRSARISEKVKVFDSPEGEKIPKRSRNSSGRKGRPGKKEATKTEEAKDAETGEEAEEAPTEDATKETDVEMKRAEEAKEASAETEDTEKSADKADDAPAPAPMEEAPAPAPMEEDKKETEKPAESVVALPAPTEDKKGDAKPAEHEAVAPAPVSNPTENSAPAPAEPAVVPAPAPETKSDAEPVAVDAPAPETKSDADLAAVTAPAPEAKLDAEPAAVVAPASETKPDAEPAAVTAPAP

SEQ ID NO: 43545 - protein, 235 aa, Sorghum bicolor
  Clone ID: SORBI-28MAY03-C57732_1.pep
ARRGAGRGEPKTARGPNRIPPPERRTPVPRPAMEMGGMSDAERLFFFEMACKNSEAVYEQNPNDADNLTRWGGALLELSQVRAGPDGLKLLEDAEAKLEEALQIDPNKSDALWCLGNAQTSHGFFTPDTAIANEFFAKATGCFQKAVDLEPANELYRKSLDLSTKAPELHLEIQRQMVSQAATQASSASNPRQSRKKKKDSDFWYDVFGWVILGAGIFAWVGLARSMPPPPPPAR

SEQ ID NO: 43546 - protein, 451 aa, Sorghum bicolor
  Clone ID: SORBI-28MAY03-C58277_1.pep
MAGVLLIIVLTFLLVLPSATAIGQVCGNAGNYTANGTYQSNLASLVAALSTNISSSSQAQLFANATAGKAPDVVYALALCRGDITSSNLTGCAACVNNSFAYAHKMCPYAKAASVYDDDCLVGFSSSNILVPANNITRDMSTLFQYWNPTSITGDATVVAADVNDLLTQTAQVAAASPRRFATAFMDASSSSIPTLYSLAQCTPDLSAGDCLACLQRIVGVINATTSVRLGGRVLVLRCNFRFENMMFYEGAATTRITPSSSSSGPPASPFPAPTTNKRMKPWVIAVSAAPPLAVVALCFIFYCRWRSRRYIKGRPRLRRKPWDNKLRGGDEPDWEMEADLSEFSVFDFHQILEATGNFSEENKLGEGGFGPVYKGQFPEGVEVAVKRLASHSGQGFIEFKNEVQLIAKLQHTNLVRLLGCCLQEEEKILVYEYLPNKSLDFFIFGMYCSF

SEQ ID NO: 43547 - protein, 217 aa, Sorghum bicolor
  Clone ID: SORBI-28MAY03-C5832_1.pep
RPPSERVLSLSVWSSSQPPEFSYGSKRQQGTEVSAEKQRLAASLFGSAAAKADRKAQASRKTAKDSPSTEKVATTNVTAQPVKEQVIPAAPPPDLLDLGDEPVSSNPPLADPFSQLEGLLGPASAAPVLSGTPATGASKAPDLMSIFSDDVPTGVASGSTDPTLGDVNSTSSHKGATAVASKKGPSLQDALQKDATARQVGVTPTGNNPNLFKDLLG

SEQ ID NO: 43548 - protein, 170 aa, Sorghum bicolor
  Clone ID: SORBI-28MAY03-C51292_1.pep
SSPVVGTSLPRGPHPALRSLGLRGARAVDPARCLGAPSVRTPRWSTGGAAPRPQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGERA

SEQ ID NO: 43549 - protein, 372 aa, Sorghum bicolor
  Clone ID: SORBI-28MAY03-C5260_1.pep
EGVISLIFEKAVFEPTFCPMYAQLCSDLNVKLPTFSPEEPDGKEITFKRVLLNNCQEAFEGASSLRAEIAKLTGPDQDMEVGDKERLVKLRTLGNIRLIGELLKQKMVPEKIVHHIVMELLGSGPDKKPCPEEEDVEAICHFFNTIGKQLDENPKSRRINDTYFIQMKELTMNPQLAPRLRFMVRDVIELRSNNWVPRREEIKAKTISEIHSEAEKNLGLRPGAASVIRNGRSSPGGPLSPGGGFPMNRPGTGGMMPGMPGSRKMPGMPGLDNDNWEVPRSRSMPRGDSIRNHGPLLNRPSTVQKASSINTRLLPQGSGAALIGKSALLGTGVPPSRPLSFTPGPGPAQTTPSPKPLIAGPAVAPAPDKPSS

SEQ ID NO: 43550 - protein, 124 aa, Sorghum bicolor
  Clone ID: SORBI-28MAY03-C5254_1.pep
KIPLIFGERRPGDAEILFSETTKAERELNWKAKYGIEEMCRDQWNWASKNPYGYGSLDSTKQNGHQTNGSADSSKQNGHHTNGSTDSPKRNDHYAYGSADSPKRNGHYVYGSSDFKQNGNGHLR

SEQ ID NO: 43551 - protein, 131 aa, Sorghum bicolor
  Clone ID: SORBI-28MAY03-C52856_1.pep
MLAMVVAPAAGWLGPRDTVIIDATLGELAKLFPDEIAADQSKAKILKYHIVKTPRSVYKTVPNCEPCRPLQRSPIEGFYLAGDYTKQKYLASMEGAVLSGKLCAQSIVQDYSRLALRSQKSLQSEEVPVPS

SEQ ID NO: 43552 - protein, 177 aa, Sorghum bicolor
  Clone ID: SORBI-28MAY03-C53081_1.pep
FWMARLNEGLSLFDAILIVPMFQIAWTFFSICTGFVYFQEYQVFDTLRIIGCGLGLTCVLAGISLLAPDDSKADTKGDSSTTEDSIIDVDRNGKMQMEETDTDDSNSFVTSVKVKAKRVLLKAKSACSMSLGLGEDTISASSVLAMPMVSSRTTGFRGIGNDRSKYVPLRTTDWSNL

SEQ ID NO: 43553 - protein, 422 aa, Sorghum bicolor
  Clone ID: SORBI-28MAY03-C59597_1.pep
MEALAIGSAPPRPGLAALARYSHLRRPGTVTGTLVTAARRPVTAASMDAAAGGRPSPAPIRCTSAETDAEVEVDEVATSSHAAGATTDTEQGGNGSPVAGAADSAEVVPGVDGIRIRRRPVTGPAVHYVGPFQFRLENEGNTPRNILEKIIWDKDVEVSQMKERRPLYMLKGPLEAAPPARDFVGALKASYDRTGLPALIAEVKKASPSRGVIRENFDPVQIAQAYEKNGAACLSVLTDEKYFQGSFNNLEAIRNAGVQCPLLCKEFIVDAWQLYYARSKGADAVLLIAAVLPDRDIKYMLKICKILGMAALVEVHDEMEMDRVLGIDGVQLIGINNRNLETFEVDITNTKKLLEGERGQIIAQKDVIVVGESGLFTPDDISFVQNAGVKAVLVGESLIKQEDPGKAIAGLFGKDISHAGAT

SEQ ID NO: 43554 - protein, 112 aa, Sorghum bicolor
  Clone ID: SORBI-28MAY03-C59773_1.pep
LQYNSVTCGSSLLTALTSLKLISGSSPTKTLFLLVLLDVLYAAIMASATGSAGGVAWIGLKGNTHTNWTKICNIYGNFCRHIGSSVFLGLVASVILVLLTILNAYCLYRRSR

SEQ ID NO: 43555 - protein, 214 aa, Sorghum bicolor
  Clone ID: SORBI-28MAY03-C5961_1.pep
MSRHPEVKWAQRIDKVYITVQLSDAKDAKVNLEPDGVFTFSGSVGTNVYELKLDLNDKVNVEASKISVGVRSIFCIVEKAEAKWWKKLVRDDQRAPHFVKVDWDKWVDEDDDGTDVNLDGMDFSNFGGMGGMGGMGGMGDMAGLGGLGGLGGMGGLGGMGGLGGMGGMGGMGMDDFEDESDDEEEVSKPQAAGKAVEAEKTESAEGKTEAAQSS

SEQ ID NO: 43556 - protein, 286 aa, Sorghum bicolor
  Clone ID: SORBI-28MAY03-C6009_1.pep
RPGRVQKEKQKIEEEENKLKAAIEEAEKQYSEVSSEMKDLEIKSEQFEELEERYWHEFNSFQFQLASHQEERDAVFAKIEVSQVHLELLKRTNVLNDAFYISHDGVIGTINNFRLGRLSNVEVEWDEINAAWGQAALLLHTMAQYFTPKFQYRIKIHPMGSYPRVTDIHNNTYELFGPVNLFWSTRFDKAMTWFLTCLQEFAEFAISLDKENNVPPEKSLKLPYKIDGDKVGSHTIVLSFNKNENWTKALKYMLCNLKWVLYWFIGNTSFAPHSGSLHTQSLKNKS

SEQ ID NO: 43557 - protein, 147 aa, Sorghum bicolor
  Clone ID: SORBI-28MAY03-C60168_1.pep
NNSADNEWADLATAHAAGDLVGDDQAGGHPAGEHRPHHVHDAGREPPRHRHPCSLSPLHQPPPRRQFHKHRPSYPSERKNRCKFLRLAPDLRIQLGSYAPAIGKKYCVHKRFGWISLPPLPPNPCFPLFTPSPVLRATKARIRTDEL

SEQ ID NO: 43558 - protein, 307 aa, Sorghum bicolor
  Clone ID: SORBI-28MAY03-C61_1.pep
MSAELKRDYEIGAEIGRGRFGVVHRCTSRATGEAFAVKSVDRSQLADDLDRELAELEPKLAQLAGAGNPGVVQTHAVYEDETWTHTVMDLCAGPDLLEWVRLRRGAPVPEPLAAAIVAQVAQALALCHRRGVAHRDVKPDNILIDTAPAGSDDGEDEEEDSGEAEEAETAPRARLADFGSAAWVGAGGLGRAEGLVGTPHYVAPEVVGGGEYGAKADVWSAGVVMYALLSGGALPFGGETAAEVLAAVLRGSVRFPPRLFSGVSPAAKDLLRRMICRDEWRRFTAEQVLAHPWIVSGGGARAIERPT

SEQ ID NO: 43559 - protein, 181 aa, Sorghum bicolor
  Clone ID: SORBI-28MAY03-C54365_1.pep
MSTATAALAAARSPAVALLSLRRRAHAAAPIRFPGLRVGSGCRHVAMASAAHARAPTDPLPKGADSFFRAVISNMEKVYLSRNPTAKTILELVRSYDGDHICYDHLAFRTFGVNGYGINSLSEFFTDFGYVPREELRFPAKNLRALWFSPPTNGGYSGTGTYGPFPGTCFAHLLGVEWTTM

SEQ ID NO: 43560 - protein, 390 aa, Sorghum bicolor
  Clone ID: SORBI-28MAY03-C5405_1.pep
DQHFTISPCSTSNIAPGQPPPTQPAPSTGGFPGFSNTTNQALMGQPTPSQSSMVMQPAPVSNPFGTLPAMPQMSIGNGGSSPSVQYGISSLPVAEKPLQSRALSMAVPRHLSQRRIKLLPRKYNPISDGKVPFFAEDEESPATPKADAFFIPRENPRNLVIRPIEQWPSRRETDRQLTLKNATYLNKYEDASTESERGKSAMSPSSRPPAVENNNQHEARAMAQHENGNVTSVERLLPKLPRADYFTEPSIEEIAAKERAQAGYCGQVRDFVVGRHGYGSIKFFGETDVRCLDLESIVEFNNREVIVYKDDSKKPPVGEGLNKAAEVTLLNIKCVNKKTGEQYCEGARVERYREMLVKKAEEQGAEFVSFDAAKGEWKFRVKHFSAYGLW

SEQ ID NO: 43561 - protein, 74 aa, Sorghum bicolor
  Clone ID: LIB3476-020-P1-K1-H9.pep
LIIGSTRLTVMADSAAAAAVFSSIAQFASILQQQLKSFAQKVTEPQHDILQKRKAGNLITTTTPKQTNQKKTLL

SEQ ID NO: 43562 - protein, 217 aa, Sorghum bicolor
  Clone ID: SORBI-28MAY03-C57141_1.pep
MSKAAAASLPPPPPEVAHLVEQLQRHHLAPDASLLSNSAHSDLLQAREEVAAERALYLEALAVYAEAVAMVEEYHAAGGPGAGKKLNCSPQVYESLEHRLAVAEAAQRLRLPLLSQDGEVHEQEIEKLSTFSRSSFDSTLTSATPSSSSISTSYNNYSSTASAVTVAAAHGSGSSDAVEPGVGGVPDRFLGITSDYLYQVQQEQPAMSVDMVDYQRT

SEQ ID NO: 43563 - protein, 162 aa, Sorghum bicolor
  Clone ID: SORBI-28MAY03-C5665_1.pep
MDAGRKRTAPEAGANGAGGPKRARESETTQMGVGSKSKPCTKFFSTAGCPFGASCHFLHNFPGGYQAVSKMTNLGGPPVPAPPGRMPMGPGGPDGPPSPAVKTRMCNKYNTAEGCKWGSKCHFAHGERELGKPLQMDNSLGAPPPMGPGPNGHFMPPPMPHL

SEQ ID NO: 43564 - protein, 360 aa, Sorghum bicolor
  Clone ID: SORBI-28MAY03-C6366_1.pep
RMLDMGFEPQIRKIVKQIPPRRQTLMYTATWPKEVRRIASDLLNNPVQVNIGNTDQLVANKSITQHVEVIPHMEKSRRLDQILRSQDPGSKIIIFCSTKRMCDQLARNLSRQYGASAIHGDKSQSERDSVLNDFRSGRCPVLVATDVAARGLDIKDIRVVVNYDFPTGVEDYVHRIGRTGRAGATGSAYTFFGDQDSKYASDLVKILEGANQSVPQQLKEMALRGGYGGRSRRWASSDDSYGGQGYGAKRSTDSFNNSSFGNQAGGGSSFHSSFHNSSSGNQFGDTTSFHGSYDNSSRNNQTGDNASFPPSSSNNQSGDGLSFHERFYGSRGRDQSKTSNDGFRARSRSPPGKPVGVSNW

SEQ ID NO: 43565 - protein, 132 aa, Sorghum bicolor
  Clone ID: SORBI-28MAY03-C63747_1.pep
GLTNSLLAAKKPDQAVDIILLCRQKLNEKSQTGLVDLEAANDNDRQKPQDIDPIQVDLLLGKAYSDWGHISDAISVYDTLITEHPEDFRGYLAKGIILKENGKAGDAERMFIQAKFFAPEAAKALVDRYAQR

SEQ ID NO: 43566 - protein, 452 aa, Sorghum bicolor
  Clone ID: SORBI-28MAY03-C6619_1.pep
WFSREPDQSVVESQRMLMNNMIGSASSSAIKKFVQMLDSKGQSDSEEIRSRAMRIVAHFASEIRLNKIPYGIQCISSFLESLEASISHHRHKETIIDILKKLTDDEENLRLMSNANGLALKIIKMLVDSDGGELHDSKHDRWCSNIAVPGMEVIKRFTSVIKRSNNVQLPRDILESPNAISTLESMLKCPKCKVQEELQKSVIMVLTQITSKETSLAAGEEIKKRLDEVKNRLILSLIAIFLDGGNGKSSVKKLAAGESLAKMSRINENSATILGAEDGRIGSGLTQVVLDKNSEYRKSAADILNHLCSHYTTNEDSRFLKLKKAMIDDVILPVLREVLGCRPTAEPRPPPWYLYLEDNVEEQEALSSLCATVHDILIRQDPNLATQFDQKAEEIGQEMETKEVMTFADLVKKAQDVVDNKRRRQSWVVHPYPPPQYVVCSAEEDPNSCCIS

SEQ ID NO: 43567 - protein, 131 aa, Sorghum bicolor
  Clone ID: SORBI-28MAY03-C66491_1.pep
DPDGMVKLLPIPSLKKVRITKPKIQQRNRPKTVPVPVPVPKESPYNQQDMMLQNAHGPVPFATFAERPQKEIMIPWLCTSIASALRIRPRGKRSSGKSPRRAPPRNYVTRKICKNCSRTLVSIGFVCFAIC

SEQ ID NO: 43568 - protein, 284 aa, Sorghum bicolor
  Clone ID: SORBI-28MAY03-C6424_1.pep
MAAALEQLSRSKMFDGFNLRFRHQSATLGCAMTFSIYMPPSPASNIPVLYWLSGLTCTDENFIMKSGAQRAAAAHGIALVSPDTSPRGLNIEGESDSYDFGVGAGFYLNATNEKWKNWRMYDYVVKELPKVLSDNFEQLNTSQASIFGHSMGGHGALTIYLKNTDKYKSVSAFAPIANPINCPWGQKAFSNYLGPTKSDWEEYDATCLIKKNSNVPTPILIDQGDADKFLAEQQLLPHNFEEACKAVGATLILRMQPRYDHSYYFIATFMDDHIAHHAKFLKSA

SEQ ID NO: 43569 - protein, 61 aa, Sorghum bicolor
  Clone ID: LIB3476-020-P1-K1-A9.pep
GGNHGRIRIDIGQRQRDQLTNQALIIPICCPADLREESTAHLGNQFLHQKRNGSIRANNCA

SEQ ID NO: 43570 - protein, 295 aa, Sorghum bicolor
  Clone ID: SORBI-28MAY03-C6653_1.pep
TRAATFVCPLDVIKTRFQVHGWPKLATGTIGGSVIIGSLQQIAQREGFRGMYRGLSPTVLALLPNWAVYFTVYEQLKSLLSPDDGSHQLSLGANVVAASCAGAATTIVTNPLWVVKTRFQTQGIRAGSIPYKGTLAALRRIAHEEGVRGLYSGLVPALAGISHVAIQFPAYEKIKAYLAERDNTTVEALSFGDVAVASSLAKVAASTLTYPHEVVRSRLQDQRAHSDARYKGVIDCIRKVYHKEGVAGFYRGCATNLLRTTPAAVITFTSFEMIHRFLIDLFPAEPEPQIHPLKH

SEQ ID NO: 43571 - protein, 273 aa, Sorghum bicolor
  Clone ID: SORBI-28MAY03-C586_1.pep
MAMRAAPAAATGFFSPSSVSPRRFSSATPPASLSTGRCIQRHRLRAFPSSEIPLEELNPSVDLLRKTAEAVGDFRKTPIYIVGTDCTAKRNIAKLLANSIIYRYLCSEELLEDVLGGKDALRAFKESDEKGYLEVETEGLKQLTSMGSLVLCCGDGAVMNSTNLGLLRHGVSIWIDVPLEMAANDMLKSTGTQATTDPDSFSQAMSKLRQRYDELKERYGVSDITVSVQSVASQRGYSSVDSVTLEDMVLEIVRQIEKLIRAKEMMEAAGRPF

SEQ ID NO: 43572 - protein, 436 aa, Sorghum bicolor
  Clone ID: SORBI-28MAY03-C59137_1.pep
IVFQLSRKSYKPPKKPLTEKEIDELCDEWEPEPLCPPIKEGARIDTPMLESAAGPHTIVDGKEVVNFASANYLGLIGNEKIIDSCIGSLEKYGVGSCGPRGFYGTIDVHLDCESKIANFLGTPDSILYSYGISTIFSVIPAFCKKGDIIVADEGVHWAVQNGLHLSRSTVVYFKHNDMASLASTLEKLTHGNKRAEKARGYIVVESIYQNSGQIAPLDEIVRLKEKYRFRVILEESHSFGVLGKSGRGLAEHYGVPIEKIDIITAGMGNALATDGGFCTGSVRVVDHQRLSSSGYVFSASLPPYLASAAVSAVNYLEENPSVLANLRSNIALLHKELSDTPGLEISSHVLSPIVFLKLKKSTGSPTTDLDLLETIADKVLKEDSVFIVTSKKSNLDRCKLPLGIRLFVSAGHTESDISRLSSSLKRVSASVLSDYF

SEQ ID NO: 43573 - protein, 342 aa, Sorghum bicolor
  Clone ID: SORBI-28MAY03-C59320_1.pep
ARGKHSFDVVFEFASEESQHEPVILFLKDVEKICGNNYTYHGLKNKLESFPAGVFIVGSQIQTDARKDKSNNGSPWLKFPYSQAAILDLAFQDSFGRVSEKNKEALKMSKHITKLFPNKVTIESPQDEKELSQWKQLLDRDIEILKAKANVLKMQSFLTRHGMECTDLESVVCVKDRNLTSECVDKIVGYALSYQLKDRPIQTPGKDARVVLSGESLKHGVDLLESIQSDPKKKSTKKSLKDVVTENEFEKRLLTDVIPPDEIGVTFEDIGALENVKETLKELVMLPLQRPELFSKGQLMKPCKGILLFGPPGTGKTMLAKAVATEAGANFINISMSSIASK

SEQ ID NO: 43574 - protein, 327 aa, Sorghum bicolor
  Clone ID: SORBI-28MAY03-C59423_1.pep
ARGILDMYEALAEVIPEMKHVGVGSSGDGVISDVQAILDRLGDAVRGNLFEFGKMLQQETSRRAMTTGEIHPMTRYVMNYLRLLVVYSETLDVLLADDSSDHDAFRSSDDQDQEHLENMTPFGRRLLKLISYLEANLEEKSKLYEDAALECIFAMNNLLYIVQKVKDSELGKVLGDHWIKRRSGKIRQYSKSYLRLSWAKALSYFKEDGHGSGSGSGSGSGSGSGHSSSRMSIKDRFKNFNMAFEEIYRNQTLWKVPDPQLREELKISISENVIPAYRAFLGRYGHQVDSGRNPGKYIKYTPEDLESQLSDLFEGSQVSANHSRRRT

SEQ ID NO: 43575 - protein, 249 aa, Sorghum bicolor
  Clone ID: SORBI-28MAY03-C5949_1.pep
FHAPAMYVAIQAVLSLYASGRTTGIVLDSGDGVTHTVPIYEGYALPHAILRLDLAGRDLTDCLMKILTERGYSFTTTAEREIVRDIKEKLAFVALDYEQELETAKSSSSVEKSYELPDGQVITIGAERFRCPEVLFQPSLIGMEAPGIHETTYNSIMKCDVDIRKDLYGNIVLSGGTTMFPGIADRMSKEISALAPSSMKIKVVAPPERKYSVWIGGSILASLSTFQQMWISKEEYDESGPAIVHRKCF

SEQ ID NO: 43576 - protein, 315 aa, Sorghum bicolor
  unsure (1)..(315): unsure at all Xaa locations
  Clone ID: SORBI-28MAY03-C673_1.pep
QPCYFHTGWGGACCQPYYFDVFKGHXLHDLXXWXRENSDGADQGFLVGCYPDLLDKPMFHPPERGGELNGTYRLPLGYQMDASYYYLKLHWHVPCGPNSVITFPSAPWFKPWYWWSWPVLPLGLSWHKQRWDDLGYAAEMPVVLMEVLMYIVIITVTRLARPGMTKLCYNRRPEKQSALVQWLIKLAAIVAMVAAYSIPFFVIPRTVHPIMGWSIYLFGALALSVLVINVFLLPPLDVLTTWLAIVGMLFVMAFPWYHDGVVRALAVFGYAFCSAPFLWASMVRMMDSVQTMLERDPFFPRIGEPAQETEFSKLF

SEQ ID NO: 43577 - protein, 183 aa, Sorghum bicolor
  Clone ID: SORBI-28MAY03-C67898_1.pep
MEHDVHHHHHQQPEEAMELPPGFRFHPTDEELITHYLARKAADPRFAPRAVGVADLNKCEPWDLPYRATMGEKEWYFFCVKDRKYPTGLRTNRATESGYWKATGKDREIFRGKALVGLKKTLVFYTGRAPRGGKTGWVMHEYRLHGKHAAAAAAASSSSSLIPSVRAGASKDDWVLCRVFKKS

SEQ ID NO: 43578 - protein, 133 aa, Sorghum bicolor
  Clone ID: SORBI-28MAY03-C6856_1.pep
WFEVVGEVDFCFPVGTYSPDFRVHLGKFYKRFGRRHCTSEHVHGWDKKPVRFQLSTSDGQQALSQCYLEEPGSWVLYHAGDFVASKPDQPMKLKFSMAQIDCTHTKGGLCIDSVLIYPKGKGFQQERVVRSQK

SEQ ID NO: 43579 - protein, 246 aa, Sorghum bicolor
  unsure (1)..(246): unsure at all Xaa locations
  Clone ID: SORBI-28MAY03-C6860_1.pep
MYRAAASLASKARQAGSSAAARQVGSRLAWSRNYAAKDIKFGVEARALMLRGVEELADAVKVTMGPKGRNVVIEQSFGAPKVTKDGVTVAKSIEFKDRVKNVGASLVKQVANATNDTAGDGTTCATVLTKAIFTEGCKSVAAGMNAMDLRRGISMAVDAVVTNLKNMARMISTSEEIAQVGTISANGEREIGELIAKAMEKVGKEGVITIADGNTLYNELEVVEGMKLDRGYISPYFITXSKTQKC

SEQ ID NO: 43580 - protein, 157 aa, Sorghum bicolor
  Clone ID: SORBI-28MAY03-C6876_1.pep
MISWRRSASWLSSASRSSLGAAVGGEAKVTPEVDPAAAQEMEEDEEADEERWSRLLPELLTEIMRRVDAGAERWPPRRDVVVCACVCRRWRDAAVSVVRPPLECGRITFPSSLKQPGPRDAPMHCFIRRDKKNSTFSLYLSLAQALTDKGKFLLAAR

SEQ ID NO: 43581 - protein, 243 aa, Sorghum bicolor
  Clone ID: SORBI-28MAY03-C6953_1.pep
MFGFRKADPDLEAGGASLLYPGMTESPELRWAFVRKIYVILAVQLAMTAAVSGFVVKVPAVSNFFVSSNAGIALYIFLIILPFIVLCPLHYYHQKHPVNLLLLGLFTVAISFAVGMTCAFTSGKIILEAAILTAVVVISLTAYTFWAAKRGHDFNFLGPFLFAAIMVLMVFSLIQIFFPLGKVSVMIYGGLASLIFCGYIIYDTDNIIKRYTYDEYIWAAVSLYLDVINLFLSLLQLLRAADS

SEQ ID NO: 43582 - protein, 234 aa, Sorghum bicolor
  Clone ID: SORBI-28MAY03-C74186_1.pep
MATRVLPPALLSLILLPLLLLSARDTVAAGEDFPRDGRVIDLDESNFEAALGAIDFLFVDFYAPWCGHCKRLAPELDEAAPVLAGLSEPIVVAKVNADKYRKLGSKYGVDGFPTLMLFIHGVPIEYTGSRKADQLVRNLKKFVSPDVSILESDSAIKTFVENAGTSFPMFLGFGVNDSLIAEYGRKYKKRAWFAVAKEFSEDIMVAYEFDKVPALVAIHPKYKEQSLFYGPFEE

SEQ ID NO: 43583 - protein, 196 aa, Sorghum bicolor
  Clone ID: SORBI-28MAY03-C61462_1.pep
GNERESEREAGARGGCPPQPPFLSPFLLSYLRIRDSSGAPRSPRRPPARDCSLPLGRTVDAPALGILQPPPVLRGGPPGGAGQARGGFPVPPVAFPCVMECKFYGFQTVPSMFPRGAMPRLEEFHFRMSLQDFLKGEFSTDDLALDHLSSLRSVDVRLFGGGHEKMEQELEMKEKVKEKLRQEADAHPNHPSLALY

SEQ ID NO: 43584 - protein, 432 aa, Sorghum bicolor
  Clone ID: SORBI-28MAY03-C6230_1.pep
MEQRNVLALGEHVLKATIRKRKHETAMEHPEGNDVMVFSQHDPRKHPATFDDRANCKKSKLISCGSGSILESYRNFKTSGLPVRVLFYQHGDWSDFPEDVVNLAQQDFQLKRPITTAVFQNKHIMLDFVHMICIDYEMTIDKPLAWVDDHGKHFFPDLSAGLYTSKPSQHEKGEADECDGVSSVAESSSSVSVGEVVSHSKRISNIAEDSLKAHNRLYEAVGENNSGPSFHLNEYFSGTIQATGKPNNGPRVDSAVQNLLLKGLGQPFSEKDIIAIYRTPLLDQQWQVRCGLFQKEVEETRSRRGNANVRYAWLPCSRYTMEQMTTRGALETAKPKKGSMFGVGTCLAPANCSNSCARYSEFQEDGIIRMMLCRVIMGNVEVVLPGSKQFQPSNESFDNGVDDLQNPQNYIIWDSNVHKHIFAEYAVIVKVP

SEQ ID NO: 43585 - protein, 184 aa, Sorghum bicolor
  Clone ID: SORBI-28MAY03-C62487_1.pep
SMFISQVIGTAMGCVIAPCVFWLFYKAFGNIGIAGSEYPAPNAVVFRSMAVLGVDGFSSLPKHCLTLCYVFFAAAIVINLIRDLVPKKVSRFIPIPMAMAIPFYIGAYFAVDMFVGTVILFVWQRLDRAKADAFAPAVASGMICGDGIWVLPQSVLALAKVKPPICMRFLSRAMNDKVDAFLGS

SEQ ID NO: 43586 - protein, 192 aa, Sorghum bicolor
  Clone ID: SORBI-28MAY03-C6252_1.pep
MASDGAAAAPAKVTPKKANLLDPYSIKHLLDETISDVVKSKGYTEDTRLGNWKLGIGAAVIAVALLAQFYPKKFPQNREFLLGCIALYVVLNVVLLILSYTKEKDAILFTHPPAGSFNSTGLTISSKLPRFSDMYTLTIASADPQSISANKPVHFTKSVTKWFTKEGVLVEGLFWKDVEKLIDDYNSERKSK

SEQ ID NO: 43587 - protein, 106 aa, Sorghum bicolor
  Clone ID: SORBI-28MAY03-C6262_1.pep
GHSVLGPVKEWQIQDCIDVHKLLETVFGDHDVANRWKARCAEYFPYSTYFEGIKSAISAYAVDHSLESSPENGIASNPQLKSKEGEQGSLNGTVHIVDDLSSLSIR

SEQ ID NO: 43588 - protein, 98 aa, Sorghum bicolor
  Clone ID: SORBI-28MAY03-C7146_1.pep
MSSLNSLFNRSTFGTKCKTCLNLVISRIKLLRNRRDLQLINMRKEMVQYLQTGQESIARIRVEHIIREQNILAAYEIIELFCEFVLARLTGQESIARI

SEQ ID NO: 43589 - protein, 253 aa, Sorghum bicolor
  Clone ID: SORBI-28MAY03-C7283_1.pep
TGVWESLALGSGLLGCASAILAPLVRGHCIRTCSGARRLVLLAPRWWCRSPGFAVIATLAGRFAAHGRGRRSVVPCSSDSVGWSSLPCLHIAGRLCSGVLMDGTVYVIGGMASDTEVLTCGEEYDLDRGTWRVIENMSEGLNGASGAPPLVAVVENELYAAQYAGKLVRKYNKTDNSWTTLGELPERPEAVNGWGIAFRGCGERLLVIGGPRVLGGGMIELHSWIPSEGPLQWNMIGSKPSGNFVYNCAVMGC

SEQ ID NO: 43590 - protein, 272 aa, Sorghum bicolor
  Clone ID: SORBI-28MAY03-C732_1.pep
MAFVSATAAASTTLFLSVLSPARSAGACVCSQARKPSTAPLHAAKGPNSAPVVLESKAKGKKKKGSGAGNLAGALDVEIREAQEYLDSDEQEPLPDNFPFEIIDEDGMSVVILRRDYKDEKIEVTVSMPNLEGGPEFDDEDGEGDGESAGKDDEEAEEEDESAGDSSISLKVVVSKDSGPKLEFTCTAFREEITIDDMLIVEKTDDDGEEKFPYEGPEFTELPVNVQKGLFKYLEQRGVTLSATNYMHDYMVTKQAQEYIRWMTKLKDFVKQ

SEQ ID NO: 43591 - protein, 112 aa, Sorghum bicolor
  Clone ID: SORBI-28MAY03-C711_1.pep
MKVIAAYLLAVLGGNTSPTADDVKNILESVGAEADEEKLEFLLTELKDKDITEVIAAGRERLSSVTSGGGAIAMGAPAAAAGGAAPAEEPKKEEKVEEKEESDEDMGFSLFD

SEQ ID NO: 43592 - protein, 69 aa, Sorghum bicolor
  Clone ID: LIB5048-005-R1-XP2-F8.pep
GKFGVGISTTDIGYGFQLVRLKHHCPFPVSLANGPIILAGVHEITVSIATTYLCYFACDIRVCIFFRNL

SEQ ID NO: 43593 - protein, 223 aa, Sorghum bicolor
  Clone ID: SORBI-28MAY03-C7187_1.pep
EGHLTSSFAHPSSNVCIRFITGQTWISAGLAGDSVISGGISNVRPGAIRMVNSAHGVRGATAPWRGGQVLEVFVADVGFDNVSIASRITGDDGEHPAERCHKCALTTLGNITLWAGVGVNRCLAAMLQGIPSAYFSNICLFNVSLSGRTTDPWNCSLVEGYPNSVSPEVCEQLRTSPGPGQICYGSNYPAAAAQPQPQPQPLQKSSASRLVNPFLSISWFLCR

SEQ ID NO: 43594 - protein, 211 aa, Sorghum bicolor
  Clone ID: SORBI-28MAY03-C73575_1.pep
MAPALTSNPPSFRPLSFPFRRRAATVLCRVGKPGKDSAADDAAPKKRPNLFADFGKLADATSLIPAFPSSAAGSLFTGGGRGRKDPQMVFVAGATGQTGVRIAQTLLRQGFAVRAGVPDLASAQELARLAAAYRLISPAEARRLNAVAADFDDPEAIAKSIGPAAKVVVTVGLAEKGPEGGAITTDDALRVVQAADLASVAHVVVVYDVDG

SEQ ID NO: 43595 - protein, 148 aa, Sorghum bicolor
  Clone ID: SORBI-28MAY03-C6667_1.pep
MGGKDLTEDQIASMREAFSLFDTDGDGKIAPSELGVLMRSLGGNPTQAQLRDIAAQEKLTAPFDFPRFLELMRAHLKPEPFDRPLRDAFRVLDKDGSGTVSVADLRHVLTSIGEKLEAHEFDEWIREVDVAPDGTIRYDDFIRRIVAK

SEQ ID NO: 43596 - protein, 255 aa, Sorghum bicolor
  Clone ID: SORBI-28MAY03-C66889_1.pep
MADTSSERSDIHVLLLPYPSQGHINPILQFGKRLAAAHRGRVRCTLAATRFLLSNSQPSACTGGDAIRIAAISDGCDRGGRAEAAGAVEYLSRLESAGSETVDQLLRSAEAEQAGRPVDVLVYDAFLPWAQRVARRRGVPCAVFFTQPCAVDVVYAHARAGRVRPPLVGDEPVELPGLSVALRPVDMPSFLADPSGYPSYLDLLLNQFDGLHTADHVFVNSFYELQPQESDYMASAWRAKTVGPTVPSAYLDNTL

SEQ ID NO: 43597 - protein, 76 aa, Sorghum bicolor
  Clone ID: SORBI-28MAY03-C67115_1.pep
AVWASFGRTPAHARKLRITDSPFPLRDDDAAGGQVDLEAEEFIKKFYEQLRTQQSLATATPDYYGGGYAPPVSGIA

SEQ ID NO: 43598 - protein, 137 aa, Sorghum bicolor
  Clone ID: SORBI-28MAY03-C67216_1.pep
MAMEPNMARRLWHVVRAVLFMLRKGMPKRKLAMDLHLLVHRGKIAGKALGNLMTAHGHNSHHDSKAEAAAAAAAAPPQQQFSSSGRGRRALDPSLAVYNPREVEFSCSNTPSYPSLHLNLIPTGKRRRRNNNSSSRR

SEQ ID NO: 43599 - protein, 181 aa, Sorghum bicolor
  Clone ID: SORBI-28MAY03-C7573_1.pep
MYGGDEVSAIVIDVGSYSCKAGYAGDDTPKAVFPSVVGSVEQTEGMDDPKPEKEADSASDSKNGAKPMDVDKAKTKRKLYVGQELEFRRDHMEVISPMKDGTVTDWDIVDNIWNHAFRRRLLINPEEHPMLIAEPSTNTAQQREKAAELMFESYKVPALFLAKNAVLTSFASGRATSLVGD

SEQ ID NO: 43600 - protein, 269 aa, Sorghum bicolor
  Clone ID: SORBI-28MAY03-C7579_1.pep
MAVSNNITACVTLLALICAVPVIASGIWFASAQGEECARLARWPVAILGGLLLLAALAGFVGAYWNRRRLLAFYLFAMASLVVLLIALLVFAFAVTRGSGAYPVLGRAYDDYHLDGFSMWLRGYVSDDPGRWEKIRACLAVSDTCKKLARQAAFTNAEQFYQSHLSPLQSGCCKPPSVCGFSYVSPTVWTAAPRPPADPLCGLRRFPPGQLCYECESCKAGLLETLRDQWHKANIALVVATVALVILYLVGCSAYKNAQAAAIFSRYKY

SEQ ID NO: 43601 - protein, 258 aa, Sorghum bicolor
  Clone ID: SORBI-28MAY03-C7590_1.pep
MGGGVWVFQLVSLLALGFVLSSVEASLGDIDPRYRTCVRECQTTGITGENIISHCQSKENDTSVGGSWYNQEQIYVQWKQLNCMTDCRYFCMMQREGERQSLGLSPVKYHGKWPFLRVSVFQEPLSVALSAMNLLVHFAGWLSFFLLVNYKLPLRPQTKRTYYEYTGLWRHIYAILSMNAWFWSSIFHTRDIDLTEKLDYSSAVALLGYSLILSLLRTFNVKDEATRVMFAAPILAFVTTHILYLNFYELDYGWNMKV

SEQ ID NO: 43602 - protein, 353 aa, Sorghum bicolor
  Clone ID: SORBI-28MAY03-C76175_1.pep
MAADGNGAAAAGGDTRAVFAQIYKTLKEELLTDPAFEFTEESHQWIDRMVDYTVLGGKCNRGLSVVDSYKLLKGADTLSEEEMFLACTLGWCIEWLQAFFLVLDDIMDESHTRRGQPCWFRVPQVGFIAVNDGIILRNHISRILRRHFKGKPYYADLLDLFNEVEFKTASGQLLDLITTHEGEKDLTKYNITVHGRIVQYKTAYYSFYLPVACALLLSGENLDKYGDVENILVEMGTYFQVQDDYLDCYGDPEFIGKIGTDIEDYKCSWLVVQALERADESQKRILFENYGKKDPACVAKVKNLYKELNLEAVFQEYESESYKKLIADIEAQPSIAVQNVLKSFLHKIYKRQK

SEQ ID NO: 43603 - protein, 188 aa, Sorghum bicolor
  Clone ID: SORBI-28MAY03-C7622_1.pep
YSPDRYRKSQAGASGAHVWGGSAGVLCPAVVDTISSIVQNVDEQDLGAMFGSGRGQGGLDLSRMLQQMMPVVSQALGGAGGRSAGANSRQSRSWPQRIDSGGGNVPASSSSQIDLHQARESIEQHESPENIFSSVLETAAQAYGEDDSIQGMIEELASDQELTDEYLKFLVEQVRQRVQSESQSTSQP

SEQ ID NO: 43604 - protein, 227 aa, Sorghum bicolor
  unsure (1)..(227): unsure at all Xaa locations
  Clone ID: SORBI-28MAY03-C7625_1.pep
TIYTATTDAAAHTGAADDSVAAKSRPPPPPASPNAKGLPITPGEADHPFYNPTGTCEPASVLCVSDPHRPAVDIAFXISTPSLSGNHCALSSSESVAKFPANXAALPYNHHDRRKRIYPQRPGEIVCDFYMKTGSCKYSQKCKFHHPIDRSAPHFNENGDPQPPVTLGFPRREDAEACAFYMRSGTCRFGVHCKFDHPPRQKAISKLQAAGKEGIEGLSVALHDPDV

SEQ ID NO: 43605 - protein, 152 aa, Sorghum bicolor
  unsure (1)..(152): unsure at all Xaa locations
  Clone ID: SORBI-28MAY03-C23080_1.pep
MRLVIKEGLRLHPPLPLLLPRECRSSCQVLGFDVPAGTVVFVNAWAIGRDPSSWDKPDEFVPERFEGSGVDFKGTDFEYVPFGAGRRMCPGMAFGLVTMGLALASLLYHFDWELPPGMTATDXDMTEEMGVTARRLHDLLPVPFVRMPVPMT

SEQ ID NO: 43606 - protein, 223 aa, Sorghum bicolor
  Clone ID: SORBI-28MAY03-C23085_1.pep
MAPKRSTSLSSGSNSSSGGGVCPLAAAAEQPRLRGVRKRPWGRYAAEIRDPVRKARVWLGTFDTPEQAARAYDAAARRLRGPGATTNYPHASEPVPPASAPARSASGSASASFSWSLLSPPASSSSSCSLLPESVTVAVTAPAPSLDLSLALPASASVAKTYQLFMDPTPALLPFLLPKSEEERSCSGSPSSSSVVFDAAPPPVGLGLGLDLNLALLPAEMVV

SEQ ID NO: 43607 - protein, 449 aa, Sorghum bicolor
  unsure (1)..(449): unsure at all Xaa locations
  Clone ID: SORBI-28MAY03-C2322_1.pep
MAGGGEAPLLEGKPRVYFDGCPGCANDRRKAENLGIPYGQFFHIWIIILVSCLPISLLFPFIYFMIRDLHIAERVEGIGFYAGFVGASYMLGRALTSTAWGMIADRIGRKPVIILSIISTLLFNTLFGLSVNYWMAIATRFLLGSLNGLLGPIRAYAVEVCRTEHQAIGLTLVSTSWAIGLIIGPAIGGYLAQLKXYPKLFPANSIFGRFPYFLPCLCVSFFCLVILISCIWLPETLHKHKLHKTEDQGIEDFAEQQNSSTTNKSLLKNWPLMSSIILFCVXDVGQVLAVTGASILLYQTFVYPRIVKVLGPVNTSRIAAILSMVLLFTYPPMTHLSKPWLSVVVNIASMLKNNLVVTVVTCSFILQNNSVPQEQRATANGLATTLMSFFKAFAPAGAGIVFSWAQKRQHAFLFPGDQMVFFLLDIVIFVELIWTFKPFLAIPEQIPRS

SEQ ID NO: 43608 - protein, 224 aa, Sorghum bicolor
  Clone ID: SORBI-28MAY03-C23747_1.pep
MAGTCAHAEFLRAQPAWALALAAVGFLVALRAAVRFALWVYAAFLRPGKPLRRRYGAWAVVTGATDGIGRAIAFRLAAAGLGLVLVGRNPEKLAAVAAEIKAKHPKVPEVRTFVLDFASEGLAAGVEALKDSIRGLDVGVLVNNAGLSYPYARYFHEVDEELMRSLIRINVEGVTRVTHAVLPGMVERKRGAIVNIGSGAASVVPSDPLYSVYAATKAYVDQFS

SEQ ID NO: 43609 - protein, 190 aa, Sorghum bicolor
  Clone ID: SORBI-28MAY03-C771_1.pep
MAAIPAVISGCCSSSRLSQPAGLLPSTSSRRRFKVTAMAPKKKVNRYDENWSKQWFGAGLFAEGSEEVTVDVFKKLERRKVLSTVEKAGLLSKAEELGVTLSSLEQLGLLSKAEDLGLLSLVETAAGTSPSVLASVSLPLLVAAVVAVVVVPDDSAALVALQAVVATVLAAGAAGLFVGSVVLAGLQESD

SEQ ID NO: 43610 - protein, 179 aa, Sorghum bicolor
  Clone ID: SORBI-28MAY03-C7756_1.pep
MAQTMAAASELVTLKRPFGGNDGFGDGSGNGGTVAEEKPKARRREADPAAALASARHEFGEHGGVNMSIEASATFTVMEPDTMRRLFAGELGPDRGDMYIYSRHFNPTVLALGRQMAALEGTEAAYCTASGMSAISAVLMQLVGAGGHVVASRCLYGGTHALLARFLPRTSGVRATFVD

SEQ ID NO: 43611 - protein, 222 aa, Sorghum bicolor
  unsure (1)..(222): unsure at all Xaa locations
  Clone ID: SORBI-28MAY03-C7841_1.pep
MDFKGFWESRFGGKKEPEEQNGHANGSVPKRTSDLAVYEQFEQQARQTQVRAAAIRDGNADVIQKPLLPSFESAEMRNLAETLLRDIIRGSPDVKWESIKGLENAKRLLKEAVVMPIKYPKYFTGLLSPWKGILLFGPPGTGKTMLAKAVATECKTTFFNISASSIVSKWRGDSEKLVKVLFELARHHAPSTIFLDXIDAIISQRGEARSEHEASRRLRLTT

SEQ ID NO: 43612 - protein, 153 aa, Sorghum bicolor
  Clone ID: SORBI-28MAY03-C7872_1.pep
RPPSRQSPSTPPSKAPSTSGKTRPASPRGNWLYKEDDLRSITSIRSERPRRQSTGGGGSVRDDASLTSTPPLPSYMQSTESARAKSRYRSLLTEKLEVPERAPLVHSVVKKRLSFPVVDKPSVVPTDKPKERVRRHSDPPKVDPATLKDVPAA

SEQ ID NO: 43613 - protein, 181 aa, Sorghum bicolor
  Clone ID: SORBI-28MAY03-C7876_1.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAK

SEQ ID NO: 43614 - protein, 296 aa, Sorghum bicolor
  unsure (1)..(296): unsure at all Xaa locations
  Clone ID: SORBI-28MAY03-C80685_1.pep
MAAMLVGALRRGSGCHGGSRLLAQSLRRFVSTLVVAEHEGGFVKPSSLSALAAAEAIAKENKISVLLGGSGPSLHKAADHAASSHPLVSEVLVADSEALAHPLAEPWADLLRSVQQKGGYSHVIASSTSFGKNLLPRAAALLDVSPVTDVTAVKEPRVFVRPIYAGNALCTVKYTXRGSLHDGGWGFFSAENFKLLEQLAEKLGAAVGATRAAVDAGYVPNDLQVGQTGKIVAPELYMAFGVSGAIQHLAGMRDSKVIVAVNKDADAPIFQVADYGLVADLFEVLDELLKKIPEKK

SEQ ID NO: 43615 - protein, 128 aa, Sorghum bicolor
  Clone ID: SORBI-28MAY03-C7443_1.pep
MAKFNVVQKNRRQWKQDRKRAAHGEPGTGKLKQRTAPVSMSGKRKRKLERRLNREQKEAAMIKALENMGDVDMVSAEESSEAAKGKSQVKFSVKKNSRIQIKRLKGKGRKKAKNAKPPAKEKVDAMVE

SEQ ID NO: 43616 - protein, 137 aa, Sorghum bicolor
  Clone ID: SORBI-28MAY03-C74795_1.pep
TRIFFRGAYVCGHEKTMDKISRSLKYWSKGEVQTTFLCHEGFLGTLGAFWSYENMGIDSLAAHEVIREVLLGAPYTGQFPSLPVTQQQENGEHSTLEGEVENLRHDNAVLKAEVERLQRENAELRAKLVRSGETSTL

SEQ ID NO: 43617 - protein, 208 aa, Sorghum bicolor
  Clone ID: SORBI-28MAY03-C7514_1.pep
MAASSLCHGHLLLFLLVAVASACLGTAAAHQAGSGEGYTIAGRVKIDGASAKGFGLPAKTSNTKVILNGGQRVTFARPDGYFAFHNVPAGTHLIEVSSIGYFFSPVRVDISARNPGYIQAALTETRRVLNELVLEPLKEEQYYEVREPFSVMSLLKSPMGLMVGFMVLMVFVMPKLMENIDPEEMKQAQEQMRNNPVSFSGLLSRAQG

SEQ ID NO: 43618 - protein, 293 aa, Sorghum bicolor
  Clone ID: SORBI-28MAY03-C7529_1.pep
MGATATEAAEDGAAVAGGALGLGLGETVRELREAYECGRTRSVAWRRAQLRGLLRLLEEKEAEAFQALRTDLGKHHAEAYRDEVGVLIKSTNGALQQLGKWMTPEKVWVPLIAFPATAQVVPEPLGVVLVFSCWNVPLGLSLEPLIGAIAAGNAVALKPSEISPCTARFLADNIGRYMDPSAVKVILGGPEVGEQLMEHRWDKVLFTGSPRIARAVMAAASRHLTPVALELGGKCPCIFDAMGSARDLQISVNRIIAGKWSSCAGQACIAIDYVLVEERFAPILIKVLKSTLK

SEQ ID NO: 43619 - protein, 296 aa, Sorghum bicolor
  Clone ID: SORBI-28MAY03-C82790_1.pep
MAVYIRLDDAVRARLRGDAAGCTITSSGSDHDASACLSELVQAFLETGAGAAEEGVPGPAPKEYDESGEEDAPGRAAAAAASVRALLDPPAEEDVFRIRLAAAVATAMEVEAALRAHGASFRRAVVRRLRGAGYDAGVCKSRWEASGGITAGTYEYVDVVAPLAADGRKRARYIVDADFRAGLEVARATPEYAAVVAEVPASAVVAREESVGRAVRVASDAARRSLRAHGLHVPPWRKTRYMLAKWLGPYKRSTATSLPAANAGAMPMTGGAGMDIKCRAVGFFAPPATAPAARIK

SEQ ID NO: 43620 - protein, 228 aa, Sorghum bicolor
  Clone ID: SORBI-28MAY03-C8283_1.pep
RQLAFSTVGTPDYIAPEVLLKKGYGMECDWWSLGAIMYEMLVGYPPFYADDPITTCRKIVHWRNHLKFPEDGVRSNEARDLICRLLCDVDHRIGSAGADQIKAHPWFRGVAWDKLYEMEAAFKPQVNDELDTQNFMKFEELENPPAKTGSGPSRKMMLNSKDLSFVGYTYKNFDAVKAIKISDLQRNSSLTRPSIGSIFGPPGMDSPMEPNGRDTHMHTVSSGDPMIP

SEQ ID NO: 43621 - protein, 230 aa, Sorghum bicolor
  Clone ID: SORBI-28MAY03-C82990_1.pep
MAIAATSPKMSSVLAALSLLLLAVACQASPYYPLELGYYRYKCPQAEAIVKAIMEKAIAQNPGNGAGLIRMLFHDCFVEGCDASVLLDPTPFSPTPEKTSPPNNPSLRGFELIDAIKDALEAACPGVVSCADIIAFAARDASYFLSGGKVRFDMPAGRLDGTFSNASESLKFLVPPTSNLSTLVSSFAVKGMSVEDLVVLSGAHTVGRSHCSSFVSDRLNASVPSDISPG

SEQ ID NO: 43622 - protein, 333 aa, Sorghum bicolor
  Clone ID: SORBI-28MAY03-C8558_1.pep
THDVGYWANSFLEDLKRTCSDHSQRRCWGIGFGLRFRVVSLDLHFRKLSLESILMAYRRAKTRAILLDYDGTLMPQAINKSPSTESVRILNSLCGDKKNVVYLCSGYDRRTLHEWFPCENLGIAAEHGYFLRCKRDATRKTCVTATDCSWKQIAEPVMCLYRETTDGSTIEDRETVLVWNYEDADPDFGSCQAKELVDHLESVLANEPVSVKTTPHSVEVKPQGVSKGLVARRMLVSMKDRGQCPDFVLCIGDDKSDEDMFQLIASAACGDSLGSKAEVFACTVGRKPSKAKYYLDDAAEVVRLMQGLSYVSEELALANHRDEDDDSSLDVWE

SEQ ID NO: 43623 - protein, 400 aa, Sorghum bicolor
  Clone ID: SORBI-28MAY03-C8500_1.pep
MATEVNQTYFSWSQGGSTERDGPQGVSVSQTLDHGSISFGRFELESLSWEKWSVFTNDRRNEEFGKFNGLVAQKKAYFEEYYKKIRELKASQQQNQQTELILEYSGDGSDSSQTAEDEQGADLETPTGSGAAVDVYVEEALHETMSEHGLQCYDDQGNENFDTEFSSSNLSSSGVLQQTDVRGAVRGSSSTSKMDAGKKNAGSVHGDTRTTYEAARTPRRIIEKDSRLRHSPKIIPKSIKTLSKSAMDYTSERPGSMKPNTSMNQKAKLVQRSSAAAQKMCGPTEGNKHTGLRRPSSAGARRPSTGDRHAIAKENSQLPAVVSTPRRPSTAERRPVTRDRAQKEANVTTPRRPSTSERLPVKRENAAKHNDISAVRRPSTGERRAITRDSVVRTDVKTPS

SEQ ID NO: 43624 - protein, 195 aa, Sorghum bicolor
  Clone ID: SORBI-28MAY03-C85966_1.pep
IRTGKLVSLSEQELVDCDDVDNQGCNGGLMDYAFQYIKRNGGITTESNYPYLAEQRSCNKAKERSHDVTIDGYEDVPANNEDALQKAVANQPVSIAIEASGQDFQFYSEGVFTGSCGTELDHGVAAVGYGITRDGTKYWIVKNSWGEDWGERGYIRMQRGISDSQGLCGIAMEPSYPTKIATTHGAIMTDGHASY

SEQ ID NO: 43625 - protein, 305 aa, Sorghum bicolor
  Clone ID: SORBI-28MAY03-C7631_1.pep
MAAGSAASLVAAAICLALAVLAPAVPGGGATLESVPDLVKAMYLNIESSPCVRLLNLSGEIGCSNPGSEKVIAPIVRFRKSSDQLIQPSTILLPLDQMSDFFLRVSNDPELYQKVAGVLIESNGVNGDLQELSPDRKFPQDDFAPYSNHSHDWNLAGSGIMWNRYNFPVFLLSEESTKTLQKISEKNEKTSNGYRANVAEFDLVMQTTKAQTHDSASCLKEQSCLPLGGHSVWASLPPLKNGSTEHQKPLILAIASQDSASFFRDRSLGSDSPISGLIALLTAVDALSHIHDLSNLKRQLVFAVF

SEQ ID NO: 43626 - protein, 213 aa, Sorghum bicolor
  Clone ID: SORBI-28MAY03-C7637_1.pep
MGTVVDAAPAVVAEEVTENMLGGKKVTVVFVLGGPGSGKGTQCANIVEHFGFTHLSAGDLLRAEIKSGSENGTMIENMIKEGKIVPSEVTIKLLQEAMIKNENDKFLIDGFPRNEENRAAFENVTKISPAFVLFFDCSEEEMERRLLGRNQGRVDDNIETIKKRFKTFVESSLPVIEHYNSRDKVKKIDAAKPIPEVFEDVKAIFAPFSSKAE

SEQ ID NO: 43627 - protein, 208 aa, Sorghum bicolor
  Clone ID: SORBI-28MAY03-C7649_1.pep
ARGGGPLCSLESMASQDYPHDEYNLERENRNQASNPGPLLERPGDKSELVTGLDEGCYVHAEQPPVMGWTVGPQMLHPKYGVLVEESQFESNIADNHLTRKPISIKNIPRNPLVDAVAAHDRSSMRKVSELAPSTDKLKPNERNMLLEQIRSKTFSLKPVAPAKPTAMRSPARTSTRNLKVAAIIEKANAIRQAVGSDDEDADSWSDT

SEQ ID NO: 43628 - protein, 125 aa, Sorghum bicolor
  unsure (1)..(125): unsure at all Xaa locations
  Clone ID: SORBI-28MAY03-C76584_1.pep
MAVVTRGAASLPLVLLVFVFAAPSPADGCDRCVRRSRATYQASSLALNAGSCGYGSLAASFNGGFLAAASPELYRGGVACGACFQVRCRDSELCSAAGAKXVVVTDQARTSLNRTGLVLSAAAYA

SEQ ID NO: 43629 - protein, 384 aa, Sorghum bicolor
  Clone ID: SORBI-28MAY03-C7670_1.pep
ARGLFVVAAAAPRGARGVFEGLRAKGFASVSSSTGNENMSTGTGTLPPVPPPSSYFGSPVFWIGVGVALSVAFTTVSSMVKRYAMEQAFKSMMTQAPPNSFGSNSPFPFGMPPQASPTAPSSFPYLEPKKDTSPQVSTVDVSATEVEAAGTSKEVDVTETPEPSKKFAFVDVSPEELQQKNLQSSLETVDVKHDSTDSESKEDIEEKVPTNGATFKPNEDAARGPTEPSNSGPMLSVETIEKMMEDPTVQKMVYPYLPEEMRNPDSFKWMLQNPMYRQQLQDMLNNMGASPDQWDNRMVDHLKNFDLSSPEVRQQFAQVGMTPEEVVSKIMANPDVAVAFQNPKIQTAIMDCSQNPLNIVKYQNDKEVMDVFMKISQIFPQING

SEQ ID NO: 43630 - protein, 237 aa, Sorghum bicolor
  Clone ID: SORBI-28MAY03-C9227_1.pep
MAAAAATTPHSLLLQRAASPAAPPRATATATSLRLPARAARISCAAVAAPSPAAAAAADEAERGVYNFAAGPATLPLSVLKRAQAELVDYHGSGMSIMEMSHRGKEFDAAIKKAEADLRALLAVPDTHDVLFLQGGATTQFAAVPLNLCAGPSDPADFVVSGSWSDKAFKEAKKFSAASVAWSGKDGKYTALPPFDAIKQNPEARFLHICSNETIHGVEFKDYPEPRNKSGILVADM

SEQ ID NO: 43631 - protein, 153 aa, Sorghum bicolor
  Clone ID: SORBI-28MAY03-C9291_1.pep
MQIFVKTLTGKTITLEVESSDTIDNVKAKIQDKEGIPPDQQRLIFAGKQLEDGRTLADYNIQKESTLHLVLRLRGGTMIKVKTLTGKEIEIDIEPTDTIDRIKERVEEKEGIPPVQQRLIYAGKQLADDKTAKDYNIEGGSVLHLVLALRGGQ

SEQ ID NO: 43632 - protein, 316 aa, Sorghum bicolor
  Clone ID: SORBI-28MAY03-C92913_1.pep
MATGDEAETAAPASEEARDWSDMTPVCLAEAFSRLALEDLWRGAMACCRSWRDAARSRPGLFAVLNLEPGFAESTPGAEAAAWWTPAFQRRADAMLRSAATLAAGELCEIRVRHCSDDALEFAAERSLKLSILSIKTSPAITDRSMLTVGACCPMLTELDISNCYDVSYKSLEVIGQSCLNLRVLKRNIFNWIDPSEHVGIVPEDYLRECPEDGDREAITISKFMPKLKHLELRFSKLTAVGLNSIPEGCKDLEVLDLFGCANLTSRGIDQAAANLKNLVTLVKPNFYIPRSSFHMGRYGHWQLYDERFQTNVFQI

SEQ ID NO: 43633 - protein, 261 aa, Sorghum bicolor
  Clone ID: SORBI-28MAY03-C9561_1.pep
TWLCFARFPGPLAPPEGAVLAVQRRSCNLAPFWISPTAWVQEFNNTARIVKKIKLTGTPCKIFKKTALIIGMFTPASPVARFEGAAIRTVSGIRGQVKKAAKIEPGDMLKRKGENTEGIARCTFEDRILMSDIVFLRAWVNVEVPTYCNPVTTALQPREQTWQGMRTTAELRREHNIPTPHNKDSVYKPIERKPRKFNPVEIPAKLQQLLPFKSKPKDTPKQKKVSVENRVPVIMQPREKKTHAAIQQLRLIKHENNLSWL

SEQ ID NO: 43634 - protein, 482 aa, Sorghum bicolor
  Clone ID: SORBI-28MAY03-C954_1.pep
TRRGPSYGYRGRVMLAFEDNGSSKIGVRFDKQIPDGNDLGGLCEEDHGFFCSAELLRPDFSAGEEVERLAMTELIEVISEENKSGPLIVLLKDVEKSFTGAPGSLSSLRSKLESLPSGVLVIGSHTQMDSRKEKAHPGGFLFTKFASSSQTLFDLFPDSFGSRLHERSKESPKAMKHLNKLFPNKISIQLPQDEALLTDWKQQLDRDVETLKAKSNIGSIRTFLSRNGIECNDLEKLFIKDQSLSNENVDKIVGYAVSYHLKHNKIETSNSKDAKLVLASESLKHGLNMLQSMQSDNKSSKKSLKDVVTENEFEKRLLADVIPPNDIGVTFDDIGALENVKDTLKELVMLPLQRPELFCKGQLTKPCKGILLFGPPGTGKTMLAKAVATEAGANFINISMSSITSKWFGEGEKYVKAVFSLASKIAPSVIFIDEVDSMLGRRENPGEHEAMRKMKNEFMVNWDGLRTKDKERVLVLGATNRP

SEQ ID NO: 43635 - protein, 327 aa, Sorghum bicolor
  Clone ID: SORBI-28MAY03-C9616_1.pep
MMRALAVLAMVALFAASSARAEQCGTQAGGALCPNCLCCSKFGWCGSTSDYCGSGCQSQCTGSCGSTPSTPTPTPSSGGGGSVASIISESLFNQMLLHRNDAACPANGFYTYSAFIAAANAFPGFGTTGGADTQKRELAAFLAQTSHETTGGWATAPDGAYAWGYCFKEEQGAASGPDYCEPSTQWPCAAGKKYYGRGPIQISYNYNYGAAGQAIGAGILANPDLVASDPTVSFETAVWFWMTPQSPKPSCHAVMTGQWTPSGADTAAGRLPGYGVVTNIINGGLECGKGADSRVADRIGFYKRYCDLLGVSYGDNLDCANQKPFNS

SEQ ID NO: 43636 - protein, 124 aa, Sorghum bicolor
  Clone ID: SORBI-28MAY03-C8109_1.pep
MGYAQLVIGPAGSGKSTYCSSLYDHCQTVGRTIHIVNLDPAAEHFDYPVDMDIRELISLDDVMEDIGLGPNGGLIYCMEHLEDSLDDWFDEQLENYLDDDYLVFDCPGQIELFTHVPVLRNFVE

SEQ ID NO: 43637 - protein, 251 aa, Sorghum bicolor
  Clone ID: SORBI-28MAY03-C793_1.pep
MKPRPLDYGCGPAAAAAAGCAGWAWRPRPRGGGRSPGVSPKCSNSPNSAAAAGAVHSEHHRRGDSVVLLRPVELPGTGYGSEVEARIERVIFACRFMTFLGIGGLLLGSVPCFLKGSVHVMNAFVDYYLHGGGKLILMLLEAIEMFLIGTVTFVLGIGLYELFISTIDSSYGSNLFGLFSLPDRPKWVEIKSLDDLKTKLGHVIVLVLLVGIFEKSKRVTITSCTDLLCFAGSIFLCSVCLYLLSRLNTSK

SEQ ID NO: 43638 - protein, 123 aa, Sorghum bicolor
  Clone ID: LIB3478-054-Q6-K1-H6.pep
MGLMAFCCALPVSHPEMFLIGTVTCVSGIGLYELFISTIDSSYGSNLFGLFSLPDRPKWVEIKSLDDLKTKLCHVIVLVLLVGIFEKSKRVTITSCTDLLCFAGSIFLCSVCLYLLSRLNTSK

SEQ ID NO: 43639 - protein, 272 aa, Sorghum bicolor
  Clone ID: SORBI-28MAY03-C8128_1.pep
MACLAGSVRPPAILLVFHLASAGGSSSVDLGRKAGSIAAAADEQSPAVEEAASRGRYAVIFDAGSTGSRVHVFKFDKKLDLVPIGDDIEFFTKIKPGLSSFAGKPQEAANSILPLLEQAKEIVPLRLQKDTPLKLGATAGLRLIGDEKAEEILEAVRDLVHTKSKFQYNPKWITVLEGTQEGSYLWVALNYLLGKLGGDYSKTVGVIDLGGGSVQMAYAVSGNAAANAPAVPDGKDPYITKEYLKGKDYNLYVYSYVFILSVWLFEFRFCLD

SEQ ID NO: 43640 - protein, 189 aa, Sorghum bicolor
  Clone ID: SORBI-28MAY03-C81491_1.pep
PIIPTNWIIQTTGRVRKPSGPSWAASTAPSGKGGRLDGDGAASAPACCGCARRPVHLPPAALARPLPEGACRAAPGAPAVRAAPGAVRVSACALPRDLPPLAGGARPAALPSLCKLRVWRRAGSHCPALPAGGLTVMELDGPPAATCYMLSARKLCIIWGGTPQYWRWIPLTDSRFTEGAELLNVCWLE

SEQ ID NO: 43641 - protein, 218 aa, Sorghum bicolor
  unsure (1)..(218): unsure at all Xaa locations
  Clone ID: SORBI-28MAY03-C99789_1.pep
MNKSPRPQVVQAPVQSVVAASAPNPCVEISSSVDCXRGKEQPTNKRPRSESTAEPSTKASREKIRRDKLNERFLELGAILEPGKTPKMDKSAILNDAIRVVGELRSEAKELKDSNESLQEKIKELKAEKNELRDEKQRLKAEKESLEQQIKFLNARPSLVPHHPVISASAFTAPQGPAVAGHKLMMPVLGYPGFPMWQFMPPSDVDTSDDPKSCPPVA

SEQ ID NO: 43642 - protein, 152 aa, Sorghum bicolor
  Clone ID: SORBI-28MAY03-C9959_1.pep
REPVYDCGKSMNPAVDLGQIEGSFIKGIGFFVYEEYLTNSDGLMISNSTWDYKIPTVDIIPKQFNAEVLNTGYNKNRVLSSKAAGEPALVLASSVHCALREAIRAARMEFANSTVSGRSPLEFKMDVPAPMTLVKQLCGLDIVEKYLKSLST

SEQ ID NO: 43643 - protein, 109 aa, Sorghum bicolor
  Clone ID: SORBI-28MAY03-C102776_1.pep
DSERSLMERVRQELKIELKQGFKSRIEDVREEILRKRRAGKLPGDTTSILKQWWQQHSKWPYPTEDDKAKLGTRLGRQARVILGNFINQRKRNWHNNSQTSTLKSKRKR

SEQ ID NO: 43644 - protein, 200 aa, Sorghum bicolor
  Clone ID: SORBI-28MAY03-C10301_1.pep
MYSNFKEQAIEYVKQAVQEDNAGNYVKAFPLYMNALEYFKTHLKYEKNPKIKEAITAKFTEYLRRAEEIRAVLDEGGAGPGSNGGDAAVATRPKTKGKDNGDGGNGGDDSEQSKLRAGLNSAIITEKPNVKWNDVAGLESAKQALQEAVILPVKFPQFFTGKRRPWRAFLLYGPPGTRKSYLAKAVATEADSTFFSISSS

SEQ ID NO: 43645 - protein, 176 aa, Sorghum bicolor
  Clone ID: SORBI-28MAY03-C10389_1.pep
GERKRGEEGDSTGALSEKEAGAKVPKKAAAGRRGGGGPKKKPVSRSVKAGLQFPVGRIGRYLKQGRYAQRIGTGAPVYLAAVLEYLAAEVLELAGNAARDNKKNRIIPRHVLLAIRNDEELGKLLAGVTIAHGGVLPNINPVLLPKKTAAAAAKEGKEKKSPKKAATKSPKKAAAA

SEQ ID NO: 43646 - protein, 160 aa, Sorghum bicolor
  Clone ID: SORBI-28MAY03-C10463_1.pep
IQCFVAVEKEEWKFDTLCDLYDTLTITQAVIFCNTKRKVDWLTEKMRSNNFTVSAMHGDMPQQERDAIMGEFRSGDTRVLITTDVWARGLDVQQVSLVINYDLPNNRELYIHRIGRSGRFGRKGVAINFVRKDDIRILRDIEQYYSTQIDEMPMNVADLI

SEQ ID NO: 43647 - protein, 94 aa, Sorghum bicolor
  Clone ID: SORBI-28MAY03-C8728_1.pep
WSQVEILAEPPLGKLMFTGANFGRTSPWKWMFRSQNFGRTSPLGTPSFRDRRLGLQISLVAGQQTEGVSVTNCGVTEETRERGREMRARRAECG

SEQ ID NO: 43648 - protein, 308 aa, Sorghum bicolor
  Clone ID: SORBI-28MAY03-C8839_1.pep
HEAEVAKEASDMVLADDNFSTIVAAVGEGRSIYNNMKAFIRYMISSNIGEVASIFLTSALGIPEGLIPVQLLWVNLVTDGPPATALGFNPPDKDIMKKPPRRSDDSLITPWILFRYMVIGLYVGVATVGIFIIWYTHGSFLGIDLASDGHTLVSYSQLSNWGQCSSWEGFKVSPFTAGARTFKFDANPCDYFQGGKIKATTLSLSVLVSIEMFNSLNALSEDGSLLSMPPWVNPWLLLAMSVSFGLHFLILYVPFLAQVFGIVPLSLNEWLLVIAVAFPVVLIDEVLKFVGRCLTARARKQSGKRKAE

SEQ ID NO: 43649 - protein, 112 aa, Sorghum bicolor
  Clone ID: SORBI-28MAY03-C8943_1.pep
MASFSEAPPGNPKAGEKIFKTKCAQCHTVEKGAGHKQGPNLNGLFGRQSGTTAGYSYSAGNKNKAVVWEENTLYDYLLNPKKYIPGTKMVFPGLKKPQERADLIAYLKEATA

SEQ ID NO: 43650 - protein, 181 aa, Sorghum bicolor
  Clone ID: SORBI-28MAY03-C9184_1.pep
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSSNIANKA

SEQ ID NO: 43651 - protein, 222 aa, Sorghum bicolor
  Clone ID: SORBI-28MAY03-C914_1.pep
MAIVYALVARGTVVLAEFAAVSGNAGAVARRILEKLPPDAESRLCFAQDRYIFHVLRSDAAGITFLCMANDTFGRRIPFLYLEDIQMRFMKNYGRVAHSALAYAMNDEFSRVLHQQMEFFSSNPSADTLNRLRGEVSEIHTVMVDNIEKILDRGDRISLLVDKTSTMQDSSFHFRKQSKRLRRALWMKNAKLLVVLTVVIVVLLYLIISAFCGGLSLSSCRS

SEQ ID NO: 43652 - protein, 229 aa, Sorghum bicolor
  Clone ID: SORBI-28MAY03-C10657_1.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKDSTLHLVLRLRGGQ

SEQ ID NO: 43653 - protein, 146 aa, Sorghum bicolor
  Clone ID: SORBI-28MAY03-C10705_1.pep
TRFATIPPLVNQVEINPVWQQHKLREFCREKGIQLCAYSPLGAKGTHWGSDSVMDSGVLHEIAKSKGKTVAQVCLRWVYEQGDCLIVKSFDEGRMKENLDIVGWELTEEERQRISKIPQRKINQGRRYVSEHGPYKSLEELWDGEI

SEQ ID NO: 43654 - protein, 223 aa, Sorghum bicolor
  unsure (1)..(223): unsure at all Xaa locations
  Clone ID: SORBI-28MAY03-C10897_1.pep
AGRAGRLALALFXGPPAAGGGNGSWEAFPSNGGNEVTSAWQNPAAEPGKADWELALVETASNLSKQKPAMSGGMDPLLLNGMYDQGVVRQHVSAQVTTGSASSVALPAPGQKTQMLALPAPDGSMQAVGGDPFAASLAVPPPSYVQMADLEKKQQLLTQEQVMWQQYQRDGMQGQSSLNKLDRAYNNGFAPNPAMPYGMPTAYNTNPMPMAYTGNTGYYYPTY

SEQ ID NO: 43655 - protein, 89 aa, Sorghum bicolor
  Clone ID: SORBI-28MAY03-C108013_1.pep
SIGRARHVGLQLARSAARGMSATATNAVSQQKDAADKKPAQETVTKTVQTVEVRSSAGQPDEEGVLKPVKVVHEIPAKEAKDNSGVKQD

SEQ ID NO: 43656 - protein, 145 aa, Sorghum bicolor
  Clone ID: SORBI-28MAY03-C10681_1.pep
MPKIKTSRVKYPEGWELIEPTIRELDANMREAENDPHDGKRKCEALWPIFRISHQRSRYIYDLYYRRKEISQELYEFCLDQGYADRNLIAKWKKPGYERLCCLRCIQTRDHNFATTCVCRVPKHLREEQVIECVHCGCRGCASGD

SEQ ID NO: 43657 - protein, 106 aa, Sorghum bicolor
  Clone ID: SORBI-28MAY03-C10991_1.pep
FKDHVCKTSILDDFGFYDNREKLMQERKAKQQQSLKKVIDVKLPNSTDTEKSLKGETGSTELTEADVLNKELSLDKAGEKNGEKGNDVAPQDLKSPTEKLAGPNGC

SEQ ID NO: 43658 - protein, 172 aa, Sorghum bicolor
  unsure (1)..(172): unsure at all Xaa locations
  Clone ID: SORBI-28MAY03-C9685_1.pep
MGGVCSRKRSQLVDEGDSLQTSPRFSKTSSLKWLLLTLPRSNSDVSGKGQGNEPGRCPSLMELCVARICQDIGKYSTFAMLPRDLSQQIFNELVNSNRLMEASLQVFRDCALQDIGLGEYPGVKDAWMEVVASQRQSLLSVDISCSEVTDSXIDLLRDCSSMQKLACNYWIK

SEQ ID NO: 43659 - protein, 75 aa, Sorghum bicolor
  Clone ID: SORBI-28MAY03-C9584_1.pep
SSPPAIRRQNIQERENGGAPRSCRPGDLRVTAAASGGARMRKPTGRQLRQAVAAHSLRAARASGRRAGTGSDLIP

SEQ ID NO: 43660 - protein, 290 aa, Sorghum bicolor
  unsure (1)..(290): unsure at all Xaa locations
  Clone ID: SORBI-28MAY03-C9718_1.pep
MDCSTRFLIGNPSPAASHFSGERRSPADRVFLRTMASAAPVEEPTAAARAKGRPTGDSFIRRHLRTLAPYQPILPFEVLSARLGRRPEDIIKLDANENPYGPPPEVAAALGSLKFPYVYPDPESRHLRAALAEDSGLESEYILAGCGADELIDLIMRCVLEPGDKIVDCPPTFTMYEFDASVNGALVIKVPRLPDFSLDVDRIVEVVEQEKPKCIFLTSPNNPDGSVINDEDLLKILDLPILVVLDEAYIEFSILKSKMAWVKKHXDNXIILRTFSKRAGLAGLRVGYGA

SEQ ID NO: 43661 - protein, 125 aa, Sorghum bicolor
  Clone ID: SORBI-28MAY03-C97154_1.pep
TRQLRLLMELIGTPNEADLDFVNENARRYIRQLPRHARQSFPEKFPHVQPLAIDLVEKMLTFDPRQRITVEGALAHPYLASLHDISDEPVCSMPFSFDFEQHALSEEQMKDLIYQEALAFNPDYQ

SEQ ID NO: 43662 - protein, 202 aa, Sorghum bicolor
  Clone ID: SORBI-28MAY03-C99535_1.pep
MESSSHKRAREVVDLTAAGPGEAAALPEADAKRLRPQDLLDMLDDDTDAAAAGDLASVMRSLEEEIASFDEAVGAAEAAPTQQQQQPELGFLLEASDDELGLPPAGASASSSEEAGGGGGGLAGAPPESAELDGGQIWGFEDEIDGGAGFGGYSPEAAAAAVAAAAAWDDDGFDAGLFAFGESDAYGPSDLAALRHETMPAV

SEQ ID NO: 43663 - protein, 311 aa, Sorghum bicolor
  Clone ID: SORBI-28MAY03-C11301_1.pep
GLAAAPALLMTLAGLFLPEAPNSLIERGRVEEGRRVLERIRGTADVDAEFTDMVEASELANTIEHPFRNILEPRNRPQLVMAVCMPAFQILTGINSILFYAPVLFQSMGFGSNASLYSSVLTGAVLFSSTLISIGTVDRLGRRKLLISGGIQMIVCQVIVAVILGAKFGADKQLSRSYSIAVVVVICLFVLAFGWSWGPLGWTVPSEIFPLETRSAGQSITVAVNLLFTFAIAQAFLSLLCAFKFGIFLFFAGWITVMTVFVCVFLPETKGVPIEEMVLLWRKHWFWKKVMPADMPLEDGWGAAPATNNHK

SEQ ID NO: 43664 - protein, 443 aa, Sorghum bicolor
  Clone ID: SORBI-28MAY03-C1153_1.pep
HEGLLSVTSGANPVSLKKGIDKTVQGLIQELENKARPVKGGGDIKAVASISAGNDEFIGSMIAEAIDKVGPDGVLSIESSSSFETTVEVEEGMEIDRGYISPQFVTNLEKSIVEFENAKVLITDQKISSIKEILPILEKTTQLRAPLFIIAEDITGEALATLVVNKLRGILNVAAIKAPSFGERRKAVLQDIAIVTGAEFLAKDLGLLVENATEAQLGTARKVTIHQTTTTLIADAASKDEIQARVAQLKKELAETDSVYDTEKLAERIAKLAGGVAVIKVGAATETELEDRQLRIEDAKNATFAAIEEGIVPGGGTAYVHLSTIVPSIKEKIEDPDERLGADIIQKALVAPASLIAHNAGVEGEVVVEKIKDSVWEVGYNAMTDTYENLIEAGVIDPAKVTRCALQNAASVAGMVLTTQAIVVEKPKPKPQVAEPSEGSLAV

SEQ ID NO: 43665 - protein, 210 aa, Sorghum bicolor
  Clone ID: SORBI-28MAY03-C12_1.pep
MAEVEVPAAAVATTIPEAAEATEGGAAAEAKGPHKLHRQWTFWYDIQSKPKPGAAWGTSLKKAYTFDTVEEFWSLYDQIFRPSKLSGNADFHLFKAGVEPKWEDPECANGGKWTVPCNRKATFENMWLETLMALIGEQFDETEDICGIVASVRARGDKLALWTRTASNEAVQVNIGKKWKDVIDYNDKITYTFHDDSRREKPSRGGRYTV

SEQ ID NO: 43666 - protein, 133 aa, Sorghum bicolor
  Clone ID: SORBI-28MAY03-C11508_1.pep
MGNFISSLVTPPPAADDPNCAVVAAHSKTTYDEQWAAHKNGGKLMVIDFSASWCGPCRFIEPAFKELASRFTDAIFVKIDVDELAEVARTWKVEAMPTFVLVKDGKEVSRVIGAKKDELERKIQMFIMSSSSS

SEQ ID NO: 43667 - protein, 57 aa, Sorghum bicolor
  unsure (1)..(57): unsure at all Xaa locations
  Clone ID: LIB3480-027-P1-K1-B11.pep
VKIDVDELAEVARXWKVEAMPXFVLVKDGKEVSRVIGAKKDELERKIQMFIMSSSSS

SEQ ID NO: 43668 - protein, 286 aa, Sorghum bicolor
  Clone ID: SORBI-28MAY03-C12065_1.pep
TRVETSVSTPKESTPVKELDRERNKSRVKRIERKVRSLTPTSEELASLDLREGRNVVTFTFSTAIVGKQQVDCHIYLWKWNTRIVISDVDGTARGSDVLGQFMPLVGVDWSQNGVAHLFSAIKENGYQLLFLSARAISQAHITRQFLFNLKQDGKALPDGPVVISPDGLFPSLYREVIRRAPHEFKISCLEAIKNLFPHDSNPFYAGFGNRDTDEISYLKVGIPMGKIFIINPKGEVAVNRRVDTKSYTSLHALVHGMFPPISSSSEQEDYNAWNYWKMPLPDVDL

SEQ ID NO: 43669 - protein, 101 aa, Sorghum bicolor
  Clone ID: SORBI-28MAY03-C12073_1.pep
MSQRPCGTRLTSDGSGAHHGWYCNYLEVTVTGPHLGCAQTLFTVEQWLATDASPYRLYAVVDECESETTTKRRQRQETETQTRSPAGEAEADEATVSVTAL

SEQ ID NO: 43670 - protein, 257 aa, Sorghum bicolor
  Clone ID: SORBI-28MAY03-C10433_1.pep
TRQKENINRAVKKFSDNFAILLFHYDGRVSEWDEFEWSQRAIHISVRKQTKWWYAKRFLHPDIVAAYEYIFIWDEDLGVDHFNAEEYIKLVKKHNLAISQPGLEPDRGLTWQMTKRRGDSEVHKDTEERPGWCSDPHLPPCAAFVEIMAPVFSRDAWRCVWHMIQNDLVHGWGLDFALRKCVEPAHEKIGVVDSQWIVHQVVPSLGNQGQSENGRAPWEGVRARCRKEWGMFQTRMAEAEKAYYKMMGITPPNSTLA

SEQ ID NO: 43671 - protein, 166 aa, Sorghum bicolor
  Clone ID: SORBI-28MAY03-C105305_1.pep
MSARAAPPPSPPLARGTSTQCSTASCSHRRSSNNPSPMAPKAALFLALGLLLAASAHGCEPSCSGPVVPTPPVVPTPPTHSHGGRCPIDALKLSVCANVLGLVKVGLPPQQECCPLLEGLVDLDAALCLCTAIKANVLGIHLNVPVSLSLILNNCGKICPEDFTCY

SEQ ID NO: 43672 - protein, 223 aa, Sorghum bicolor
  Clone ID: SORBI-28MAY03-C10537_1.pep
HEGGKGGHAALPHHTIDPILAASNVIVSLQQLVSREADPLDSQVVTVGKFQGGGAFNVIPDSVTIGGTFRAFLKESFNQLKQRIEEVIVSQASVQRCSASVDFLTKDRPFFPPTINSPELHDFFVNVASEMVGSRNVRDRQPLMGAEDFSFYAEAIPSTYYYFVGMYNETRGPQAPHHSPYFTINEDALPYGAAAQAALAARYLLEHQQPAATTDKAKPHDEL

SEQ ID NO: 43673 - protein, 263 aa, Sorghum bicolor
  Clone ID: SORBI-28MAY03-C1062_1.pep
MDGLSKTIGGGGPSVPAGSHPAGGSQAAAGGGATQRTQYPYVTGTSVIALKYKDGVIMACDTGASYGSTLRYKSVERIKAVGKHSIIGASGEYSDFQEILRYLDELTLSDHMWDDGNSLGPKEIHSYLTRVMYNRRNKFDPLWNSLVLGGVKKGPKGDEKYLGMVNMIGTHFEENHVATGFGNHLAIPILRAEWREDMTFEEAVKLVEKCLLVLLYRDRSSINKFQIAKITTEGSTIYPPYSLKTYWGFTPFENPPQGAVGSW

SEQ ID NO: 43674 - protein, 149 aa, Sorghum bicolor
  Clone ID: SORBI-28MAY03-C12581_1.pep
MASSLAEEEEAFEHTLLVVREVSVYKIPPRTTSGGYKCGEWLQSDKIWSGRLRVVSCGDRCEIRLEDPATGELFAACFVLPGQRESAVETVLDSSRYFVLRIEDGRGKHAFVGLGFNERNEAFDFNVALSDHEKYVKREQEKETAGAGG

SEQ ID NO: 43675 - protein, 113 aa, Sorghum bicolor
  Clone ID: SORBI-28MAY03-C13114_1.pep
ARGNKLFCVTHVDMGLDTTAVREAVIKVMDKKGLPIMLFSTDEASNKAVIYAGVPPNAPNGFKVLDWLTPSIAPLKGRGGGGKNGIAQGQGSDASQLKEAMALANSIASMKLS

SEQ ID NO: 43676 - protein, 275 aa, Sorghum bicolor
  Clone ID: SORBI-28MAY03-C13146_1.pep
MALPSAGSFAACSLQPRVSIRACHAPRPPPHLQPGAAAAVSSARTRQQRRANATKGGVSTVCEPLGPDRPVWFPGKPAPPWLDGSLPGDFGFDPLGLGSDPESLRWFAQAELMHGRWAMLAAAGILIPDLLARWGFIDAGYSWFDAGSREYFADPWTLFISQMALMGWAESRRWADILKPGCVDIEPRFPNRKNPVPDVGYPGGIWFDWANWGRGSPEPVMVLRTKEIKNGRLAMLAFVGFWFQAVYTGQGPIDNLLAHLADPGHCNIFSAFTSH

SEQ ID NO: 43677 - protein, 171 aa, Sorghum bicolor
  Clone ID: SORBI-28MAY03-C13190_1.pep
MGAAESVPETSIHEFTVKDCNGKEVSLETYKGKVLLVVNVASKCGFTEVNYTQLTELYRKYRDKDFEILAFPCNQFLRQEPGSNQQIKDFACTRFKAEYPVFQKVRVNGPDAAPVYKFLKASKPGLFGSARVKWNFTKFLVDKNGKVVERYGTSTAPMSIEKDIQKALDEE

SEQ ID NO: 43678 - protein, 375 aa, Sorghum bicolor
  Clone ID: SORBI-28MAY03-C13390_1.pep
MGYQDASRGGGKLSLASVGFAGPGAGAGGGGGYKELLVMALPTDDGLDGAKVAEAIGVRLPDVGGAVRTILESREAREFASGALAGAMSKAILAPLETIRTRMVVGVGSRHIFGSLVEIIGQNGWQGLWAGNTINMLRIIPTQAVELGTFECVKRSMTEAQEKWKEDGCPKIQLGNMKIELPLHFLSPVAIAGAAAGIAATLACHPLEVIKDRLTVNRELYPSISLAFRRIYQTDGIGGLYAGLCPTLIGMLPYSTCYFFMYDTIKTSYCRLHKKSSLSRPELLVIGALSGLTASTISFPLEVARKRLMVGALQGKCPPNMIAALSEVIREEGFLGLYRGWGASCLKVMPNSGITWVFYETWKDILLADRDKPRA

SEQ ID NO: 43679 - protein, 338 aa, Sorghum bicolor
  unsure (1)..(338): unsure at all Xaa locations
  Clone ID: SORBI-28MAY03-C1345_1.pep
HCWVKDPWRSMSYVLRDVVVVLGLAAAAARLDSWLVWPLYWAAQGTMFWALFVLGHDCGPGSFXNNPKLNSVVGHILHSSILVPYHGWRISHRTHHQNHGHVEKDESWHPLPERLYKSLDFMTKKLRFTMPFPLLAFPLYLFARSPGKTGSHFNPSSDLFQPNEKKDIITSTASWLAMVGVLAGLTFMMGPIPMLKLYGVPYLVFVAWLDMVTYLHHHGHEDKLPWYRGKEWSYLRGGLTTLDRDYGLINNIHHDIGTHVIHHLFPQIPHYHLIEATEAAKPVLGKYYKEPKKSGALPWHLFGVLAQSLKQDHYVSDTGDVVYYQTDSKTNTSAQKSD

SEQ ID NO: 43680 - protein, 275 aa, Sorghum bicolor
  Clone ID: SORBI-28MAY03-C10968_1.pep
VKHLPFVAGAMIDSHTTAEYWKSRTSDRLKIQMPQTYVVHLGNSKELMEVAEDNVARRVLREHIRESLGVRSEDLLFAIINSVSRGKGQDLFLQAFYQGLQLIQHQKLKVPTMHAIVVGSDMNAQTKFETQLRDFVVKNAIHDRVHFVNKTLAVAPYLAAIDVLVQNSQARGECFGRITIEAMAFKLPVLGTAAGGTTEIVLDGSTGLLHPAGKEGVTPLAKNIVRLASHAEQRVSMGEKGYDRVKEMFMEHHMAERIAAVLKEVLQKSQERSRS

SEQ ID NO: 43681 - protein, 237 aa, Sorghum bicolor
  Clone ID: SORBI-28MAY03-C1096_1.pep
MFLTRTEYDRGVNTFSPEGRLFQVEYAIEAIKLGSTAIGLKTKDGVVLAVEKRVTSPLLEPSSVEKIMEIDEHIGCAMSGLIADARTLVEHARVETQNHRFSYGEPMTVESSTQAICDLALRFGEGDEESMSRPFGVSLLIAGHDENGPSLYYTDPSGTFWQCNAKAIGSGSEGADSSLQEQYNKELTLQEAETIALSILKQVMEEKVTPNNVDIAKVAPKYHLYTPAEVEAVIARL

SEQ ID NO: 43682 - protein, 100 aa, Sorghum bicolor
  Clone ID: LIB5051-012-A1-XP1-D4.pep
AAGLGWTDENGPSLYYTDPSGTFWQCNAKAIGSGSEGADSSLQEQYNKELTLEEAETIALSILKQVMEEKVTPNNVDIAKVAPKYHLYTPAEVEAVIARL

SEQ ID NO: 43683 - protein, 158 aa, Sorghum bicolor
  Clone ID: SORBI-28MAY03-C1108_1.pep
MGHGVSCARTGDEHDYFRAAQVGDLDALGALLAADPSLARRATLYDRLSALHIAAANGRLEVLSMVLDHGVPPDAVNRHKQTPLMLAAMHGKIDCVLKLLQAGANILMFDSLHGRSCLHHASYFGNVDCLQAILTAARTTPVADSWGFARFVNVRDDH

SEQ ID NO: 43684 - protein, 187 aa, Sorghum bicolor
  Clone ID: SORBI-28MAY03-C11220_1.pep
MGEPSKELLDLPSDPRPPASFIESLLAGREQQQDKEGKRKSGPPTDPFPKSQVIGKVKDFLGEIAKANQKLQLDAQNKPPVEYDIEALTGNEEEYIEMDLLLGVADLHSEKAVEAAEATINGSQPSEMPFACSPSDSEDDSEDSDEDIGDKPIVSDKDNKCKSKDDAKMGPAKGKKPNKRQKIVVLN

SEQ ID NO: 43685 - protein, 145 aa, Sorghum bicolor
  Clone ID: SORBI-28MAY03-C13628_1.pep
LLVAMASNNSIASPALLLSVAMALVLFTATTSVRAQSPAPTPAVMPAAPPPPAPTTPPPAPAAPSQNSSCPSGFPNSASFARGVREYLRRGIILILSAVKVTPGTSTTRCFCYFSTNITIPVPFSPPIMVPNPNGPLACVPGRQI

SEQ ID NO: 43686 - protein, 145 aa, Sorghum bicolor; identical to SEQ ID NO: 43685
  Clone ID: LIB5048-012-R1-XP1-A2.pep

SEQ ID NO: 43687 - protein, 293 aa, Sorghum bicolor
  Clone ID: SORBI-28MAY03-C14146_1.pep
DAWDTPPPPVPKSQSPTPSLPPKNPAPPPPHLAMGSAAATSPPPSGKLTQDELKRVAAHRAVEFVEPGMTLGLGTGSTAAHALDRLGDLLRAGALPGVAGVPTSLKTEAHASAVGIPLLPLDAASGARIALSIDGADEVDPDLNLVKGRGGSLLREKMIEGAGDRFVVIVDESKLVPRLGCTGAIPVEVIPFGAPHTLGLIRNLFDGVSGFHARLRTAPAAKGEDLEAPFVTDNGNYIVEMFFEDGIRGDLRDISDRLLRITGVVEHGMFLGMATTVIVANKDGTVAVMGRKK

SEQ ID NO: 43688 - protein, 82 aa, Sorghum bicolor
  Clone ID: SORBI-28MAY03-C1408_1.pep
MGKYVELLDMGVRIAARFHSHCPQTARLYYHPPAGGTGSHAAAASGGDGRKGDAAASAAMMMKKQQGQRLDAPSEIILYTVV

SEQ ID NO: 43689 - protein, 108 aa, Sorghum bicolor
  Clone ID: SORBI-28MAY03-C14147_1.pep
HVAGLDARPRLRLVFPPSTETFYFEELIIFWSIAFPRWLELLIQKCKGLRRFELQCGLSLLRSCLDSGKNWHLVQQIPEVRIISCDGKRYFRYNKSRRIYETNAQSEE

SEQ ID NO: 43690 - protein, 107 aa, Sorghum bicolor
  unsure (1)..(107): unsure at all Xaa locations
  Clone ID: SORBI-28MAY03-C143_1.pep
VRRLXNELNKEAVMNVLLPHRADRIKPLFVVNFLQSKDKQLRVATLWCLLNLIYPKCEASSGRVVRLQNAGVIQQVKSMINDPCLDCKLRVRMVLEHCVDNADDCFM

SEQ ID NO: 43691 - protein, 295 aa, Sorghum bicolor
  Clone ID: SORBI-28MAY03-C40_1.pep
MFRRKHASHFNSNDAEQQEAKINELKYALGPLSAHDEKYCSDTCFRRYLEARNWNVTKSRKMLEESLKWRATYKPEDIRWPDVSVEAETGKMYKASFRDREGRTVIIMRPTKENSTSHDGKIRFLVYVLENAILGQHEGQEKMVWLIDFAGWTMAHATPIKTARESTSILQNHYPERLAVAFLFNPPKVFEAFYKAVKYFLDPRSIEKLNFVYLKDEESMKVLYKCIDPEVLPVEFGGRNSVMYNHEEYSKLMLQEDIEPSSFWEDDAKTVDHAVNGTLVPDVAPRSLQLAAKAS

SEQ ID NO: 43692 - protein, 79 aa, Sorghum bicolor
  Clone ID: SORBI-28MAY03-C40353_1.pep
MESSSSNASNVPLPASQRPLHATDADEEDDSVKQLNECATVYLSLQDCLIESNRNWKVCQAHVQALKACQAKRNKSGQT

SEQ ID NO: 43693 - protein, 167 aa, Sorghum bicolor
  Clone ID: SORBI-28MAY03-C40089_1.pep
VALCIVELNAPSFYPSVVSLWVNDSFERKDMERELLAKLLVSLCSGRHNLLSKQQLSDGLSSVLASLEDTLSDAPRATEYLGRLLARFVEESVLLLQEVGKLIQEGGEEPGYLIQDGIAADILGAVLDSIKSDKGDSFLNEVKSTSSLKLVDFRPQHLKRSKLDAFM

SEQ ID NO: 43694 - protein, 212 aa, Sorghum bicolor
  unsure (1)..(212): unsure at all Xaa locations
  Clone ID: SORBI-28MAY03-C40600_1.pep
MAYSGQRHGGVGSSSRPGNGFKGAANSVEFLGREMLGMQLRDAKPDTDDEREMGSSSDVTDSSSNEAGHVIATTIRGHNGLPKQSVTYIAEHVVGTGSFGVVYQAKCRETGEXVAIKKVLQDKRYKNRELQIMHMLDHPNIIGLKHYFFSTTERDELYLNLVLEFVPETVNRIARXYNRMNQRMPLIFVKLYTYQICRALAYIHNCIGICHR

SEQ ID NO: 43695 - protein, 164 aa, Sorghum bicolor
  unsure (1)..(164): unsure at all Xaa locations
  Clone ID: SORBI-28MAY03-C40924_1.pep
MGLISNDAWHKRFFSVAPPAALVFFFVLIFVAGAIVTLDHKESLSILQLQPKGVIAAVEMRPPATSELRSSATTEPRAEPAEEPDICENKCRPPGSEPLPRGIVQDKSNFEMESLGGNPERKENGNGRQPKSLLAIPVGIKQKAIVDKLVSXFPEAKFTVMLFH

SEQ ID NO: 43696 - protein, 325 aa, Sorghum bicolor
  Clone ID: SORBI-28MAY03-C15266_1.pep
MGQDGQQIRRDKLIIDTDPGIDDSMTILMAFRAPSLEIIGLTTIFGNVDTVGATRNALLLCERAGHPEVPVAEGSHEPLKGGKPRVADFVHGSDGIGNLFLPAPSAKKVEESAADFLINKVSEFPGEVSVLALGPLTNVALAIKRDPSFASKVKKIVVLGGAFFAAGNVNPAAEANIHGDPEAADIVFTSGADIVVVGINITTQVCLTDEDLLELRNSKGKHAPLLSEMCKFYRDWHAKSDGFHGIFLHDPVSFTAVLHPEYFTFKKGVVRVETQGICTGHTLMDHGLKKWNSENPWSGYKPISVAWTVDVPKVISFVKKLLMAQ

SEQ ID NO: 43697 - protein, 172 aa, Sorghum bicolor
  Clone ID: SORBI-28MAY03-C15481_1.pep
IAQCNASLISLKMRDGVQIFLHSSIASCSFSTLVQTVWQLAVISATLSSYFFLHPSSQDLESGVPKPCFLLHFNEHWTASIHTFLKRLLRAQDSLQAGSLSFFSAQRFLQVSSFSFLSAAAPAMSARTNTKSTTTIFIFFGNGDRDVVAIGIIGADRGGWHLNLFAYPGPAG

SEQ ID NO: 43698 - protein, 404 aa, Sorghum bicolor
  Clone ID: SORBI-28MAY03-C1552_1.pep
MACSAQLLSQSLYSSHRASPPGPRNLRSQGRPPARASPAARPGSRARGCRGVSLRVDASFEEGRRQVEVSYDPQARFNQIADQIDKDAGMTRLNLFSPCKINVFLRITGKRPDGFHDLASLFHVISLGDTIKFSLSPSKSRDRLSTNVPGVPVDESNLIIKALNLYRQKTGTNNFFWIHLDKKVPTGAGLGGGSSNAATALWAANQFAGCIASEKDLQEWSGEIGSDIPFFFSQGAAYCTGRGEIVQDIPNPLPENLPMVLIKPPEACSTAEVYKRFKLEQTSQADPLTLLKEITQNGISQDVCVNDLEPPAFEVLPSLKRLKKRIIAASRDDYSAVFMSGSGSTIVGIGSPDPPAFVYDDEDYKDVFWSEACLLTRDENEWYREPISSNATSSKDGLEASVAD

SEQ ID NO: 43699 - protein, 332 aa, Sorghum bicolor
  Clone ID: SORBI-28MAY03-C15660_1.pep
MAAASSRRASQLLGSAASRLLHARGFAAAAAAAPSPAVFVDKSTRVICQGITGKNGTFHTEQAIEYGTNMVGGVTPKKGGTEHLGLPVFNSVAEAKAETKANASVIYVPPPFAAAAIMEAMDAELDLVVCITEGIPQHDMVKVKAALNRQSKTRLIGPNCPGIIKPGECKIGIMPGYIHKPGRIGIVSRSGTLTYEAVFQTTAVGLGQSTCVGIGGDPFNGTNFVDCLEKFVDDPQTEGIVLIGEIGGTAEEDAATFIQESKTQKPVVAFIAGLTAPPGRRMGHAGAIVAGGKGTAQDKIKALREAGVTVVESPAKIGSTMFEIFKQRGMVE

SEQ ID NO: 43700 - protein, 143 aa, Sorghum bicolor
  Clone ID: SORBI-28MAY03-C1572_1.pep
HKIKDYFKSKKMEMTIKYIDPTYMIRAIPSNAPDPRVRTLLAHSAIHGAMAGYSFTVGMVNGRHTYIPFYRVTSTRNKVKVTDRMWARLLSSTNQPSFLSQKDIDEASEADRLANRPPLPTGASSRVARSFDQSSSCSSNGEI

SEQ ID NO: 43701 - protein, 287 aa, Sorghum bicolor
  Clone ID: SORBI-28MAY03-C13563_1.pep
PGETRVVYVETMSNPTLAVADIPMLARVAHEAGAKLVVDNTFTPVVVSPARLGADVVVHSVSKFISGGADIIAGAICGPASLVNAMMDLQDGALMLLGPTMNAKVAFELSERLPHLPLRIQEHSRRALAFAERMQGLGLRVLYPGLPDHPHHARLAAMGNPGYGSGGMLCLDMGTEERANRLMHHLQNTTQFGLMAVSLGYYETLMSCSGSSTSSEMPPEDRARAGISPGLVRMSVGYNGTMEQRWAQFERALALMHPPTHHLSLKGAAAAADRDGSDAAGNNHRKH

SEQ ID NO: 43702 - protein, 335 aa, Sorghum bicolor
  Clone ID: SORBI-28MAY03-C13545_1.pep
MAMAKILLLILLGVVTAVVEAGDPPVKWKAAHASESIQQAVDAMPKGQQGRYVIYVKAGVYDEIVMIAKDKVNIFMYGDGPKNTRVTGQKSFADGITTMKTATFSIEAAGFICKNMGFHNTAGAAKHQAVALRVQGDLAAFYNCRFDAFQDTLYVHARRQFFRNCVISGTIDFIFGNSAAVFQNCLIITRRPMDNQQNSVTAHGRTDPNMKSGIVIQNCRLVPDQKLFADRFKIPSYLGRPWKEFSRLVIMESTIADFIKPEGYMPWNGDFGIKTLFYAEYNNRGPGAGTSKRVNWPGFHVITRKDAEQFTAGPFIDGALWLKFTGTPHILGFKS

SEQ ID NO: 43703 - protein, 225 aa, Sorghum bicolor
  Clone ID: SORBI-28MAY03-C13660_1.pep
MAAAKIAPSMLSSDFANLASEAERMVRLGADWLHMDIMDGHFVPNLTIGAPVIQSLRKHTKAYLDCHLMVTNPSDYVEPFGKAGASGFTFHIEVARDNWQDLIQSIKSKGMRPGVSLRPGTPVEEVFPLVEAENPVELVLVMTVEPGFGGQKFMPEMMDKVRTLRKKYPSLDIEVDGGLGPSTIDVAASAGANCIVAGSSIFGAADPGAVISVLRKSVEGSQNKN

SEQ ID NO: 43704 - protein, 206 aa, Sorghum bicolor
  Clone ID: SORBI-28MAY03-C13677_1.pep
MGSSEAEKPLRRIAASFEELAAVAKQQPPASMDAGAFSRACSNVSVLFGCLGIAFKFAEMDYVAKVDDLVEASKSILTLPSMVELDIQTDTVRKPGSHTRNLLRVKRGIDMVKVLFEQILVTEGNSLRDAASVAYAQVFAPHHGWAIRKAVAAGMYALPSKSQLLKKLNEDEESAKVQMQNFVRSSAPVICYVDDLFTSRNLGIDW

SEQ ID NO: 43705 - protein, 108 aa, Sorghum bicolor
  Clone ID: SORBI-28MAY03-C1377_1.pep
PNYFGEMFLWWGIFVASTPVLSDAEWLVILGPIFLTLLLLFVSGIPLLESSADKRYGRMEEYRVYKNTTSPLIPLPPAVYGSLPAWFKVAFLLELPLYNPGPGADPIS

SEQ ID NO: 43706 - protein, 395 aa, Sorghum bicolor
  Clone ID: SORBI-28MAY03-C13799_1.pep
MDSWTEAQLRKMEAGGNDRLNAFLTARGVTKETPPGAKYNSNAAAVYRDRIAALAEGKPWTDPPVVKETPGSGAPAAARKPPVHTSAASASGGGGWDDWDDDFRPDMRRNQSVGSFAAAGGQSGRQPPRSKSTQDMYTRQQLEASAANKEDFFATRGSSWRSKSTQDMPSQGGKYVGFGSSPAPSANRNGGAAQGDVMQVVSQGFGRLSLVAASAAQSAASVVQVGTKEIQSKMRDGGYDQKVNETVSVVANKTAEIGSRTWGIMRGVMALASQKVEEYAKEGGMSGWGDDWQRSEQNSEPYQRFEHETNGNSWNSSQNSSSKNNNSSSWDDWDDQGKKDEPAKPHQSSDSWAGWDDGKDDGFDSPSYNNHSTPNKGSNQNGTTGGTFWTEGGFR

SEQ ID NO: 43707 - protein, 151 aa, Sorghum bicolor
  unsure (1)..(151): unsure at all Xaa locations
  Clone ID: SORBI-28MAY03-C16508_1.pep
AMARLTTDQLSEPGSPENILYYHMIPEYQTEESMYNAVRRFGKVRYDTLRLPHKVVAREADGSVKFGPGEGCADPYARDIHPGGRNTVQGIDAVLFAPDDTKATQTADPNRKPPAIVAHKKKIKLRXGKLLEATCQMAGLFGQRSRFASCQ

SEQ ID NO: 43708 - protein, 196 aa, Sorghum bicolor
  Clone ID: SORBI-28MAY03-C1647_1.pep
PAWLRRRAPISGSTVLPYFAPIADRLGALPYLGPFADRTRRRGAPPPACRPLVNIPFDKGRLSKEELEKMVQEAEKYKAEDEEHKKKVDAKNSLENYAYNMRNTIKDDKIASKLGADDKKRIEDAIDGAISWLDSNQLAEADEFEDKMKELESICNPIIAKMYQGAGADMGGAAGMDEDAPAGGSSGAGPKIEEVD

SEQ ID NO: 43709 - protein, 153 aa, Sorghum bicolor
  Clone ID: SORBI-28MAY03-C16511_1.pep
GPLRCAPLPSEHLCDKPLGAADYFGLFKKFHTLALDGVPKFGSSNRTAAYRFVTLIDVMYENKARLLCTAEAGPVGLFENIVTVAEAQKVSPRSSRSQKSDDPDLCVGFVTSQEKGGIVAVEPGRLAATKWSEAAAAGAVQLSWLARVVRFLS

SEQ ID NO: 43710 - protein, 267 aa, Sorghum bicolor
  unsure (1)..(267): unsure at all Xaa locations
  Clone ID: SORBI-28MAY03-C16607_1.pep
MAAERAPVLVRHAGGGVEALRQLPPGFRFRPTDEELVVQYLRRKAFGVPLPAAVIPVVRDLYSLDPWDVVVVPGPGTAPRQATXASNEHRRVTKIEKELKLQSFFAPDASSEGEKYFFAVRPAGAGKSGGARATASGRWKPSGKEKPVVLPRPCGGGSLLVGVKRAMTFVPRRKKKAASSAAAALTTGWVMHEYRSPRRCTRTAAAWLKLKESGSSAASSRRAAAAAGRAGGERCRPPTPAAVAASPSSASSCVTDGSSSDLDEVNS

SEQ ID NO: 43711 - protein, 293 aa, Sorghum bicolor
  Clone ID: SORBI-28MAY03-C16666_1.pep
ARGDTSAALSAYCAAAGIPAIVFLPADRISLQQLIQPIANGATVLSLDTDFDGCMRLIREVTAELPIYLANSLNSLRLEGQKTAAIEILQQFNWQVPDWVIVPGGNLGNIYAFYKGFEMCRVLGLVDRVPRLVCAQAANANPLYRYYKSGWTEFQPQVAETTYASAIQIGDPVSVDRAVVALKATNGIVEEATEEELMDATALADRTGMFACPHTGVALAALFKLRDQRIIGPNDRTVVVSTAHGLKFTQSKIDYHDKNIKDMVCQYANPPISVKADFGSVMDVLQKNLNGKI

SEQ ID NO: 43712 - protein, 252 aa, Sorghum bicolor
  Clone ID: SORBI-28MAY03-C14521_1.pep
RPCKKEIRLGAPATQWISVYNSRQPMKQRYHYNVADARLAQHVEKGNEDGLLISSISSCSNLWAIIMDAGTGFSAQVYELSSHFLHKEWIMEQWDKSYYISSVAGSNNGSSIVVMSKGTPYTQQSYKVSDSFPFKWINKKWREGFHVTSMATSGNRWAIVMSRSAGFSEQVVELDFLYPSEGIHRRWDNGFRITAMAATMDQSALILSKPRRRPRDETQETLRTTQFPSQHVKDKWAKNLYLAGICYGRTVA

SEQ ID NO: 43713 - protein, 189 aa, Sorghum bicolor
  Clone ID: SORBI-28MAY03-C1454_1.pep
MAARRLLLLLAVVAASLLAADARPCHTFLVAFPADPNPNPNPSRGDGAVHHHLGIPHVATVITVFRVRRLGPQVPHGHRNHHLHSIPANVQIHRPDLPHPAAGAGAAAGPQERARGILVVVVGLLFGIACGALTAASAYLVWSMVAGAAAASPYDELYDDEDEASDTESPKKVGDVIIQELEARDGGKN

SEQ ID NO: 43714 - protein, 232 aa, Sorghum bicolor
  Clone ID: SORBI-28MAY03-C1467_1.pep
MASPAEETPAAEDTASPPPPPPARSRGFWFLGEDKSVHKALGGGKTADVLLWKDKKTSAAVVGGATILWVLFEIVEYHLLTLVSHVLIVALTILFLWSNATVFIKKSPPDVPEVQISEDLAVNIALALRADINKALALLREIALGHNLMKFLGVIVALWILSEIGELCELLRFMYIAVLILHTVPILYHKYQDQVDDFAAKAHRELCKQYKVLDAKVLSKIPRATPKDKKQN

SEQ ID NO: 43715 - protein, 188 aa, Sorghum bicolor
  Clone ID: SORBI-28MAY03-C14876_1.pep
FRELAASTASKLERAAPVRGATAGEGDEIGIDPGNETPEQRNKFLVLRLYEALNARDHAAVQSLLAPDLEWWFHGPPKHQHMMRLLTGGGGSSGGFRFVPRSVDALVAPTPTTSTTVIAEGHEGRCYWVHAWTVGADGVITQLREYFNTDLTVTRLAAVAVAASAKCVWQSRRPDSATNSLPGLLLAL

SEQ ID NO: 43716 - protein, 315 aa, Sorghum bicolor
  Clone ID: SORBI-28MAY03-C14969_1.pep
TRVQLTGSQNEGVRQEAAGALWNLSFDDRNREAIAAVGGVEALVALVQQCLNASQGLQERAAGALWGLSVSEANSIAIGQGGGVAPLLTLARSEVEDVHETAAGALWNLAFYYGNALRIVEEGGVPVLVKICSSSGSKMARFMSALALAYMFDGRMDEVALVGASSDSSSKSVNVEGARRIAFKHIETFVLTFSDPQMFSMAAASSAPAALSHVAEAVFIHEAGHLRCSRSEIGRFVAMLRNPSPILRACAAFALLQFTIPGGRHAVHHAGLLQEAGAGRVLRAAAAATTASIEAKIFARIVLRNLEHHQSGTST

SEQ ID NO: 43717 - protein, 63 aa, Sorghum bicolor
  Clone ID: SORBI-28MAY03-C17118_1.pep
MAGGRVAHATLKGPSVVKEIFIGMTLGLIAGGMWKMHHWNEQRKTRSFYDMLDKGQISVVVEE

SEQ ID NO: 43718 - protein, 96 aa, Sorghum bicolor
  Clone ID: SORBI-28MAY03-C17239_1.pep
MLQFPALMRQWPSPPLIPASTLLPVPATSQEDELLLAMAESDLEDKLNEIRKTNSHLVIIGKPTGDTKEEYDAEVEDDDADNVEESDGDDFDQETG

SEQ ID NO: 43719 - protein, 112 aa, Sorghum bicolor
  Clone ID: SORBI-28MAY03-C17307_1.pep
MGFEKQILRAGTGPKPVKGQKVTVHCTGYGKDRDLSKKFWSTKDPGQQPFSFNIGLGSVIKGWDEGVMTMQVGEVARIQCTPDYAYGAGGFQAWGIQPNSVLAFEIEVLSAQ

SEQ ID NO: 43720 - protein, 133 aa, Sorghum bicolor
  Clone ID: SORBI-28MAY03-C17329_1.pep
AQTNERTARFYQYQRYNTSFQGRSYETHPQAGPWRRCGRRPQQATGTGTGTGRACSRSSRQRSTECRRSSQSGSRGSAGPGPRPCRAPAAAPSRGRRRSCSTSWRVGSSGGCLPVVVGCSFARRHPSTGRLLF

SEQ ID NO: 43721 - protein, 256 aa, Sorghum bicolor
  Clone ID: SORBI-28MAY03-C1743_1.pep
ARGGTRLSGILVVKGTAYSPLREARENEDTHGTLLSQNVIGVIHDHYVTFRLDMDVDGADNNSFVRVEMARQETAPGESPRRSYLKATRHVARTEKDAQVRLKLYDPAEFHVVNPTKKTRVGNPVGYKLVPAGTAASLLDPEDPPQKRGAFTNNQIWVTPYNKSEEWAGGLFVYQSKGEDTLATWSERDRPIENKDLVLWYTLGFHHIPCQEDFPIMPTVSSSFDLKPVNFFESNPILKQRPTKEDDLPICSATAV

SEQ ID NO: 43722 - protein, 206 aa, Sorghum bicolor
  Clone ID: SORBI-28MAY03-C15779_1.pep
PRVRKSLLKIWNLNNFTGVIGVFNCQGAGQWVWPVKETAYVPINVNIIGQLSPSDVESLEEIAGDDWDGETAVYAFGSCSLSRLQKHKSLEVSLSTMACEIYNISPIKIFSEAVWFAPLGLIDMFNSGGALHNVSSVADSSATTVHIRCRGPGWFGAYSATRPELCRVDEHEVEFTHAEDGLLTFYLPLSSSQDNLRHIEIVYRAL

SEQ ID NO: 43723 - protein, 244 aa, Sorghum bicolor
  Clone ID: SORBI-28MAY03-C15898_1.pep
MTEYWVSQGNKWCDFCKIYIANNSFSIRTHELGKRHKDNVTKRLSTMQKESEAKEKEQQQAARALQQIEAKAKKSYQKDLENNQRNVDGDTSAPGDGWVFDSASGYYHDKSTGLYYDSNSGFYYSDSLGKWVTQEEAYKSVQISKTDIGQSSTSQTKAPAAETAVPAIKGGPAPGRVVTKPLNPMRPIKGTPAPSAVAVNKRKREDGKPKVISKEEEAALKAREAARKRVEDREKPLMGLYKTY

SEQ ID NO: 43724 - protein, 450 aa, Sorghum bicolor
  unsure (1)..(450): unsure at all Xaa locations
  Clone ID: SORBI-28MAY03-C16066_1.pep
ARGILVFLTGEEEIEDACXRKINKEINNMGDQVGTVKVVPLYSTLPPAMQQKIFEPAPAPLKEGGPPGRKIVVSTNIAETSLTIDGIVYVIDPGFSKQKVYNPRIRVESLLVSPISKASAHQRAGRAGRTQPGKCFRLYTEKSFNEDLQPQTYPEILRSNLANTVLTLKKLGIDDLVHFDFMDPPAHEALMRALEVLNYLGALDDEGNLTQLGEMMSEFPLDPQMSKMLVISPKYNCSNEILSISAMLSVPNCFLRPREAQKAADEAKARFGHIDGDHLTLLNVYHAYKQNNEDPQWCYENFINSRALKSADNVRQQLVRIMTRFNLKMCSTDFNSREYYVNIRKAMLAGYFMQVAHLERTGHYLTVKDNQVVHLHPSNCMDHKPEWVIYNEYVLTTRNFIRTVTDIGGEWLIDIAPHYYDLSNFPSCEAKRVLERLYNKRERERASNRG

SEQ ID NO: 43725 - protein, 201 aa, Sorghum bicolor
  Clone ID: SORBI-28MAY03-C1628_1.pep
MAGPGVLNERILSSMSQKHVAAHPWHDLEIGPGAPEVFNCVVEIPRGSKVKYELDKASGLIKVDRVLYSSVVYPHNYGFIPRTLCEDSDPMDVLILMQEQVVPGCFLRARAIGLMPMIDQGEKDDKIIAVCADDPEFRHYTDITDLPPHRLQEIRRFFEDYKKNENKEVAVNEFLPAKDAINAIKYSMDLYGSYIIESLRK

SEQ ID NO: 43726 - protein, 119 aa, Sorghum bicolor
  Clone ID: SORBI-28MAY03-C16358_2.pep
DADAGAAGGVCGGGVRGGLRARGLPAHAARLRRIMSGATTMYFLSLSNTITIAGSFYLYACIATARWPAMYFFLPETMGKSLEDTVKLFGKDADDEDVGDDSRRHVPSKKPSTELSAQQ

SEQ ID NO: 43727 - protein, 97 aa, Sorghum bicolor
  Clone ID: SORBI-28MAY03-C16358_1.pep
MDWLGQKRAEMLMQVLLVASAVVAFVVGYVRADFQLMLLVYAGGVVLTAFVTVPNWPFFNRNPLKWLDAAEAERHPRPQVSAGGAAGGGKKKSGKNK

SEQ ID NO: 43728 - protein, 231 aa, Sorghum bicolor
  Clone ID: SORBI-28MAY03-C1648_1.pep
SASLCHPRGFLLRHRKKLQVRPQRWQPSTAAFPSGAAHHRQPSPARPEPPPPDTAGASAAPRPAFPPPPRFRTHSRGLIGLHGRGGAQGPRPRLLQPPAAAHGAAVQDTKLHGYDIPAKTRVLINAWAIGRDEESWENADTFRPERFVHTTNFDYSGKDFRFIPFGAGRRGCPGIGFGTRLAELALANLLHHFDWELPDDQDLESFEVVESSGLSPGLKYPLTLVSKTPQA

SEQ ID NO: 43729 - protein, 159 aa, Sorghum bicolor
  Clone ID: SORBI-28MAY03-C1809_1.pep
MAAVVRGVLRGIKEKGLTNFIRDARDEGYFKCLLDGNLLQTKIHNIGATLVGVDKFGNKYYEKLHDTQYGRHRWVEYAEKGRYNASQVPPEWHGWLHHVTDSTGDKLLNQKTARYLVEHKQNYSGEGEELIYHSKGHALNPGQRDWTRYQPWEPKKEQA

SEQ ID NO: 43730 - protein, 177 aa, Sorghum bicolor
  Clone ID: SORBI-28MAY03-C1819_1.pep
MADSSAPTRVMMAVNESSLKGYPHPSISCRTAFDWTLSKLVRSNPGGFHFLFIHVQVPDEDGFDDMDSIYASPEDFHQMKRRDKIRGLHLLEYFVNQCHQLGIKCEAWIRHGDPKEVICSEVKRVQPDLLVVGSRGLGPFQRVFVGTVSEFCVKHAECPVITIKRNATEAPQDPVDD

SEQ ID NO: 43731 - protein, 55 aa, Sorghum bicolor
  Clone ID: SORBI-28MAY03-C18265_1.pep
MLFRRRSGLDDVDMSGSQLGSPAHAGRKRGSPRTAESQRAIAETKTCGEKSRGRK

SEQ ID NO: 43732 - protein, 70 aa, Sorghum bicolor
  Clone ID: SORBI-28MAY03-C18288_1.pep
MAGGNLFGRALSYVVNEFLVEGLANNRAFQRFAVKTNRTLENLSSKAKEVTEELSEQLKEARGEKDHFKH

SEQ ID NO: 43733 - protein, 68 aa, Sorghum bicolor
  Clone ID: LIB5121-003-A1-PF1-F1.pep
MAGGNLFGRALSYVVNEFLVEGLANNRAFQRFAVKTNRTLENLSSKAKEVTEELSEQLKEARGEKDVS

SEQ ID NO: 43734 - protein, 258 aa, Sorghum bicolor
  unsure (1)..(258): unsure at all Xaa locations
  Clone ID: SORBI-28MAY03-C18529_1.pep
MAEEKESTSIPLSQAAEAVDPEDPAKSPPRPSSPTTSTRKACCAVLQSWVSRKFMTGCVVLFPVAVTFFITWWFIQFVDGFFSPLYAKFGVDIXGLGFLTSLVFIFLVGIFVSSWVGSTIFWVGEWFIKKMPFVRHLYSASKQVSTAISPDQNTTAFKEVAIIRHPRIGEYAFGFITSTVVLQTDKGDEELCSVYVPTNHLYIGDIFLVNSEEIIRPNLSIREGIEIIVSGGMTMPQVIASLEPMPRKSQSIRLNRMT

SEQ ID NO: 43735 - protein, 111 aa, Sorghum bicolor
  Clone ID: SORBI-28MAY03-C17809_1.pep
MDKGKGAVVVAPAPAAAAGKKAKRFDIKKWNAVSLWAWDIVVDNCAICRNHIMDLCIECQANQASATSEECTVAWGVCNHAFHFHCISRWLKTRQVCPLDNSEWEFQKYGH

SEQ ID NO: 43736 - protein, 124 aa, Sorghum bicolor
  Clone ID: LIB5052-011-A1-XP1-A5.pep
MSAMETDINAPPPPAPAGEGSSAAGPSSSTSRKPNKRFEIKKWNAVALWAWDIVVDNCAICRNHIMDLCIECQANQASATSEECTVAWGVCNHAFHFHCISRWLKTRQVCPLDNSEWEFQKYGH

SEQ ID NO: 43737 - protein, 211 aa, Sorghum bicolor
  Clone ID: SORBI-28MAY03-C16755_1.pep
ETTHYILGSVAGPHPYPMMVREFHKVIGKETRRQAMDKWGGKPDVLVACVGGGSNAMGLFHEFVEDQDVRLIGVEAAGHGVDTDKHAATLTKGEVGVLHGSMSYLLQDDDGQVIEPHSISAGLDYPGVGPEHSFLKDIGRAEYDSVTDQEALDAFKRVSRLEGIIPALETSHALAYLEKLCPTLPDGVRVVVNCSGRGDKDVHTASKYLDV

SEQ ID NO: 43738 - protein, 463 aa, Sorghum bicolor
  Clone ID: SORBI-28MAY03-C16917_1.pep
MAAAASACGGAGCGPQCSSSAGGEGDASSESMGRLSISSAAAAAATCGKCDGGGAAVAVAGGVGMCVDCFRAHLFGKFKLAVTSNAMVRPTDAVLLAFSGGPASRVALQFIHEMQSKAIQSWETRDAQALPAFRLGVAFVDESVLSVRPGHEIDTAIEDIKSIVSSLSPGDKQLHVAPLEDVISSGSDDKAARLKELVGVINDETGRDDFIRCLRMLSLQKIALENGYTKIMLGTCASGIACHVLSATVKGQGYALPADVQYVGTRWEVPVVLPLHDCLAQELNLLCELDSLKTPQLLDRPCSGINGLVASFVSRLREENPSREHTILRTAQKLKPFSFNKFSANGYHDFLPSRLRPKFQNIDANESTFSEILCLICGSPFSESELQNLENTKHKAQKKTDLYAAHCCQSCHFQILPAATDMHGHFFSLLPKFWTEKVDTASASHSSLRDQIADYLLDEDDEN

SEQ ID NO: 43739 - protein, 262 aa, Sorghum bicolor
  Clone ID: SORBI-28MAY03-C16927_1.pep
ARGNARRMQHGAERMCMPAPSVEQFVHAVKQTVLANRRWVPPQGKGALYLRPLLMGSGPILGLAPAPEYTFLVYAAPVGNYFKEGLAPINLVVHDEFHRAMPGGTGGVKTIANYAPVLRAQTDAKSKGFTDVLYLDSVHKRYLEEVSSCNVFVVKGGVVATPATQGTILPGITRKSVIELARDRGYKVEERLVSIDDLMSADEVFCTGTAVVVAPVSTVTYRGNKYEFRTGPDTVSQELYTTLTSIQMGLAEDNKGWTVAVE

SEQ ID NO: 43740 - protein, 99 aa, Sorghum bicolor
  Clone ID: SORBI-28MAY03-C17072_1.pep
MKSSTLLLVILCLQAALVMGIFAAVAKENAVGESKAIDINPGQLKCCTNCNFSFSGLYTCDDVKKNCDPVCKKCVAVQTYSGKMFKCTDTFLGMCGPNC

SEQ ID NO: 43741 - protein, 112 aa, Sorghum bicolor
  Clone ID: SORBI-28MAY03-C17100_1.pep
MRPLVILAAVTLVALGVLATLPLGEGSSWPCCDNCGVCNRKLPPDCKCNDVSVQGCHPECKNCVKVGAGIRPGGGHGPVVTYRCDDILTNFCEHRCTAAPPPEAAAFLGDGF

SEQ ID NO: 43742 - protein, 299 aa, Sorghum bicolor
  unsure (1)..(299): unsure at all Xaa locations
  Clone ID: SORBI-28MAY03-C1960_1.pep
CASVHHNANAINRWNRNLLFIGGNRDEECLQDMEGDEWDGXSIEAHTSTCSCAPHRVDNNSVGITGLAFARVSELLVSYNEENIYLFPKNGGLGSDPKKSVKIGANEGCKSTTLASGHDVSQPAPQVYVGHRNCETVKRVSFIGPNDEYVASGSDCGRMFIWRKRDGKFLRAMEGDECIVNCIEPHPHAMTIASCGIDNDVKVWTPSAIERAPVVNVDELQSRPRKRRAKFWRFDLPDLLIQHILVSEHRQRSAEEDSSEDHEDNTGLLNLVLRAAVGGVSSDDDGDDDDDDETSDGSE

SEQ ID NO: 43743 - protein, 247 aa, Sorghum bicolor
  unsure (1)..(247): unsure at all Xaa locations
  Clone ID: SORBI-28MAY03-C1961_1.pep
SDIPELNPEVDVYRIGTLMELVRELSLSFADDGKRVKSLDSXVCVQGSMGQGAFAGIPLQLAGIRKILEFMDWGDYGAKGTFINIGALGASEVDKEDDMFVLIAPQNAVGNCIIDDMRAMTDAAGDRPVILVNPRLKDMPGSSGVMQTMGRDIRLKYAASFETCYSFRLLYYAGSFYPIMGALRMSYPNRYEIYRRVDELNGKEKYILIAEFTNKPTPDDITCAFTGRKKEEEKTPSGFWGFLNGIF

SEQ ID NO: 43744 - protein, 215 aa, Sorghum bicolor
  Clone ID: SORBI-28MAY03-C20079_1.pep
MNAFRFLGDMTHLFSVLVLLLKIYATKSCSGVSRKTQELYMLVFVARYLDLFTDYVSLYNSVMKVVFITSSVAIVWCMRRHPQVRRTYDKEQDTFRHAVLVAASFLLALMFHERFTFREICWAFSIYLEAVAILPQLVLLQRSRNVDNLTGQYVFFLGAYRAFYILNWIYRYFTEGHHSRWIPWLAGLVQTALYADFFYYYFLSWKNNVKLELPA

SEQ ID NO: 43745 - protein, 194 aa, Sorghum bicolor
  Clone ID: SORBI-28MAY03-C20277_1.pep
MASEEMKATEVAALLDLKPHPEGGFYAETFRDGSVTLTTSQLPPHYKVDRAVSTAIYFLLPAGSVSRLHRIPCAETWHFYKGEPLTVFELHDDGHIDLTVIGPHLEAGQRPQYTVPPNVWFGSFPTLDVESFASDGSVLVKSRKRDPELHYSLVGCTCAPGFQYEDFEMAKFEDVSSIAPKAEPFLKFLIPSTE

SEQ ID NO: 43746 - protein, 130 aa, Sorghum bicolor
  Clone ID: SORBI-28MAY03-C20870_1.pep
RHKHLVISKKFTRGRKGKREMSYQKVPPEEPYPPPGYPRPPPPDVYPPPPWGHGHPPPPPPPQGPYYPPPQHPPPGYQGYFNDPPPHGEYQQQHHHNHGNQGSSSSSGFLKGCLAALCCCCVLEECCGCF

SEQ ID NO: 43747 - protein, 148 aa, Sorghum bicolor
  Clone ID: SORBI-28MAY03-C17474_1.pep
MEEDSPLTKTVKGAVTGLAAGTIWGTVVATWYDVPRVERHVALPGLIRTLKMCGTYGATFATIGGLYIGVEQLVQSQRKKRDFVNGAVGAFVAGASVCGYRGKSIQSALIGGSCLAFTSAVLDIGGNTTRVDNGKEYYAYTTEKKPAN

SEQ ID NO: 43748 - protein, 312 aa, Sorghum bicolor
  Clone ID: SORBI-28MAY03-C17650_1.pep
MDPDFSRASGGPSFEFAFNSVNFSDRVLRIEIVAGDDALGAKGAAGEGCSSLADWARHRKRRREELRRGKESGKYMPDPGNCKVEAEECDAYEEGNEPVAMIEESPPDIEPDGEDGESSDSSWSMECTQVLRVKSIYISSAILAAKSPFFYKLFSNGMKESDQRHATLRITASEENALMELLSFMYSGKLTTNQPTALLDILMVADKFEVVSCMRHCSQLLRSLPMTTESALLYLDLPSSISMAAAVQPLTDTAKEFLANKYKDLTKFQDEAMNIPLAGIEAILWSNDLQVASEDAIYDFVIKWARAQYPKL

SEQ ID NO: 43749 - protein, 299 aa, Sorghum bicolor
  unsure (1)..(299): unsure at all Xaa locations
  Clone ID: SORBI-28MAY03-C17698_1.pep
MTRRVLPLLLLLALLPSLAPPGASARPGAGQDLGHQCPVLEHGLPPFAAALRASCPVSTEGYSPPEEVVNGEELLRMLDSKEEHTAVLFYASWCPFSQRIRPVFDDLSSMFPRVKHVAVEESNIVKAILSRYHVRALPSIIIARSSYVFWPLGSKDLDSLVNLYTTATGQEPVAYIGTRKWSAARSTDYAKIWNSSISETVKREPYLAFSILFICLRIFFFFFPKFFALIQDFWTEYYEQXHLGILAKLTHAVDVRKVWSKLRLMVGAKNGRIWASLASVSLGGQPSPRVAVGLMGSTI

SEQ ID NO: 43750 - protein, 285 aa, Sorghum bicolor
  Clone ID: SORBI-28MAY03-C17798_1.pep
MRSSPRMDPNPRAPLLLAIIVLALGASVAAGAKDDASGVSLGRRAGGFLHGLKKKDALVEGDHGVALDEVGPGLFDALFASLSMILVSEIGDETFIIAALMAMRHPKSIVLSGALSALYVMTVLSTGLGRIVPNLISRKHTNSAATVLYLFFGLRLLYIAWKSDPKGSQKKEMEELEEKLESGQGKSTIRRFFARFCTPIFLEAFILTFLAEWGDRSQIATIALATHKNAIGVAVGASLGHTLCTSLAVVGGSMLASKISQRTVATIGGVLFLGFSVSSYFYPPL

SEQ ID NO: 43751 - protein, 115 aa, Sorghum bicolor
  Clone ID: SORBI-28MAY03-C17874_1.pep
MKLVRFLMKLNNETVTIELKNGTVVHGTITGVDISMNTHLKTVKLTLKGKNPVTLDHLSVRGNNIRYYILPDSLNLETLLVEETPKVKPKKPTTGKPLGRGRGRGRGRGRGRGPR

SEQ ID NO: 43752 - protein, 120 aa, Sorghum bicolor
  Clone ID: SORBI-28MAY03-C2217_1.pep
DLSSIEPGTTVTVKWRGKPVFIRRRTEDDIKLANSVDVASLRHPEQDAERVKNPEWLVVIGVCTHLGCIPLPNAGDFGGWFCPCHGSHYDISGRIRKGPAPFNLEVPTYSFLEENKLLIG

SEQ ID NO: 43753 - protein, 162 aa, Sorghum bicolor
  Clone ID: SORBI-28MAY03-C22524_1.pep
MAPIAVGDSLPDGQLGWFDENDQLQQVSVHALAAGKKVILFGVPGAFTPTCSNQHVPGFITQAEQLKAKGVDEILLISVNDPFVMKAWAKTYPENKHVKFLADGSGAYTKALDLELDLTEKGLGVRSKRFALLADDLKVTVANIEEGGQFTISGAEEILKAL

SEQ ID NO: 43754 - protein, 158 aa, Sorghum bicolor
  Clone ID: SORBI-28MAY03-C21501_1.pep
MCCIWRSVYVTIMPWHVVFPLHQHFGSCCHLRVIGMGGLLPLPWGTFLGTPPELCGSMVMVGMPGCLGVESDDDALRVRTMLRKDFQVEVPIYYNSRRVEGQEMAKDRNGDPVTGYVRISHQVYNVTKDYERLRDAVNKLVSEGFTSINLRPSEKQEA

SEQ ID NO: 43755 - protein, 120 aa, Sorghum bicolor
  unsure (1)..(120): unsure at all Xaa locations
  Clone ID: LIB5048-012-R1-XP1-D8.pep
XXFFFFFWVFFFFFFFFFFFFFTAAVNILTFRLFLGYSNSQNVGEEGRRHARALLLHTLNAKYNTCQFLEVHYIHQLAGYARNYVTITKQQYWLRWSDPHLSSWPQRLQVDDTWLEDHYT

SEQ ID NO: 43756 - protein, 265 aa, Sorghum bicolor
  Clone ID: SORBI-28MAY03-C22731_1.pep
AQTTQQRIFPFDLELKQSPDPETAQDEHTKANCKIGKGNLFFLGVPSFSCAKIWHRAAVGGWTRARERIGYFSAAAGWGGGSPWRRPPPSAAPSPRTSGPPAAHRAPATTCRSPTPPPRGLRRPSYQPRPRRPPARSLGAGPERRRSRRGGSRRPRRRPGPPRRRAGRARRTRGASGRGRPGRRRPGATTRGRSPPPPAARASASGRGTAPRKARRAPPRGSASRRRCRSQPPSASCRSSCCFTRSHSSQLPLYYQCRAWLGTIP

SEQ ID NO: 43757 - protein, 103 aa, Sorghum bicolor
  Clone ID: SORBI-28MAY03-C23048_1.pep
KLPSQICLFNEIQAIQPAREKISTKPNSHSCFMFIYIYLVYRGCVVPKLRTPQAQSQILQHINIKHIETMDTTTAPRLSAVLAKLNIQHATPDWIFILIALVL

SEQ ID NO: 43758 - protein, 145 aa, Sorghum bicolor
  unsure (1)..(145): unsure at all Xaa locations
  Clone ID: SORBI-28MAY03-C2063_3.pep
FQARNSRCSFENHRKTGDVASRARPLIIXKTTEALSVSINQLSXHGRIKNALEEGVTIVDSXTSSIIELXETKKIQIRRKPASSSXIYMPNSAVDTHKPSLLISHHEPASAAQETGLYASRDNSISKYKHCSCLIRLGKKQKQKS

SEQ ID NO: 43759 - protein, 288 aa, Sorghum bicolor
  unsure (1)..(288): unsure at all Xaa locations
  Clone ID: SORBI-28MAY03-C2063_1.pep
ASSSCYTLFKTINEAKFGLWQTLASKAKEVLNGDGLAPKFEDLGNNRCIQKISGFFSCNFRPXNSRCSFENHRKTGDVASRARPLIIXKTTEALSVSIVRNQLSXHGRIKNALEEGVTIVDSXTSSIIELXETKKIQIRRKPASSSXIYMPNSAVDTHKPSLLISHHEPASAAQETGLYASRDNXVANVMAAKAKLLLYEQKSIEXDPDFEKQRCAQLEVLEAKKKGDKTEEXISMQLETLLSHESRLAQENLTYASENRFLRETVHFYQFTTQDNALLDDEGTDVGI

SEQ ID NO: 43760 - protein, 95 aa, Sorghum bicolor
  Clone ID: LIB3481-003-Q6-K1-A8.pep
LPPSFDLLPMLICPPVEIPWSAGMSEYVASGARGQSRSRWWPREQSRQPKLAQHHALQFCPLSALLLVLLAEHISASQNLDRFNRFLLIPPLFAL

SEQ ID NO: 43761 - protein, 133 aa, Sorghum bicolor
  Clone ID: SORBI-28MAY03-C19111_1.pep
DLVRIDAHSMCSPGFSCDSAYQVTYIVRGSGRVQVVGPDGKRVLETRAEGGVLFIVPRFHVVSKIADASGMEWFSIITTPNPIFSHLAGKTSVWKAVSAEVLQASFNTTPEMEQLFRSKRLDSEIFFAPPSSN

SEQ ID NO: 43762 - protein, 124 aa, Sorghum bicolor
  Clone ID: SORBI-28MAY03-C18363_1.pep
MRAISTAAAAAGGMLRARLRSASRVRGGGEGAGRWTTPGHEERSKGYLFNRPPPPPGESRKWEDWELPCYVTSFLTVVILGVGLNAKPDLTIETWAHEKALERLQQQELAAAAAVSGGGDADAE

SEQ ID NO: 43763 - protein, 325 aa, Sorghum bicolor
  Clone ID: SORBI-28MAY03-C19148_1.pep
MAAAGDAGGLLVCVTGASGLMRSWLVRCLLAPGPTIATTSHGDGGGGGSQHLQAMGGADARLRLFRMDLVDPASVQPAIEGAHGVFHLASPMILQAEDPEKELLEPAVKGTLNVLRAAKDCGVGRVVLMSSQAAMVPNPNWPPGKVIDDDCWADVELLKKLQLWYSVSKTLAEKAAWDFAEKEELQIAVLNPGMVLGPMLTPSVNASLRLLLQILGGERIDLDDIYMGCVDVRDVAHSLIMLYENPSAQGRHLCMESAERLVDLANKIADLYPEHPVQRIREDKQGWVVRAKDPSKKLIKLGVRFTPLDKTIRDTVDCFRSKGLI

SEQ ID NO: 43764 - protein, 133 aa, Sorghum bicolor
  Clone ID: SORBI-28MAY03-C194_1.pep
EIRSKRSACTELYYTLAEFDLLYSIEFSIHLEANIHSRYWLLILLLERTPGRGRTGQVFLLLLQTTLQAIIHHPQWKQTQGIIYKTVRTYSGYTNQTLLFFSPSGRHSKPICIKLKKQKKNPNPMTALANLVP

SEQ ID NO: 43765 - protein, 155 aa, Sorghum bicolor
  Clone ID: SORBI-28MAY03-C19414_1.pep
FFLASAYLELKMHEEALKRYERLMGVFRCSGYIQAQIATVQYSMRDLDEAEMINAGLPRIWLHRADSMDIYSNLLYAKESLTALSFLAHRVFLTDKYRPESCCIIANYYSLKGQHEISVLYFFIVLMKITLLPYYVHLALHTRRNFSFFKKTSVG

SEQ ID NO: 43766 - protein, 126 aa, Sorghum bicolor
  Clone ID: SORBI-28MAY03-C23271_1.pep
MARLALALLLLLAVAASSASATGGSHHLDLDLGFLSSSSGARRRECRGTVAECLAAEESEEERLDLVSSPESHRRALYGNGYISYGALRRDNVPCSRRGASYYNCRPGGQANPYHRGCSRITRCRG

SEQ ID NO: 43767 - protein, 121 aa, Sorghum bicolor
  Clone ID: SORBI-28MAY03-C23960_1.pep
LPSRDIHVSISRVNSKVQDREPHDAAKRAVLKKWSQLERPDSFDSCDTYRSQNFSNAMFLGGTLSSKNSFKGDHGQEEKVEYSGPLLSQSHKVDELLQKNERHIRQVVRTSWFRRGRKVDK

SEQ ID NO: 43768 - protein, 356 aa, Sorghum bicolor
  Clone ID: SORBI-28MAY03-C24342_1.pep
MATADRTRSFMKDVKRVIIKVGTAVVTRHDGRLALGRLGALCEQVKELNALGYEVIIVTSGAVGVGKQRLKYRKLVNSSFADLQKPQMELDGKACAAVGQSGLMALYDMLFTQLDVSSSQLLVTDSDFENPNFRERLRETVESLLDLKVVPIFNENDAISTRKAPYEDSSGIFWDNDSLAGLLAIELKADLLVLLSDVDGLYSGPPSEPQSKIIHTYIKEKHHSEITFGDKSRVGSGGMTAKVKAAFVASNSGTPVVITSGLASQSIVRVLQGEKIGTLFHKDASMWEPSKDVSAHKMVVAARECSGRLQNLSSDEREKILLDVSDALEENEDLIRTENEADVAAAQDTGSSPLLS

SEQ ID NO: 43769 - protein, 191 aa, Sorghum bicolor
  Clone ID: SORBI-28MAY03-C24406_1.pep
PCITGDVVAPRDLPPPTSSVCVCRLLTLPVVSSSSASSPGSCPGPQSSRSLPAPPPPALLEWWWFPRLPSHRGSARGSRPWLQLLLDDLTSQVNQLKDQNKQLSMALSITSQNLVAVQAQNSVLQTQKMELDSRLGALTEILWYINSSTSPSTAPADPAMVNSFTTWSSASDILGANAWNQQQPIDLYQCF

SEQ ID NO: 43770 - protein, 184 aa, Sorghum bicolor
  Clone ID: SORBI-28MAY03-C24517_1.pep
TRVLTVTTEAMIEHMNNLLKIQGSKVLFGGEPLANHSIPKIYGAMKPTAVFVPLEEILKSGNFELVTKEIFGPFQVVTEYSEDQLELVLEACERMNAHLTAAVVSNDPLFLQDVLGRSVNGTTYAGIRARTTGAPQNHWFGPAGDPRGAGIGTPEAIKLVWSCHREIIYDVGPVPKSWALPSAT

SEQ ID NO: 43771 - protein, 242 aa, Sorghum bicolor
  Clone ID: SORBI-28MAY03-C24525_1.pep
MCTLEQRGRVFVLTLTGDGEHRLGHALISSLRSAVASAAEGAAKAGPGCALVTVGEGRFFSNGLDIGWAGTSRARLGELVAALRLLAADLLALPMPTVAAVTGHASAGGCLLALCHDYRIMRGDRGVLYMSEVDIGLPLPPYFVAVLRAKITSANALRDVALRGKKVRAAEGKEMGIVDAVYPSADETAAEAFKFAEQLAARKWDGGVYASIRMSMYPEACRSVGIVEESDEEKRKHFASKL

SEQ ID NO: 43772 - protein, 187 aa, Sorghum bicolor
  Clone ID: SORBI-28MAY03-C21343_1.pep
MSYMRGDLLTKMRKMVKGLARPEPRWLKAMEEAPPVTFPRPEGRIKQIEFPEDVYVRKFNKKHPDSLYHDAIKISGFDPPPARVFAWRVLELKEQGVSEDDAMAVADMEYRTQKKAKKKAYKELKEIARSEGKKPPPNPYPSAIKEIQAEEKKYVMDRLFNPKVIEIANKMKEERDKLRQERAAGQW

SEQ ID NO: 43773 - protein, 143 aa, Sorghum bicolor
  unsure (1)..(143): unsure at all Xaa locations
  Clone ID: SORBI-28MAY03-C2113_2.pep
CRPLPPPPSSSSSVAQRGRKKNRSMASNYVDTTGEEGRFHGPHSHSSSTTPTGAAASPRHMRRSFSSASSGSHSHGGGGKCVCAPPTHAGSFKCRLHRTNFQCHVYGYAHPXPXISPAXXAPAQGXPSSVMLQASSDGAVALC

SEQ ID NO: 43774 - protein, 111 aa, Sorghum bicolor
  Clone ID: SORBI-28MAY03-C2113_1.pep
HWVFKSKSSQNSTSLSGACKGYIFAMEVTEELETWPEQDTHNRRWVSPAEAYQLCRYEWMREALTALLERLSVLEPVAAATAAATPPELTDQQPGMYMMLQASSDGAVALC

SEQ ID NO: 43775 - protein, 344 aa, Sorghum bicolor
  Clone ID: SORBI-28MAY03-C2140_1.pep
MERYEVIRDIGSGNFGVAKLVRDVTTKELFAVKFIERGQKIDEHVQREIMNHRSLKHPNIIRFKEVVLTPTHLAIVMEYAAGGELFERICNAGRFSENEARFFFQQLISGVSYCHSMQVCHRDLKLENTLLDGSVAPRLKICDFGYSKSSVLHSQPKSTVGTPAYIAPEVLSRKEYDGKVADVWSCGVTLYVMLVGAYPFEDPDDPKNFRKTITRILSVQYSIPDYVRVSTECRHLLSRIFVGNPEQRITIPEIKNHPWFLKNLPVEMTDEYQQSMQQLADMNTPGQSLEEVMAIIQEAQKPGDAVSLAGQLPSCLGSMDLDDIDLDDIDDIDIENSGDFVCAV

SEQ ID NO: 43776 - protein, 288 aa, Sorghum bicolor
  Clone ID: SORBI-28MAY03-C2149_1.pep
MGDVGVTSPKPSWPPQNRADDPKLHNPLLRLERMGCGWLGVIFEWEGVIVEDDAELERQAWLTLAQEEGKSPPPAFVLRRVEGMKNEQAISERPPTRPDPSELRRLASRKEEIHNSLRGGSYHQMRNGSREFMSTLANYKIPIAVATTRPRKVIEEAIEAVGVRSFFDAVVAAEDVYRGKPDPEMFLYAAQLLSFIPERCIVFGNSNSAVEAAHDARMKCVAVASKHKIYELSAADLVVKQLDELSVVDLKNLADIESPEFGMEPEPEMEEEEVPPPSTSVGVDDLFW

SEQ ID NO: 43777 - protein, 169 aa, Sorghum bicolor
  Clone ID: SORBI-28MAY03-C21762_1.pep
MARLLAARALTLARPSAAPSALRFCLCRSRALSDKVDFVEIDLSEESPSSSSGGGDAGDSATGQAKMGSRRLEDAIHGVLVRRAAPEWLPFVPGASYWVPPLPPPLGVANLLGAALYTSRGEAAMTEEEALSFTTVRGWPSAAYFVGGKFPPPVKKSWKDATKTDDDES

SEQ ID NO: 43778 - protein, 201 aa, Sorghum bicolor
  Clone ID: SORBI-28MAY03-C25391_1.pep
MEFMLGDPAFSAAVQHLMELPDELERQLNAPTRAYVRDRRAMANTPMDVKELPSGHIVLAVDMPGVSLADVKVQVEDGNVLAISGERKRPAEDCGADAEADATQKQQQQQQQQAADGGKQKQQAGAGAGEQQQGVVKYLRMERRMGKFMRRFPLPESADLDSIRAEYKDGVLTVIVDKKPPPEPKKPRVVQVTVGGEQQGK

SEQ ID NO: 43779 - protein, 348 aa, Sorghum bicolor
  Clone ID: SORBI-28MAY03-C25321_1.pep
MLDLVAMAADDFALAEDLQVEEVLRFSVQSEDVCAVCKHVIRSLEASWKPENCDHVICIACFCQHEAETEATGLPRCAVSSCDSLRNTETHQGISVPQNTLISIEDMDQKGKKPLDSTLQELGQCSRGANTKISSEFYCAICMETVHIGEFFPIDGCTHTFCTSCVSQYIAAKVEENVLSIGCPDPGCKDGVLHPDVCRDVIPTQLFQRWGAALCDSSLGSLKFYCPFKECSALLVHDPGHDEGVITNVECPHCCRMFCAQCKVPWHDGVACAEFQRLGKDEQGREDLLLRKVAQKSKWQRCPKCKIYVERIEGCVHIICRCGHCFCYLCASPMSRENHCCKTCKRTW

SEQ ID NO: 43780 - protein, 166 aa, Sorghum bicolor
  unsure (1)..(166): unsure at all Xaa locations
  Clone ID: SORBI-28MAY03-C25345_1.pep
HGVDSSAHRLAQAVCIEEVHFSLKPEDKLNKVKAVPREGGGXLRAGASAVAGAAGPCCRDSWCGAPPSCPCARRASSWGSLGAALALPGAVLPALPSALDFIGLSLSGPRLDGGSLLVCLNSIRALNAPTWSLVDDIRQLVDSLRNYFSSKFNSSSSNYVANTVTL

SEQ ID NO: 43781 - protein, 681 aa, Sorghum bicolor
  Clone ID: SORBI-28MAY03-C25404_1.pep
QVEFESKRRDFELELERERKSFDQKMTQNQADLLKREKNVKSLEAKLSKSEQALNDKKKSMESLQNDLDAKSKALKRWDESLKNDEKRLLEEKQQLDHEREQLETYKLELERTKSALEAEKERISEEQNNLKLTEQERQEHSLLTAELKKEIEEYRMRSNSLSEEMEDLRKQRQKFEEEWEQLDEKRALLVEEDKRLKIERMNLERWRDNEEKRLNDVKLEMDEKLKDQLENLERKEKALTDDIKHKQMENDEFLKGERADLQRKLQLRQHELEMEMEQKQASKEKELEEKENELNKKMDFVENKLQHAIELNESKIQKILLEKRELQMEREILLEERKKLETDKADIKRDIEILHSLSKSLKERRERYNRDRKSLIDLSEKYKACKNCGISIFGEELNSLLLKDGAEIEHPSLAVEGDDRALTTGTSGPDTGTLVSSGGRLSFLQKCSGLFKFSPRKKGEQSSEQPAEKNIPFGARLEEAAQIDGDYEPTPVYEVASFDAEDELPSDGGTSASEESERLDIADDAQMESSVGVADNSIDIVGTQSFDGTNNIAVEPTIASVDQNGKDSAAPAEAGVQPETLKQGRRQQNRRGRGKGGVKRTRSVRAVVEDAKTILGETFEEKNDGQGDKVKVGATRKRRFVGATISEQDEEGSEAHSESVSLGGQRRKRRQTSGAVTEAP

SEQ ID NO: 43782 - protein, 377 aa, Sorghum bicolor
  Clone ID: SORBI-28MAY03-C25502_1.pep
MAQILLHGTLHATIFEAESLSNPHRASGGAPKFIRKLVEGIEDTVGVGKGSTKIYATIDLEKARVGRTRMISNEPINPRWYESFHIYCAHMAADVIFTVKIDNPIGASLIGRAYLPVTDLLDGEEIDKWLEICDENREPIGDSKIHVKLQYFDVFKDRNWARGVRSTKYPGVPYTFFSQRQGCKVTLYQDAHVPDNFVPKIPLADGKNYEPHRCWEDIFDAISKAQHLIYITGWSVYTEITLVRDTNRPKPGGDVTLGELLKRKASEGVRVNMLVWDDRTSVGLLKKDGLMATHDEETANYFHDTEVNCVLCPRNPDDSGSFVQDLQISTMFTHHQKIVVVDHELPNEGSQQRRIVSFIGGIDLCDGRYDTQYHSLF

SEQ ID NO: 43783 - protein, 156 aa, Sorghum bicolor
  unsure (1)..(156): unsure at all Xaa locations
  Clone ID: SORBI-28MAY03-C760_1.pep
LFAAWAFSFYDRSAPIYTQPXHLPPXKVLDADVTDSVIGEGCVIKNCKIHHSVVGLRSCISEGAIIEDTLLMGADYYETEADKKLLAENGGIPIGIGKNSHIRRAIIDKNARIGDNVKILNADNVQEAARETDGYFIKGGIVTVIKDALLPSGTVI

SEQ ID NO: 43784 - protein, 109 aa, Sorghum bicolor
  Clone ID: SORBI-28MAY03-C7496_1.pep
SRISTRLPPARSVSLALPLWLPARSLSVSPPTRAASTAPFRPAPPRCPSSPGTGCSPRTSLLPAACARSTPTCILLAATARRSPACVGIYAVSSRGASLDLCTGCKVAG

SEQ ID NO: 43785 - protein, 104 aa, Sorghum bicolor
  Clone ID: LIB3476-035-P1-K1-C1.pep
ARLLPECLLPPVGVRSMKPYLHLPRRHRRWLGCIWRCIQSDSKQKVKKSGQVNNFCLKCFFIFCSYPVWFTYTLHSNSCEFYIFLVLGLVLLTELIRHNPLLIR

SEQ ID NO: 43786 - protein, 87 aa, Sorghum bicolor
  Clone ID: LIB3478-026-P1-K1-F6.pep
GGHAYDDYLLTVGLSPYLEKKEIRQIPVKWAGPSFVVWHNFYLSKICQCHMIGPLGRNLGLQQGNLLTQKIMMSYYTEIDISHLIGS

SEQ ID NO: 43787 - protein, 239 aa, Sorghum bicolor
  unsure (1)..(239): unsure at all Xaa locations
  Clone ID: SORBI-28MAY03-C7302_1.pep
MGKGGGCVPSKKRQPPAAAPSSSSAEAAVPREAPEEELAKAASPTPAAAGRKLRLYIVFYSMYGHVESLAQRAAAGAGAVDGLEAVLRRVPETLPLEVLEKMQAPPKDPAVPVIASAAELQEADGVLFGFPESAXWGAPELPGWPAGFFVSTGTQGGGQETTAWTAITQLAHHGMLFVPIGYTFGSGMFNMDDIRGGSPYGAGVFAGDGSRQPSETELALAEHQGKYMASIVKKLAHHA

SEQ ID NO: 43788 - protein, 142 aa, Sorghum bicolor
  unsure (1)..(142): unsure at all Xaa locations
  Clone ID: LIB3476-032-P1-K1-A6.pep
VIASAAELQEADGVLFGFPTRYGSMAAQMKAFFDSTGSLWEAQKLAGKPAGFFVSTGTQGXGQETTAWTAITQLAHHGMLFVPIGYTFGSGMFNMDDIRGGSPYGAGVFAGDGSRQPSETELALAEHQGKYMASISEKLAHH

SEQ ID NO: 43789 - protein, 348 aa, Sorghum bicolor
  Clone ID: SORBI-28MAY03-C77519_1.pep
MTSQAPTSWLSGLARSSSSTMAGGVASAPASASASASASLPDAPKSSAVGAGPGGGKRNHLRGALFQYGPKSAQVAFRTGDFNHQVIFIGGLTDGLLATDYLEPLSLAPVALAWAVVQPSLAPPFPASAFSGFGLAALELDPLVRDLLISDLSDGVISLGLSSRGQGTGCQDIVHYMRTNFACSKAVSGVILQAPVSDREYRATLPETAEMIDLAAKMISEGRGMELMPREANPDAPITAYRYHSLCSYMGDDDMFSSDLSEDQLRQRLGHMSTTQCQVIFSMGDEYVPEYVDKEALVDRLCRALGGAEKVEIEWGNHALSNRVQEAVRAIVDFVKREGPKGWDDPWS

SEQ ID NO: 43790 - protein, 154 aa, Sorghum bicolor
  unsure (1)..(154): unsure at all Xaa locations
  Clone ID: SORBI-28MAY03-C7829_1.pep
NALKFYASVRXNIRRIGLVKKGEETIGRQIAVKIVKNKHAPPFKTAQFELEFGKGICRSSELFELGLKHKLIKKTGGAFYSFNDMSFCGKNNLKSYLDENKSVANDLEMELRRLMATEAPKEQEAEDSSPSDLPEEIVTPEVSSEEDLGAVIEG

SEQ ID NO: 43791 - protein, 134 aa, Sorghum bicolor
  Clone ID: SORBI-28MAY03-C27449_1.pep
VRVPVEQGLQQSHAPARGFMSPNMGKPVGELELGRKPISWDEPRSAADIRDLEVGLGGLLDEKEGRVAHASPDLSRETLPELVEGRAGVHSRRSSWGHRSGTSESMDSVAVQMGTGDSHWGSISSVHGTTSGAH

SEQ ID NO: 43792 - protein, 105 aa, Sorghum bicolor
  Clone ID: SORBI-28MAY03-C27087_1.pep
MGAGAEVMHQVVPLLEPPFHRCVVKSVDVMEEVVTVAPGQVQPATSPKAVVEVAVEVPDLEFKRASNAGSSVSAEQLQFVPSIRSGSFADIGPRRFMEDEHIRID

SEQ ID NO: 43793 - protein, 589 aa, Sorghum bicolor
  unsure (1)..(589): unsure at all Xaa locations
  Clone ID: SORBI-28MAY03-C27489_1.pep
PGALIPADILSWKGNSLNSNRKLALNQTVGSSSTVDSNMDPTVLPLEPKGGQLPLFSSGDWISHSGSGYEAAETAGSTQTSSGATSARPAGNVFDSSWLLVNHDQSDGPSTSAGTSSQQKVVPQSEHQQNLNRLPDLQEIPESKNLFADLNPFGDMKSKKTSVPFKGPDHRNNELQKRRGTGVPNAGRPQQRLVMKNWSPYNDVSNNKQYNYVEDSFARRNVGNNAASSSSQMPRPASRSNLNSGTRNDASYHNYDSIMAGTSAMKITSTAETGKVPERVLRGDLDKGQTNYRLEDQHVVVQPPQERLPWGNPAEGRFPMNRVQSPAKQHIENMDVKQDHKKMLPDPKKXSPLDRFMDTSLPSRNMDMRSQRLDFDDVSECEIPWEDLVIGERIGLGSYGEVYRADWNGTEVAVKKFLDQDFYGDALDEFRSEVRFMRRRXIMRRLRHPNIVLFMGAVTRPPNLSIVSEYLPRGSLYKILHRPNCLIDEKRRIKMALDVAKGMNCLHTSVPTIVHRDLKSPNLLVDNNWNVKVCDFGLSRLKHSTFLSSKSTAGTPEWMAPEVLRNEQSNEKCDVYSCGVILWELATLR

SEQ ID NO: 43794 - protein, 374 aa, Sorghum bicolor
  Clone ID: SORBI-28MAY03-C27690_1.pep
MGSVSTSSRASPPASALHPRASPARGRNATEAIRSPSIHPPALVSAYPPRFSCFGGQARAEKMAEDGYPVKLHIYDLSQGMARQLSATILGKAIEAIWHTGVVVYGREYYFGGGIQQGQPGRTPYGTPIRVEDLGVTHVPREVFEEFLREIGPRYTPATYKLLSHNCNNFSNEVAQFLAGAAIPSYILELPNQVMNSPVGALILPMIQGLEASLGAGAVPQPPQFRPAPAAPVGAATVTRPLTPKDDVVPRSTTADDDKPEAAKTAAGNNGSANDSTAVVPPAVQPAAAPATSAGEVSSAAPTTVSTKLAAPPPPDPLAAAKSRVQEEIKREFAAIMAAGTARAGEAAALATRRVMERHGLQRAAAAAAAAHRG

SEQ ID NO: 43795 - protein, 248 aa, Sorghum bicolor
  unsure (1)..(248): unsure at all Xaa locations
  Clone ID: SORBI-28MAY03-C28033_1.pep
LTPAGLPVRLPLPRGSGLRRAPAAGRRLVPTALVLRPAGASAALLPQRLLQPLPPLWAAALTPAAVRPRHVAVAEPLGSLTEVISNCDALCKRIAAEGPESLRSSVQPFIPASAEAEASNPNPPVLAACFFQSREWQHVNANXIGRKQGEIENKIETADALAVKLLQRFNYCLTSMRAASHTPAEVHPLQIELGALQGSLTEVISNCDALCKRIAAEGPESLRSSVQPFIPARAEAEGSGSLDPKQES

SEQ ID NO: 43796 - protein, 287 aa, Sorghum bicolor
  Clone ID: SORBI-28MAY03-C28856_1.pep
RMSRRWSRTIYVGNLPGDIREREVEDLFYKYGRIVDIDLKVPPRPPGYAFVEFEDARDAEDAIAGRDGYNFDGHRLRVEAAHGGRGNTSSYDRSSGFGGGGGGARRGVSRHSEYRVLVTGLPSSASWQDLKDHMRKAGDVCFSEVYRFCLIFLLLVIDEYMLCGFVPIKKLDDTEFRNASGRAYIRVKEYDGKRGRSYSRSRSPSRSYSKSRSPSKSPKTRRSSSRSRSRSVSSRSRSASKGRSPSRSPARSKSPNASPANGEAASPKKQSPNRSPSGSRSPDAKPE

SEQ ID NO: 43797 - protein, 199 aa, Sorghum bicolor
  Clone ID: SORBI-28MAY03-C33435_1.pep
MATLHLFHVVYQFIRTAATPLVPPQQPLLFVLVPLILVLLPLICRRLQHRRNNAGDDERKQSMTLLPSPPGRLPVIGHLHLVGDLPHVSLRDLAAKHDLGGGLMLLQLGAVPNLVVSSPRAAQAVLRTHDHVFATRPAPKVLDKLLYGPSTIAFGPYGDHWRKVKKLVTTHLFTMKKVNSFRHARQEEVSLVIAKLKKP

SEQ ID NO: 43798 - protein, 350 aa, Sorghum bicolor
  Clone ID: SORBI-28MAY03-C24593_1.pep
MATLPGSAPAEAAELVPTLSSLEPVYGAGAQLDEARLRFARLGDRFHAVYGARPALFARSPGRVNLIGEHIDYEGYSVLPMAIRQDMIVAIRRADGGQVRVANVDDKYPLCVYPADPDKEIDIKNHKWGHYFMCGYKGVYEYCRSNGIDLGKPVALDVVVDGTVPQGSGLSSSAAFVCSATIAIMGVLEKNFPKKEVAQFTCLSERHIGTQSGGMDQAISIMAKPGFAELIDFNPIHATDVQLPPGGTFVIAHCLAESKKAETAATNYNNRVVECRLAAIVLAIKLGMDRKKAVSSVTTLSDVEGLCVSFAGKEGSSDPAIAVKKLLHENPYTAEEIENITGESLTSVFQ

SEQ ID NO: 43799 - protein, 260 aa, Sorghum bicolor
  Clone ID: SORBI-28MAY03-C24569_1.pep
MSTEEAVVAEVPVTVVEAEAPAAQEAEKDKAKKTAPKEKKAAPKEKKDTAKKPAAHPPYAEMISEAIAALKERTGSSSVAIAKYVEEKHGGKLPTNFRKQLTSQLKKLAAAGKLTRVKNSFKLPVTARPAADAKPKAAAKPKAPKAAKTAAKPKASPKAKAKTAASPKPKAKAKPAGPTPAALPKPRGRPPKVAKTSAKSSPAKGAAKKAAASAAAAKKEKAVASSKKAVGSPKKKAATPKKAAAAAAPARKGAARKAKK

SEQ ID NO: 43800 - protein, 238 aa, Sorghum bicolor
  Clone ID: SORBI-28MAY03-C2463_1.pep
MSVASNTEADDAGMQERWWKPSSPFGTSVGTPGAEFYDAFEEISSDGGTRSSRAMDDDLREMRLSLLRPIERRKQAEEALEIWQKEWKKLSHHLSHVALSLPSPSIAEDTDDSSVDPGAELCQQITVSQLVAAAIAQGFARAEVESEMETVIAAKNFEIARLSDRVQYYEAANREMSQRNQEAIEMSRQQRKERKKRQKWFWGSVGLAVTLGATAIAWSYLPSSQPQASADSKSTANN

SEQ ID NO: 43801 - protein, 179 aa, Sorghum bicolor
  Clone ID: SORBI-28MAY03-C24875_1.pep
LAKVVHEEFGIVEGLMTTVHATTATQKTVDGPSMKDWRGGRGAGQNIIPSSTGAAKAVGKVLPELNGKLTGMAFRVPTPNVSVVDLTCRIEKSASYDDVKAAIKAASEGALKGILGYTDEDVVSNDFVGDSRSSIFDAKAGIGLSSSFMKLVSWYDNEWGYSNRVLDLIAHMALVSAKH

SEQ ID NO: 43802 - protein, 150 aa, Sorghum bicolor
  Clone ID: SORBI-28MAY03-C25303_1.pep
NTKKAVTPNAARSGKLETKSNNNRLKGPSVLDSHSTRSKRMDLQASGKQKSSSVNLPPRKIFSSTAGEPAVETISRSKKKEGVQATVQSRASTSKRTTPLQTGNLKARAPNPPAPPAPPPPRRTSRMISKPTGASSIVGRKPKASAPQWH

SEQ ID NO: 43803 - protein, 185 aa, Sorghum bicolor
  Clone ID: SORBI-28MAY03-C30225_1.pep
ARGNISYICSRYYRAPELIFGATEYTTAIDLWSAGCVMAELLLGQPLFPGESGVDQLVEIIKVLGTPTREEIKCMNPNYTEFKFPQIKAHPWHKVFQRRLPPEAVDLVSRFLQYSPNLRCTALEACMHPFFDELRDPNTRLPNGRPLPPLFNFRSQELKGVPLEVVERLVPEHSRRQSLFMALRT

SEQ ID NO: 43804 - protein, 153 aa, Sorghum bicolor
  Clone ID: SORBI-28MAY03-C30227_1.pep
MAFWWPLLVLAAAYALCRLLLFLIPPTVPSIDVDASDVLAKEDSFIYIPRKGKAAQTDKVQCYEPATMKYLGYFPALTPDEVKEHVAQARKAQKIWAKSSFKQRRQFLRILLKYILEHQDLICEVSSRDTGKTMVDASLGEIMTTCEKITWLL

SEQ ID NO: 43805 - protein, 176 aa, Sorghum bicolor
  Clone ID: SORBI-28MAY03-C3046_1.pep
HDTVPPHNHHPSQRLQRPPSSAQNTPLALPVPVSRCCPLGSALVGGLCCSSWRRPPPPRPRCRRRAAPTRASPSRPPPWRSPARSSSTPCAAPSSRTWSPPTPPRPLVSARASPRPTSGRRRSGRWRGEGRASRSGCASRTTSWTPRTMAPPTPLPPGRRGRRRRRRPSRRAVPRR

SEQ ID NO: 43806 - protein, 292 aa, Sorghum bicolor
  Clone ID: SORBI-28MAY03-C30540_1.pep
RVLPSEDLPQCALKSDELVQISGAPSLVRKALYEISTRLHQHPRKENRPLEEIINASTQRKRESPILLQHENPMLPHLHSDHPPPIPLLDPYRSGLQYHVTETEEFSIRILCASELIGSVIGKSGANVKRVEQQTGARIKVQEGDKDASGESLIIVSSKEVPSEPVSPAFVALVVLLVQTAGQIHGREDYRGLTSATGRFLSTIELRIPNSSLESIVGVGGVNLAEIRQISGARLRLHEAHAGSSESVVEIQGTLEEAKAAQSLLQGFISANSRSIQQQPQSSRMPLYPSWG

SEQ ID NO: 43807 - protein, 409 aa, Sorghum bicolor
  Clone ID: SORBI-28MAY03-C3064_1.pep
HEADALHRLATRAVEILHAMAIPIELSDRESLVKSASTALNSKVVSQYSTLLSPLAVDAALSVVDPAHPDLLDLRDIRIVKKLGGTVDDTELVRGLIFDKKASHAAGGPSRVENAKIAVIQFQISPPKTDIEQSVIVSDYAQMDRILREERNYILGMVKKIKAAGCNVLLIQKSILRDAVTDLSLHYLAKAKILVVKDVERDEIEFITKTLNCLPIANIEHFRTDKLGYADVVEEISVGEGKVVKITGIRDMGRTATVLVRGCNQSVIDAAERSLHDALCVIRCLVNKRFLIAGGGAPEIEMSMQLAAWAKELRGMESYCIKEFADALEVIPYTLAENAGLNPISIVTELRNRHARGEKNAGINVRKGQITNILEENVVQPLLVSTSAITLACECVRMILKIDDIVTVR

SEQ ID NO: 43808 - protein, 200 aa, Sorghum bicolor
  Clone ID: SORBI-28MAY03-C25901_1.pep
MAASNGGGGGPGPGPISAEAEAAFGEAIRLVFGRWTALQMAVENQWGGRDSRSKADQFGESILFWFCRTKGPHYFEDLVDMMYDTISESFNSDFEDNSVEEVAEQLLIIHEECLQNNYSSIEKLRNSHVQGNAVSQSRQIVADDDDDSDSSDDGDDTSMMEDQEAPPEEMAVDRPRPPRPTPDADGWTVVPPRRGGRNRN

SEQ ID NO: 43809 - protein, 252 aa, Sorghum bicolor
  Clone ID: SORBI-28MAY03-C25807_1.pep
MEKKRVVIVGAGVSGLTVCKHLLELGCRPVVFEGDTVLGGVWARAPACTELQTPRPMYQYSDFPWPETVTEVFPNHRQVVAYLDAYARHFGVLGCIRFAHRVVGMEYHGGGGGGVSEQDMDACEEWAGNGQAFGSGAGEWRLSVADADGHVETHKADFVVLCMGRFSGIPNIPTFPAGKGPEVFDGQVIHSMDYAKMGASKAKEMIRGKRVTVVGYLKSALDIAAECAEVNGTAHPCTMVVRTKHWILPDYF

SEQ ID NO: 43810 - protein, 152 aa, Sorghum bicolor
  Clone ID: SORBI-28MAY03-C26017_1.pep
TRAKVTWTETSVTVTGPPRQPFGRKHLKAIDVNMNTMPDVAMTLAVVALFANGPTAIRDVAPGGVKETERMVAIRTELTKLGASVEEGPDYCIITPPEKLNVTAIDTYDDHRMAMAFSLAACAEVPVTIRDPGCTRKTFPDYFDVLSTFVKN

SEQ ID NO: 43811 - protein, 162 aa, Sorghum bicolor
  Clone ID: SORBI-28MAY03-C26772_1.pep
QRVIECGGYIEDGYLNGVLSVTRALGDWDMKLPQGSPSPLIAEPEIHWTTLTEEDEFLIIGCDGIWDVMSSQHAVSTVRKGLRRHDDPERCARELAMEAKRLETFDNLTVIIVCFVPDLAGAASAAAPSSEQAPAPAGRIRCCKSLSPEALCKLRRWLESDH

SEQ ID NO: 43812 - protein, 153 aa, Sorghum bicolor
  unsure (1)..(153): unsure at all Xaa locations
  Clone ID: SORBI-28MAY03-C2681_1.pep
FPFGIKHQLFSCIRFMADHDAWRELSETYVFLQMYKQAAFXYEELILAXPTIPLYHIAYAEVLYTMGGLENLQTVNKYYASTIQLTGGKNTRAVFGVCLCTSAINQLTKGRNKEEEGSELQRLAAEVLLKNYKQQAPSKVPLISTMLKNMKLS

SEQ ID NO: 43813 - protein, 142 aa, Sorghum bicolor
  Clone ID: SORBI-28MAY03-C3113_1.pep
MSYLLPHLHSGWAVDQAILAEEERLVIIRFGHDWDETCMQMDEVLAAVAETIKNFAVIYLVDITEVPDFNTMYELYDPSTVMFFFRNKHIMIDLGTGNNNKINWALKDKQEFIDIVETVYRGARKGRGLVIAPKDYSTKYRY

SEQ ID NO: 43814 - protein, 98 aa, Sorghum bicolor
  unsure (1)..(98): unsure at all Xaa locations
  Clone ID: LIB3478-007-P1-K1-G1.pep
MSYLLPHLHSGWAVDQAILAEEERLVIIRFGHDWDETCMQMDEVLAAVAETIKNXAVIYLVDITEVPDFNTMYELYDPSTGMFFFRNKHIMNDLGTGN

SEQ ID NO: 43815 - protein, 496 aa, Sorghum bicolor
  Clone ID: SORBI-28MAY03-C3093_1.pep
TRCGGRSTTSACAPTASSSCSTSSRRPTSQRGSTRRPSPSAAPAGWRCRRPLAQSNMKEMEKHISSLQEEVKGHQDKATDHQQIEESLRSTISELKVVQEALELSKSQVADLEQKLASQDADISKLTEELNLHCSSEESLKEKTLKLETELTTALEELQAKLLSLQEMETKLDEQSKGRQTSEAALEKQNGQLIVLQAELDNLKDENETLQGSLADLNSKFSEKDSMLHQAEDELAKAQLVLSEALSQKEELELNLNSLSEQHGESKAFGENASQKILELEAQVHAMHAAEEALNLELKEAEASVKAAENKSSDLEQQLSEIENKLVASSEEIELLKERIQQEAAVSAERGMQLEETMTSVEGYKEKITELQSSLDSSVSKNQLLEQEVKELTDKCSEHQEQAHSVQQRSLELEDLLHTSKTHAEGAHSRTQELEQELNNTYEKLKGVEEELEQYRSKASQLADDLEAYQTKAASLEAVVEAASEKEKELMESLNQ

SEQ ID NO: 43816 - protein, 190 aa, Sorghum bicolor
  Clone ID: SORBI-28MAY03-C32_1.pep
MCDAAVATAAAARYRGVRKRPWGRFAAEIRDPAKRARVWLGTFDSAEAAARAYDVAARALRGPLARTNFPAHHLPALTSRPPAAVAAPTCSSSSTVESSSGPRTGVPRATPAAVHRRRAAAKPRPLRQAAPADADCHSDCASSASVVDDGDDASTVRSLSCPRPTLDLNLPAPLDVDDSHELGLCTELRL

SEQ ID NO: 43817 - protein, 222 aa, Sorghum bicolor
  Clone ID: SORBI-28MAY03-C3251_1.pep
DYGSRGRYDSGETDGRSRRSARGRSRSRSRSHSRSRSPSPKRSRRHEARRSRTKSRSRSRSRSYRNHRASRSKSRSPVASRRYEKTAAISGSARPNSGHAEHKSPPRSHSVDDHVNHSDHKDDHMEDGKMERVDLDRSPSPQDDKSAPYSPVYNGKASGSMSPNVQPEADAKYVKPSGKPEPASPVRHSKGRDDDEEGIIDEDGEIAEDDPRANAAVQNGNN

SEQ ID NO: 43818 - protein, 70 aa, Sorghum bicolor
  Clone ID: SORBI-28MAY03-C3310_1.pep
VTDAGRVEPLASCAQAALAWSLRSDSLHEVKFPHEWKIDPPLLSTRARQQTVEPETQPMQTTLASTEDQH

SEQ ID NO: 43819 - protein, 254 aa, Sorghum bicolor
  Clone ID: SORBI-28MAY03-C29361_1.pep
HDPAQSTQIKRREEKRREEKRTQGSQRAAPLSEAGRQGRARESGGRGRPKLELERMDSNQGVVAVVKPTLAKGTPSASFRLRNGSLNAVRLRRVFDLFDRNGDGEITVDELAQALDALGLDADRAGLAATVGAYVPDGAAGLRFEDFDKLHRALGDAFFGALADHQDDAADAGGKKGEEDEQEMREAFKVFDVDGDGFISAAELQTVLKKLGLPEASSMANVREMITNVDRDSDGRVDFSEFKCMMKGITVWGA

SEQ ID NO: 43820 - protein, 335 aa, Sorghum bicolor
  Clone ID: SORBI-28MAY03-C2940_1.pep
ARGSSREFVDTITRDLLGSRVFVFTPKGEIKNLPEGATVVDYAYLIHTEIGNKMIAAKVNGNLVSPIHVLANAEVVEIITYDKLSSKYALQRHQQWLQHAKTRSARHKIMKFLREQAALSAAEITADAVRNFVADLEDESDSELSLPSTKNEDSKFNWEKILSSDKLFFVNKSSDGFLPVNNVHPKLNGKQNKTVKELGIKINGHSTIRGDSFNELMHPGNSTCKEVFPGLDRWKSGKISSWHSTEGNSVQWLCIACVNRKGMMAEVTSALTACGITICSCVAEVNKRRGMGVMLFHFEGSYENVVSACSSVDMILGVLGWSVGCSWCPLGVLEC

SEQ ID NO: 43821 - protein, 399 aa, Sorghum bicolor
  Clone ID: SORBI-28MAY03-C29461_1.pep
MGILERIKEIEAEMARTQKNKATEYHLGQLKAKLAKLRTQLLEPPKGSSGGGDGFEVTKFGHGRVALIGFPSVGKSTLLTMLTGTHSEAASYEFTTLTCIPGIIHYNDTKIQLLDLPGIIEGASEGKGRGRQVIAVAKSSDLVLMVLDASKSEGHRQILTRELEAVGLRLNKRPPQIYFKRKKTGGISFNTTVPLTHIDEKLCYQILHEYKIHNAEVLFREDATVDDLIDVIEGNRKYIKCVYVYNKIDVVGIDDVDKLARQPNSLVISCNLKLNLDRLLARMWDEMGLVRVYTKPQGQQPDFTDPVVLSTDRGGCTVEDFCNHIHRSLLKDVKYVLVWGTSARHYPQHCGLSHGLQDEDVVQIVKKKEKEEGGRGRFKSHTNAPDRISDRVKKAPLKT

SEQ ID NO: 43822 - protein, 310 aa, Sorghum bicolor
  Clone ID: SORBI-28MAY03-C29914_1.pep
MARHFVLNTGAKIPSVGLGTWQSDPGVVGNAVYAAVKAGYRHIDCARVYGNEKEIGVALKKLFEEGVVKREDLFITSKLWNDHHAPEDVPEALNESLNDLQLEYLDLYLIHWPVRVKKGTNHSPENFVTPDIPATWGAMEKLYDAGKARAIGVSNFSSKKLGDLLAVARVPPAVDQVECHPAWQQTKLHNFCQSTGVHLTAYSPLGSPGTTWMNSNVLKEPIIISIAEKLGKTPAQVALRWNIQMGHSVLPKSTNEERIKQNLDVYDWSIPDDLLAKFSEIKQARLLRGNFAVNPASVYKTHEELWDGEL

SEQ ID NO: 43823 - protein, 173 aa, Sorghum bicolor
  Clone ID: SORBI-28MAY03-C29925_1.pep
RSEHEASRRLKTELLIQMDGLTKTNDLVFVLAATNLPWELDAAMLRRLEKRILVPLPEAEARQAMFEELLPATTSKLEVPYNILVEKTEGYSGSDIRLVCKEAAMQPLRRLMSVLEASDELVPEEELPEVGPLKPEDIELALRNTRPSAHLHAHRYEKFNQDYGSQVLCSESA

SEQ ID NO: 43824 - protein, 176 aa, Sorghum bicolor
  Clone ID: SORBI-28MAY03-C3418_1.pep
SAPASSPAAGAAMGRGKFKGKPTGRRNFSTPEEIAAGTSGRPRTFKKKEEEEEEEHEEREESEEEESEDESDDKPKHKGTEGIIQIENPNLVKAKNIKAKEVDLGKTTELSRREREELEKQKAHERYMKLQEQGKTEQARKDLERLALIRQQRADAAKKREEEKAAKEQRKSEARK

SEQ ID NO: 43825 - protein, 257 aa, Sorghum bicolor
  Clone ID: SORBI-28MAY03-C34423_1.pep
MADSMVASFWGPVTSTTELCEENYAHSSYIAEFYNTISNVPCVLLAVIGLVNAFRQGFEKRFSVLHVSNMILAIGSMIFHATLQLLLQQSDETPMVWEILLYMYVLYSPDWHYRSTMPTFLFLYGAAFAVVHFFARFQVVFKLHYIVLCFLCIPRMYKYYILTKDMAAKRLAKLWVLTLTLGTLCWLVDRIFCKKLSHWYVNPQGHAWWHVLMGLNSYYANTFLMFCRAQQRGWEPRITHLLGFLPYVKVQKPEKRE

SEQ ID NO: 43826 - protein, 113 aa, Sorghum bicolor
  unsure (1)..(113): unsure at all Xaa locations
  Clone ID: SORBI-28MAY03-C34629_1.pep
SRTAMRGSFPLNGTYFQVNEAFADHFSSQNPIGVPRSWICDIPRRTDYXATTILLLVRGFSSEGLXTGLWEXLASLRGVAWSGQARWPLYARWRFPASKVVRGRKPGAAREGG

SEQ ID NO: 43827 - protein, 280 aa, Sorghum bicolor
  unsure (1)..(280): unsure at all Xaa locations
  Clone ID: SORBI-28MAY03-C3390_1.pep
HEENDDLEEIRELGSGTYGAVYHGKWRGCDVAIKRIKASCFDGRPSERERLIADFWKEALILSSLHHPNVVSFYGVVRDGPDGSLATVTEFMVNGSLKQFLRKKDRTIDRRKRVILAMDAAFGMEYLHGKNIVHFDLKCENLLVNMRDPQRPICKIGDLGLSKVKQHTLVSGGVRGTLPWMAPEFLSGKSCMHSVEIDVNRHGKSWTQLSXSPYKLCPRRDGSNTTRAILVQIVHXSKNNSIILFPGLMESCWSSDPAERPSFTDISQRLRKMAAAMNVK

SEQ ID NO: 43828 - protein, 75 aa, Sorghum bicolor
  Clone ID: LIB3481-022-P1-K1-E7.pep
SGELLTVDEPYSDMRAAEIIGGIVNDSLRPEIPSWCDPEWKGLMESCWSSDPAERPCFTDISQRLRKMAAAMNVK

SEQ ID NO: 43829 - protein, 134 aa, Sorghum bicolor
  Clone ID: SORBI-28MAY03-C34644_1.pep
LEEGINRLVLCSGKVYYELDEERRKAERTDVAICRVEQLCPFPYDLIQRELKRYPNAEIVWCQEEPMNMGAYSYINPRLLTAMKALGRGGIEDIKYVGRAPSAATATGFYSVHVQEQTELVQKALQRDPINYPF

SEQ ID NO: 43830 - protein, 122 aa, Sorghum bicolor
  Clone ID: SORBI-28MAY03-C30754_1.pep
ARAFNMMFVTCAVATDSRAVGDLPGLAVGSAVCITSIFAGPVSGGSMNPARTLAPAVASNVFTGLWIYFLGPVIGTLSGAWVYTYIRFEEAPAAKDTQRLSSFKLRRLQSQSALAADEFDTV

SEQ ID NO: 43831 - protein, 161 aa, Sorghum bicolor
  Clone ID: SORBI-28MAY03-C30799_1.pep
SGHDQLYNMQMLEAAFHRLPQPKDSERAKTYIPRHPAVTPASYPQIQAPIVSHPTFWERIGSDTLATDMLFFAFYYQQNTYQQYLAARELKKQSWRFHRRYNTWFQRHVEPQVTTDEYERGSYVYFDFHVTEDGSGWCQRIKNDFTFEYNYLEDELSVQTN

SEQ ID NO: 43832 - protein, 132 aa, Sorghum bicolor
  Clone ID: SORBI-28MAY03-C30900_1.pep
VVDLTPLQLRSFTKNSNKTCKHTFSSPGDLNYPAISAVFAEQPSAALTVRRTVTNVGPPSSTYHVKVTEFKGADIVVEPSTLHFTSSNQKLTYKVTMTTKVAQKTPEFGALSWSDGVHIVRSPLILTWLPPM

SEQ ID NO: 43833 - protein, 192 aa, Sorghum bicolor
  Clone ID: SORBI-28MAY03-C31377_1.pep
NQMTRCGACHGRGLLAHQDGSDTICGMCNGKGMLPCIACGSRGLVTCNTCTGYGSLLAQSMAHVQWKTLSARKVSAARGAASVPEEVFHRAKGVQLCNIQAYQCTPAFFADSYPLNQFSSEVIASRLPVPPSARVISERHIISVVPVTRVTMAHRKKSFSFYVVGYSRDVFIRDYPSKFCWGLCCCFEWLGK

SEQ ID NO: 43834 - protein, 289 aa, Sorghum bicolor
  Clone ID: SORBI-28MAY03-C31190_1.pep
MASLFGARRRRSPEDDGEDDRSGSGRAQRRRLSPEDAAASPAEAGAATGTSPGWLSGFVSGAKRVFSSVLLFSSPEETGSGEDEEEEDDDEEEEEGVGLNENEDIHDTQGAIVPFSESKLAIEQMVMKETFSRDECDRMVELIKSRVRDSTFPEAHEYGKPEEIPSRNAGIAHDFTGTWRSLSRDRNFPESVPLSSMRMGPGSFSPGSPLQASPELCSAAVTEAKKWLEEKRQGLGLKPEDNGPCTLNTDMFSSHDDSDMGTPVDLAKSYMQSLPPWQSPFLGRQKFDT

SEQ ID NO: 43835 - protein, 208 aa, Sorghum bicolor
  Clone ID: SORBI-28MAY03-C37081_1.pep
MDQQHQQGLDAAAARRMATLASHLRPHPASPPQVEDVPLLRGSNCRAKGAAPGFKVAILGAAGGIGQPLALLMKINPLVSVLHLYDVVNTPGVTADISHMSTGAVVRGFLGQPQLENALTGMDLVIIPAGVPRKPEMTRDDLFNINAGIVRTLCEGIAKCCPNAIVNVISNPVNSTVPIAAEVFKKAGTYDPKRLLGVTTLDVVRANT

SEQ ID NO: 43836 - protein, 582 aa, Sorghum bicolor
  unsure (1)..(582): unsure at all Xaa locations
  Clone ID: SORBI-28MAY03-C3614_1.pep
ARGEDPIRWNPLTDVVDGYSPTLPHLKGLQNGDTATSAIKQVASGRFGVTPTFLVNANQIEIARAQGAKPGEGGQXSCGKKXSAYIARLRNSKPGVPLISPPPHHDIYSIEDLAQLIYDLHQINPKAKVSVKLVSEAGIGTVASGVSKGNADIIQISGHDGGTGASPISSIKHAGGPWELGLTETNQTLIQNGLRERVVLRVDARGRSGRDVLMAAAMGADEYGFGSVAMIATGCVMARICHTNNCPVGVASQREELRARFPGVPGDLVNYFLFVAEEVRATLAQLGYEKLDDVIGRTDLLRPKHVSLVKTQHIDLGYLLSNAGLPKWSSSQIRSQDVHTNGPVLDETILADPEIADAIENEKEVSKAFQIYNVDRAVCGRVAGVIAKKYGDTGFAGQLNITFNGSAGQSFGCFLTPGMNIRLVGEANDYVGKGMAGGELVVVPVDKTGFVPEDATIVGNTCLYGATGGQVFVRGKAGERFAVRNSLCQAVVEGTGDHCCEYMTGGCVVVLGKCCMNVAAGMTGGLGYILFEDDTXLFPKVNKEIVKMQRVNAAXGQMQLKSLIESYVEKTGSEKGATILRE

SEQ ID NO: 43837 - protein, 314 aa, Sorghum bicolor
  Clone ID: SORBI-28MAY03-C37190_1.pep
MQVKQKVYELYKGTVERVTAPRTVSAFLEKGVLSVPEFILAGDNLVAKCPTWSWEAGDPSKRKPYLPADKQFLVTRNVPCLRRAISVEEEYDAAGAEVVLDDDEDGEGWLATHGVQASKREEEEDIPSMDTLDIGRSDGIKSIPSYFSGGKDEEEEEDIPDMDTYEDTGNNLAAAEPSYFVAEEPEDDNILHTRTYDVSITYDKYYQTPRVWLTGYDESRMPLKPELVFEDISQDHARKTVTIEDHPHLLAGKHASVHPCKHAAVMKKIIDVPMSGGVEPEVDKYLFIFLKFIATVIPTIEYDYTMDVDLGSTS

SEQ ID NO: 43838 - protein, 210 aa, Sorghum bicolor
  unsure (1)..(210): unsure at all Xaa locations
  Clone ID: SORBI-28MAY03-C3710_1.pep
RSTPAGPGKAPPPSESKVMQKATRLSVATTTIFYMLCGCTSSAAFSYAARNNPFTGFGSCESFWLLDVANVAIVVXLVGADQVFCLPTFAFVERRAAAACPDSAFIARDLRVGPFALSVSRLTWRSAFVCVTTVGDMLLPVLGNVVEFLVALSFWPQSVVFPLVRYSRQRRLGRGSTRGIGLQTVSSRCCLESIAAAAGYIAYFIYVLYY

SEQ ID NO: 43839 - protein, 108 aa, Sorghum bicolor
  Clone ID: LIB3481-027-P1-K1-F12.pep
SGFLGAVSFWPLTVYFPVEMYIKQRRVPRGSTKWICLQTLSVGCLFVSIVAAAGSIADVIDALKVYHPFSSLLLFSWRGGWTYVLHAVFNAFNDFGQSYYKGSRGGRE

SEQ ID NO: 43840 - protein, 199 aa, Sorghum bicolor
  Clone ID: SORBI-28MAY03-C37802_1.pep
MADVDEYRCFIGNLSWSTTDESLKDAFSKFGNLTEAKVVLDKFSGRSRGFGFVTFDEKQAMEDAIEGMNGLDLDGRNITVDKAQPQGPGRDRNGDRDYDRDRGSRYDRGRDYGSGRAPRGGGGGDCFKCGKPGHFARECPSGDGGRGDRYGGRDDRYGGGGGGGGRYGSERGGDRYSGRSRDGGSYGGDRYSRDRSGPY

SEQ ID NO: 43841 - protein, 311 aa, Sorghum bicolor
  unsure (1)..(311): unsure at all Xaa locations
  Clone ID: SORBI-28MAY03-C33540_1.pep
MDRADPAPRRLALLSSHLPAGGPAAADAPRLQRYPVSAAAPGPRAGALAVVDGRTGKRHEVKVSEDGTVRATDFKKITAGKDDKGLKIYDPGYLNTAPVRSTICYIDGDEGILRYRGYPIEELAESSSFVEVAYLLMYGNLPTQSQLASWEFAISQHSAVPQGLLDIIQSMPHDAHPMGVLASAMSTLSVFHPDANPALKGQDLYKSKQVRDKQIVRVLGKAPTIAAAAYLRLAGRPPILPSNTLSYSENFLYMLDSLGNKSYKPNPRLARALDILFILHAEHEMNCSTAAVRHLASSXXVDVFTALSGGV

SEQ ID NO: 43842 - protein, 209 aa, Sorghum bicolor
  unsure (1)..(209): unsure at all Xaa locations
  Clone ID: SORBI-28MAY03-C3277_1.pep
EPARDPAYEPAPEPPPYGPAPDPAXDPASEPAYEPAPEPPQXGPAPDPAYEPASEPAXEPDPPPLEPAXEPALEPAYEPAPPPLEPAXEPALEPAYEPEPPPFEPAXEPALEPAYEPEPPPFEPAYEPAXEPAYDPAPPPDPAFEPEFEPDQDPEPEPDHEPEPEXDPDPDPEPEPPPPPPPMPMPIPVPMPRPPPTPTPPPPPPPPPR

SEQ ID NO: 43843 - protein, 162 aa, Sorghum bicolor
  unsure (1)..(162): unsure at all Xaa locations
  Clone ID: SORBI-28MAY03-C33623_1.pep
MAGAAVAAANGGACCHAAKGPGYATPLEAMEKGPREKLVYVTCVYNGTGINKPDYLATVDLDPDSPTYSQVIHRLPVTHIGDELHHSGWNSCSSCHGDPSAWRRLLQLLPRRSIXKRRFLILPSLLSGRVYVVDTATDPRAPSLHKVVESEDIAEKTGLGFP

SEQ ID NO: 43844 - protein, 185 aa, Sorghum bicolor
  Clone ID: SORBI-28MAY03-C33640_1.pep
MAAKKVLMLCGDYMEDYEVMVPFQALQAYGVSVDAVCPSKKAGNICRTAVHQGIGHQTYSETKGHNFTLNASFDEITASEYDGLVIPGGRAPEYLAMDRQVLNLVRNFSDAKKPIASVCHGQLILAAARVVENRNCTAYPAVKPVLVAAGAKWEEPDTMAKCTVDGNLITAATYDSHPEFISLFV

SEQ ID NO: 43845 - protein, 155 aa, Sorghum bicolor
  Clone ID: SORBI-28MAY03-C33819_1.pep
SMRTLNGHSIGPYQIHGGKSVPIVKGGEQTKMEEGEFYAIETFGSTGRGFVQEDLECSHYMKNFDVGHVPLRVAKAKQLLGTINNNFGTLAFCRRYLDRLGETKYLLALKNLCDSGIIQPYPPLCDVKGSYVSQFEHTILLRPTCKEVISRGDDY

SEQ ID NO: 43846 - protein, 364 aa, Sorghum bicolor
  Clone ID: SORBI-28MAY03-C39614_1.pep
MGAVGFRRLLLLPLALLASAAAVEARFVVEKNSLMVTSPTSLRGQRDSAIGNFGIPQYGGSMAGAVVYPKDNANACDDFDGRHPFRAKPGAMPTFLLVDRGDCLFAKKVWNAQNAGASAVLVVDDKDEPLITMDLPREDDDAAKYIQNITIPSALIDKIFGDQLKKAVKDGEMVNVNLDWREAVPHPDERVEYELWTNSNDECGPKCNMLMNFLKEFKGAAQLLEKGGYSQFTPHYITWYCPQAFVISKQCKSQCINHGRYCAPDPEQDFSTGYEGKDVVEENLRQLCVFKVANENKRPWVWWDYVTDFHIRCPMKEKKYNKKCAETVIKSLGLDVKKVDKCMGDPNADLDHPLLKMEQDAQIG

SEQ ID NO: 43847 - protein, 531 aa, Sorghum bicolor
  Clone ID: SORBI-28MAY03-C3905_1.pep
MEGQPLHLLLAQPHHPPLPGLIPNRPTHYLPTSRLRFRVHRRKPKQLAAVPSRRPSGSQADAPGRSGWERVPNAVAAAVFQLAVCSLLFLFPNRARVLALPPPPGAAAVVEATHEEEDKEWEAALQKWKTKTYALSVPLRVVALRGSFPPSWIKDFVEVQGKRLKFSPELRANLDGIFSEMSQCMDKGQVQPKSAMAADAVTLGDSWLGYAIRQGLLEPVKNAEEQDWFRSLSDRWKVHLCVRQNGEADPNGTIWGVPYRWGTMVIAYKKNKFKRHNLKPIQDWEDLWRPELAGRISMVDSPREIIGAVLKHLGSSYNTVDMEIDVNGGREAVLNSFTQLQKQVQLFDSMNYLKSFSVGDVWVAVGWSSDVIPAAKRMSNVAVVVPKSGSSIWADLWAIPCATRFQTDQIGSRTRGPSPLIHQWFDFCLQSARSLPFRQDVIPGASPLYLENPVPEVPQDKNKRKPKLETNLVRGVPPPEILERCEFLEPLSGKALEDYQWLMSKVQRPRLGFFGNVLQKMSAVLDFKRRF

SEQ ID NO: 43848 - protein, 323 aa, Sorghum bicolor
  Clone ID: SORBI-28MAY03-C39723_1.pep
LQMNLMSGHISHLLDLLWSWLSPAEENHSNTARPLDDPEMIRFGAHIVLVLRHLFSDEMDDELDEKLVTVGGLIINMDVRYLFSEDQEELVGVYASQLQHDLCINLFVEMMELRLNSSLHTMYKLFLSAVEYLPFSSDDASKACFEEIIERVLSRSRQTKPSKYDEDFSDVAHQHHLQSLQKAMVIQWLCFTPPSSIPDFQMITGKLLIRALVHSNTLFREFSLISMRRVPELPAGPHKLLAILAEPLKQKENLISLEDPEVSDNLLEFEDWHEYYSLDATYRSWLKIEMKNAAVSPEMLSAEEKDQAVAAAKETLDLAFLLL

SEQ ID NO: 43849 - protein, 278 aa, Sorghum bicolor
  unsure (1)..(278): unsure at all Xaa locations
  Clone ID: SORBI-28MAY03-C39829_1.pep
PRSPPPAAPPLPPAAPLPAASSLSLLFSHPNSHSRQPSVRGGPAAGSHLRLPPRASPSRARCASSDTTATKHRRPAEENIREEAARLRGPAQGFSAWYEPFPPAPGGDPDERYSLDEVVYRSSSGGLLDVRHDMEALARYPGSYWRDLFDSRVGRTAWPYGSGVWSKKEFVLPEIDSDHIVSLFEGNSNLFWAERLGREHLGGMNDLWVKHCGISHTGSFKDLXGPGCASTGDTSAALSAYCAAAGIPAIVFLPANRISLEQLIQPIANGATVLSLDT

SEQ ID NO: 43850 - protein, 228 aa, Sorghum bicolor
  Clone ID: SORBI-28MAY03-C40027_1.pep
TREMNPFTMVNGEPYPLDMRGELDDTAAFKNFKKWGDIEFPLPFGRVLSSTESFIHELDEKTSASLKFTVLNPKGRIWTMVAGGGASVIYADTVGDLGYASELGNYAEYSGAPNEEEVLNYARVVLDCATADPDGRKRALLIGGGIANFTDVAATFNGIIRALREKESKLKASRMHIYVRRGGPNYQSGLAKMRKLGAELGVPIEVYGPEETMTGICKQAIECIMAAA

SEQ ID NO: 43851 - protein, 455 aa, Sorghum bicolor
  unsure (1)..(455): unsure at all Xaa locations
  Clone ID: SORBI-28MAY03-C35097_1.pep
MEYRPSDSSGTDDDLPQFPNSRSIRGSGRVSGNGRALVPASSYARAPTDMEAQIQQLEQEAYCSVLRAFKAQSDAITWEKEGLMTELRKELRVSDKARTRLLNRVNNDNIICSIREWRSTGGLQAGLSNNPQPIHDPVPSPTTSGRKRQKTSQSVPALPAPPLALHSQQLATPTQPSSSTATKAVPPGPKGKKMKPGQKVPGGSAAKPMSSSAGPSGRGPHMNRNFPGGSAPEAQAQNLDPLVGRKVMSRWPEDNSFYEAVISDYNAETGLYALVYDINTANETWEXWVDLKEMGPEDIRWQEDDSGIDPVTYLRSRGAPTSGVRKPTGRGGPMPGSGRGRGLQKNMSKKDFPPPQNGVGKRSSDDIDILHTESLIKEVEKVFSISNPDPQEVEKAKKALKEQEQSLIDAIARLAEASDGESDGHNRGRRNLYAGNQHQANYIDAMPVGDQADAM

SEQ ID NO: 43852 - protein, 207 aa, Sorghum bicolor
  Clone ID: SORBI-28MAY03-C3520_1.pep
MEAEAAAKRARESGEDAAAGAGAGAEAAAAGAGEQAGISAVIPGWFSEISPMWPGEAHSLKVEKVLFQGKSDYQNVMVFQSSTYGKVLVLDGVIQVTERDECAYQEMITHLPLCSIKDPKKVLVIGGGDGGVLREVSRHSSVEQIDICEIDKMVVDVSKQFFPHLAVGFEDPRVSLHIGDGVAFLKNAPEGTYDAVIVDSSDPIGPA

SEQ ID NO: 43853 - protein, 149 aa, Sorghum bicolor
  Clone ID: SORBI-28MAY03-C34708_1.pep
HEAAPYAIVYRNMAILGVDGFRSLPENCLTLCYIFFAAAIVINLVRDLTPQRVSRFIPLPMAMAIPFYIGSYFAIDMFLGCVILFVWEQLNKAKADAFGPAVASGLICGDGIWTLPQSILALAKVQPPICMKFLSRSTNAKVDSFLGLS

SEQ ID NO: 43854 - protein, 162 aa, Sorghum bicolor
  Clone ID: SORBI-28MAY03-C35795_1.pep
DEELEQTSEAVGYGAVKYADLKNNRLTNYTFSFEQMLSDKGNTAVYLQYAHARICSIIRKSNKDVEELKMSGAISLDHPDERVLGLYLIRFAEVVEEACTNLLPNVVCEYLYNLSEMFTKFYTNCQVVGSPEETSRLLLCQATAVVMRQCFNLLGITPVYKL

SEQ ID NO: 43855 - protein, 216 aa, Sorghum bicolor
  Clone ID: SORBI-28MAY03-C36848_1.pep
ARGPPLHSVPLSVALQQHPVEGTATQQFVHNVPVDKSSTNNRFQESSVSAGPSDGNKTFLNAAASQYRDELGLVQQPASTSSSSQTVQPSFGQAGVISNEVSTSAKVTVRATPSKVNPGTAAGVASNPEGPQVTSIPSKTHQSSSSSDQQYQHPVNNQDRRARATQKAGTGNEWQRRSGYQGRNQGSGSDRSSGTGRMKQIYVAKPSSTSGHAPSG

SEQ ID NO: 43856 - protein, 254 aa, Sorghum bicolor
  Clone ID: SORBI-28MAY03-C41057_1.pep
ARGSFGFDTAVEEAQRAINAAHVEAVSAENGIGLVKLMGRHSGFIAHYATLASRDVDCCLIPESPFYLEGEGGLFRYIEKRLKDNGHMVIVVAEGAGQKLIAETMQSIGKDASGNELLLDVGLWLSQKINEYFKKNKMTINLKYIDPTYMIRAIPSNASDNVYCTLLAHSVVHGAMAGYTGFTIGQVNGRHCYIPFYRITEKQNRVSITDRMWARLLSSTNQPSFLCNKVVEEAKKEQERAAQLLDGSPSHRKG

SEQ ID NO: 43857 - protein, 70 aa, Sorghum bicolor
  Clone ID: SORBI-28MAY03-C41122_1.pep
MGLSSAQSQLSALDSSSRLGLKSWQKTKPCIEILCNNQVLSPEMSLATVRTYIWKKPEDLILHYRVVQSR

SEQ ID NO: 43858 - protein, 220 aa, Sorghum bicolor
  Clone ID: SORBI-28MAY03-C4168_1.pep
MEGNKDDAAKCLRIGKGALDAGDRARAIKFLSKAKRLDPSLPIDDLLTSLLSPEDDSPASSSSSQPPPPPPQTATAGASEAAEPDGLRERKHKGKKREEEEEATPAAREYTAEQLEVVRQVKKHTRDYYQILGLEKDCSVEDVRKAYRKLSLKVHPDKNKAPGAEDAFKAVSKAFQCLSDAESRKRYDLVGSDEPVTHHRRPSTARAYNGFYEEDFDPDE

SEQ ID NO: 43859 - protein, 307 aa, Sorghum bicolor
  Clone ID: SORBI-28MAY03-C41935_1.pep
MRPPARGGRGGRGGRFDGGGRGGGGGRGFGGGRGGGGGRGGRGARPPPAGPGGGGRGGRGGGMKGGSKAVVVPHKHAGVFISKSKEDALCTKNMVPGESVYAEKRVSVQNEDGTKVEYRVWNPFRSKLAAAVLGGVDNIWIAPGTRVLYLGAASGTTVSHVSDIVGPDGLVYAVEFSHRSGRDLVNMAKKRTNVIPIIEDARHPARYRMLVGMVDVIFSDVAQPDQARILALNASYFLKNGGHFVISIKANCIDSTLPAEAVFAAEVEKLKADQFKPAEQVTLEPYERDHACVVGGYRMPKKQKATS

SEQ ID NO: 43860 - protein, 334 aa, Sorghum bicolor
  Clone ID: SORBI-28MAY03-C4231_1.pep
VRGDAVNNFTRKMDDLKRKRDDLKTREAILEQTVQDGAKDLEQLMNSRSTYLAKQEECTKKIRDLGSLPADAFEAYKRKNKKQLHKMLYDCNEQLKQFSHVNQKALDQYVNFTEQREQLQRRRAELDAGDVKIMELISVLDQRKDESIERTFKGVARHFREVFSELVQGGHGYLVMMKKKDGDAVDDEDEDEDGPRDPGPEGRIEKYIGVKVKVSFTGKGETQSMKQLSGGQKTVVALTLIFAIQRCDPAPFYLFDEIDAALDPQYRTAVGNMIRRLADMADTQFIATTFRPEIAKVADKIYGVTHKNRVSYINVVSKEQALDFIEHDQTHNAS

SEQ ID NO: 43861 - protein, 115 aa, Sorghum bicolor
  Clone ID: SORBI-28MAY03-C37916_1.pep
HPEVEGSAFGDSDLRFSVVAGGHPCPPVRPAVLKLAKSIWLLHRLAYSFDPKAKVFQVKKGSEFSEIHMESIVKNIIIEEGAERPKVGLMIMPGFLIGTSVIQSRVYPSAVVFPV

SEQ ID NO: 43862 - protein, 262 aa, Sorghum bicolor
  Clone ID: SORBI-28MAY03-C3853_1.pep
MRRYSPPYRSPPRRAYGGRGRSPPPPRRGYGGRNKEGSGSLLVRNIPLSVRAEELRVPFERFGPVRDVYIPKDYYSGEPRGFAFVEFVDPYDASEAQYHMNRQVFFGREIAVVLAAESRKRPEEMRSRARVRGYSGHEGRRSSYYGRSRSRSRSPRYRGRPRSRSYSPAPRRRDDYSASPRRKEAHRTSPPRRPPKEHDEDKKRRSYSPASRDDADNGYEKRSPPADSNGSPPHRRSPKEEYSGSPPGSRSRSADESPVRSD

SEQ ID NO: 43863 - protein, 118 aa, Sorghum bicolor
  Clone ID: SORBI-28MAY03-C39005_1.pep
HVAYPPYLGLSIILNNACVIKNNHAVTIITGTFILPNNAVPQDQRGAANGLSMTGMSFFKALAPAGAGIVFSWAQKRQHAFFFPGDQMVFFLLNVVELVGLLLTFKPFLEVPEQFESR

SEQ ID NO: 43864 - protein, 108 aa, Sorghum bicolor
  Clone ID: SORBI-28MAY03-C39121_1.pep
MAQVGSATASERPPPQDAWVVELRSLLPQWESLRDSSKVIIPISISRVNQFDAARLDVEMSAVLKEQLVKVFSLMKPGLLFQYEPELDAFLEFLIWRCSGSTHHWKRS

SEQ ID NO: 43865 - protein, 173 aa, Sorghum bicolor
  Clone ID: SORBI-28MAY03-C39546_1.pep
MDGSTRGGGHSEALRNYNLGRTLGIGTFGKVKIAEHKLTGHRVAIKIINCRQMKNMEMEEKAKREIKILKLFIHPHIIRLYEVIYTPTDIYVVMEYCKYGELFDYIVEKGRLQEDEARRIFQQIISGVEYCHRNMVVHRDLKPENLLLDSKYNVKLADFGLSNVMHDGHFLKT

SEQ ID NO: 43866 - protein, 263 aa, Sorghum bicolor
  Clone ID: SORBI-28MAY03-C3578_1.pep
MHVFALRMGKAVKKKKKKKGVRTDCILCTIISGFVKRRGLAIRAYDKLVSIGCEPGQVTYASVINVYCRLGRSDRAEAVFSEMIERGFDKCVVAYGNMISMYGKIRRASEAMRLLALMKQNGCEPNVFVYNALLDMHGRLGNSKQAEKIWKEMMRRKVRPDRISYTAIILANNRAGELNRCVELYQEYRETGGKVDKVMAGLMVGVLSKSSRFNELIELLKEMNGTKLDRRLYMSVLRSLRDAGLEVHVKWLQSNFTFMEEKT

SEQ ID NO: 43867 - protein, 251 aa, Sorghum bicolor
  Clone ID: SORBI-28MAY03-C786_1.pep
EFPGPTNPSARRHPRGDNIQIDTKNILFICGGAFVDLEKTISERRHDSSIGFRAQVRSNMRSGGVINAEITSSLLESVESGDLIAYGLIPEFVGRFPILVSLSSLSEDQLVEVLTEPKNALGRQYTKLFEMNDVKLHFTEEALRLIAKRAIAKNTGARGLRSILESILTEAMYEIPETRTGKDKIDAVVVDEESVGSANQHGIGAKILCGERALDLYLAKHNNKESMGQHQVRSNVESEIDTEAPSRVASM

SEQ ID NO: 43868 - protein, 117 aa, Sorghum bicolor
  Clone ID: SORBI-28MAY03-C44270_1.pep
TGRLLREKVDPAVQRVVRSQMNAVDSSPFRESPDLFEVEATNGMPRASIDKLPESWITEEYRRDAVGDLSGCSVCLQDFQVGEKVRSLPDCWHVFHVPCIDGWLIKHGSCPLCRRKL

SEQ ID NO: 43869 - protein, 204 aa, Sorghum bicolor
  Clone ID: SORBI-28MAY03-C44073_1.pep
TSSLKTAAMAKLCTLLLAAVVVLPRPLRPRARRRRPRRPRPDGGRQQRVDAHGAQLGRNVAPQQRQEAQSAVRAPAHLRLRQGARRQQRHPGRVDARQDLPFLGQLPLILLLPSNGASRARPEMCVRVSWEAVCQKTRRLKKGMEFFPPSTRPRCIRLVMCERRCCNFISSLLVSVVLLWLWKAKRETRAARLMFARQCIKLWF

SEQ ID NO: 43870 - protein, 379 aa, Sorghum bicolor
  Clone ID: SORBI-28MAY03-C4446_1.pep
MDKYEPVREIGAGNFGVAKLMRNKETRELVAMKFIERGNRIDENVFREIVNHRSLRHPNIIRFKEVVLTPTHLAIVMEYAAGGELFERICEAGRFHEDEARYFFQQLVCGVSFYHAMNICHRDLKLENTLLDGSPAPRLKICDFRYSKSSVLHSRPKSTVGTPAYIAPYVLSRREYDCKHADVWSCGVTLYVMLVGAYPFEDPKDPKNFRKTISRIMSVQYKIPEYVHVSHNCRHLLSRIFVQNPYKRITMSEIKSHPWYLKNLPRELKEEAQAAYYSRRGVGDAAAGSSNANGNGNANAVAPAAYSSQSVEEIMRIVQEAQTLPKPARPVSGYGWDAASDDDDDQYEEEAEPEEEDDYDRTVRQVHASGEFDMSRLQI

SEQ ID NO: 43871 - protein, 276 aa, Sorghum bicolor
  Clone ID: SORBI-28MAY03-C44623_1.pep
TRVDLAQLQDAIRPDTGLVSVMAVNNEIGVVQPLEEIGRICKEKGVPFHTDAAQALGKIPIDVNRSARGLMSLSGHKIYGPKGVGALYLRRRPRIRVEPQMSGGGQERGIRSGTVPTPLVVGFGAACEIAAQEMDYDHRRVSALQQRLLDGIRAQVDDVVINGSMEHRYPGNLNLSFAYVEGESLLMGLKEVAVSSGSACTSASLEPSYVLRALGVEEDMAHTSIRFGIGRFTTEEEVDRAIELTVHQVKKLRDMSPLYEMAKAGIDLKSIEWSQH

SEQ ID NO: 43872 - protein, 257 aa, Sorghum bicolor
  unsure (1)..(257): unsure at all Xaa locations
  Clone ID: SORBI-28MAY03-C45405_1.pep
MDNHLKSPLISLLLFCTATTVAYPACSEILSHKVSKHFVSYSPQPRDFPNEQLYRAYFVIQRFKNTITGDPKNITATWTGHDICGKTSYVGFYCGALPGRDNKLTVTAVILNGYNLHAPRLHGFVDQLPDLALFHAASNNFGGDVPRLAGLGYMYDISVSNDHPIHTLIDTYGAQGAGSINVVSQCVTATINFNFHLGIPGSKEGKHSTGATDAKALLLNXNNLSGPLPSNIGFSQLSYLALANNKLTGPIPSSIIH

SEQ ID NO: 43873 - protein, 507 aa, Sorghum bicolor
  Clone ID: SORBI-28MAY03-C1443_1.pep
TRVNKLFEFMHEMHPGVQDMACDTFLKIVTKCKRKFVTQQVGENEPFVSELLSNLATTIADLEPHQIHTFYESVGHMIQAESDNTKRDEYLKRLMSLPNQKWAEIIGQASQSIDILKNQDVIRSVLNILQTNTSVASSLGPHFFPQISLIFLDMLTVYRMYSELVSSTIAEGGPFASRTSFVKLLRSVKRETLKLIETFVDKAEDLPHIGKQFVPPMMDPVLGDYARNVPDARESEVLSLFATIINKYKGEMLEDVPRIFEAVFQCTLEMITKNFEDYPEHRLKFFSLLRAIGTHCFQALIQLSSPQLKLVIDSINWAFRHTERNIAETGLSLLLEILKNFQASGFQNQFYKTYFLTIEQEIFAVLTDTFHKPGFKLHVLVLQHLFCVVDGLTEPLWDASSVPYQYTDNAMFVRDYTIKLLGTSFPNMTVTEVTKFVDGLLSSKHDLPSFKNHIRDFLVQSKEFSAQDNKDLYAEEAAAQRERERQRMLAIPGLIAPSELQDEMVDS

SEQ ID NO: 43874 - protein, 145 aa, Sorghum bicolor
  unsure (1)..(145): unsure at all Xaa locations
  Clone ID: SORBI-28MAY03-C14806_1.pep
RSITXGLRSMERHAVDFYISDFQSGLRALVRTGSGARVTPYVDESVVIDINPDNKDMSPEFLRWLRGRNLSSDDRIMRLKEGYIKEGSTVSVMGVVQRNENVLMIVPPAEPISTGCQWAKCILPASLEGLVLRCEDTSDLDVIPV

SEQ ID NO: 43875 - protein, 229 aa, Sorghum bicolor
  Clone ID: SORBI-28MAY03-C15296_1.pep
MVEPPSYETPKDVHVVEKPYVTPMNSNATTLATNAKEVGHAEAQKDSQRSAPSVPVSYSTAHPTEDADSRTLYVSNVHFAATKDSLSRHFNKFGAVLKVVIVTNAATGQPTGSAYVEFLHKESAERALSLNGTSFMTRILKVVRRSSHEAAHFYGWPGSGRSSLYGRHGRMAYPRAVLPGGSFRGRAPMKAGARSLQWKREPSGTDSSAGAKTDMSVPFSSEQVLPPAT

SEQ ID NO: 43876 - protein, 193 aa, Sorghum bicolor
  Clone ID: SORBI-28MAY03-C15377_1.pep
HEGPAKGSRHTKAAKAKGVLFQPASQFLPMIEQVHDSLVEKTKCIPGAKGASNKFCVSVHFRCVDEKSWSTLADLVKSVLTDYPKLKLTQGRMVFEVRPTIKWDKGKALEFLLESLGFADCTDVLPVYIGDDRTDEDAFKVLRKRGQGVGILVSKHPKDTSASYSLQEPAEVMEFLLRLVEWERLSKARPAKW

SEQ ID NO: 43877 - protein, 136 aa, Sorghum bicolor
  Clone ID: SORBI-28MAY03-C48905_1.pep
ATQITTHQAALSNNNYDNNLPIAAVDAVLGSDNSGVKKRNKRVMAVDGAAAESCFDDGSSDSFSSKKLKLPSDSRIAGHFGTTASSYYYCNNQLQLVDSTMSRSGFHQYSSLLLSSSNPFLSQQQQLLLNSHIGMQ

SEQ ID NO: 43878 - protein, 314 aa, Sorghum bicolor
  unsure (1)..(314): unsure at all Xaa locations
  Clone ID: SORBI-28MAY03-C492_1.pep
KNCKPVAIKKLYAHYPQSLKEFETELETVGSIKHRNLVSLQGYSLSPVGNLLFYDYMECGSLWDVLHEGSSKKKKLDWETRLRIALGAAQGLAYLHHDCSPRIIHRDVKSKNILLDKDYEAHLTDFGIAKSLCVSKTHTSTYVMGTIGYIDPEYARTSRLNEKSDVYXLWHCSAGAADWQEASGQRVQSPSXILSKTASNEVMDTVDPDIGDTCKDLGEVKKLFQLALLCTKRQPSDRPTMHEVVRVLDCLVNPDPPPKPSAHQLPQPSPAVPSYINEYVSLRGTGALSCANSTSTSDAELFLKFGEAISQNME

SEQ ID NO: 43879 - protein, 185 aa, Sorghum bicolor
  Clone ID: SORBI-28MAY03-C50133_1.pep
HEGQTSKETTQKKFEAEFGSNSQSTGQNIKEKFSQSPMKKRKQKEKADKITEDARSNKPDFSQKENSKRPKSAKSSAERGSSAKNTREGTDASASMMFLKGSVKRKSPGFLSDKPSLKKQKHHKLVSGRPDGKLFVRDSGTSAPFVKNAGKQKQSIAELADLAGKEKLTASEVRKLLKPEMSGKS

SEQ ID NO: 43880 - protein, 215 aa, Sorghum bicolor
  Clone ID: SORBI-28MAY03-C52493_1.pep
MARREAARLLRRLGPLAVESPTRGMPRCQHESANHIVNSCRRFHWIPSLQRPLCGPTTCRGIYEGQSSANKACEVQKRTFGSAATATHIQRNPAYSQLSSDDVSYFKSVLGENGVVQDEDRVAVANVDWMGKYRGASQLLLLPKNTAEVSKILSYCNTRRLAVVPQGGNTGLVGGSVPVYDEVIVGLAGMDKIISFDNVYGAPSRGAGWVLPRLS

SEQ ID NO: 43881 - protein, 193 aa, Sorghum bicolor
  unsure (1)..(193): unsure at all Xaa locations
  Clone ID: SORBI-28MAY03-C52656_1.pep
MSFRSIVRDVSESFGSLSRRSFEVRISGLPGLSGHHRGKSVGSLSDRPVVVDQSRWVGLPPELLRDVMKRLEEGESNWPSRKNVVACAAVCGTWRELXGCALLRPVPRRLLTLPVSLHQPGPRSGMIQCFIKRDKSTSTYYLYLCLSPAVLSEDGKFLLAAKRNRRTTYTEYIISVDRKNISRSSNGYVGKMR

SEQ ID NO: 43882 - protein, 75 aa, Sorghum bicolor
  Clone ID: SORBI-28MAY03-C42086_1.pep
RGKHNEQIERGEAPLECAGVRQWRTPILAMTADVIQATHEPCFIFVVGGYASKTFWGEHLCADASRFFLNRNQVQ

SEQ ID NO: 43883 - protein, 65 aa, Sorghum bicolor
  Clone ID: SORBI-28MAY03-C42582_1.pep
KLAGSSCCHKISISEMIPGTGQEATQLNTNLAVNPTAASTTNRSSTILASCYDILVSTLFSGLPS

SEQ ID NO: 43884 - protein, 270 aa, Sorghum bicolor
  Clone ID: SORBI-28MAY03-C4302_1.pep
PWRGPHPCELHCQGPLACSLRLPPGLRLGGLPRVRRAPSEPAGGVPHIFSHFITNLPAIHSTLVFVCVKYLPVYTVPLDERFLVKRIGPKNFHMFRCVARYGYKDIHKKDDDFEQMLFNSLMLYIRLESMMEEYTDSDDYSTRELNQAGNANQRINGISTSSNMDLSYTSHDSIIQVQSPNHIGNSQVVSSGQMYQTVGDEIAFLNACRDAGVVHILGNTIVRARRDSGFIKKFAINYMYAFLRKICRENSAIFNVPHESLLNVGQVFYV

SEQ ID NO: 43885 - protein, 197 aa, Sorghum bicolor
  Clone ID: SORBI-28MAY03-C4333_1.pep
VRGHPPLGWHDTICYLVLPVLLVASQYVSMEIMKPPQSDDPSQKNTLLILKFLPFMIGWFSLSVPSGLSIYWLTNNVLSTAQQVWLRKMGGAKPVVSKGGSGIITAGRAKRSNAEPAGERFRQLKEEENRRKLSKALAAGDSDASSSTYDMEDEELDDETTEEGGPVEEASSTGSDKKLPSYSGKKGKRSKRKRMVQ

SEQ ID NO: 43886 - protein, 124 aa, Sorghum bicolor
  Clone ID: SORBI-28MAY03-C43496_1.pep
IHTSTDASFVPKAIDLAARELTSLATPGQVDQSQLDRAKASAKSAILANLESQASLTEDMGRQVLAFGERKPAEHLLKAIDGVTLKDVTSVAEKIISSPLTMASHGNVLNMPTYESVSGKFRSK

SEQ ID NO: 43887 - protein, 180 aa, Sorghum bicolor
  Clone ID: SORBI-28MAY03-C43903_1.pep
MSDRSSSAGPTFFPFGPQAEAWDVTFKVKYGDTLKRFYGCANGNHFDMNLSALRAKIATAFKFGSDADFILTYTDEDGDIVMLDDDDDLRDAALRQKLNPLRITVQLKKNQPTDKKDVSAPVKPITQDSLSQIMSAIEFLKPVQEDSLAHIKSAIGEAIKSVPEPIPDALAKLSHEILDA

SEQ ID NO: 43888 - protein, 147 aa, Sorghum bicolor
  Clone ID: SORBI-28MAY03-C5515_1.pep
MDKLSGSARLMIVSDLDHTMVDHHDEENLSLLRFGALWESVYCQDSLLVFSTGRSPTLYKELRKEKPMLTPDITIMSVGTEITYGEAMVPDDGWEEYLNNKWDRNIVVEETVGFSELKLQPETEQRPHKVRFLVDKKSAQEVIKSVA

SEQ ID NO: 43889 - protein, 210 aa, Sorghum bicolor
  Clone ID: SORBI-28MAY03-C55321_1.pep
TRILYSVLITAVITDAIKDGVGRPRPDFFWRCFPDGKPNYDNITTDVICHGEKSVIKEGHKSFPSGHSSWSFAGLGFLAWYLAGKLKAFDRKGHIAKLCLVFLPLLVASLVAVSRVDDYWHHWQDVFAGGILGLTVASFCYLQFFPFPFDNDALWPHAYFQQLAETHSNGNANSINIRPTESEDEQEDHGGIALRDTSPILESMESGRRL

SEQ ID NO: 43890 - protein, 284 aa, Sorghum bicolor
  Clone ID: SORBI-28MAY03-C55730_1.pep
ARGKYDGKYLHSLVRELLGETKVSQALQNIVIPTFDIKLMQPTAFSKYDAINDVSKDALLSDVCISTCAAPALLPGRQCDPRVQDGEPRAVTPSVGGAAADNPTRLAGAGKALLKKPASKVNFPTEREESGGLRGPSQDARAPFAQMLVDARRARLREKVGSPSLEDNAPASILFSQSRAVLDDIHDSVLFQALHSERQYLRIQDDELTGETSSVDVSTMENLNRLVDVGKGLLKKPACKVNIETGKNEPDVKRGTNEDELIRFAKMLVRERRARIQRKGDNTI

SEQ ID NO: 43891 - protein, 288 aa, Sorghum bicolor
  Clone ID: SORBI-28MAY03-C5623_1.pep
MVNAFFLFCGCVDQASVAVVEKWGRFLRLADPGLHFFNPFAGECVAGALTTRVQSLDVRVETKTKDNVFVQLICTIQYRVVKENADDAFYELQNPQQQIQAYVFDVVRAIVPRMNLDDLFEQKNDVAKAVLEELEKVMAAYGYSIEHILMVDIIPDAAVRKAMNEINAAQRLQLASVYKGEAEKILMVKKAEAEAEAKYLSGVGIAKQRQAITDGLRENILNFSHSVSGTSAKEVMDLIMVTQYFDTIKELGDGSKNTTIFIPHGPGHVKDISEQIRDGMMQASSSNV

SEQ ID NO: 43892 - protein, 258 aa, Sorghum bicolor
  Clone ID: SORBI-28MAY03-C564_1.pep
HEDENEQGEDVIAILPWEEWWEFEVTKDDSNPQIALLPLHPDLRAKFNETAAWIYAKSMDGKPYGYHNMIFSWIDTISDNYPPPLDAHVVASVMTVWTKLQPEYAGNMWEEALNKRLGTKGLHLSEIIVESEKRGITFDKLLTVPENDSWVYEDGQSASCIAFVLMMYKEAGLFDPITSSVEVTEFTIKDAYTLNFFEDNATRLPEWCNKDDDVKLPFCQIKGRYRMELPGFNTMEPYAHMNERCPSLPPDYNRTKGC

SEQ ID NO: 43893 - protein, 183 aa, Sorghum bicolor
  Clone ID: SORBI-28MAY03-C4558_1.pep
SKAFRNLPGVDVANVERLNLLDLAPGGHLGRFVIWTESAFKKLDEVYGTFDTPSAKKKGFVLPRAKMANADLSRLINSDEVQSVVKPINKEVKRREPRKNPLKNMAAVLKLNPYLGTARKMAALAEAARVNARKQKLDSKRTKLSPEEASKVKAAGKAWYKTMISDSDYTEYENFTKWLGVTQ

SEQ ID NO: 43894 - protein, 311 aa, Sorghum bicolor
  Clone ID: SORBI-28MAY03-C4733_1.pep
ARGVHLKSLIPQRPTVGDVNGDGHTDVVVPTVSGNIYVLSGKDGSKIQPFPYRTHGRIMSPVLLLDMSKHGENAKGLTLATTSFDGYLYLIEGSSGCADVVDIGETSYTMVLAARGDGGDDLDLIVTTMNGNVFCFSTQSPHHPLKEWRSSNQGRNNAAYQYNREGIYVKHGSGTFRDEEGKNFWVEFEIVDKYRVPYGNQAPYNVTVTLLVPGNYQGDRRIVVSGLYHQPGKQRMMLPTVPVRTTGTVVVEMVDKNGLYFSDEFSLTFHMHYYKLLKWLLLLPMLGMFGVLVILRPQEGAPLPSFSRNVD

SEQ ID NO: 43895 - protein, 117 aa, Sorghum bicolor
  Clone ID: SORBI-28MAY03-C47447_1.pep
LVQNERKLLEKINILCLMEIIFSRPSEDRTIPLSVIAERTKLSISDVEYLLMKSLSVHLIEGIIDEVDSTVHVSWVQPRVLGIPQVKALRDRLDAWVGKVHTTLLSVEAETPDLVAA

SEQ ID NO: 43896 - protein, 354 aa, Sorghum bicolor
  Clone ID: SORBI-28MAY03-C478_1.pep
MASPSRILILLPLLFLLLGSHCSTGAAARRQLLRAGDPSSQVKFDFSPFLIEYKNGRVKRLMGTNVVAASSDALTGVTSRDVTIDPSTGVAARLYLPSFRASTRVPVLVYFHGGAFVVESAFTPIYHAYLNTLAARAGVVAVSVNYRLAPEHPLPAAYDDSWAALKWVLASAAAGSGSDPWLSQYGDLSRLFLAGDSAGGNIAHNLALRAGEEGLDGGARIKGVALLDPYFQGRSPVGADSTDPAYLQSAARTWNFICAGRYPINHPYADPLLLPASSWQHLGASRVLVTVSGQDRLSPWQRAYYAALRGSAWPGEAELYETPGEGHVYFLTKLSSPQALAEMAKLVAFINRDD

SEQ ID NO: 43897 - protein, 112 aa, Sorghum bicolor
  Clone ID: SORBI-28MAY03-C4817_1.pep
MKFIAAYLLAVLAGNSSPSAEDLTAILESVGCEVDNERMELLLSQLSGKDITELIAAGREKFASVPCGGGGVAVAAAAPAAGGAAPAAEAKKEEKVEEKEESDDDMGFSLFD

SEQ ID NO: 43898 - protein, 148 aa, Sorghum bicolor
  Clone ID: SORBI-28MAY03-C59808_1.pep
ACGGAGPGPTEPGLSQIQSDVRGTAGYVDPEYLRTNYLSFKSDVFSDGILRLGILSGRRPIEARRGPTERITVRWAFSKYHRGNVRDILDPMLTEAVNEDILNKIFDVAFQCVAPTREGRPSMKEVVERLWKVRRDYAKIQRIAELTL

SEQ ID NO: 43899 - protein, 261 aa, Sorghum bicolor
  Clone ID: SORBI-28MAY03-C608_1.pep
MSSRSPPPKDRRMRTERTSYRDAPYRRDSRHGPSRFRNDLCNNCKRPGHFARDCPSVAVCHTCGLPGHIAAECSSKGICWNCKEPGHMANSCPNEGICRNCGKSGHIARDCTAPPVPPGEVILCSNCYKPGHFREECTNEKACNNCRQSGHIARNCTNDPVCNLCNVAGHLARECPKSDKLGERGGPPPFRGVGAPFRGVGVPFRGGFSDVICRACNQIGHMSRDCMAGAFMICHNCGGRGHMAYECPSVSLMDRFPPRRF

SEQ ID NO: 43900 - protein, 415 aa, Sorghum bicolor
  Clone ID: SORBI-28MAY03-C609_1.pep
MEVSSRLQSLLRPLLLCRSRAAGRAFQTLALRSPPPPPPPPPRLPSSFLLRTRRLPPSHPYGAPSRVLFHRPFASVSPAPAPVPGSDHLNSKDQGPPPAPLPPPPPEDLASEDESYYHEHLLEVAQENQSRVVPVKAFFLCTSIDLRSLQSQNSFNVIPPTSRATNYVVLRYYDVNGDPEGFKSGVIDESHCHYMVVFQYGSIVLFNVSDHEADGYLKIVEKHASGLLPEMRKDDYAVVEKPTLETWMQGGLDYIVLRDLSIDGIRTIGSVLGQSIALDYYIRQVDGMVAEFTDINRGMEKTGTFTMERKKLFQLVGKANSNLADVILKLGLFERSDIAWKNANYAQIWEYLRDEYELTQRFGNLDFKLKFVEHNIRFLQEILQNRKSDFLEWLIIILISVEILISVYNIIQEQM

SEQ ID NO: 43901 - protein, 252 aa, Sorghum bicolor
  Clone ID: SORBI-28MAY03-C6174_1.pep
QGLQTCLVALLSRWFKPAAESFVKVPFLGAVSHLTLAVCPFCVAFAVLWAVFRQLPFAWIGQDILGIALIVTVIQIVRVPNLKVGSVLLSCAFLYDIFWVFISKRWFHESVMIVVARGDKTDEDGVPMLLKIPRMFDPWGGYSIIGFGDILLPGLLVAFALRYDFSAKKGFRSGYFLWAMVAYGSGLLITYVALNLMDGHGQPALLYIVPFTLGTLIALGWKRGELPNLWTRGEPERVCTHMHMPLLPTTPN

SEQ ID NO: 43902 - protein, 104 aa, Sorghum bicolor
  Clone ID: SORBI-28MAY03-C63766_1.pep
PENPKKAQAKKENSANPSALKLQGSITLSNNINDRKTPKKKPLPSPSPTDQKKPSPSPSSDQKKPVPKEQRAKAAGTPPKPKAKDMKGSQEKKPQQKVAPSVSA

SEQ ID NO: 43903 - protein, 134 aa, Sorghum bicolor
  Clone ID: SORBI-28MAY03-C52907_1.pep
DFSSSRFSEISGLAQQDEGSGQAKERPLALRNKEPRWHEQLQCWCLNFRGRVTVASVKNFQLIAAPQLDSESSQQAQQQAQPSNSSSVLDHDKVILQFGKVAKDMFTMDYRYPLSAFQAFTICLTSFDSKLACE

SEQ ID NO: 43904 - protein, 263 aa, Sorghum bicolor
  Clone ID: SORBI-28MAY03-C5203_1.pep
MENSARASNGEVAAVPDSWNFVPNETLLGLASISVRGVLAKIKAEMGAAGGGGGGRPVIPMGHGDPSAFPCFRTSPEAVDAVAGALQSGEYNSYSTCVGLEPARRSIAQYLSRDLPYELSLDDVYLTNGCAQAIEIICSVLARPGANILVSRPGYLFYEARAVFNGMEARYFDLLPEKDWEVDIEGVQALADKNTVAMVIVNPGNPCGNVYSYEHLAKVAETARKLGIFVIADEVYAHLTFGERKFVPMGVFGAVAPVLTLGS

SEQ ID NO: 43905 - protein, 131 aa, Sorghum bicolor
  Clone ID: SORBI-28MAY03-C5392_1.pep
EAGGGGEHGGDLVAEEAGAPQKPRRSLHRNQPKSHHARPSPRATAGSPQPRGGDRPRALAGNTLSSTERVPEWDNSATLRRPDRRRLVVDDGVAKRKNLFVLIFYIYLYKENALIFANIYFLLGGLWNSSR

SEQ ID NO: 43906 - protein, 161 aa, Sorghum bicolor
  Clone ID: SORBI-28MAY03-C54023_1.pep
MYSPKPESSFAPNPNSGTHQQQMELPGANMGPSNGANNNTNMAARQRLRWTNELHERFVEAVTQLGGPDRATPKGVLRIMGVQGLTIYHVKSHLQKYRLAKYIPDASTDGNKADNKDPGDLLAGLEGSSGLPISEALKLQMEVQKRLHEQLEVQRQLQLRI

SEQ ID NO: 43907 - protein, 301 aa, Sorghum bicolor
  Clone ID: SORBI-28MAY03-C5378_1.pep
VAFCSRVLDNDLMLYYICPMHTLFTLMVYGSLGLFNKYNEIPSIMAIKIACCFLSVILIWEIPGVFELLWAPFTFLLGYKDPSPSKAHLPLLHEWHFRSGLDRYIWIVGMIYAYFHPNVERWMEKLEESETKVRLSIKGTIVTLSLTAGFLWYEYIYKLDKVTYNKYHPYTSWIPITVYICLRNCTQQLRSASLALFAWLGKITLETYISQIHIWLRSNMPNGQPKWLLCFIPDYPMLNFMLTTAIYLLLSYRVFEITSVLRAAFIPSRDNSRLYQNFIAGIAISVCLYLCSLILLKIPVV

SEQ ID NO: 43908 - protein, 66 aa, Sorghum bicolor
  unsure (1)..(66): unsure at all Xaa locations
  Clone ID: LIB3480-026-P1-K1-D5.pep
GLXNXYNEIPSIMAIKIACCFLSVILIWEIPGVFELLWASLTFLLGYKDPSXLVLDRERPALFFFF

SEQ ID NO: 43909 - protein, 192 aa, Sorghum bicolor
  Clone ID: SORBI-28MAY03-C5507_1.pep
MASRRRGFSGLPPPACLPVVVLVVCLAAAVAVSGEPLPQYYNAIFSFGDSFSDTGNFVIINSGKLPNMPKFPPPYARCSNGRLVIDFLAEAFGLPLLPPSANKGTNFSQGANFAVMGATALDLKYFKDNNVWSIPPFNTSMNVQLEWFQEVKQSICPSDPSTCRALFAKSLFVFGEFGGNDYSFSWKADWSL

SEQ ID NO: 43910 - protein, 171 aa, Sorghum bicolor
  Clone ID: SORBI-28MAY03-C6524_1.pep
MLAAKTLITANPSGGMVPDQSDNMTAVTAGKQAEAEPSETAWIGPVLAPNPWCAKLSKVNRHFYTRQSACRVAGKTSAAVKQPLCKGNRSRRVSSDSALDYDDLIAFYDAATGVLFHRTHWTAKPLFHATHALPAKVSIQFNMDACRYETGDSTNKAIRRAFMNRLIRWHV

SEQ ID NO: 43911 - protein, 128 aa, Sorghum bicolor
  Clone ID: LIB3476-021-P1-K1-D10.pep
LNLSSPSESRRRAMAAEPPEPASSQDAQLAASSSAAVDGVGDPNPCCAKLWKKYQKLETSRTALREAVKLLQAENEKLQKENSELSKGSDSAVYYEDMYINFNIAKEIVFQIAGMQPANVRVRPKDMC

SEQ ID NO: 43912 - protein, 406 aa, Sorghum bicolor
  Clone ID: SORBI-28MAY03-C6550_1.pep
RLFVKASGRPQDILPKLRMLAGFSQDDDIELYEEIKFEPNVMCEYIDNRLLFRSCQLEDGDIICFQKSSKPDSADRYRFPDVPSFLTYIRNRQVVHFRSLEKPKEDDFCLEMSKIFTYDQVVEKVAEKLGVDDPSKIRLTSHNCYSQQPKPQPIKYRGVERLLDMLIHYNQTSDILYYEVLDIPLPELQALKTLKVTYHHATKDEVSVHSIRLPKNSTVGDVLNDIKTKVELSHPNAELRLLEVFYHKIYKVFAANEKIENINDQYWTLRAEEVPEEEKNLGPFDRLIHVYHFTKDTQNQTQVQNFGEPFFMVIREDEILSSIKERIQKKLKVPDEDFSKWKFAYISLGRPDYFEDSDTVAVKFQRNMYGAWEQYLGLEHPDTAPRKAHTINQNRHSFERPVKIYN

SEQ ID NO: 43913 - protein, 447 aa, Sorghum bicolor
  unsure (1)..(447): unsure at all Xaa locations
  Clone ID: SORBI-28MAY03-C6600_1.pep
MDFFSEYGDANRYKIQEVIGKGSYGVVCSAIDQHTGDKVAIKKIHNIFEHLSDAARILREIKLLRLLRHPDIVEIKHIMLPPSRRDFKDIYVVFELMDTDLHQVIKANDDLTREHHQFFLYQMLRALKYIHTANVYHRDLKPKNILANANCKLKICDFGLARVAFNDTPTTVFWTDYVATRWYRAPELCGSFFSKYSPAIDIWSIGCIFAEILTGKPLFPGKNVVHQLDLMTDLLGTPSLDTVSRIRNEKARGDLSSMRKKHPVPFSERFPKRDPAALKLLQRLLAFDPKDRPTAEEALADPYFKGLAKVEREPSCQPITKMEFEFERRKVTKEDVKELIFREILEYHPQLLKDYMNGTEKTNFLYPSAVDNFRRQFANLEENGGKSGAHTASSDRKHVSLPRTTTVHSNPIPPNGISQVPQKIPTARPGKSGXPVIPFENATAVIH

SEQ ID NO: 43914 - protein, 161 aa, Sorghum bicolor
  Clone ID: SORBI-28MAY03-C66532_1.pep
PELVRTGKATPVTDVFAFGVFVLEVACGRRPLGCIAPDEQSVLLDWVQEHDRKGAALDTVDARLCGKYDADEARLVIRLGLMCAHPLPDARPGMRQVVQYLEGDTAMPEVAPTYVSYTMLALMQNDGFDSFAAMSFPSTVSSSVSPVSGGFSSVSGLSGGR

SEQ ID NO: 43915 - protein, 213 aa, Sorghum bicolor
  Clone ID: SORBI-28MAY03-C66538_1.pep
MAATTLVLLVLLCLCTALTCSSSGGGGTGNTGIRMKLTHVDAKGNYTAPERVRRAIALSRQINLASTRAEGGGVSAPVHWATRQYIAEYMVGDPPQRAEALIDTGSSLIWTQCTACLRKVCVRQDLPYFNASSSGSFAPVPCQDKACAGNYLHFCALDGTCTFRVTYGAGGIIGFLGTDAFTFQSGGATLAFGCVSFTRFAAPDVLHGASGLI

SEQ ID NO: 43916 - protein, 335 aa, Sorghum bicolor
  Clone ID: SORBI-28MAY03-C56978_1.pep
RLWKWSRNEQAPGGKATARVVPHHWQPNSGLVMTNDTADTNPEEAVPCIALSKNDSYVMSACGGKVSLFNMMTFKVMTTFMPPPPASTFLAFHPQDNNIIAIGMEDSTIHIYNVRVDEVKTRLKGHQKRITGLAFSTNLGVLVSSGADAQLCVWTNDTWEKKRTVSIQMPAGKAPAGDSRVQFSSDQSHLLVVHETQLAIYDASEMERIYQWIPQDTLSASISHASYSCNSQLVFAAFTDGNIGVFDAENLRLRCRIAPSVINSNPPVHPLVVAAHPHEPNQFAVGLSDGSVKVLEPSESEGKWGTPAPADNGIPNGKMPASSATSNPAADQVQR

SEQ ID NO: 43917 - protein, 214 aa, Sorghum bicolor
  Clone ID: SORBI-28MAY03-C57939_1.pep
MLSSTTLRALVPAAVASPSPAHVTACPAPAVGRRVPAAVVVRAVRNYDSIPKREPFSSSRSILDEFLRQDKPLVQRTKDQITDYCTTTEGDECCSCWDAYFELNKLEQELPKEEISRMVKDSEGDVRYLIESIHHRSNLRKKMAEKSRNLVPSTSQGQTAKPRPFPVPDGIPKTQEELAEEEEALMPESPYIRLLRRMGRYPDWYPPPPDHETD

SEQ ID NO: 43918 - protein, 326 aa, Sorghum bicolor
  Clone ID: SORBI-28MAY03-C57969_1.pep
MAAVEGTTKKKVIIDTDPGIDDAMAIFVALRSPELEVLGLTTTFGNVHTALATRNALHLLEAVGRTDIPVAEGSHATIKKATKLRIASFVHGSDGLGNQDFPPPATKPVDQSAAAFLVEQANLYPGQVTVVALGPLTNLALAVELDPSFPKKIGQIIILGGAYSVNGNVNPAAEANIFGDPDAADIVFTCGADILAVGLNVTHQVVLTDADREKLEQCESKYARYLCKIMGIYFDYHKDAYFIKGVYLHDPTTLIAAVNPSLLTYTEGVVRVQTVGITKGLTVFDNTKKRYGEITAWTGMPTVKVAVTVDAPAVVELMMQRLMTDD

SEQ ID NO: 43919 - protein, 411 aa, Sorghum bicolor
  Clone ID: SORBI-28MAY03-C5820_1.pep
ATGISQGDPMLQQEYFLPDGLLYSPTPGYHHPFSSFDRAPTQPNNAPGLFGQGNLPLASGMHHGSMYGPGSYKGRRRGSKFGGTTPSWSSAGRRFGTFDLSGNQQRGSMPFGSHNGSLEFMNEQNRGPRATKPKTQDTENSSDEKNEKTVPLIDSELYNRSDFITEYKDAKFFVIKSYTEDHVHRSIKYNVWASTASGNRKLDSAYRAAKEKEEHCPIFLFFSVNGSGQFCGVAEMIGPVDFDRSVDYWQQDKWSGQFPVKWHIIKDVPNNLLRHIILENNDNKPVTNSRDTQEVKLEQGLQMLTIFKSHEAETTILEDFDFYEQREKALQENRRQQQPASTDPQKLVDTKAQGPVADISDAFAKAVQLKDIENSGTTPKAEGASAENGSAATAKVEGSADLNMGPAEESS

SEQ ID NO: 43920 - protein, 259 aa, Sorghum bicolor
  unsure (1)..(259): unsure at all Xaa locations
  Clone ID: SORBI-28MAY03-C58668_1.pep
MGTQAPENYPPEKDARTAREKAIDDWLPITSSRNAKWWYSAFHNVTAMVGAGVLSLPYAMSELGWGPGIAVLIVSWIITLYTLWQMVEMHEMVPGKRFDRYHELGQHAFGEKLGLWIVVPQQLVVEVGVNIVYMVTGGKSLKKFHDVLVCDDSGCDSKHNIKTTYFIMIFASVHFVLSQLPNFNSISGVSLAAAVMSLSYSTIAWGASVDKGKLPDVDYHLRATTTPGKVFGFFGALGDVAFAYAGHNVVLEIXATIPS

SEQ ID NO: 43921 - protein, 175 aa, Sorghum bicolor
  Clone ID: SORBI-28MAY03-C5931_1.pep
GNIYLRGYEGSLSSRNSHGAFEGLRIQIITWLTFLIMTLFAMLCSVPSKMARRISNQPSRHDDYRVEYPQEQEYKEEFRPPSPAPSYTEKDVLSSMLRRLGELEDKVQVLETKPSEMPFEKEELLNAAVRRVDALEAELISTKKALYDALMRQDELLAYIDRQQLIKFRKKKFCF

SEQ ID NO: 43922 - protein, 161 aa, Sorghum bicolor
  Clone ID: SORBI-28MAY03-C67878_1.pep
MGMEDVVGPSRSMADDFAASTLPPLMDVSGGSGGNMSLSAAAAAAASIELTTPPAPHVTCFSNTLEGHFLTPPTCLLPSAAAASAASPFLASMAQYDGDAGVGGMVHELLQEAGGWYSKLGERERLSGGASQDTGVTSEVNPAEISSTRHHMDHEASFWGF

SEQ ID NO: 43923 - protein, 318 aa, Sorghum bicolor
  unsure (1)..(318): unsure at all Xaa locations
  Clone ID: SORBI-28MAY03-C6814_1.pep
LEKIDPEKTAIQVVILVATRELALQIQAVSKELGKYLNIQVMVSTGGTSLKDDIMRLYQPVHLLVGTPGRILDLIEQGICVLKDCSMLVMDEADKLLAPEFQPSVEALIHFLPPSRXQLLMFSATFPXVTVKEFKEKYLPRPYVINLMDELTLKGITQYYAFVEERMRRDLLLTLFSKLQINQSIIFSNXFPELIYFIFHFVFFPYRYDTRCLSVDVSFVDFDFXHGVCIQFNLXLCTDLFTRGIDIQAVNVVINFDFPKTSETYLHRVGRSGRYGHLGLAVNLITYEDRFNLYRIEQELGTEIKTIPPQIDLAVYCQ

SEQ ID NO: 43924 - protein, 227 aa, Sorghum bicolor
  Clone ID: SORBI-28MAY03-C6820_1.pep
HEAEFHPSHCNTLAYPTRPGSIRLIDLRQSALCDNHSKIFEEHEAPGSRSFFTEIIASISDIKFSRNGRYILSRDYMTLKLWDLNMNSGPVSTFQVHEHLRPRLCDLYENDSIFDKFECCLSGDGLRVATGSYGNIFRVFGCTSGSMEATTLEASRNPMRRQIANPVRPTRTLTSFTRGVRRGGENQGVDANGNSFDFSTKLLHLAWHPTENSIACAAANSLYMYYA

SEQ ID NO: 43925 - protein, 227 aa, Sorghum bicolor
  Clone ID: SORBI-28MAY03-C6850_1.pep
PTRPPTRPDPRVRPRVRTHASGPTRPTRPPTRADEVVEERIADDDVILVKGTKNTSAVSIILRGANDFMLDEIDRSLHDALCIVKRTLESNMVVAGGGAVEAALSVYLENLATTLGSREQLAIAEFAESLLIIPKVLSVNAAKDATELVAKLRAYHHTAQTKADKQHYSSMGLDLSKGIIRNNLEYGVIEPSMSKVKIIQFATEAAITILRIDDMIKLTKEEGNEEE

SEQ ID NO: 43926 - protein, 281 aa, Sorghum bicolor
  Clone ID: SORBI-28MAY03-C8266_1.pep
MYRVASGLGALKRHGADAQMMNVAIRCASTSVAQGSSGGFWTWLTGARSNEIPPPDFALPGVTIPPPLPDHVEAGKTIVTTLPNGVKIASETSAGSSCSVGVYVDCGSVYEAPETTGASQLVKTMAFATTANRSELRVVREIDAIGGTAKASASREMMSYTYRALKTYMPEMVEVLIDCVRNPAFLDWEVKEQILRLKAELVKSSSNPEKFLLEALHSTGYSGALANPLIASEYAISRLNSDVLEQFIIENYTAPRIVLAASGVDHEELVSIAGPLLSDIP

SEQ ID NO: 43927 - protein, 278 aa, Sorghum bicolor
  Clone ID: SORBI-28MAY03-C616_1.pep
SAHASAHASAHASAHASAHACADAWAERYAIFPEIQIVMQPMGMVAGGAPVGSDAGKVPRLGVLPKYATDESEMRWFEVPGFNIMHSLNAWEEADGEELVLVAPNVLSVEHALERMELVHSCVEKVRINLRTGAVSRTPLSAGNLDFGVIHPGYLGRRNRYGYLGIGDPMPKISGVAKLDLDRAGTGDCTVARRDFGPSCFAGEPFFVPDDVEGNGNEDDGYLVCYVHNERTGENLFVVMDARSPQLDIVAEVELPTRVPYGFHGIFVTKAELQAQQQ

SEQ ID NO: 43928 - protein, 121 aa, Sorghum bicolor
  Clone ID: LIB3478-047-P1-K1-C12.pep
DHASVFSVQQPSFLHDFAVTERYAILPEIQIVMQPMGMVAGGAPVGSDAGKVPRLGVLPKYATDESEMRWFEVPGFNIMHSLNAWEEADGEELVLVAPNVLSVEHALERMELVHSCVEKCA

SEQ ID NO: 43929 - protein, 406 aa, Sorghum bicolor
  Clone ID: SORBI-28MAY03-C6378_1.pep
TRIDEDVYIFRPLRFNTLPVVKIATEPLNPSELPKMVEGLRKISKSYPLAITKVEESGEHTILGTGELYLDSIMKDLRELYSEVEVKVADPVVTFCETVVDTSSMKCFAETPNKRNKITMLAEPLEKGLAEDIENGLVSLDSRQKEITDFFRQRYQWDVLAARSIWAFGPDKQGPNILLDDTLSIEVDKNLLNAVKDSIVQGFQWGAREGPLCDEPIRNVKFKILNANIAPEPLHRGGGQIIPTARRVVYSAFLMANPRLMEPVYYVEIQTPIDCVSAIYTVLSRRRGHVTADVPKPGTPIYIVKAFLPVIESFGFETDLRYHTQGQAFCLSVFDHWAIVPGDPLDKSIVLRPLEPAPIQHLAREFMVKTRRRKGMSEDVSINKFFDEAMMNELAQQAADIHLQMM

SEQ ID NO: 43930 - protein, 256 aa, Sorghum bicolor
  Clone ID: SORBI-28MAY03-C6465_1.pep
MSYHCRALVQGPFLHPPFSPGAAGAPAPSLGVRVGLPSRALRLPRPARASVEKREQQVTMEEKAGQAAFGWAARDATGVLSPYNFSRRVPKDDDVTIKVLYCGICHTDLHIIKNDWGNAMYPVVPGHEIVGVVTGVGGGVTRFKAGDTVGVGYFVGSCRSCDSCGKGNENYCAGVVQTSNGVDYAHGGVPTKGGFSDVIVVNEHYVVRVPDGLALDRTAPLLCAGVTVYSPMMRHGLNEPGKHLGVVGLGGLGHVA

SEQ ID NO: 43931 - protein, 241 aa, Sorghum bicolor
  Clone ID: SORBI-28MAY03-C6207_1.pep
MAANLEDVPSLDLMHELLRRMKCSSKPDKHLILIGPPGSGKGTQSPLIKDEYCLCHLATGDMLRAAVAAKTPLGIKAKEAMDKGELVSDGLVVGLIDEAMKKPSCQKGFILDGFPRTVTQAQKLDEMLAKQGANVDKVLNFAIDDAILEERITGRWIHPASGRTYHTKFAPPKSPGVDDVTGEPLIQRRDDTAEVLKSRLEAFHRQTEPVIDYYSKKGLVVNLPAEKPPKEVTAEVQKALS

SEQ ID NO: 43932 - protein, 266 aa, Sorghum bicolor
  unsure (1)..(266): unsure at all Xaa locations
  Clone ID: SORBI-28MAY03-C655_1.pep
MKIDDTARVISFSEKPKGDELKAMQVDTTVLGXSKEEAEKEPYIASMGVYIFKKDILLNLLRWRFPTANDFGSEIIPAAAKEINVKAYLFNDYWEDIGTIKSFFEANLALAEQPPRFSFYDADKPMYTSRRNLPPSMVNNSKITDSIISHGCFLDNCRIEHSVVGVRSRIGSNVHLKDTVMLGADYYETDAERRELLAEGNVPIGIGENTTIQKCIIDKNARIGKNVIISNSEGVVEADRTSEGFYIRTGVTVVLKNSIIADGLVI

SEQ ID NO: 43933 - protein, 175 aa, Sorghum bicolor
  Clone ID: SORBI-28MAY03-C6475_1.pep
RTAETLTMDYHRGANLEVRIARIFNTYGPRMCIDDGRVVSNFVAQALRKEPLTVYGDGKQTRSFQYVSDLVEGLMKLMEGDHIGPFNLGNPGEFTMLELAKVVQDTIDPEARIEFRPNTADDPHKRKPDISRAKELLGWEPKVPLREGLPRMVTDFRKRIFGDQGESTEAAGGLS

SEQ ID NO: 43934 - protein, 40 aa, Sorghum bicolor
  unsure (1)..(40): unsure at all Xaa locations
  Clone ID: LIB3476-020-P1-K1-F9.pep
VRIALIFNTYGPRMCIDDGRVVXNLFSQALRKEPLTVYGD

SEQ ID NO: 43935 - protein, 219 aa, Sorghum bicolor
  Clone ID: SORBI-28MAY03-C69681_1.pep
RPLFYNLFLQNNILLKKEGCVGSGWPNLTICSRACTTFFKKREKPRPGPIFFPKAKQTAVAMFVFQLSYESTLKLISERCRLPFISRIDEVAHDGSILYGIEIELPSLFENEAPRRMFFWSSLQANLDQPYEHACLQAIIFLQNLYRLTIVDYNYQNMVCQQLFIRQLFSLANRGVQLARIIIGRAHNEIVSDTDGLRIAEQLIEKVDGLVNVDIFTHC

SEQ ID NO: 43936 - protein, 160 aa, Sorghum bicolor
  unsure (1)..(160): unsure at all Xaa locations
  Clone ID: SORBI-28MAY03-C706_1.pep
MAIAYXGSAFIFQLFGMEVLQALAVKQVIHLNIAACLIKLTTCVEHIAQCSIVLSHKFEDVKAVYHRIELKSELGQTQSAGVGFRVARMYSPERALFLRGRRLRAGQDGALSLPQVPPFAGLVGPGPLVGPEEANYLVVFWQWLVSFFLYLFRMFKRKKE

SEQ ID NO: 43937 - protein, 313 aa, Sorghum bicolor
  Clone ID: SORBI-28MAY03-C721_1.pep
DFVTVCKKVYVRTRRVRLLGLEGAGKTSLLKAMLGQVKERNSAVLECIHVDLHGKGISSGLCYIDSTTVNLQELPLEVGRFKEELSLGLHDISRKTDLVIAVHNLAHRIPQYQQSNTSQPQPALSLLLDEAKALSIPWILAISNKFSVSAHEQNTLISSAMEAYQASPEMTKVVNSSPFLMPSARNSLQRIRSAAENSGNKDPANRSAYLPVNFALSPFQRKDVVMHVEGVSALRQLVHQVVLNNEEQAFEELARDRLLQELAREKAASLQMKQKPPKRDGSVTAAAVGASLGAGLGIVMAVIMGAASALRKP

SEQ ID NO: 43938 - protein, 378 aa, Sorghum bicolor
  Clone ID: SORBI-28MAY03-C72836_1.pep
MGCCGAMSARPRGIHEETLLRVPGASVHLMAGSDGPVELARGDLAVVRLTKDDVAVATAVRVGKDLGWPLARDEPVVKLDRLHYLFTLPDKDGTFLNYGVSFNADAADDSALASLDGLLRSSACFSAPSYPVVPSKSSRRPPPPPQQQQQPVASDGYWNEFAPRMEGYNGVLAKAIAAGTGQLVKGIFMCSEAYASQVQRGADLFRPQAGGSARSRFGDAGGADRSSQASTKRGAVNKSLKRVRKLSEMTEKMSQSLLDTVISVTGAIAAPLLRSKQGRAFLASVPGEVVLASLDAINKVMDAVEAAEKKSLAATSNVVAGAVSRRYGESAGEATEDAFATAGHAVGTAWNLFKIRKAVTPSSSMPGNMVKSAIRNRN

SEQ ID NO: 43939 - protein, 623 aa, Sorghum bicolor
  Clone ID: SORBI-28MAY03-C73190_1.pep
MYSANHWGGSFEIADGAAEDDHSRNMDLDRGALSARQHHELDETQQSWLLGPPEAKKKDKYVDLGCIVVKRKVLWWALWCVVAAFVLIGLPIIIAKSIPHKKPGPPPPDQYTEALHKALLFFNAQKSGHLPKNNGVKWRGNSGLSDGSYAKDVKGGLVGGYYDAGDNIKFHFPMAFSMTLLSWSVIEYSAQYKAMGEYDHVRELIKWGTDYLLLTFNSSASTIDKLYAQVGSAKINGSRPDDHYCWNRPEDMAYPRPSVSVGSAPDLGGEVAAALAAASIVFRDTAAYSKKLSQGAATVYKFARQSGRRTPYSLRQPDIEYYYNSTSYWDEYMWSAAWMYYATGNSSYISFATDPRLPKNAKAFFNILDFSVFSWDNKLPGAQLLLSRLRMFLNPGYPYEESLIGYHNATSLNMCMYFPRFGSFNFTKGGMALFNHGKGQPLQYVVANSFIAALYADYMEAVNVPGWYCGPNFMTTNDLREFAKSQINYILGDNPKKMSYVVGFGKKYPRHLHHRGASTPHNGVKYSCTGGYKWRDSKKADPNLLTGAMVGGPDRNDGFKDSRNTFGQNEPTLVGNAGLVAALVALTNSGRGVGITAVDKNTMFSAVPPMFPAAPPPPSSWKP

SEQ ID NO: 43940 - protein, 130 aa, Sorghum bicolor
  Clone ID: SORBI-28MAY03-C66547_1.pep
MPDIQLGCHTIQSHGTKVARLHMYDWIILLCLAVLDGLLNLIEPFHRFVGRDMMTDLSYPLKGNTIPFWAVPLIAIVLPWVIFGVIYFKKKNVYDLHHGILGILYSVLITAVITDAINDGVGRPRPDFFW

SEQ ID NO: 43941 - protein, 140 aa, Sorghum bicolor
  Clone ID: SORBI-28MAY03-C6642_1.pep
MASGSMKREISETHDTLRFGLNAGVKADLAPPHPLQSTIQSEAKFWADKKKFGTEAIYGSALNIRKDLDAQILSRFQRPPGALPSSLLGYEALTGSLDDFGFEDYLNMPQDSDSFRQPDMHHGMEVRLGLSKGPICPSFN

SEQ ID NO: 43942 - protein, 157 aa, Sorghum bicolor
  Clone ID: LIB5047-010-R1-XP1-A6.pep
MQSSSMKRDISETHDTLRFGINAGVKADLATPHPLQSTIQSETKFWADKKKFGTDAIYGSALNIRKDLDAQILSRFQRPPGALPSSLLGYEALTGSLDDFGFEDYLNMPQDSDSFRQPDMHHGMEVRLGLSKGPICPSFNWGSECSSAARSPQSSYF

SEQ ID NO: 43943 - protein, 386 aa, Sorghum bicolor
  Clone ID: SORBI-28MAY03-C6690_1.pep
ARGKRSYNTHVIDIEDNCAGKIEIPESGGLLKQELFSLTIPQVGGGEDIFATIRWSQKLLYHNGQFSVEVPFRFPQYVNPLPKVFMKKEKIQLTVNSGASKEVILQGTSHPLKEKNRQGEKLSFLHEAVVENWSTKDFTFAYTVYSGDLSGGVLVQPSTLRDYDDRDMFCLFLLPGNNANRKVFRKAVVYIIDTSGSMQGKPLESVKNAMSTTLSDLMQGDYFNIITFNDELHSFSSRLEQVNERTIGNAIEWMNLNFVAQGGTDMMHPLSEAMALLSSSHDVLPQIYFVTDGSVDDERNICHTLKTQLIKSGSKSPRISTFGLGSYCNHYFLRMLASIGKGHYAAALDTGSIEGRMLQWFQKASSTIVSNVSIDGIKHIQGFEVD

SEQ ID NO: 43944 - protein, 231 aa, Sorghum bicolor
  Clone ID: SORBI-28MAY03-C6724_1.pep
MEDWDSEDFQPVAPVVKAEPLKNQWADEDVEEDDVKESWEEEEEEKPKPAPVEKAAAKPSTKAPAKKGKQQASTSAAEPDEPPLSPTSEKIRQQRLVEEADFKSTTELFAKKGGEQKSLDTFIPKSESDFAEYAELIANKLRPYEKSFHYMALLKNVMRLSMTSLKGADAKEISSSVTAIANEKIKAEKEAAAGKKKQGAKKKQLHIEKGDDDFIPGRGGGYDDPDEYDFM

SEQ ID NO: 43945 - protein, 303 aa, Sorghum bicolor
  Clone ID: SORBI-28MAY03-C6730_1.pep
MTSSGLRVCPLLKLFQLATRLCASAPPFIPSLPSVLSPLSGNVGLPPPGAIPGVAPWPVNVSLHPGHSTMVPSGPPLCTSPHHLYPPAPRSPNLMHPVPFLYPPYSQPQVVPSTTFPMNTNIFRPNHYGWQPYMGPAPSEFVPMSSWSSSHTVDFIPTPHVVDPISQSLADKHIQSDAAVVSIGPSLDSNAVVAKEEMETPAVVASGNLISNKHDDQDKQLKDAIRIELSPDMQEDNRHDEGSFRIYVKGKSRRKQTLRIPISLLNKTYGSRSFKLVYNKVVRENDIFRPSSVSFAEVVSTGN

SEQ ID NO: 43946 - protein, 116 aa, Sorghum bicolor
  Clone ID: SORBI-28MAY03-C67535_1.pep
MLVSKIKPCMCVAGLVRPACLRIAPPPRPRGGDGARSSPPTSLSPRQSSGSGSSSGDEEGAGPSDGAGSESDGDGESSEDRACAEAAILLTKLALARQTADNVSVVVVNLRRRRRS

SEQ ID NO: 43947 - protein, 101 aa, Sorghum bicolor
  Clone ID: SORBI-28MAY03-C765_2.pep
MAEEKHHHHLFHHRKEEESSGEVDYEKKEKHHKHLEQLGELGTIAAGAYALHEKHKAKKDPENEHGHRIKEEVAAVAAVGSAGFAFHEHHEKKDAKKHGHN

SEQ ID NO: 43948 - protein, 101 aa, Sorghum bicolor; identical to SEQ ID NO: 43947
  Clone ID: SORBI-28MAY03-C765_1.pep

SEQ ID NO: 43949 - protein, 97 aa, Sorghum bicolor
  Clone ID: LIB3480-058-Q6-K1-B4.pep
VVAIDRDRHSQLAVKWVMDHLLSGASQIVLLHVAAHYATNHGFAMAETTQGALEAEMKEIFVPYRGFFNRNNGLVEVSEVVLEEADVSKAILGYISA

SEQ ID NO: 43950 - protein, 260 aa, Sorghum bicolor
  Clone ID: SORBI-28MAY03-C8025_1.pep
RRRSPLFPPPSAAALRLVLHDRRRDNAFTSSLDATEAPASSATAASCGLATADGHADATAAPGRRRLSCPRRAPTAPPRARDDGALASTADMTPRSHLRRAVASRDAALAASSFDHGWPRGRHSTAEPPRCPATPSTAAPSFDCDLAQDALRSPDHRARRRAPTRPRPRHGHRVKLLSLSSPSQTPVSSPRPKFSPSCVHHAEIGLRAVFYTLQGGCALGAPLPHGWTTLLPSANPWTRCSKPQPLPTSRSKPQLVSGRS

SEQ ID NO: 43951 - protein, 168 aa, Sorghum bicolor
  Clone ID: SORBI-28MAY03-C8161_1.pep
KSSGPHFSSPPTSRGFRGMNCRSFHSGGCVGVLPSPPPPPARTYSSPEPKTPKQQPRHGGKRSRPISISPSTSPPTHSELWAGPAFSNSPPPSSLPIPKFSLRQKRSISLELPPVERSDDVEVRQHAKSAPSSPVEGSGYDFFNDDAIASAIATENLRRILQLDITDH

SEQ ID NO: 43952 - protein, 313 aa, Sorghum bicolor
  Clone ID: SORBI-28MAY03-C8182_1.pep
AVVKCLELALKKQKPLLIVAEDVESEALGTLIINKLRAGIKVCAVKAPGFGENRKANLQDLAILTGGEVITEELGMNLENVEPHMLGTCKNFRVSKDDTVILDGSGDKKSIEERAEQMRSAIENSTSDYDKEKLQERLAKLSGGVAVLKIGGASEAEVGEKKDRVTDALNATKAAVEEGIVPGGGVALLYASKELDKLQTANFDQKIGVQIIQNALKTPVHTIASNAGVEGAVVVGKLLEQENTDLGYDAAKGEYVDMVKAGIIDPLKVIRTALVDAASVSSLMTTTESIIVEIPKEEAPAPAMGGGMGGMDY

SEQ ID NO: 43953 - protein, 234 aa, Sorghum bicolor
  Clone ID: SORBI-28MAY03-C68623_1.pep
VLRYGAFDYRSVLDFLKAARERGIAFVMAPWELDTPKSECDRGVAPGLAVCKFDMLRDSSPAVVAPRLRDSREDEFEAGSPDDCHTRVLAPRACAFDVKQLIEVCTRMDNLHSAEHGDNHLQRQVARYLKVGGAFPGNLPFVPISGFHGDNMVDKTDKMPWYKGPTLLEALDDIKPPKRPMDKPLRVPLQDVYKIGGIGTVPVGRVETGVLKPGMVVTFAPVNVTTEVKSVEMH

SEQ ID NO: 43954 - protein, 256 aa, Sorghum bicolor
  Clone ID: SORBI-28MAY03-C6877_1.pep
MDDYAREMMELKTLVTRTLEKKGVLAKIRAELRASVFEAIEEEDRVVENDDGVNPALLGSCNDRAKQLHASPSGRLLTALVCEYLEWAQLSHTMKVYLPECNLPKDFWKNELKDFSNKSGAEGSRSAESGPMLLDVLEGYLKYENLSQTRMGGRRMMSSESDTSLNADHRSMRRPPSASVGSLPPMGRPISSSQASDRRGGPSASNTRKDEYNWRYDADDISEEVLRASAALENVQLDRKSRNLPTSWRHSGDGTE

SEQ ID NO: 43955 - protein, 278 aa, Sorghum bicolor
  Clone ID: SORBI-28MAY03-C6930_1.pep
MMPLSQPDFSPSQFTASQNAAADSTTPSKMRGASSTMPLTVKQVVDAQQSGTGEKGAPFVVDGVEMANIRLVGMVNGKVERTTDVTFTLDDGTGRLDFIRWVNDASDSSETAAVQNGMYVAVIGSLKGLQERKRATAFSIRPITDFNEVTLHFIQCVRMHIENTKLKAGSPARTSSSMGVSVSNGFSESSTPTSLKSNPAPLTGGGSGSDTDLNKQVLHFFSEPANLESEHGVHVDEVYKQFKQLPKDKIKEAIAFHVDAGHLYSTIDDFHFKSALTD

SEQ ID NO: 43956 - protein, 168 aa, Sorghum bicolor
  Clone ID: SORBI-28MAY03-C6951_1.pep
MAPLVDESWRSKFERVRDDGFSRLRGLWVLHEIIMPIVTKLLTALCVPYVLARGIFPVLGYPLIVNSAVYRFAWLGCLIFSALFFCGKRFHVWFTNLHNSIRDDRYLIGRRLHNFGEDSHSPEPSESGATIGSDDQDRALVLRDQEEDVGLRMRRNNMRANQQPRLAL

SEQ ID NO: 43957 - protein, 176 aa, Sorghum bicolor
  Clone ID: SORBI-28MAY03-C69555_1.pep
MDSLVKCGNGYGGYGYGYGYGYGNSKPQMNYNRQNTESVTTVVTEINRMTVNDKPSCYGGGGDVQKQACKVEAFEEHDEAYNGAVAVQKHSFKEEKEERYGAAAVKKHDEYKEEKYGEVIDAEYGAHYGGGAAALKKQQGYGYKQEAYGETEGAAGVRRRPLRRRRDEARLQLQAG

SEQ ID NO: 43958 - protein, 123 aa, Sorghum bicolor
  unsure (1)..(123): unsure at all Xaa locations
  Clone ID: SORBI-28MAY03-C6921_2.pep
VVVVVVVVAGIAALAGLVARRGCGGAAIVRGMSFGGSSSVASGAKRPFEYGRTHVVRPKGTHKATIVWLHGLGDNGASWSQLLETXSLPNIKWICPTAPSRPVSVFGGFPSTTWFDVADLSED

SEQ ID NO: 43959 - protein, 326 aa, Sorghum bicolor
  Clone ID: SORBI-28MAY03-C6921_1.pep
TRNRRTNPHEQKDPDGHWNELPCRLLASAGAPRRRPPPPPPPVPCKTTSSPAALAGLVARRGCGGAAIVRGMSFGGSSSVASGAKRPFEYGRTHVVRPKGTHKATIVWLHGLGDNGASWSQLLETLPLPNIKWICPTAPSRPVSVFGGFPSTAWFDVADLSEDAPDDIEGMDASAAHVANLLSTEPADIKLGVGGFSMGAATALYSATCFAHGKYGNGNPYPVNLSLAVGLSGWLPCARTLKNRIEASPEAAQKASSIPLLLCHGKADDVVLYKHGERSADALKANGFSNVLFKSYNSLEHYTVPEEMDEVCKWLTANLALGTKSS

SEQ ID NO: 43960 - protein, 269 aa, Sorghum bicolor
  Clone ID: SORBI-28MAY03-C89763_1.pep
MRKRERENPCGICGHYHKYEEGEVCGVCGHRLKPSDGEGAPSSHESAFPTEVLKEFLFLGSYDNASRSEVLRTLSISHILNTVPDCHNLYKNSFTYHSLQRDRPLDFDEANQYLEKCERDKSRVLVHCMTGKNRSAAIVAAFLMKSRGWRLAQSFQWVKDRRPQVQLTDASQNELLEYELKLFGPSAQPLVPTESFASLGFGYEKPAGDIQAPMFNQMTMPSIFERVNPNDHPTNFTFGAERIAEVNPHDNNSDGGVNPTKTENLMDGS

SEQ ID NO: 43961 - protein, 164 aa, Sorghum bicolor
  Clone ID: SORBI-28MAY03-C8916_1.pep
LRSTSTPSPSALFARVLQAWHYVLYAGYRRGHYLLPGPYLGDLRYSKPASVIYEFISFGLGSPPTCAEPASSFSCLGRCVRSKLDTKGHHLEPRCIIDYISFSLVDKKYLFAATTAVPAPRSGSHSSPLHDFHVQVADLLPGLPCRASNYPCTVVADVPKCQLM

SEQ ID NO: 43962 - protein, 77 aa, Sorghum bicolor
  Clone ID: LIB3476-055-P1-K1-E8.pep
CIWVLGGDPWCPALNLRIIQNMYMCSQTIIKWVVFSNLKLLRHGYKLQVANNGDHPVCCKVTDSAFVNILTLIRSAN

SEQ ID NO: 43963 - protein, 306 aa, Sorghum bicolor
  Clone ID: SORBI-28MAY03-C898_1.pep
AAGRIAPYFVERFQFDKNCLVIQWSGDNPNSLAGLTLNTPGDLAISLGTSDTVFGITAEAKPSIEGHVFPNPVEPDGYMVMLCYKNGSLTREDVRNRCADKSWDVFNNYLEKTPPLNGGKLGFYYKDHEILPPLPVGFHRYAVENLNDVTSDTLLEREVEEFDPPSEVRAIIEGQMLSMRGHAERFGMPNPPKRIIATGGASSNESILKSIAQIFGCPVFTVQRPDSASLGAALRAAHGWLCNAQGSFVPISCLYQGNLEKTSLGSKLAVPAGDKEEDRELLQKYTLLMRKRMEIERRLVEKIGRS

SEQ ID NO: 43964 - protein, 117 aa, Sorghum bicolor
  Clone ID: SORBI-28MAY03-C893_2.pep
MEKCNSNARFAPLSDTPFALRGALGSTSSNLEQTRGYASSPLAAQRPKISAPGSRPLHTSRPLSSPVANRPLSPHLPLKKPQFSATFSISHRIFGVALGVAIISVPLATKFSLMFGV

SEQ ID NO: 43965 - protein, 117 aa, Sorghum bicolor
  Clone ID: SORBI-28MAY03-C893_1.pep
MEKYNSNTQFAPLRETPFALRGVLGSSSSYPEQARGYTSSPLAALPPKMSTPGNRLLHTSRPLSSPVANRPLSPHLPLKKPQFSATFSISHRIFGVALGVAIISVPLATKFSLMFGV

SEQ ID NO: 43966 - protein, 166 aa, Sorghum bicolor
  Clone ID: SORBI-28MAY03-C9111_1.pep
KDPNRPFPSGQNETPLVKWRIQGMDESSLPLSVNCWPSVSGNETYVNIEYEASEMFDLHNVVISIPLPALREPPSVRQIDGEWKLDSRNSVLEWSILLIDQSNRSGSMEFVVPPADPSSFFPISVGFSASSTFSDLKVTGILPLKEGNPPKFSQRARLLTANYQVV

SEQ ID NO: 43967 - protein, 136 aa, Sorghum bicolor
  Clone ID: SORBI-28MAY03-C30852_1.pep
REKPESMNAFALISRSQGFNLGNLFEKEMMGMVKRETSFTSQCTAQEIMTKIEDACGPLGFNVRKQNYKMKLKGDKSGRKGHLSVATEVFEVAPSLHMVELRKTGGDTLEFHNFYKNFSTELKDIVWKAESDATKK

SEQ ID NO: 43968 - protein, 243 aa, Sorghum bicolor
  Clone ID: SORBI-28MAY03-C31848_1.pep
MVLEQEQEEVLPGAVHGHRLSTVVPSSVTGEVDYALADADLAFKLHYLRGVYYYPPGDVARGLATKVLKDPMFPWLDDYFPVAGRVRRAEQQEPEAAAAGAPRRPYIKCNDCGVRIVEAKCDRDMDDWLRDDAPDRLRQLCYDKVLGPELFFSPLLYVQITNFKCGGLALGFSWAHLIGDVPSAVTCFNKWAQILSGKKPEATVLTPPNKPLHGQPPAGCLLPLLARDGDAAVAFSMVPRQCS

SEQ ID NO: 43969 - protein, 407 aa, Sorghum bicolor
  unsure (1)..(407): unsure at all Xaa locations
  Clone ID: SORBI-28MAY03-C32289_1.pep
TRDDSYYAAPKAHPVSSEVRRIRIDLEQAQALICKLDSEKGIENSVLSSSDHEKSDRDKSHGSMGPIVIIRGSSTVKGLEGAELLDTLVTYLWRIHGVDYYGMSETNEPKGLRHVKADARTYNGASSNGAEWENKLDSFWQDRIQGQDPLEMLKAKEKIDGAATEVLDPYVRKIRDEKYGWKXXGCGAKGCTKLFHAAEFVQKHLKLKHAXLVVDLTSKAREDIYFENYMNDPKAPGGTPIMQQPAPRGKGRQRPPIESRLRDERGNHRFDRNVDSPTHDGSSENPDDPIYDSFGDPIMHGAFPPDIPAPPVLMPVPGAGPLGPFIPAPPEVAMHMLRDQGAPPPFEPTGGPHPRKAGRGVGPQIRGPSPIFTAPPPHQMHDPRRIRSYQDLDAPEDEVTVMDYRSL

SEQ ID NO: 43970 - protein, 363 aa, Sorghum bicolor
  Clone ID: SORBI-28MAY03-C33010_1.pep
QRLGRAARVRDPPTKPRAPHTNNHPALPVNANAAGVGARGGGALDDAIQSPRGPRLFSPPAPRLLVLLLYRRPLSPPPRAAPSSSPAYSTRQGTHTFMEVVQEVLKHGSVDGVRAVIRADKKSYSLVQLIAASFDVHNILCSKNMTHNGIQDSSSEGINGTGFLHGARVGIVAKPSPEFVAGVFGTWLSGGVAVPLALSYPEPELLHVMNDSDISMVLSTKEHHEVMENLSIKRSAYCSLLPPITSISSEINPQEPSSNEATSSVSTLITHINSSKKIKGDDPALILYTSGTTGKPKGVVHTHKGILSQVQILSEAWGYRSEDQFLHCLPLHHVHGLFNALFAPLYSGSVVEFIPKFSVSGIW

SEQ ID NO: 43971 - protein, 326 aa, Sorghum bicolor
  unsure (1)..(326): unsure at all Xaa locations
  Clone ID: SORBI-28MAY03-C33030_1.pep
TRPNWLILAISPANQGIATSDAFKLARDVDPSGVRTFGVSSKLDLMDKGSNALGVLEGRAVSLHHPWVGIVNRPHADIISNVDMIIARRKEHEFLHSSPEHSHLHSRLGASSLDEFPXQPQAPAGGAPIVPKPPVMISIGETLELKRFPSLQTELAAACYKALQRLRDDGRKTTLRLVDMESAYLTVEFFRKLPQEVDKTGTANPRTANPPAPGNPRTANPPPPSDDRYTDAHFRRIASNVSSYIGMVSETLKNTIPKSVVHCQVREAKRSLLNDFYTQVGGKDAKQLAVLLDEDPALMERRLQCFKRLELYKSARDEIDSVSWTR

SEQ ID NO: 43972 - protein, 338 aa, Sorghum bicolor
  Clone ID: SORBI-28MAY03-C9321_1.pep
PAGFPSKKEWDGATLRNNETLCNCIFPLRGRSVPLGQYTRCVDQYWDQLNSLGRADGSRLRLLTYDIVLMLARFATGASFSTDCKGGGRESNSRFLPFMVQMASYLADGSANQQRHVMAKAVTTYLSGSASTLDSPIRVSASVSGSRGGSGSSEETVQFMMVYSLLSESYESWLQHRPVFLQRGIYHAYMQHKHGRSTLKLSSDSSSLAVRSDEGSSSDTSDEKLFAIVQPMLVYTGLIEQLQQFFKKGKSSSMSKMGEEDESAGSLEKWEIQMKEKLDNMKEMVGLSKNLLSWLEDMTSSDDMQEAFDVMGALTDVFSSGYATCEDFVRAAMHAGRS

SEQ ID NO: 43973 - protein, 299 aa, Sorghum bicolor
  unsure (1)..(299): unsure at all Xaa locations
  Clone ID: SORBI-28MAY03-C9406_1.pep
MDRKDVGILAMDIYFPPSCVQQEALEAHDGASKGKYTIGLGQDCMAFCSEVEDVISMSLTVVNSLLKKYKIDPKLIGRLEVGSETVIDKSKSIKTWLMQIFEESGNTDIEGVDSSNACYGGTAALLNCVNWVESNSWDGRYGLVVCTDSAVYAEGPARPTGGAAAIAMLIGPNAPISFESKNRASHMAHVYDFYKPDLASEYPVVDGKLSQTCYLMALDSCYRQFCNKYEKIAGKQFSISDAEYFVFHSPYNKLVQKSFARLYYNDFMRNCSSCDDDAKEKXQSFSNLTGEESYQSRDL

SEQ ID NO: 43974 - protein, 270 aa, Sorghum bicolor
  unsure (1)..(270): unsure at all Xaa locations
  Clone ID: SORBI-28MAY03-C9423_1.pep
MNSSRSLLSSPLFASSSPNFRSSTSVSVSSSPSPSRTTGIFPMIHDNTGRASTACHYSPSLVAEEQLHGSKDTLTLKGEKALLELLLGMALDQHVDGGKLTAEDTDFETYLKEATSRVLYQPVFTEDDSTSENSSASTAKTPGSLDLGKPTKEVELPAQESGTSDTQLDVPLPHRVDPNHSYEGLLSNDQVFIRSTRVLERRSKKRNANRALSNDVPCSGVNRKEKSKKFGRVLDPDEPFXVVLRDRETTEFLTSKEEKPDVSQIQNLMK

SEQ ID NO: 43975 - protein, 127 aa, Sorghum bicolor
  unsure (1)..(127): unsure at all Xaa locations
  Clone ID: SORBI-28MAY03-C9345_2.pep
MKGGGAMKPSSMFYVHEADVVQIHHFLEECSLCAKSLSGDIFMYRGDTPFCXEECRQQQIEVDRAKHRRKKRAAAHALTARSREHRHHHHHHHHHHHQQPQPRKAGMDANHHPWVDAGFARAPALRV

SEQ ID NO: 43976 - protein, 108 aa, Sorghum bicolor
  unsure (1)..(108): unsure at all Xaa locations
  Clone ID: SORBI-28MAY03-C9345_1.pep
MKGGGAMKPSSMFYVHEADVVQIHHFLEECSLCAKSLSGDIFIGDTPFCSEECMQQQIEVDRAKHXRHHHHHHHHHHHQQPQPRKAGMDANHHPWVDAGFARAPALRV

SEQ ID NO: 43977 - protein, 357 aa, Sorghum bicolor
  Clone ID: SORBI-28MAY03-C9440_1.pep
MAAAAEIGGFTAARVAAAAALRPAAHPAPAAAAPPQPRRAVAAQSLRTTTAEVLTADLAGTTNGAVHAQMNSEATSEITSQAVISRRKTKIVCTIGPSTNTREMIWKLAETGMNVARLNMSHGDHQSHQKVIDLVKEYNTQNTDGNVIAIMLDTKGPEVRSGDVPEPIMLKEGQEFNFTIKRGVSTEDTVSVNYDDFINDVEAGDILLVDGGMMSLAVKSKTADTVKCEVVDGGELKSRRHLNVRGKSATLPSITEKDWEDIKFGVENGVDFYAVPFVKDAKVIHELKDYLKGANADIHVIPKIESADSIPNLQSIIAASDGAMVARGDLGAELPIEDVPLLQAEIGQTCRSMEKPV

SEQ ID NO: 43978 - protein, 208 aa, Sorghum bicolor
  Clone ID: SORBI-28MAY03-C8010_1.pep
MERKVVAVCAVVGFLGVLSAALGFAAEATRVKVSDVQISSTPGECIYPRTPALALGLISAVSLMLAQSIINTVAGCICCKRHPVPSDTNWSVALISFIISWCTFIIAFLLLLTGAALNDQRGEENMYFGSFCYVVKPGVFSGGAVLALASVALAIVYYVALSSSKGPPPTFATPQNHGIAMGQPVIPQQSSEPVFVHEDTYNRRQQVP

SEQ ID NO: 43979 - protein, 194 aa, Sorghum bicolor
  Clone ID: SORBI-28MAY03-C8654_1.pep
MANAASGMAVDDDCKRKFLELKAKRTYRFVVFKIEEKQKQVVVDKLGEPNLTYDDFAATLPADECRYCVYDFDFVTEEGCQKSKIFFIAWSPDTAKIRSKMLYASSKERFKRELDGIQVELQATDPTEMGTRAIRGRAHSVAGPAAAAVSALSLWRPIWQPKPKMGLQHNTIPIASNRVPLQKTYFGFWVSGEA

SEQ ID NO: 43980 - protein, 75 aa, Sorghum bicolor
  Clone ID: SORBI-28MAY03-C8693_1.pep
MARGDSCLARVGAGVAIGGAVGGAVGACYGTFEAFRYKIPGLLKIRYIGQTTVGSAAIFGLFLGAGSLIHCGKSY

SEQ ID NO: 43981 - protein, 144 aa, Sorghum bicolor
  Clone ID: SORBI-28MAY03-C8560_1.pep
ARGPPPPGQNQMPPQHVQGNMPPPPPHAGGGQPNYQAHRRHPQAGHEPGGAPHYQQGGAPGYQGGPPGYQGGNQGYQGNPGPAYQGGNPGYQGGPPGYPGGNPPPPPPYQGGNPNAPPYPGGGNPGYPGGSPGYQGQGGNSNFQ

SEQ ID NO: 43982 - protein, 82 aa, Sorghum bicolor
  Clone ID: LIB3476-051-P1-K1-A6.pep
VHTATVHENQIATRVRFMLLHTISPRRLLWNRGAYLYLGVVMFIGSSSCLLDLGSLGCHQGSQDCHHQGMAGIGVPPLYREG

SEQ ID NO: 43983 - protein, 95 aa, Sorghum bicolor
  unsure (1)..(95): unsure at all Xaa locations
  Clone ID: SORBI-28MAY03-C8741_1.pep
MLFFSYFKELVGKEVTVELKNDLAISGTLHSVDQYLNIKLENTRVVAXDKYPHMLSVRNCFIRGSVGRYEPDRPRLTSAHISPAASLGPARDLIL

SEQ ID NO: 43984 - protein, 348 aa, Sorghum bicolor
  unsure (1)..(348): unsure at all Xaa locations
  Clone ID: SORBI-28MAY03-C9885_1.pep
MASSSTYLMLASARAPLAPLLRPTLMALVARTAAASITSGARASVPLFVNPAAFRPGVRRCGWAHICRDSSLQGPPGTDSPAQKQEDMKKSEAVSEAAIRIAGGSGRRFSDWSTSVLIFGIWGGLLYYVFLLAPNQTPYQDTYLLQKLLNLKGNDGFRMNDVLVSLWYIMGLWPLVYTMLLLPTGRSSKSKIPVWPFLVLSCIGGAYALIPYFVLWKPPPPPIDEDEIGQWPLKFLESKLTAGVVFALGIGLIIYAGKAGGDDWKEFIRYFRSSKFIHATCLDFTLLSAFSPFWVYNDMTARRWKNGSWLLPLALIPFVGPYXYILLLRPSLSSLLEASASPSDEFKK

SEQ ID NO: 43985 - protein, 367 aa, Sorghum bicolor
  Clone ID: SORBI-28MAY03-C99691_1.pep
MEGDEKSAGGAPAYWGLGARPCDACGAEAARLYCRADAAFLCAGCDARAHGAGSRHARVWLCEVCEHAPAAVTCRADAAALCASCDADIHSANPLARRHERLPVAPFFGALADAPKPFASSAAAVPPKATAGADDDGSSEAEAASWLLPEPDHGHKEEGATTEVFFADSDPYLDLDFARSMDDIKTIGVQGGPPELDLNGAKLFYSDHSMNHSVFARSMDDIKTIGVQGGPPELDLNGAKLFYSDHSMNHSVSSSEAAVVPDAAAGAAPVVAVVSRGLEREARLMRYREKRKSRRFEKTIRYASRKAYAETRPRIKGRFAKRTPGAGEDPLEEHEEMYSSAAAAVAALMAPGGADADYGVDGVVPTY

SEQ ID NO: 43986 - protein, 86 aa, Sorghum bicolor
  Clone ID: SORBI-28MAY03-C99749_1.pep
KSIASHAHKLNWMTSSIPFIFLCFLDLATYSGLFTFLVCRGGQDGTSARQGEGNVQATLSARNRSTEVHTVMKCLGTETHKYYSSS

SEQ ID NO: 43987 - protein, 100 aa, Sorghum bicolor
  Clone ID: SORBI-28MAY03-C101331_1.pep
MATRRAVVRVTALPAWAAVARSMEGVGGGGARVSRYFSDKASGRVLSEEERAAENVYIQKMEREKLEKLRRKEDKAKAEAAKRAAAAKGDKKKGEEAHPS

SEQ ID NO: 43988 - protein, 225 aa, Sorghum bicolor
  Clone ID: SORBI-28MAY03-C10200_1.pep
PAADVSPADQAPATAADRVYYIYQTLYDCEEVLATYREKGIAVPVPSEEQNLIDKHHSEFLKYMSNDLKTTDVLDRCFVELLKTINSSLNDLKKLQQKIEQQKKKQQQQKKQQQKQQQLQKQPEDYIQALIALETELKNKLSILGLMPSSSLAEVLKQLKDKALKRAGLTEENLQEQIEQRNVARKNKQFEVSDGIRKNLATKGIALMDEPSGTVWRPCEPERSE

SEQ ID NO: 43989 - protein, 148 aa, Sorghum bicolor
  Clone ID: SORBI-28MAY03-C11443_1.pep
DAYHMTEPHPEGRGITLCIEKALADAGVAREEINYVNAHATSTQAGDLKEYEAIVRCFRQNPQLRVNSTKSMTGHLIGAAGGIEAVASVQAIRTGWVHPNLNLENPEDTVDVGVLVGSQKERCEVKVALSNSFGFGGHNSSILFAPFK

SEQ ID NO: 43990 - protein, 242 aa, Sorghum bicolor
  unsure (1)..(242): unsure at all Xaa locations
  Clone ID: SORBI-28MAY03-C9122_1.pep
SPTCTDYVISLDKVDMSKGSSTYIGKLRSNFLGTKFTVYDAHPPYDGAVVSKSRSARVVGLNQVSPRVPAGNYPVSHISYELNVLGSRGPRRMNCVMDSIPASAVEEGGKAPTQTEFPLSSLDSFPSIPFFRSKSARIDSSTSQSSRSDRLVLKNKSPRWHEQLQXCWCLNFRGRVTVASVKNFQLVASDDNGPGNQDNNKVILQFGKIGKDLFTMDYRYPISAFQAFAICLSSFDTKIACE

SEQ ID NO: 43991 - protein, 326 aa, Sorghum bicolor
  Clone ID: SORBI-28MAY03-C913_1.pep
ARGAIIMVVSVTASTTSGKPLSEDNLEKTTEACDRALTLDAAKKKVLDFVESRMGYLAPNLSAIVGSAVASKLMGTAGGLGALAKMPACNVQLLGAKRKNLAGFSTASSQFRVGYLEQTEVFQSTPPALRTRACRLIAAKSTLAARIDSIRGDPTGKAGRNLLEEIRKKIEKWQEPPPAKLPKPLPVPDSEPKKKRGGRRLRKMKERYAQTDMMKLANRMQFGIPEESSLGDGLGEGYGMLGQAGSGKLRVSAGQSKLAAKVAKKFKEKSYGSSGATSGLTSSLAFTPVQGIELSNPQAQGNLLGGGTQSTYFSETGTFSKIRRTQ

SEQ ID NO: 43992 - protein, 171 aa, Sorghum bicolor
  Clone ID: SORBI-28MAY03-C9166_1.pep
PVFLHKDWIMEQWEKSYYITAIAGSTNGSSLVVMSKGTPYTQQSYKVSESFPYKWINKKWKEGFHVTSMATAGNRWGVVMSRNSGFSTQVVELDFLYPSEGIHRRWESGYRITSTAATNDQAAFILSMPKRKPMDETQETLRTSAFPSAHVKEKWAKNLYIASICYGRTVC

SEQ ID NO: 43993 - protein, 210 aa, Sorghum bicolor
  Clone ID: SORBI-28MAY03-C9222_1.pep
MGDWVIGALINIVGSVAINFGTNLLKLGHDQREKLSSINNSEGNEKFVPTCVMHFQTWRIGILFFAAGNCLNFMSFAYAAQSLLAALGSIQFVSNIAFAYFVLNKTISVKVMVATTFIVFGNIFLVSFGNHQSPVYTPEQLIAKYSNLVFVLYCMSLVFVVAFNHYLYRKTIISNSSKDAGTHWRTMLPFSYAVVSGAIGSCSVLFAKSL

SEQ ID NO: 43994 - protein, 196 aa, Sorghum bicolor
  Clone ID: SORBI-28MAY03-C92980_1.pep
MARVEALSGLSSIPLEYVRPADERAGLGDAFDLARTHANDHTAPRIPVVDISPFLDASSQQQRDACVEAVRAAAVDWGVMHIAGHGIPAELMDRLRAAGAAFFALPIQEKEAYANDPAAGRLQGYGSRLATNASGQREWEDYLFHLLQPDGLADHALWPAHPPDYVPATRDFGRRTRELTTTLLAILSMGLLGPER

SEQ ID NO: 43995 - protein, 82 aa, Sorghum bicolor
  Clone ID: SORBI-28MAY03-C8814_1.pep
MGAVASSAAGGGRGRGGDGTALGDLPENCVAEVLLRLDPLEICRMARLSRTFRGAASGDGVWESKLPRNYARLLAIAAAGDG

SEQ ID NO: 43996 - protein, 504 aa, Sorghum bicolor
  unsure (1)..(504): unsure at all Xaa locations
  Clone ID: SORBI-28MAY03-C108_1.pep
MAPPQTLPRLVLFIGGAWREPCLKLRVEVVNPATEATIGDIPAGTAEDVEIPVAAVXGRVLRGRRQPLVACLWGRASQLSXAIAAKIKDRKSESWALLETLDSGKPLDEASADMDDVAACFEYYADLAEALDGKQRSPISLPMENFKSYVLKEPLGVVGLITPWNYPLLMATWKVAPALAAGCTAVLKPSELASVSCLELGAICMEIGLPPGVFNVITGLGLKLVLHYPHIPCGIRLLLLGSTETGKRIMTSAAQMVKPVSLELGGKSPLIVFDDIRDIDKAVEWTMFGIFANAGQVCSATSRLLLHEKIAKKFLDRLVHGAKNIKVSDPLEEGGRLGSVVSEGQYEKIKKFISTARSEGATILYGGARPQHLKRGFFLEPTIITDVSTSMQIWREEVFGPVICVKEFRRESEAVELANDTQYGLAGAVISSDQERCRAISKALQSAIDNCSQPCFVQAPWGGNKRMFGRELGEWGLDNYMTVKQVTKYCSDEPWGWYQPPSKL

SEQ ID NO: 43997 - protein, 195 aa, Sorghum bicolor
  Clone ID: SORBI-28MAY03-C11185_1.pep
MGSRKRWLPVALLLLAASALWPPVAAAAAAGGGGGEAEHAVQQHSERISGSAGDVLEDNPVGRLKVFIYDLPRKYNKKMVTKDPRCLSHMFAAEIFMHRFLLSSAVRTLNPKEADWFYTPVYTTCDLTNAGLPLPFKSPRVMRSAIQYISNKWPFWNRTDGADHFFVVPHDFAACFHYQEEKAIERGILPLLRRA

SEQ ID NO: 43998 - protein, 832 aa, Sorghum bicolor
  Clone ID: SORBI-28MAY03-C112_1.pep
MLCLVSPSSSPTPLPPPRRSRSPADRAAPPGIAGGSNVRLSVLSVQCEARRSGPRKVKSKFATAAIVQEDKTMATAKGNVDHLPIYDLDPKLVKFKDHFSYRMKKFLDQKGSIEENEGSLEEFSKGYLKFGINTSEDGTVYREWAPAAQEAELIGDFNEWNGANHKMEKDKFGVWSIKIDHVKGKPAIPHNSKVKFRFLHGGVWVDRIPAWIRYATADASKFGAPYDGVHWDPPASERYTFKHPRPSKPAAPRIYEAHVGMSGEKPAVSTYREFADNVLPRIRANNYNTVQLMAVMEHSYYASFGYHVTNFFAVSSRSGTPEDLKYLVDKAHSLGLRVLMDVVHSHASNNVTDGLNGYDVGQSTQESYFHMGDRGYHKLWDSRLFNYANWEVLRFLLSNLRYWLDEFMFDGFRFDGVTSMLYHHHGINVGFTGNYQEYFSLDTDVDAVVYMMLANHLMHKLLPEATVVAEDVSGMPVLCRSVDEGGVGFDYRLAMAIPDRWIDYLKNKDDSEWSMGEIAHTLTNRRYTEKCIAYAESHDQSIVGDKTIAFLLMDKEMYTGMSDLQPASPTIDRGIALQKMIHFITMALGGDGYLNFMGNEFGHPEWIDFPREGNNWSYDKCRRQWSLVDTDHLRYKYMNAFDQAMNALDERFSFLLSSKQIVSDMNDEKKVIVFERGDLVFVFNFHPKKTYDGYKVGCDLPGKYRVALDSDAFVFGGHGRVGHDVDHFTSPEGIPGVPETNFNNRPNSFKVLSPPRTCVAYYRVDEEAERLQAKAETTGSRKTSPDIIDVDATPVKTSTATKEDKEATSGGKEDASKKGWKFARQSSNKNTK

SEQ ID NO: 43999 - protein, 354 aa, Sorghum bicolor
  Clone ID: SORBI-28MAY03-C11331_1.pep
MEAATASNKIVNRDEITDAFTDSAQIPEKYIRTDEVRAGVVVGEDDDCYCELPVVDMARLLDPELSASETLKLGSACRNWGFFQLTNHGVDEGVIQHMKDNTADFFGLPLDSKNAVAVRGDGFEGYGHHYSRLSKLDWAESVILITQPVQDRNMELWPTNPPTFRHALDRYSAETTSLIRRLLSYMAADLGVGEAALLDAFSGKRQSMAIHHYPACRHPDKVMGNTAHTDGLGLTVLLHVDDTPGLQMLRGGRWFPVRPLPGALVVNVGDILHIVTNGAYKSVQHRVLVNAERGRTTAVVFQDASVGGMVTPLPELLLKAGEAPRYRSIPRFEYLKVRFSALAKREGFLESLKL

SEQ ID NO: 44000 - protein, 474 aa, Sorghum bicolor
  unsure (1)..(474): unsure at all Xaa locations
  Clone ID: SORBI-28MAY03-C1143_1.pep
MTPTVLMEFGQHRPIKRGYEEMAFRGVAAATSRGYTETVGESEVAAGSPVRVDSEDSSAPKRKCISLNSDGFDVKREIFVPSKMSSSERRYLRKRFRAELDSVRDLLKKPEFAAPVPLSRAPALSSSAAPRAKKPQKSQRGVARGIRGAKGRFLPTKPRPEPTTVLSEAAAXFKQCEAILNKLMTQKYSHIFNVPVDVDKLQIPDYFDIVKTPMDLGTVQKKLESGSYTSPSDFAADVRLTFNNAMAYNPKGHAVHDMAIQLNKMFESRWRPIEKKLASAATEKHVEVDRADSKRRKTPPVDRSDVSTEGVRQTEPEKPKMTAEEREAFGNSLASISDELPPHIFELLQQCIDSNTDMPGDGEIEIDIQAVSDDMLFELKKHVDKYLQEREQSQQVKSEPSENEAVNVSGLSHSSTNPCKGGEPIEEDVDICGNASPIMLDKDAQIRSSKCGSPSSSSSDSESSSSDSDSGSDF

SEQ ID NO: 44001 - protein, 281 aa, Sorghum bicolor
  Clone ID: SORBI-28MAY03-C9532_1.pep
VLGLGFLKLDARARKDTQKIDHTVKERAARLNHFARAFKERAQSDLKKAADKHWSDGALEADLRRADLVVKRRAMEDAFMALKFVQDIHDMMVNRLYEQLPKDGSSSRTNSTGFITLEKNGKTLELFPGEVSADQIYAIEEAYQSMASAFSEADGIDYTDPEELELLVATLIDLDAMDGKRSVSLIAECSSSPDVNTRKALANALATAPSMWTLGNAGMGALQRLAQDPNYAVARAASSAIDELKKQWELEEGDSLRFVMNQNLASEDTDGDDNSAADDDT

SEQ ID NO: 44002 - protein, 303 aa, Sorghum bicolor
  Clone ID: SORBI-28MAY03-C9661_1.pep
MDFCRHLLLAAVLVLVLELLLAGCASAASRGAGSFDPSRVVQLSWRPRAFLHKGFLSDAECDHLIVLAKDKLEKSMVADNESGKSVQSEVRTSSGMFLEKKQDEVVRGIEERIAAWTFLPPENGESIQILHYQNGEKYEPHYDYFHDKNNQALGGHRIATVLMYLSNVEKGGETIFPNAEGKLLQPKDDTWSDCARNGYAVKPVKGDALLFFSLHPDATTDSESLHGSCPVIEGQKWSATKWIHVRSFDLPVKQPGSSDGCEDDNVLCPQWAAVGECAKNPNYMVGTKEAPGFCRKSCKVCAE

SEQ ID NO: 44003 - protein, 172 aa, Sorghum bicolor
  Clone ID: SORBI-28MAY03-C9831_1.pep
MATAGKVIKCKAAVAWEASKPLSIEEVEVAPPQAMEVRVKILYTALCHTDVYFWEAKGQTPVFPRILGHEAGGIVESVGEGVTELAPGDHVLPVFTGECKECAHCKSEESNMCDLLRINVDRGVMIGDGKSRFTINGQPIFHFVGTSTFSEYTVIHVGCLAKINPEAPLDKV

SEQ ID NO: 44004 - protein, 297 aa, Sorghum bicolor
  Clone ID: SORBI-28MAY03-C9707_1.pep
ARAGGASARGNVRTLSDLGGGKGTAGSDENSEDDDEWAPPPEYFTARGTSGMVVRDRSKRKNNTDEVFKQAKRKGAKQGPFEARRRSSSRNFTGTGRLLTGETVERDAPQPPEEIVHNIYFWRNGFTVNDGPLRSFDDPANASFLKSIKDSVCPTELEPADGKSKVNVNLVRKEEEFTEPVKHAAPFEGERRTLMEPSDNNTSNAAASSSVPAPRTITVDDSLPSTSLQIRFADGSRLVARFNTSHTIGDVRSFIDATRPASSDYTLQAGFPPKPLEDATKTIEEAGIANSVIIQSV

SEQ ID NO: 44005 - protein, 387 aa, Sorghum bicolor
  Clone ID: SORBI-28MAY03-C9884_1.pep
ARGGCTYNREAEGYCPIVSYSGDLPKWAQYFPQGNKGGQSSLADYCTYYVAYSDGSCTDVNSARAPDRMLGEVRGSNSRCMASTLVPPGFVRGSMTQGNGCYQHRCTNNSLEVAVDGIWKSCPQSGGPVQFPGFNGELICPVYHELCTTVPVPVTGQCPKSCSFNGDCIDGTCHCFPGFHGHDCSTGSCPDKCTNHGICKANGICECQSGWTGIDCSTAVCDEQCSLHGGVCDNGKCEFRCSDYAGYTCQKGSAILPSLSMCHDVLVRDSEGQHCAPSELSILQQLETVVLVPNYNRLMPSGRTFLNFFNNANCAAAAKRLACWISIQRCDEDGDNRLRVCYSACELYNTACGAGLDCSDQTLFSKREEEEKGVPCTGYGEKKSFWL

SEQ ID NO: 44006 - protein, 101 aa, Sorghum bicolor
  unsure (1)..(101): unsure at all Xaa locations
  Clone ID: SORBI-28MAY03-C9692_1.pep
EGYSGSDLKNLCVTAAHRPIREILEKEKLERASAEAENRSLPMSHTSNDVLFLRFGNFIHAHXKAVAAEAEANXHKHEHVQYNDLYGGGGSRKKTTLSYFM

SEQ ID NO: 44007 - protein, 127 aa, Sorghum bicolor
  Clone ID: LIB3478-013-P1-K1-E5.pep
ATEAGANFINISMSSISSKWLGEGEKFVKAVFSLASKIAPSVIFVDEVDGMLGRRENPGEHEAMRKMKNEFMVNWDGLRTKEKERVLVLAATNRPFDLDEAVVRRLPRRLMVNLPDASNRRKILSVI

SEQ ID NO: 44008 - protein, 466 aa, Sorghum bicolor
  Clone ID: SORBI-28MAY03-C12169_1.pep
ARGTDVRLAAMAVVARARGGLEKLAVRGSHPTRGVTDQGLSAVARGSPNLGSLALWDVPLITDAGLAEIAAGCPSLERLDISRCPLITDKGLAAVAQGCPNLVSLTIEACSGVANEGLRAIGRSCVKLQAVNIKNCPLVGDQGISSLVCSATASLAKIRLQGLNITDASLAVIGYYGKAVTDLTLTRLATVGERGFWVMANAAGLQNLRCMSVTSCPGVTDLALASIAKFCPSLKQLCLRKCGHVSDAGLKAFTESAKVFENLQLEECNRVTLVGILAFLLNCSQKFRALSLVKCMGIKDIGSAPAQLPLCRSLRFLTIKDCPGFTDASLAVVGMICPQLEQVDLSGLGEVTDNGLLPLIQSSEAGLIKVDLSGCKNITDVAVSSLVKGHGKSLKKVSLEGCSKITDASLFTMSESCTELAELDLSNCMVSDHGVAILASARHLKLRVLSLSGCSKVTQKSVPFLG

SEQ ID NO: 44009 - protein, 128 aa, Sorghum bicolor
  Clone ID: SORBI-28MAY03-C11518_1.pep
NSSLSNAAPFSEGCLLRECSSEHSVIGVCSRVSYGCELKDCVMMGADIYETEEEASKLLLAGEVPVGIGGNTKIRNCIIDINARIGKNVVITNSKGIQEADHPEEGYYIKSGIVVILKNATIKDGSVI

SEQ ID NO: 44010 - protein, 128 aa, Sorghum bicolor
  unsure (1)..(128): unsure at all Xaa locations
  Clone ID: LIB3478-030-P1-K1-D12.pep
RKSYADANHVSAIILGGGTGSQLFPLTSTRATPAVPVGGCYRLIDIPMSNCFNSGINKIFVMTQFNSTSLNRHIHRTYLGGEINFADGSVQVLADTQMPEEPDGWXQGTADSVRKFIWVLEDYYNHKS

SEQ ID NO: 44011 - protein, 270 aa, Sorghum bicolor
  Clone ID: SORBI-28MAY03-C12332_1.pep
MTPASTFPLAAAVLPTHEASFSRCPPRRLPRVSCLAAPERRGGGNASNASRAPQQQPGWRAAVSAVLAAAVVAASMPAYADLNKFEAEQRGEFGIGSAAQFGSADLKKAVHVNENFRRANFTSADMRESDFSGSTFNGAYLEKAVAYKANFTGADLSDTLMDRMVLNEANLTNAVLVRSVLTRSDLGGAIIEGADFSDAVIDLPQKQALCKYASGTNSITGVSTRKSLGCGNSRRNAYGSPSSPLLSAPPQKLLDRDGFCDPATGMCEAN

SEQ ID NO: 44012 - protein, 273 aa, Sorghum bicolor
  unsure (1)..(273): unsure at all Xaa locations
  Clone ID: SORBI-28MAY03-C1225_1.pep
MASAKFGAVAQVENRGALSKRSRNDVSVREGDWNCPQCGNVNFSFRNVCNRGACGAPRPSPSPSPRMMPAPPPGGYDRSPLFYGGGGGAPPPIPLGSGSYGAPYPHLGMRYGYGPPVGAPGSYGLFSSYGQPGPMSGMGYGPGPELGRYSYGFRGSPMPVSSPWSGGALAENNDNIASRKRRGGPDGLSEGHXTCPKCDNINFSFRTTCNMKKCGAPRPTSGGNTSSSRKDNNNKEAPEGSWTCPECNNLNYPFRTVCNRKGCSYSKPAPTNN

SEQ ID NO: 44013 - protein, 134 aa, Sorghum bicolor
  unsure (1)..(134): unsure at all Xaa locations
  Clone ID: LIB3476-055-P1-K1-E10.pep
MASAKVENRGALSKRSRNDVSVREGDWNCPQCGNVNFSFRNVCNRGACGAPRPSPSPSPRMMPAPPPGGYDRSPLFYGGGWGXPPPIPLGSGSYGAPYPHLGMRYGYVPPRGAPGSYGLFSSYGQPGPMSGMGY

SEQ ID NO: 44014 - protein, 364 aa, Sorghum bicolor
  unsure (1)..(364): unsure at all Xaa locations
  Clone ID: SORBI-28MAY03-C12408_1.pep
MAAQAVVPAMQCQVGVKAAAAGARARPAAAGGRVWGVRSRTGRGGASPGFKVMAVSTGSTGVVPRLEQLLNMDIXPGNNILVICDTYTPQGEPLPEANQHRAAQIFSDPRNXEQVPWFGIEQEYTLLQKDVNWPLGWPVGGYPGPQGPYYCAVGADKSFGRDISDAHYKACLYAGINISGTNGEVMPGQWEYQVGPSVGIEAGDHIWISRYILERITEQAGVVLTLDPKPIQGDWNGAGCHTNYSTKTMREDGGFEDIKRAILNLSLRHDLHISAYGEGNERRLTGKHETASIETFSWGVANRGCSVRVGRDTEAKGKGYLEDRRPASNMDPYIVTGLLAETTILWQPTLEAEVLAAKKLALKV

SEQ ID NO: 44015 - protein, 431 aa, Sorghum bicolor
  unsure (1)..(431): unsure at all Xaa locations
  Clone ID: SORBI-28MAY03-C10317_1.pep
MAILERSSSPAAASVAVAALIALASVAGVAGEVFFQEKFDDGWEDRWVKSDWKKDDNTAGEWNHTSGKWNGDADDKGIQTSEDYRFYAISAQYPEFSNKDKTLVLQFSVKHEQKLDCGGGYLKLLGSDVDQKKFGGDTPYSIMFGPDICGYATKKVHAILTKNGKNHLIKKELPGETDQLTHVYTLIIRPDATYSILIDNDEKQSGSIYDDWDILPPKKIKDPEAKKPEDWDDKEYIPDPEDKKPEGYDDIPKEIPDPDAKKPEDWDDEEDGEWTAPTIPNPEYKGPWKQKKIKNPDYKGKWKAPLIDNPDFKDDPYIYAFDSLKHIGIELWQVKSGTLFDNILITDDPEYAKKLAVETWGKQKDAEKAAFDEAEKKRLEECFSLXESASSKDDDDDLDVDEDEDDADDDKADHSDTDEAEDSEEAKHDEL

SEQ ID NO: 44016 - protein, 455 aa, Sorghum bicolor
  Clone ID: SORBI-28MAY03-C10504_1.pep
LLSNINTSRLRFTHPDLPQNICKALGIKKLSDVIVEELDGKEEIKVVSSIHSVSLDRIKEKLQSESLQNALRIVMISVTNHFPSFEALALVQIEQILEDISQKLQLVQCLHTRFLLLPTRQDVTRTIQHPSIHEWSSNGMHRSICFINKSTGYILVAEPPSFLTIYDVIAIVVSHRLGAPMILPIASLFACLDGSEKEVLQILHLGSDVGVSKREGRYDASLGAELLSQDARQVQFLPLRPFYSGEIVAWKTGKEGEKLRYGRVPEDVRPSAGQALYRFPVETAPGETRMLLSSHVYSFKSVSMADLLSAPSQVNGGVALATNTGTEVIKDADAGLQYGKVSSTELVQAVHDMLSAAGVRMDAEKETLFEATLSLQDQLKESQVALLVEQEKAEAAVREADVAKAAWSCRICLNAEVNMTIVPCGHVLCNRCSSSVSRCPFCRTQVARMMKIFRP

SEQ ID NO: 44017 - protein, 226 aa, Sorghum bicolor
  Clone ID: SORBI-28MAY03-C10799_1.pep
MWSSDSDRDEQPVDTATTTTTSSPAQQPSTPPAPPRRRRQRARRRAQRLRAKNTGAGEEEEEAEAEDVWRGLQQQQREREREAWPRRASRPVVVAAGEEGSPDAASATSGESVGGMGRARSLTDDDLEELKGCVDLGFGFSYHEIPELCGTLPALELCYSMSQRFLDEHQQLSKAAEEAPALAPASPAQPVATNWKISSPGDSPDEVKARLKYWAQAVACTVRLCS

SEQ ID NO: 44018 - protein, 255 aa, Sorghum bicolor
  Clone ID: SORBI-28MAY03-C11078_1.pep
HEGGPGEPGGSAVVFSPGVGFAESNTMDDSSWWYGSVRTPNPVMSRTARGSASLEATTSANHALESESDSDSESLYEVEGVPYERGNKSVETKRIRRMVSNRESARRSRRRKQAQLSELESQVERLKGENATLFQRLSEANQQFSTAVTDNRILKSDVEALRVNGKMAEDMVARSAISCGLGDLGLAPYLNSRKMCQALNMLTTTGLDLLGSDAFRGPTTAPQVQNSPVQSTASLENLDNRKSNEVTSCAADIWP

SEQ ID NO: 44019 - protein, 193 aa, Sorghum bicolor
  Clone ID: SORBI-28MAY03-C11098_1.pep
LNVAKPVKGSTVAIFGLGAVGLAAMEGARLAGASRIFGVDINPAKYEQAKKFGCTDFVNPKDHDKPVQEVLIELTNGGVDRSVECTGNVNAMISAFECVHDGWGVAVLVGVPHREDQFKTHPMNFLNEKTLKGTFFGNYKPRTDLPNVVEMYMKKELELEKFITHSVPFSEINTAFDLMLKGESLRCIMRMED

SEQ ID NO: 44020 - protein, 83 aa, Sorghum bicolor
  Clone ID: SORBI-28MAY03-C12772_1.pep
AVATPTISPNATTGYAGMAYHHVIQSHHHPSPQPVANMGGNFGYEYADPTRPQVYYSQAAAPPTLPPQYQPMVSPDAGQAEKH

SEQ ID NO: 44021 - protein, 222 aa, Sorghum bicolor
  Clone ID: SORBI-28MAY03-C12847_1.pep
MGTPETSREPCPDRILDDVGGAFGMGAVGGSAFHFIKGIYNSPNGMRLSGGAQAVRMNAPRVGGSFAVWGGLFSTFDCAMVYARQKEDPWNSIVAGAATGGFLSMRQGMGAAGRSALMGGILLALIEGAGLMLNRVLANPPLPADDPNLTAAMGGNPFPGLPQAPPVVAPPEAASSSGAGGWFGGLFGKKEEEKKPSAGGGKSEILESFDTPSSPIPSFEYK

SEQ ID NO: 44022 - protein, 107 aa, Sorghum bicolor
  Clone ID: SORBI-28MAY03-C12924_1.pep
MASGGVVKHILLARFKEDVTQERLDELIRGYAALVAAVPSMKAFHWGTDVSIENMHQGFTHVFESTFESTEGIKEYIEHPKHVEFANVFLPVLDKVIVIDYKPTSVN

SEQ ID NO: 44023 - protein, 319 aa, Sorghum bicolor
  Clone ID: SORBI-28MAY03-C1301_1.pep
TRQGRNIGSPPSMASIVAATVAAASAWWATQGLLPFFTPPMAFPFVPAPSAAFPTVDVPRPSEKDRDCPVENAQKECQEAQKQGQFEGLRVAASSVSDGSGKGEVSLHTELKIPPVQNADATPTTGADTSDAFRNKKKQDRSSCGSNTPSSSDVDADNVPEKEDNANEKVKQASCSNSSAGDTNHRRFRSSGSTSDSWKEVSEEGRLAFDALFSREKLPQSFSPPQAEDSKEVAKEEENEVTTVAVDLNKNATSIDHDLDTMDEPRASFPNELSHLKLKSRRTGFKPYKRCSVEAKENRVPASDEVGTKRIRLESEAST

SEQ ID NO: 44024 - protein, 110 aa, Sorghum bicolor
  Clone ID: SORBI-28MAY03-C13108_1.pep
IPNDADPPTQTKMNGSTKKTLVNGLLDQSNGNSGLQSSGNDNPSYTNSSSAMPPSSTELTESTAPATDVDSVKNGPGTKPEQPAKRALRSSNVQQGRKRVLRSTARGRAT

SEQ ID NO: 44025 - protein, 254 aa, Sorghum bicolor
  Clone ID: SORBI-28MAY03-C11448_1.pep
MAGQHHISTHASTMDHVNRFQSEPQPFGPKLFMHSRTDAANGALSSGYGGAPIRPNDIPSSSHTGQSHIQHSDAPGTMLASYSGYPHAGSSSSIYAPHNTHHPPPLSYPHRSEDNFIPSSHMDDRRVALKRRNPIIHPVDGVNIGSSYAGSSSNPQFSRYMPPNHIPAPEPCPSRITSNMGSRYWSDHPFGGHGGSQRNVRGRHDHNPIHLGHNPGVPCASSSTHGPPHTNVIGHPRSTAVPQDRAHFSIPPRV

SEQ ID NO: 44026 - protein, 134 aa, Sorghum bicolor
  Clone ID: SORBI-28MAY03-C11477_1.pep
RQQTNLQGLPRVHEHRGEPAIVLLAQPQKIAWAEPPQNFILQKGTSMPQYASYGFWFSWSDQRKSLCEEYQIENTFLCSLIQSLRRQLGGCLLCLLGEYSLKLCTSLRRVFFTGRYQLPEERQICLPFPQNRGS

SEQ ID NO: 44027 - protein, 161 aa, Sorghum bicolor
  Clone ID: SORBI-28MAY03-C11353_1.pep
LLRRRRNNRGAHGTREPSVTLAEAQRATQQVKDAKFPDLEVIRMLWDVLMEAVQWSGKNQQQNSNAALRQVKAWAELLNAFCTSGRLELELIYKVQTQCYEDAKLMKLFPEIIRTLYDQDVLAEDTVLLWFRKGSNPKGRQSFVKALEPFVKWLEEAEEEE

SEQ ID NO: 44028 - protein, 267 aa, Sorghum bicolor
  Clone ID: SORBI-28MAY03-C11801_1.pep
MDPKMTEVTQMFARFKAAYARNDLDACVTLLSQLKVHLTKFPSLPPSFQQTPNAVEELKLARDIYEHAVVLSVKLEDQDAFERDFCQLKPYYMDTCGIIPPSPEEYPILGLNLLRLLVQNRIAEFHTELELLPVKALEHPCIKHAVELEQSFMEGAYNRVLSARQAVPHETYVYFMDLLAKTVRDEIAGCSEKGYDSLSVSDAKQMLMFNSDQDLHEYISEEHPEWEIKNGAVFFQKAKESQPCKEIPSLQLINQTLSYARELERIV

SEQ ID NO: 44029 - protein, 289 aa, Sorghum bicolor
  Clone ID: SORBI-28MAY03-C11893_1.pep
MGNMTRSDSPVSRRIVLSFLDFLNSVELAPGVDPEALEVAKDCLESIFSVNSSATREAIQPGLLLELFASLEANERDRARAALLSQSVSNKPSQNAGTSNVEEDPNKCTTSDSDSQMEDTFDLDHSGDELFAKFYAALDEINFFKTSPAGAEDPGLLSKATQYFNDALLAMQKSGTKKASLVDLAESFKSRGNEFMRSNQHLKAVELYTCAIALNKKNAIYYCNRAAAYTLLNMNNEAIEDCLKSIEIDPSYSKAYSRLGSAYFAMGNYHDALYKGYLKAAELDPSNEN

SEQ ID NO: 44030 - protein, 220 aa, Sorghum bicolor
  Clone ID: SORBI-28MAY03-C13714_1.pep
VVSDTCVAMGDWVAHPQAHTALDDILPCMDVATANESLYRSQEVTAQLVALVNNVVVNISNRNFPLGLRPLYFNQSGPLMPVLCNPFNRDMSPRRCAPGEVDFDSAAREWKRFECQTTGPPGSEVCATPGRVTPAAYRQMTAATSVSKGLYEFSPFLVQLQDCSFVRETFSSITNNNCPGLEQYSRDVYIGLVVISAGVMLSVVFWMVHTRHRRRRALCK

SEQ ID NO: 44031 - protein, 389 aa, Sorghum bicolor
  Clone ID: SORBI-28MAY03-C14034_1.pep
MEHEDQEAQKPLLVTAPGRSGDGCASGAASSSSSIAVVVASTAVAVAGSFEFGISVPVSIPEITPKNLGGGLAPVNQFLLCSGASLASVLGTFVTWRTLAIIGLAPSLLQLVGLLVPPESPRRLARFGHPRAFEAALQKLRGKAPDISDEATEIKDFTEKLQQLPESKMFDLFRKDYIRAVTVGVGLMVLQQFGGVNAICFYASEIFVSAGFSSGNTGMLAMVAVQIPMTGLGVLLMDKAGRRPLLMVSAAGTCLGCLLVGLSFLAKEHHWGKDLNLVLALAGILIFGGSFSLGMGGIPWVIMSEIFPINMKGAAGSLVTLVSWLGSWIVSYAFNFLLVWNSYGTFFIFASICGLTVVFVERLVPETKGRTLEEIQASMNSSLTPPFHL

SEQ ID NO: 44032 - protein, 191 aa, Sorghum bicolor
  Clone ID: SORBI-28MAY03-C14114_1.pep
MEMEASGALSSSSVLYAAMSLPCALLVLVVGEAGLRVASLALRGEMKAWWPTRAAMLGYRVARPGVGGASVFPDDDDPPLLLPAESCDRLAVAVYRRRGQGQGQEEQAQDPDPDCAFCLSAVRDGEEVRELRCRHVFHRACIDAWLVRPRATCPLCRDRLLPAESDHDHDRLSSSASASAYAHGGAIWHMT

SEQ ID NO: 44033 - protein, 85 aa, Sorghum bicolor
  Clone ID: SORBI-28MAY03-C14061_1.pep
MGYWWDRVVLPVRRAWLGVASRFGVRQTGLWRLRQEVSTCEYEDVHVMWEMLSRTTAPPPAPRRPSRFRPQPRPWGDRFRLCRGF

SEQ ID NO: 44034 - protein, 56 aa, Sorghum bicolor
  Clone ID: LIB3480-011-P1-K1-G12.pep
MGYWWDRVVLPVRRAWLGVASRFGVRQTGTYGSAGRLDVGGGGVSRTTISWVCWCD

SEQ ID NO: 44035 - protein, 259 aa, Sorghum bicolor
  Clone ID: SORBI-28MAY03-C14122_1.pep
TDPRKTLPASIPSSPYSPTKTPLPPSWLLEESLCGGASRRDHIPAARRRLSSAANFWPTPAADAEGPHASLTPAPERAPRAKKAKRVRNTYYRGIRQRPWGKWAAEIRDPVQGVRVWLGAYPTAEAAARAYDRAARRTRGAKAKVNFPNDISSSVTAVPTTAAGAAAAQAPAVLPAPKVEAQAQVSDEVKELSEELMAYENYMNFLGIPYMEGGNAAAGATTAAAAATVAEEAQVPAAPAGLWSFEDYYYPPSLSLFTE

SEQ ID NO: 44036 - protein, 263 aa, Sorghum bicolor
  unsure (1)..(263): unsure at all Xaa locations
  Clone ID: SORBI-28MAY03-C1393_2.pep
MGCGASSQKDAGPPRRRLGSVGDVVVFLPGLRAPRTVDFAHALAGCGVARSVGVPLPAPAAPLVPRPRPAARHGSSTANLLQALEDYLPVLLGSVKDASILRHKVQFTWSNQEDSAEETAISDAWYEVLSVLHLMAMVCLLQANTLLLPRSYGDGYAPRVSEESRRATVDVFLKAAGYLDCAIRHVLXKMPLELRRQLPVDLAEGNLKALCLQALGQGVNMQLGLAIDSPKATLAVKRRLACEMXKYWHKFREHPELCLMMGK

SEQ ID NO: 44037 - protein, 279 aa, Sorghum bicolor
  Clone ID: SORBI-28MAY03-C1393_1.pep
AGRAESLVGLLFSSPSPGFLLRPRKSSSYGDGYAPRVSEESRRATVDVFLKAAGYLDCAIRHVLPKMPLELRRQLPVDLAEGNLKALCLQALGQGVDMQLGLAIDSPKATLAVKRRLACEMVKYWQQVQESIPELPVSDGWGKKHRLFVKWKYVEAKAAAYYFHGLILDEGNTEKSHGMAIAALQASEEFLKESKRVSEAFHATPPTSRSPNPFGTAKYLFDKIPRDASSKVRINQDLYTQEKVIGAPPPLPDFALALTPEDYDLPPLDPLWNKEDTHH

SEQ ID NO: 44038 - protein, 90 aa, Sorghum bicolor
  unsure (1)..(90): unsure at all Xaa locations
  Clone ID: SORBI-28MAY03-C12547_1.pep
PAGPGHYPIREXLEKEKKEKNLAKTEGRPEPALYGSEDIRPLSIDDFKSAHEQVCASVSSDSANMNELLQWNDLYGEGGSRKKKALSYFM

SEQ ID NO: 44039 - protein, 144 aa, Sorghum bicolor
  Clone ID: SORBI-28MAY03-C12496_1.pep
MSAANQLAALIHNMFATGLLDDQFQQLQMLQDPSAPNFVAEVVTLFCQDGERIIGELAKLLDKPVVDFDRVDAFVHQLKGSSASVGALKVKNTCVQFREFCQQRSKDGCLKTLEMVRINFYELRGKFQTMLQLECQVNGFPPNN

SEQ ID NO: 44040 - protein, 201 aa, Sorghum bicolor
  Clone ID: SORBI-28MAY03-C12611_1.pep
MAHSNGAAATATAAGDGETAPVPRSLAPARKVALITGITGQDGSYLTELLLSKGYEVHGLIRRSSNFNTQRLDHIYHDPHAVPSSPRPPMRLHYADLSDSSSLRRALDAIAPDEVYNLAAQSHVAVSFEVPDYTADVTATGALRLLEAVRLSRKPIRYYQAGSSEMFGSTPPPQSEDTPFHPRSPYAAAKVAAHWYTVNYR

SEQ ID NO: 44041 - protein, 245 aa, Sorghum bicolor
  unsure (1)..(245): unsure at all Xaa locations
  Clone ID: SORBI-28MAY03-C12645_1.pep
MAASASTPLFSPCALTSKLGVGHASYGSGRRANVRRRGRLSVVAVQTGPQKPSPSSSQAAAAEDEADALQKLLKREYKYGFVSDFESFSIPKGLSEATVRRISELKAEPAWMLDFRLAAYRRFLTMVEPTWSDNEYAPVDLQSICYYSAPKTKPKLNSLDEVDPELLKTFDRLGIPLTEQKRLTNVAVDAVIDSTSIATTHREALMAKGVIFCSISEAIREYPDLVRRYLXSVVPAGDNYYAXLN

SEQ ID NO: 44042 - protein, 256 aa, Sorghum bicolor
  Clone ID: SORBI-28MAY03-C1265_1.pep
MDAGSHSISSEKSRAAAAPRPPLQEAVSRPYMPSLGSGCRNPSAKCYGDRFIPDRSAMDMDMAHFLLTEPRKDKENAAASPSKEAYRWLLAEKLLNNRTRILAFRNKPPEPENVSFADAASSNLQAKPAKQRRHIPQSAERTLDAPELVDDYYLNLLDWRVGNVLSIALGDTLYLWDASSGSTSELVTIDEDSGPITSVSWAPDGRHIAVGLNSSDVQLWDTSSTRLLRTLRGVHEARVGSLAWNNSILTTGGMDG

SEQ ID NO: 44043 - protein, 336 aa, Sorghum bicolor
  Clone ID: SORBI-28MAY03-C1556_1.pep
MAFPVPFLLLLLLVALLVVAATRLWDHVFVRLVWRPYAITKGFREQGIHGPSYSFFKGCNEDIRSMKEKTDGLVLDVGDHKYLPRIAPHYLKWRAQYGEPFLYWYGPQARICIFDYELARQILSSKSGHFVKNDAHPTLLALVGKGLGFMEGADWVRHRRVINPVFTIDKLKIMTKTMLDFAQNMASELEAEASQSENGETRVDINKQFSDLTVDNIAYAIFGNSYKLGKQVFQAQTEMLGITMATFLDVPIPGIQYLPTKANRRKQILERKLKSLLTQIIQPRLASGEYGNDLLGVMLESCTEAKQGGKQVDGLSLSMEEIIHECKLFFFAGHEN

SEQ ID NO: 44044 - protein, 77 aa, Sorghum bicolor
  Clone ID: SORBI-28MAY03-C15725_1.pep
MVLGGGAAAFASSLLVGAVISYFLWPVAAPAAAVVMMKAPGAGGLLISRAAFAANPQLYYSLLRTAGAAAAAAAFAV

SEQ ID NO: 44045 - protein, 503 aa, Sorghum bicolor
  Clone ID: SORBI-28MAY03-C1590_1.pep
HEASERPTTKTGFLGCFGSKVDAIDYYKSEIEKIGKEEAEERKKVMKDPKSVVPAAFVSFRSRWGAAVCAQTQQTSNPTVWLTEWAPEPRDVYWNNLSIPFVSLTVRRLIIAVAFFFLNFFYIIPITLVQSLANLEGIEKALPFLKPLIELPFIKSFIQGFLPGIALKIFLIVLPTILMFMSKFEGLISQSSLERRSASKYYIFLFFNVFLTSVIAGSALEQLKTYLHTSANDIPRIIGDSIPMKATFFITYVMVDGWTGIAGEILRLKPLIFFHLKNLFLVKTEKDREEAMDPGSICFDSTEPRIQLYFRLGLVYAAVTPFLLPFILVFFGFAYVVFRHQIINVYNQQYESAAQFWLSVHGRIITALIVSQLLLLGLMSTNDFEQSTPVLLVLPVLTFWFYKYCKNRFEPAFVRNPLQEAMKKDTLERAREPNFDLKAYLANSYLHPVFKGDEGDDRYSVVDDEGWMEEEVIVPTKRHSRRTTPAQSKHEGSDSLSVPESQR

SEQ ID NO: 44046 - protein, 395 aa, Sorghum bicolor
  unsure (1)..(395): unsure at all Xaa locations
  Clone ID: SORBI-28MAY03-C15985_1.pep
MVAFLLPLQLPAPLHTRPLPHHRPPVAVAMASASTSDSPNPIVLGCGAASVDYLATVASFPNPDDKIRSLALKVQGGGNTGNALTAAARLGLRPRIISKVSNDAQGRNILKELQDDGIDTSYMLVAEDGNSPFTYIIVDNQTKTRTCIHTPGYPPLLPEELTKENLSAALDGADMVYFDVRLHETALIVAEEXASRRKIPIFIDAEKKREGLDELLNFATYVVCSAKFPQAWTGASSTPVALVSMLLRLPKIKFVIVTLGEKGCLMLERSTIDASEADKIDIEALLESLEKKVDQSSTTPNCITSKANLRISADGVGSINGRLLLGTAEVIPPDELIDTTGAGDAFIGAVLYGLCTGMPPERMLPFASQVAGCGCRGLGARSSLPHRTDQRLVGY

SEQ ID NO: 44047 - protein, 227 aa, Sorghum bicolor
  Clone ID: SORBI-28MAY03-C15665_1.pep
RSAPTHCFGGSSRAGRVSRAGAAAGAAAGPLPRERPPATSLQGPGRRGRPRHRLPSTRAPPRPPGGGGPAEVAPRARPRDRVLPEVGGREFVLVCRHSRVDRRRNCPGVGAIRGAYESLPAEARQRLRAVDFVHPALRSRLFSPPLRRLLFSSGAYEKLRYMSRLDYVWAHIDKGQLQVPDRRREHDDELERRPLMDYGIEATESRCMYDAASMDSSASLHSLRCVS

SEQ ID NO: 44048 - protein, 119 aa, Sorghum bicolor
  Clone ID: LIB3480-044-P1-K1-F3.pep
MTAAPPNAAAGDLFAANLTGALLAVASSAFIGVSFATFGRFLFSSGLYEKLRYMSRLEYVWAHIDKGQLEVPDCVREHDDELERRPLMDYGIEATESRCMYDAASMDNSASLHSLRCVS

SEQ ID NO: 44049 - protein, 352 aa, Sorghum bicolor
  Clone ID: SORBI-28MAY03-C16088_1.pep
MGKKGKWFSAVKKVFSSSGTDGKEAKAEKADKSKSKRRWPFGKTKKHSEPSISTVAGTAPVAPLPSPPPTQPHSLEIKDVNPLETDSEQNKHAYSVALASAVAAEAAAVAAQAAAEVVRLTAVTTAAPKMPVSSMEELAATKIQTAFRGYLARRALRALRGLVRLKSLVDGNAVKRQTAHTLQCTQTMTRVQTQIYSRRVKLEEEKQALQRQLQLKHQRELEKMKIDEDWDHSHQSKEQIEANLMMKQEAAMRRERALAYAFSHQWRTSGRTITPTFTEPGNPNWGWSWMERWMTARPWESRLVASDKDPKERALTKNPSTITVQAASVPRAISIQRPATPNKSSRPPSRQS

SEQ ID NO: 44050 - protein, 154 aa, Sorghum bicolor
  unsure (1)..(154): unsure at all Xaa locations
  Clone ID: SORBI-28MAY03-C13462_1.pep
ARVGAGLELGSSTLAASDFCVCRSXMPTAVLHKASDFPCGPQGGADCTSILQGGGCYNTNTVAALTSGAGDSYYIYNKATGGTCDLGGSGAVCRHGPSLYGCTVGMKTTNLSLRISTSVPASLSAPTTTTATNSFMVGWGIGAFYYTAIWEATL

SEQ ID NO: 44051 - protein, 174 aa, Sorghum bicolor
  unsure (1)..(174): unsure at all Xaa locations
  Clone ID: SORBI-28MAY03-C13061_1.pep
SRAAARDLELGGKIIRVEAHPMGEHPKPKRVSGRVTLVGDAAXYVTKCSGEGIYFAAKSGRMCAEAIVAGSANGTRMVEESDLRKYLAEFDRLYWPTYKVLDILQKVFYRSNAAREAFVEMCADDYVQKMTFDSYLYKRVVPGNPLDDIKLAVNTIGSLVRATALRREMEKVTL

SEQ ID NO: 44052 - protein, 80 aa, Sorghum bicolor
  unsure (1)..(80): unsure at all Xaa locations
  Clone ID: SORBI-28MAY03-C13011_2.pep
MADQFADSANNVVIEEVNKGLNPGMVVLLVVASFLLLFFVGNYVLYVYAQKTLXAKKKKPVSKKKLKREKLKQGVSAPGE

SEQ ID NO: 44053 - protein, 80 aa, Sorghum bicolor
  Clone ID: SORBI-28MAY03-C13011_1.pep
MADQFADSANNVVIEEVNKGLNPGMVVLLVVASFLLLFFVGNYVLYVYAQKTLPPKKKKPVSKKKLKREKLKQGVSAPGE

SEQ ID NO: 44054 - protein, 246 aa, Sorghum bicolor
  Clone ID: SORBI-28MAY03-C13533_1.pep
CMRTSPSRWLACMVVLGRLPELVQRLAGGDDGGVLLGVHDGLEGADERLDPAALALLQQLGARLLNDVVAPHHLPATRLLRLRPRLHRRLHPAALEPPHRLLLLVRLVLLDRLLHHRHELVRHHVVLGCSGGDDDDDGLRHRFRCRRRSFLGGLHLLVFRGCGGGGLLPFRNDRRRRRRVLAYDLLRHDLVVVIVVALLLLLRLILHAAHGAAASTVAAGDLGTCRRQPRRRVGDLAAAGGEHRGP

SEQ ID NO: 44055 - protein, 161 aa, Sorghum bicolor
  Clone ID: SORBI-28MAY03-C13517_1.pep
GKLLDSNGLDMSKAYMLDTQETAETKYKKWEKEPAPYGWDVFNQKTLYDAYKKRTKNIEVDMEAYNKAKEADPEFYRDASSLQYGKVSNVPEENIDKMVKELKEREEKRKSFSRRRKFNEDKDIDSINDRNEHFNKKIERAFGKYTLEIKNNLERGTALPD

SEQ ID NO: 44056 - protein, 162 aa, Sorghum bicolor
  unsure (1)..(162): unsure at all Xaa locations
  Clone ID: SORBI-28MAY03-C17152_1.pep
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGAFFFFFFDMPSRSFNTVEPSSFCVMKNKSNDHSPREDYMQEECLHLNKIKQGNMRGSHIIC

SEQ ID NO: 44057 - protein, 177 aa, Sorghum bicolor
  Clone ID: SORBI-28MAY03-C16857_1.pep
MFFHIVLERNMQLHPRHFGPHLRDKLVSKLIKDVEGTCSGRHGFVVAITGVEDIGKGLIREGTGYVTFPVKYQCVVFRPFKGEILEAVVTMVNKMGFFAEAGPVQIFVSNHLIPDDMEFQSGDVPNYTTSDGSVKIQKESEVRLKIIGTRVDATEIFCIGTIKDDFLGVISDPGAAV

SEQ ID NO: 44058 - protein, 155 aa, Sorghum bicolor
  Clone ID: SORBI-28MAY03-C17018_2.pep
EAQMAPKAAPAKKADAKAQALKVAKAVKSGAGKKKTKKIRTSVTFHRPKTLKKARDPKYPRISTTGRNKLDQYQILKYPLTTESAMKKIEDNNTLVFIVDLKADKKKIKAAVKKMYDIQAKKVNTLIRPDGKKKAYVKLTPDYDALDVANKIGII

SEQ ID NO: 44059 - protein, 191 aa, Sorghum bicolor
  Clone ID: SORBI-28MAY03-C17018_1.pep
LEAGRAGIWGPAGPGSRHPFASASARRQQRYRREFQEADMAPKAAPAKKGDAKTQALKVAKAVKSGSVKKKTKKIRTSVTFHRPKTLKKARDPKYPRISTTGRNKLDQYQILKYPLTTESAMKKIEDNNTLVFIVDLKADKKKIKAAVKKMYDIQAKKVNTLIRPDGKKKAYVKLTPDYDALDVANKIGII

SEQ ID NO: 44060 - protein, 239 aa, Sorghum bicolor
  Clone ID: SORBI-28MAY03-C1748_1.pep
ATVSGITLLNSKFFHMNVFQCKGVTIKDVTVTAPGDSPNTDGIHIGDSSKVTITGTTIGVGDDCISIGPGSTGINVTGVTCGPGHGISVGSLGRYKDEKDVTDINVKDCTLKKTSNGVRIKSYEDAACVITASKLHYENIAMDDVANPIIIDMKYCPNKICTAKGDSKVTVKDVTFKNITGTSSTPEAVSLLCSDKIPCSGVTMDNIKVEYKGTNNKTMAVCQNAKGSATGCLKELACF

SEQ ID NO: 44061 - protein, 365 aa, Sorghum bicolor
  unsure (1)..(365): unsure at all Xaa locations
  Clone ID: SORBI-28MAY03-C1794_1.pep
MYEPPSRGGGGAGAAGEQPRVYQVWRGSNEFFLQGWFIFGPDVRSLFLTIFLILAPVVVFCIFVARHLINDFPDHWGVSVMVVVIVFTIYDLTLLLLTSGRDPGIVPRNTHPPEPEAIDMINDAGNGQTPQQLRLPRTKDVIVNGVIVKVKYCDTCMLYRPPRCSHCSICNNCVERFDHHCPWVGQCIGLRNYRFFYMFVFSTTLLCLYVFGFCWVYIVKIRDAEQSSIWKAMLKTPASIVLIIYCFICVWFVGGLSVFHFYLMSTNQTTSLSTFYYSCRHLKAYSXELVVILISILLGICNHFSYPLQTTYENFRYRYDRRANPYNRGIVNNFMEIFCTAVPPSKNNFRARVPVEQGLQQSHAP

SEQ ID NO: 44062 - protein, 134 aa, Sorghum bicolor
  Clone ID: SORBI-28MAY03-C6125_1.pep
MAAKARVSLTVLLAAATLACLCAVAASASAFDVPSVAFEERFSPLFGDGNVVRSSDDRSVRLLLDRRSGSGFISSDYYLHGFFSASIKLPKDYTAGVVVAFYLSNGDVYEKTHDELDFEFLGSRWGGQWRVQTN

SEQ ID NO: 44063 - protein, 111 aa, Sorghum bicolor
  Clone ID: SORBI-28MAY03-C63072_1.pep
MRPLLVSLALIFVVAGVAHGAGECGRASADRVALRLAPCVSAADDPQSTPTSSCCSAVHAIGQSPSCLCAVMLSGTARAAGIKPEVAITIPKRCNMADRPVGYKCGDYTLP

SEQ ID NO: 44064 - protein, 293 aa, Sorghum bicolor
  Clone ID: SORBI-28MAY03-C6059_2.pep
AANSTTDSKENMSSGSDTNSNTSVNESNAQEIITEKVLKKRTFRVPLKVVEKTTGAGTILSKELYSEAKNRLEALDKKDAERRKTAELKNNLESYIYSMKEKLEESTDILTVSTEQERESFAEKLSEVQDWLYMDGEDAQANEFQERLDQLKAIGDPILFRLSELKARPAACENARLYLDELQKIVKNWDANKPWLPKKRVDEVVREAEKLKAWLEEKENLQKNTPVYSPPVFTSEEVDEKVLDLQDKVSSVNRIPKPKPKVEKKTAKEEEPASKEKTTSSESAPNEGEYTET

SEQ ID NO: 44065 - protein, 108 aa, Sorghum bicolor
  Clone ID: SORBI-28MAY03-C6059_1.pep
RVEEKENLQKNTPVYSPPVFTSEEVDEKVLDLQDKVSSVNRIPKPKPKVEKKTAKEEEPASKEKTTSSESAPNEGEYTETSQESKAQEEDQSASANTSDSEPESHDEL

SEQ ID NO: 44066 - protein, 273 aa, Sorghum bicolor
  Clone ID: SORBI-28MAY03-C6314_1.pep
MGTLGRAIFTVGKWIRGTGQAMDRLGSTLQGGLRVEEQVSRHRTIMNIFEKEPKIHRDVFVAPSAAVIGDVEIGHGSSIWYGSILRGDVNSIHIGSGTNIQDNSLVHVAKANFSGKVLPTIIGSNVTVGHSAVLHACTIEDEAFVGMGATLLDGVLVEKHSMVGAGSLVKQNTRIPSGEVWVGNPAKFLRKLTEEEIAFIAQSATNYINLAQVHAAENAKSFDEIELEKMLRKKYAHKDEEYDSMLGVVREIPPELILPDNILPHNAQKAVAR

SEQ ID NO: 44067 - protein, 295 aa, Sorghum bicolor
  Clone ID: SORBI-28MAY03-C650_1.pep
MQHEPWRAGAEPAGMAPTTVDEASMERSKSFVKALQELKNLRPQLYSASEYCEKSYLHSEQKQMLPGNLKDYAVRALVNAVDHLGTVAYKLTDLYEQQASEISTLELKVSCLNQQVLTCQTYTDKEGVRQQQMTGAARRHHKHYIVPYAGNKRMQAFSDMQADADFDSTPRPYSSARTLQWHLVSEKNSKTSRPDQSEIAQGDTKTTKPSSSGFRLGKESSASPLSRNVQSNITSLDIVNVGMKDQPTTRHLSSFSSLDNPRGRQIQKAPLRTKSMLAAFFVKHRSAKMKNVSVR

SEQ ID NO: 44068 - protein, 130 aa, Sorghum bicolor
  Clone ID: SORBI-28MAY03-C6506_1.pep
MASHQQQQAGAAAAAASVDFEDYLPVMAERLGEDGLMRELASGFRLLMDPARGLITFDSLRRNAPLLGLGGMSDADLRGMLAEGDFDGDGALSEMEFCVLMVRLSPELMDEPRRWLDDAVDQASRFLFTS

SEQ ID NO: 44069 - protein, 203 aa, Sorghum bicolor
  Clone ID: SORBI-28MAY03-C1887_1.pep
MATIATMALLKPAKIVARSAPSTSGAVSLRVPTTTQAKKQTTAAVAVSSTSTTTPAAAAAAALAGAFFSALASSDAALADVAAAADAGSDNRGQLLLFVVAPAIGWVLYNILQPALNQLNRMRSQAVVAGLGLGAAATAAGMASPPEASAAASVQDLAALAAAAPADDSRGLLLLIVVAPAIGWVLFNILQPALNQLNRMRSD

SEQ ID NO: 44070 - protein, 347 aa, Sorghum bicolor
  Clone ID: SORBI-28MAY03-C1907_1.pep
TRVSREILQESRIVRIMRKRLVRKAFDMILGISCNENRDDYERFWENYGKFLKLGAMEDRENHKRIAPLLRFFSSQSNDELISLDEYVENMKPEQKDIYFIAADSLSSAKNAPFLERLTEKEYEVLLFVDPMDEVAIQNLVSYKDKKFVDISKEDLDLGDNNEEREKEIKQEFSQTCDWIKNRLGDKVARVDISNRLRSSPCVLVAAKFGWSANMERLMRAQSMGDTSSLDFMRSRKVFEINPEHEIIKALNVACRNNPDDPEALKALDVLFETAMISSGFSPDNPAELSGKIYEMMTSAIAGKWSSQSEAQPANPIPQHSAPVMSDEPLEAEVVESEPAADAGQQK

SEQ ID NO: 44071 - protein, 548 aa, Sorghum bicolor
  Clone ID: SORBI-28MAY03-C1936_1.pep
MIVANLGAKPLVIQLPIGSEDNFQGVIDLVRMKAIVWTGEELGAKFEYKDIPDDLQELAQDYRVQMLETIIELDDEVMENYLEGTEPDEETVKKLIRKGTISASFVPVLCGSAFKNKGVQPLLDAVVDYLPSPLDLPSMKGTDPEDPEIIFERQPSDDEPFSGLAFKIMTDPFVGSLTFVRIYSGKLVAGSYVLNANKDKKERIGRLLGVRANSKEDIPVAVTGDIVALAGLKDTITGETLCDPDKPVVLERMEFPDPVIKVAIEPKTKADADKMANGLIKLAQEDPSFHFSRDEETNQTVIEGMGELHLDIIVDRLKREFKVEANVGAPQVNYRESISKVAEIQYVHKKQSGGSGQFADIIVRFEPLEAGSGYEFKSEIKGGAVPKEYVPGVMKGLEESLPNGVLAGYPVVDFRAVLVDGSYHDVDSSVLAFQIAARGAFREGMRKAGPRLLEPIMRVEVITPEEHLGDVIGDLNSRRGQVNSFGDKPGGLKVVDAFVPLAEMFQYVSTLRGMTKGRASYTMQLAKFDVVPQHIQNQLSTKTEEATA

SEQ ID NO: 44072 - protein, 275 aa, Sorghum bicolor
  Clone ID: SORBI-28MAY03-C1996_1.pep
MERVLKDDAVQEKGERARMASFIGAMAIADLIKTTLGPKGMDKILQSTGRGRNVTVTNDGATILKSLHIDNPAAKVLVDISKVQDDEVGDGTTSVVVLAGELLKEAEKLVNMKIHPMTIIAGYRMALECARDTLLQKTMDNKENTDKFRTDLMNIAMTTLSSKILSQDKEYFAELAVDAVLRLKGSTNLESIQILKKPGGSLKDSFLDEGFILDKKIGIGQPKRIENAKILVANTAMDTDKVKIYGARVRVDSMSKGADIEAAEKQKMREKVKRS

SEQ ID NO: 44073 - protein, 191 aa, Sorghum bicolor
  Clone ID: SORBI-28MAY03-C19875_1.pep
MENAAGAPAPAITKPSLSKKPSPSFRLRNGSLNALRLRRVFDLFDRNGDGEITLDEMASALDSLGLGADRSGLEAAVGGYIPAGAAGLRFENFESLHRALGDALFGPIPEEVPEDDDEGDMKEAFRVFDEDGDGFISAAELQAVLKKLGLPEARSLASVQEMICNVDRNCDGRVDFGEFKNMMQGITVWGA

SEQ ID NO: 44074 - protein, 350 aa, Sorghum bicolor
  Clone ID: SORBI-28MAY03-C1639_1.pep
MTLYTDARARRSCRANPASARGAGGEGRAEGAMAAAAAAKDAAVTLSSGYRMPAVGLGVWRMDKPDVRGLIHAALRLGYRHLDCAADYQNEAEVGDALAEAFQTGLVKREDLFITTKLWNSDHGHVLEACKDSLKKLQLDYLDLYLIHFPVATRHTGVGTTSSALGDDGVLDIDTTISLETTWHAMEELVSMGLVRSIGISNYDIFLTRDCLAYAKIKPAVNQIEVHPYFQRDSLVKFCQKHGICVTAHTPLGGSTANTEWFGSVSCLDDPVIKSLAEKYGKTPAQLVLRWGLQRNTVVIPKTSKLERLQENFEVFDFDISGEDMEKMKAVDRKYRTNQPAKFWGIDLFA

SEQ ID NO: 44075 - protein, 94 aa, Sorghum bicolor
  Clone ID: SORBI-28MAY03-C16569_1.pep
CVVSTTRYVPAYSTRVKFENNAWHILPANSSDPMGAADPVWTESYWNTIGLRVYAVQDSAYDWLILLAGLIITAASYCAVQFGTTYISKVVKHD

SEQ ID NO: 44076 - protein, 256 aa, Sorghum bicolor
  Clone ID: SORBI-28MAY03-C1662_1.pep
MRRSQELFFILELFQKMVQQGVRPNVVTFSAILNACSRCNNFEDAALLLEQLRLFDNSVYGVAYGLLMGHLEAWSQARSLFNQLGRMDSPTSSAFYNALTDVLWHFGQRQGAQQVVLEGVNRRVWENTWGDFCLDLHLMSCGAAQAMVHAWLLNVRSIVFEGRAMPEFLSILTGWGKHSKIAGSSTLRRVIEALLLSIGAPFQVERFNIGRFVSPSALVAAWLRESGTVNILLLRNERVQHANPSNLVPMLQALQL

SEQ ID NO: 44077 - protein, 251 aa, Sorghum bicolor
  Clone ID: SORBI-28MAY03-C16581_1.pep
MEGFWDAQSQRRRTGGGGGFESLKRLGHISPAVQSHLKHVYLTLCSALVFSALGAYLHILLNVGGTLTTVGCLAAIAYLISLPASRDQERNRFALLMSAALLQGASVGPLVDLVIDFDPRILATAFVGTAIAFGCFSGAAIIANRREYLYLGGLLSSGLSILLWLQFATSIFGHTSTTFMIELYFGLLVFLGYMVFDTQEIIERAHGGDMDYIKHALTLFTDFVAVLVRILVIMMKNAQEKSEDEKKRKKR

SEQ ID NO: 44078 - protein, 403 aa, Sorghum bicolor
  Clone ID: SORBI-28MAY03-C16629_1.pep
PDWCWQVLCHPCLSAPSALAPPLHHLLHGAHSCRAGACVSGSARGSREGAHPFRFACVSPAPQRADVIIARSLNEHGLSKRYVRCLQISEVVNHMKDLIEFSHKNNLGPKESLNSYSKTMAKFQNMPDSRQLMAAANLANNQSNTKLMGVKQEPSTSVNNQTPGVGTIGNNTLQNATPLNSYQNMLRTSSANPILLQQEASSVFKGPAAMHNGIQLEAARSFRGPNQVQFQHPTSFQQPMLQQNNFQGFGVSPQYQQHVLNQLLQEVKNNNNRTKAQQPPPDAPNASGSLASGVAIPNVAATGEQGQHINNSNSNHNSAVKGAAPAGTGPSNVINNSTASIAPGRNNSFKSVSSSPAAAAATTTAGNAVNSKVDDSFLQLEDLDDTITNALVESGLFGAGQGW

SEQ ID NO: 44079 - protein, 158 aa, Sorghum bicolor
  Clone ID: SORBI-28MAY03-C16971_1.pep
RCVVRGEACGRQAGMGCGSSRCARRSDALAAGLLLAAAAAVHAEAAHAEAAESAAAGVVVVVVAVEAEASLFHAGGGGALGGVDALGGVDGRRVLAQQQQPQQGHAQKRHAQLAGLGRHGPLRTRARIWQGMALCGLFGWIVALLLWRARPGRPGPAG

SEQ ID NO: 44080 - protein, 128 aa, Sorghum bicolor
  Clone ID: SORBI-28MAY03-C21823_1.pep
MAMAAARRALLAHLRVPAVHPAAAGGTIPAARRLLSSTTEETKGSFLDKGEVADRVLSVVKNFQKVEPSKVTPTAHFQKDLGLDSLDTVEVVMAFEEEFSFEIPDNEAEKIDSIKTAVDFIASHPQAK

SEQ ID NO: 44081 - protein, 142 aa, Sorghum bicolor
  Clone ID: SORBI-28MAY03-C22669_1.pep
LGVGDIDFVSCSTTVYEAMLTDWMRNLEVGIPALLEDGINVLIYAGEYDLICNWLGNSRWVHSMEWSGQKDFVSSSDLSFVVDGAEAGVLKSHGPLSFLKVHNAGHMVPMDQPKASLEMLRRFTQGKLKESLPEMMVLKAAM

SEQ ID NO: 44082 - protein, 81 aa, Sorghum bicolor
  Clone ID: SORBI-28MAY03-C22729_1.pep
MSYQAGYPPPAGQQQAYGGAPPPPAYVAPPPAYPPTQDGGAYYGQQQQQQQQQTTTSRGGDGFWKGCCAAICCCCVLDMCF

SEQ ID NO: 44083 - protein, 274 aa, Sorghum bicolor
  Clone ID: SORBI-28MAY03-C2273_1.pep
TPFISTPSKLNRQAPILPPPPRFGAALTFPFPPESRAEQRAPERRGNKQEEPEPVSQSPMAARVLAALLAAALALALAAPARASNDEGDALYALRQRLSDPNGVLQSWDPTLVNPCTWFHVTCDQASRVVRLDLGNSNVSGSIGPELGRLVNLKYLELYRNNLDGEIPKELGNLKNLISLDLYANKLTGGIPKSLSKLNSLRFMRLNNNKLTGSIPREFAKLSNLKVIDLSNNDLCGTIPVDGPFSTFPLRSFENNSRLNGPELQGLVPYDFGC

SEQ ID NO: 44084 - protein, 208 aa, Sorghum bicolor
  unsure (1)..(208): unsure at all Xaa locations
  Clone ID: SORBI-28MAY03-C18000_1.pep
MASLLLRSLRRARGFSSSATSAAKEGGDGKLVATVMFERLPVVIPKIHPAVYAFQEFSFRWRQQHRRQYPDEVLGKADARGKGDYHIDYVPAPRITEADRTPAQKSXYEAFDXKVYLAFSGKNKXKSSGKAVWNRPENLYKNEETMRPSAXYAVKSSVGVHGTTSVVKYVLGGLDNTYFVGNAPMAHMDVEQTDSSVSSFKVLINERS

SEQ ID NO: 44085 - protein, 216 aa, Sorghum bicolor
  unsure (1)..(216): unsure at all Xaa locations
  Clone ID: SORBI-28MAY03-C1745_1.pep
DAPIAPPPRGHPPTPPPPSDPAPPPPAHPRGAPXPSPPPRSRRRPRPRPPXSPPPSRRRRPPQRPPPRAARASPPPRIGDARPXPGRRTPSGCSPSTPRRPPRGPSPRGRARPPPSTSRRRRRPRPRPRAPRAAPPGPPPPRARRRRPPSPRPGPAARRRCPPRARTPRARTRRPPSPSCGRPPPRRPACGPPVGRRARGWAPAGDPLAGDPVLFL

SEQ ID NO: 44086 - protein, 132 aa, Sorghum bicolor
  Clone ID: LIB3480-007-P1-K1-H6.pep
REMEDVVSVREAFALAEGSHGGRRDFYGVFDGHGCSHVAEACRDRMHELLAEELAVAADDVSWTAAMEHSFARMDSERGCGVDRMHEMLAEELAVAADDVSWTAAMERSFAWMDSERGCGVGEGTPRGRNGP

SEQ ID NO: 44087 - protein, 229 aa, Sorghum bicolor
  Clone ID: SORBI-28MAY03-C18420_1.pep
ARGKNGAKVVSLGLLNQAHNLNGNGELYLQKYPKLGVRLVDGTSLAAAVVMNSIPQGTDQVVLAGNISKVARAVATALCRKNIKVVMTNKQDYHFLKPSMAEDAAENLLFSKTATAKVWLIGEGLDASEQFKAHKGTQFIPYSQFPPRMARKDTCTYSITPAMAVPKTLQNVHSCENWLPRRVMSAWRIAGMVHALEGWNEHECGDIVLDMEKVWSGALLHGFRPVAQV

SEQ ID NO: 44088 - protein, 112 aa, Sorghum bicolor
  Clone ID: SORBI-28MAY03-C18692_1.pep
MAPTKKSKKSTESINNKLQLVMKSGKYTLGYKTVLKTLRNSKGKLIIIANNCPPLRKSEIEYYAMLAKVSVHHFHGNNVDLGTACGKYYRVCCLSIIDPGDSDIISTTPGTQ

SEQ ID NO: 44089 - protein, 423 aa, Sorghum bicolor
  Clone ID: SORBI-28MAY03-C18861_1.pep
PAAPGCPFPLPLSTCDDWATAAAAAALRQVLRSSSGPSPVISTQQIILSDTSIEESNIASMSSHIVDSSQDEVKKWAKFCSDFTASDGKQHALLDNLNKDLSQKSVILGDGLKLSAADNDVFATVHPFVIRVSDSELQKYTHVLRWMDYIQNTVGSGTTLQKINVVKSVFDPPSHPKKADKGDAESSSKKAISGQKTADKSNGSADSKKPAGETKPPENKENPTAAGNNKTSGEKKKDKEKSAGKTAEKAPEKVADKESECNISILNIQVGLIRKAWKHPSADSLLVEEIDLGDGNVRQVVSGLAKYCSPDDLTNRHVVLITNVKPGKLRDVMSAGLVLCASTEDHTAVEPLIPPEGAKIGERISFAGFDGKPEDVLNPKKKQLDKITPHLRTDENGIATFKGVPFTTSAGPCRSSIRNGNVK

SEQ ID NO: 44090 - protein, 347 aa, Sorghum bicolor
  Clone ID: SORBI-28MAY03-C24383_1.pep
MAMALSGYPATTPLQLVLFSLLLLASSAAALPVPERPAMDRVRWQVDRVNRRGSSLGLVMSYVDEATALQASGYFTPWHVLPFVDLYGRRYHIGSIRGVNVIYALTGQRRLNAAVTVQTLIDVFSVSGIVHYGTAGSSNDSMSFGDVSVPKLVAYTGAWTWKKFKSPKESSAELSFGEYNIPNGGGNLLGSLKYRNEELYSVGKPMEEVFWLPVDSAWFRIAEQLKVKLERCNDTFCLPTTPQVVYGLKGSSADMFLDNAEYRKFLFREFGVSTVDEESAAVVMTTTSPGIPVIVFRGVSDLAGGEPTWSSTSLMNLASINALKVAVEFIATVGKQKSSVSVQRSNN

SEQ ID NO: 44091 - protein, 225 aa, Sorghum bicolor
  Clone ID: SORBI-28MAY03-C2450_1.pep
ALEGVNTSLSGVPSYHVPDPSDGAPKSNEVLPQSNELPVTLNPLPVTSNPSGRAWPLRAPVRDGRVPSWQELAASVPRGIPCMSDEVATAWLNNDNVRSAIHAEPVSSIGPWQLFTEIDFDHDAGSMIIYHKNLTSQGYRALIYSGDHDMCVPHTGTEAWTASLGYGIIDSWRQWIVNEQVAGYTQGYENGLTFATIKGSGHTVPEYKPQESLAFYSRWLNGTKL

SEQ ID NO: 44092 - protein, 336 aa, Sorghum bicolor
  Clone ID: SORBI-28MAY03-C24644_1.pep
MAEQLVSTAEHDTLPDSYVRPETQRPRLREVVPDAEIPVVDLAVPDRAAVVARVAEACRTHGFFQVVNHGVAEELTAAMLAVAYEFFRLPAEEKAKLYSDDPGKKMRLSTSFNVRKETVHNWRDYLRLHCHPLEQYVPDWPDNPPSFRETVSAYCREVRALGFRLYGAISEGLDLDGVYIKETLGEQEQHMAVNFYPRCPAPELTYGLPAHTDPNALTILLMDQQVAGLQVLKDGRWIAVNPRPGALVVNLGDQLQALSNGRYKSVWHRAVVNSDRPRMSVASFLCPCNDVRIGPAAKLVTGDTPAVYRDYTYAEYYAKFWSRNLDQEHCLELFRT

SEQ ID NO: 44093 - protein, 147 aa, Sorghum bicolor
  Clone ID: SORBI-28MAY03-C24699_1.pep
MEFGVASHGAVLAAAPLVARPTWLLLSPPPPASCIQIQNRLYSISSLPLKAGPVRACRASLASSYTQTTETVDLDWENLGFGIVQTDYMYIAKCGTDGNFSEGELVPFGPIALSPSSGVLNYGQGLFEGLKAYRKTDGSILLFRPEE

SEQ ID NO: 44094 - protein, 237 aa, Sorghum bicolor
  unsure (1)..(237): unsure at all Xaa locations
  Clone ID: SORBI-28MAY03-C24700_1.pep
MGAGCRALRQSRVFLVAGRRSRGPSSFGWLPASFVRPLMVGPGIILSIKDDGSAVIAANSTFFGLRDMLQGTSLLLFVSAKNLLFXAAFESAEGFYIFDAKPRENGYIKAVRFETQSVQVGDPVDSFVFPREGYITPTGYCRGSVTGVCSRVLFHDCPMHEYAYLGSPLFNLSGDLVGITYLDQRHWQAWTVWQLRDTFKHWKSTFVSQGNEEPAGAEAQVEEPAGAEAQVEEPAEG

SEQ ID NO: 44095 - protein, 84 aa, Sorghum bicolor
  Clone ID: SORBI-28MAY03-C20171_1.pep
MADIALLVTEQFEKEVKRGAGAGGDNGSGSGGERRNFGAVAKVWSSWVESATTAASGVRVSVAAVHLEPKTALALAAADGLFSA

SEQ ID NO: 44096 - protein, 220 aa, Sorghum bicolor
  Clone ID: SORBI-28MAY03-C20451_1.pep
MASATGGSSSEMAVDHPTGPGAVEKPQFDALMPSEMSGGRPQFRKVTVPQHRFAPLKRCWMEIYTPVYEHMKIDIRMNLKARRVELKTRQDTPDVSNLQKCADFVHAFMLGFDIADAVALLRLDDLYVDSFEIKDVKTLRGEHLSRAIGRLSGKGGKTKYAIENSTRTRIVIADTKIHILGSFVNIKVARDSLCSLILGSPAGKVYSKLRAVSARLAERY

SEQ ID NO: 44097 - protein, 226 aa, Sorghum bicolor
  unsure (1)..(226): unsure at all Xaa locations
  Clone ID: SORBI-28MAY03-C20537_1.pep
MASPTAGDAPLAAPAPAADATDAALAAAAAVPDPDAEFGFQRPELGKEKLVGTVGFHERHVFLCYKGPDVWPSHLEAAESDRLPRLLAAAIKARKPNLKKTIKLTICEGEDGTESSNGDVLIFPDMIRYKGLTHFDVDNFVEEVLVKDIDWLPGSPEPMSGSYVFVCSHGSRDKRCGVCGPELIKRFKEEINGLGLDGKVSVSACSHXGGHKYAGNVIIFSSVAKE

SEQ ID NO: 44098 - protein, 172 aa, Sorghum bicolor
  Clone ID: SORBI-28MAY03-C21007_1.pep
MSFNQSTVKGQTRRERPRARPHGLTQQKRQEIKEAFDLFDTDNSGTIDAKELNVAMRALGFEMTEEQIRQMIADVDKDGSGAIDYEEFEHMMTAKIGERDSKEELTKAFRIIDQDGNGKISNIDIQRIAKELGVNLTLDEIQDMVQEADRNGDGEIDFDEFIRMMRRTSYGY

SEQ ID NO: 44099 - protein, 51 aa, Sorghum bicolor
  Clone ID: LIB5052-012-A1-XP1-B2.pep
MLKKETVAKELGVNLTLDEIQDMVQEADRNGDGEIDFDEFIRMMRRTSYGY

SEQ ID NO: 44100 - protein, 380 aa, Sorghum bicolor
  Clone ID: SORBI-28MAY03-C2209_1.pep
ARGQSSVSHSSSSSAPVFVVDSGNGYQSSGAHSNPLFLTHRLPLLQFLLSIQAMADEVQQLTRAFSGLGGLGVDEPTMVSALARWRKQPEKRSGFRKGFPGFFKSHGEIDRCEDEYMLHLAAEFARFKNLMVLWAMHPWERDARLAHHVLHQQHPPAIVVEVACTRSADELLGTRRAYQALFHHSLEEDVAYRARDKPYCSLLVGLVSAYRYEGPRVNEEVAKAEAKALGAAVKSAAAAGGGGKKLVENEEVVRILTTRSKPHLVETFKYYKEMHGRHVEEDLSQSSGEEETTTLLETVLCLAAPAKYFSQVMEGALRDGADHHGKEALTRVAVTRSDHDMDDIRAAYHQQFGAKLEDAIAAKAHGHYRDALLSLVGAGK

SEQ ID NO: 44101 - protein, 119 aa, Sorghum bicolor
  Clone ID: SORBI-28MAY03-C21144_1.pep
ADANNFANANANANPWFMGTGVPLANARWGNYAFSAAFGGLFPMLSFQVHGFPDAAAYAQPAGFHYGYGHGHGFHGGHMGHTHGVHRQAPLGQQQQADIYLKALLFMIGILVIASLLAF

SEQ ID NO: 44102 - protein, 214 aa, Sorghum bicolor
  Clone ID: SORBI-28MAY03-C26515_1.pep
DTVKSPPAENKTMKKATLMGVTTTTAFYMLAGCLGYSAFGNAAPGNILTGFGFYEPYWLIDFANVCIVVHLVGAYQVFSQPIFAALETAAAKRWPNAKFVTREHPLVAGRFNVNMLRLTWRTAFVVVSTVLAIVMPFFNDILGFLGAIGFWPLTVYYPVEMYIRQRRIQKYTTRWVALQLLSFLCFLVSLASAVASIEGVTESLKHYVPFKTKS

SEQ ID NO: 44103 - protein, 289 aa, Sorghum bicolor
  Clone ID: SORBI-28MAY03-C26710_1.pep
ARGKNDLKNHNIPVVLHNKYVGKGMADNPMNSIFIPTRSPPRQSLIETVGITEEGVFIETSSGFGQSSESVHCHHGIMSAEIGQLSTIPPKQRTLEAAQKYAHNKLNLPKEVFHGGFILEKIDGPLSTGHLVLTDTDVRNNPAVTFNYFSHPQDLNHCVYGIKTIERILKTNRFSELSADGAGLSMERVLNMSVQANVNLIPKHTNDTESLEQFCKDTVITIWHYHGGCHVGKVVDQHYRVLGVSGLRVVDGSIFSRSPGTNPQATVMMMGRYMGVKILRERLGRAAGV

SEQ ID NO: 44104 - protein, 195 aa, Sorghum bicolor
  Clone ID: SORBI-28MAY03-C26711_1.pep
CTRPNEKKQFIPFASPPPVFAPSVEKTKTVPSPSLSPVKPTEPEPETFTKKIDEVTTPPVPPTDYMFTKQPEQVRTISPSESGANIDLDDVLSAAQTAAESAERAASAARAAANLAQLRIADLKKNSQVYNKYSDSALRESHHQTEGTQKPVFDHQDSFTNDTQDYVPSHVPQRSPSLEDDPYFSYPNLFSAPKP

SEQ ID NO: 44105 - protein, 205 aa, Sorghum bicolor
  Clone ID: SORBI-28MAY03-C26716_1.pep
MTSVDSSPPPPQHHLPTLLPLMPVTAVEDKGPAAGAATEELPAPVPSQVAAAATGSARPFAPRALRPGSAAWAASLVTVEEVTATWRDGEAPPSSAACVADDAPAFVSDQWGRVTWRNAAFVRAVPADDGGDEVETQTPVALSGALPAWGTCSGFTCRVRWHSSPRRVGSTSSVVAPCDVWRLDAGGSYLWRLDLQAALTLGGRL

SEQ ID NO: 44106 - protein, 191 aa, Sorghum bicolor
  Clone ID: SORBI-28MAY03-C27195_1.pep
HEASCRISFIHSLIPDIRRVLFLKIPEARKQLLMSELDRVAQDYKVHRDEIHSKLVQIMRERLLANLRKLPQIVEGWNGPEDNDVQPSPFAKAVTKEVTYLHRILSQTLLEVDVQIIFRQVVQIFHSHITEAFSKLEVSTPQAKNRLCRDVQHILACIRKLPAENFSSETIPNYGLLDEFLAENFGTKVGE

SEQ ID NO: 44107 - protein, 617 aa, Sorghum bicolor
  Clone ID: SORBI-28MAY03-C2705_1.pep
YALQKHPGSTGINEKQSGKPPLPINAVAELRKGSYYASLELVQALCDTSYGLVDIFPIEDRKIALRESLTEINSQIASAEKNGGVCFPMGKGIYRVVHIPEDESARLNSREKAPYLICVEVLKAEAPSHSKGSSDGHKLSKGGIPLANGDVQLPKPPPWAYPLWSRHDTQNYETDRMLKSTSQVIDQAMAQLWETKVKFVNVSFSIEKLGRSRSIALSETGRRLRHDAIDSHEPPGDSQTVADQPIEWVKVTLSAVPGVNMEDVDDNEPTRKKGPRRIPSTIAIEEVKAAALKGEAPPGLPLKGVGQSTQNLDPKATDGGDPKPTDALAGELWAVKRERIRRSSVHGKSPGWDLRSIIVKSGDDCRQEHLAVQLVAHFYDIYQEAGLPLWLRPYEVIVTSAYTALIETIPDTASIHSVKSRFPNISSLPRGYVAKYEENSPNFKLAQRNFVESMAGYSILCYLLQVKDRHNGNLLIDEEGHIIHIDFGFILSNSPGGVNFESAPFKLTRELLEVMDSDAEGTPSEFFDYFKVLCIQGFLTCRKHAERIILLVEMLQDSGFPCFKGGPRRPQNLRKRFHLSLTEEQCVSLVLSLISSSMDAWRTRQYDYYQRVLNGIL

SEQ ID NO: 44108 - protein, 239 aa, Sorghum bicolor
  Clone ID: SORBI-28MAY03-C23041_1.pep
MAAVDTATKEMEALHVGQNEETKADLINEGKTANSNGVVPAAQSSQPEDDDEAQADDPSQDGAQEAAKKKKKKNKSKKKKGPLQQTDPPSIPVDELFPSGEFPEGDIQQYKDDNLWRTTSEEKRELERLQKPIYNSVRRAAEVHRQVRKYMRSIIKPGMLMIDLCETLENMVRKLIKENGLQAGIAFPTGCSLNWVAAHWTPNAGDKTVLQYDDVMKLDFGTHIDGYIVDCAFTVAFNP

SEQ ID NO: 44109 - protein, 57 aa, Sorghum bicolor
  unsure (1)..(57): unsure at all Xaa locations
  Clone ID: SORBI-28MAY03-C227_2.pep
SANFSXXDWEKELHAPVPGGMTAAWHPTQVGNQAIFCGIQTKNKGCQPDVRAYTAVL

SEQ ID NO: 44110 - protein, 228 aa, Sorghum bicolor
  Clone ID: SORBI-28MAY03-C227_1.pep
RELERNLAMKVEDGETADTFLVSGRGTLHLTILIENMRREGYEFMIGPPKVINKTGDGKLLEPYEIAAVEVPEESMGSVVELLGKRRGQMVDMEADGPEGTTLLKYKIPTRGLIGLRNAVLTASRGRAILNTIFDSYGPWAGDLSSRDQGSLVAFEDGSTTSYALLNAQERGVLFVQPGQDVYKGQIVGIHQRPGDLAINVCKKKAATNVRSNKETTVVLDEALLQFG

SEQ ID NO: 44111 - protein, 214 aa, Sorghum bicolor
  Clone ID: SORBI-28MAY03-C2367_1.pep
MAAPPARARADYDYLIKLLLIGDSGVGKSCLLLRFSDGSFTTSFITTIGIDFKIRTVELDGKRIKLQIWDTAGQERFRTITTAYYRGAMGILLVYDVTDESSFNNIRNWIRNIEQHASDNVNKILVGNKADMDESKRAVPTSKGQALADEYGIKFFETSAKTNLNVEQVFFSIARDIKQRLAESDSKPEDRTISINRPEGGEASASQKSACCGS

SEQ ID NO: 44112 - protein, 116 aa, Sorghum bicolor
  Clone ID: LIB3481-007-Q6-K1-H6.pep
MAAPPARARADYDYLIKLLLIGDSGVGKSCLLLRFSDGSFTTSFITTIGIDFKIRTVELDGKRIKLQIWDTAGQERFRTITTAYYRGAMGILLVYDVTDESSFNNIRNWIRNIEQH

SEQ ID NO: 44113 - protein, 177 aa, Sorghum bicolor
  Clone ID: SORBI-28MAY03-C24079_1.pep
YLHLKLYARHGGRASNGSSGVLEELKMCAPGGDRMAWTDKLSPSQGCSTVVGLQNSPLGWGRVGERSVSHLRRWSSRSRRSSPSEMAFWISSNHLGQRRPAGRGGPRPPAAGEQGRSAPRLAVVRPRGRSDAGGPRREWGKPAGAAGGQQAVGVRRAAGCQRRRPRALEEAGVCGLV

SEQ ID NO: 44114 - protein, 190 aa, Sorghum bicolor
  Clone ID: SORBI-28MAY03-C23885_1.pep
TRPKRTTSPGTAVPGHPQSYGVVGWPPIRTFRMNSLFNQAKENASEAGTKKPTVESDMQEDKEESKKGRVVGWVKVNMEGDIIGRKVDLNAHRSYKTLASALELMFMKPSISLCTSSSSKSLKLLDNSSEYQLTYEDRDGDWMLVGDVPWEMFVGSVKRLKIMRTSDANGLGPRFQGPHKPTAACTRGRI

SEQ ID NO: 44115 - protein, 187 aa, Sorghum bicolor
  unsure (1)..(187): unsure at all Xaa locations
  Clone ID: SORBI-28MAY03-C24117_1.pep
HVRAAAAPQPAATNAPHLHLLPVKEHQIVEQLVPGLKDEVMNTTPVQRTRFKAFVVVGXGDGHVGLGVKCAKEVATAIRGAIILAKLSVVPLRVPVRRGYWGNKXGQPHTVPCKVTVKCGSVTVRMVPVPRGXSGIVAAYVPKKVLQFAGIEDVFTSSRRFTKTLGNLVKVRNLEHKIKGEGTCSGT

SEQ ID NO: 44116 - protein, 218 aa, Sorghum bicolor
  Clone ID: SORBI-28MAY03-C27911_1.pep
MVKLTMIARVTDGLPLAEGLDDGRDLKDADFYKQQAKLLFKNLSKGHHEASRMSIETGPYYFHYIIEGRVCYLTMCDRSYPKKLAFQYLEDLKNEFERVNGNQIETAARPYAFIKFDTFIQKTKKLYLDTRTQRNLAKLNDELYEVHQIMTRNVQEVLGVGEKLDQVSEMSSRLTSDTRIYADKAKDLNRQALIRKYAPVAIVIGVVLMLFWLKNKIW

SEQ ID NO: 44117 - protein, 238 aa, Sorghum bicolor
  Clone ID: SORBI-28MAY03-C2794_1.pep
KKKNSSAPDRAHCTCGVCHAPRHSPATLISPLSPVDGGRSWQQRNKMSNRATHWCYACRRPIRLRGQDIICPNCNDGFIQKISEMGGRLNTYGLIEPDFEERRARRFGMMDAMSSLMRQRMEEMVEDSLFDIHGRQGAGTEYRRRPTAVPTLVFGGIPSPGVGSSDVNVVLRGGRRVGTAHPNFSSLVVGPSLEALFEQLFIQNNRQGPAPAPQSAIDSMPVVKINRRHLDDDPQCAV

SEQ ID NO: 44118 - protein, 137 aa, Sorghum bicolor
  Clone ID: SORBI-28MAY03-C28264_1.pep
DSVVHFLKCFPCVEKLYVTSHTQKNMKNAQSYDPLNPIECLELHLKKVVINNYHGMRPDVDFAKFFVLNAKMLREMIFGVTNYCSDKWMSNQRRRLQLDNKASQGAQFAFGRDYSMSITRSPKADDPFEYMEPGKFP

SEQ ID NO: 44119 - protein, 192 aa, Sorghum bicolor
  Clone ID: SORBI-28MAY03-C28684_1.pep
EEEKLGQSSSFKIRDLNLVGSPEVADMRGDPRLGQNSTAGCSVGLQDNQQVDFGTAFGNNPSNTDTCAPFLLGNKAVQVIDIEDDSPNEAGACDTSKSKGEMVYSSMEGMMNPPANTDALHGIQDGYGLAISDYLGADMSCYQSMQTELQDGMDLNGSEGITVMDDPIYSSLGDIGFMEVWDQQPQDYEKFF

SEQ ID NO: 44120 - protein, 157 aa, Sorghum bicolor
  Clone ID: SORBI-28MAY03-C25320_1.pep
KTVDSAVKVVETALALQEAGCFSVVLECVPAPVAAAATSALKIPTIGIGAGPFCSGQVLVYHDLLGMLRHPHHAKVTPKFCKQFGNVGDVINKALSEYKQEVETHSFPGPSHTPYKITPTDVDGFANALQKMGLSDAADAAAAAAENRENGGEPKGK

SEQ ID NO: 44121 - protein, 169 aa, Sorghum bicolor
  Clone ID: SORBI-28MAY03-C25483_1.pep
MQGATTAKQARNGDRGAAKTTEGKGDAATGAKVGTDVAKSDAARAVDVGKGDATGNKAGGANMHHHGMSAVEAKDSQTIVALQAPVTAMRPVRGDLEEHLPKPYLARALAAPDIYHPDGTADDEHMHHHMSVLQQHVAFFDRDDNGIIYPWETYSGCRALGFNMIMSFF

SEQ ID NO: 44122 - protein, 182 aa, Sorghum bicolor
  Clone ID: SORBI-28MAY03-C25977_1.pep
VDDAEFEENEVYAIDIVTSTGEGKPKLLDEKQTTIYKRAVDKNYHLKMKASRFIFSEISQKFPIMPFTARALEEKRARLGLVECMNHELLQPYPVLHEKPGDLVAHIKFTVLLMPNGSDKITSHPLQELKPTKSIEDNAEIKAWLALGTKSKKKGGGKKKKGKKGDAAEADPMEATNGASQE

SEQ ID NO: 44123 - protein, 337 aa, Sorghum bicolor
  Clone ID: SORBI-28MAY03-C26014_1.pep
MAPEPEPRILELSNGKITARISNWGATITSLLVPDAQGSIADVVLGFDDLDPYVKGMSPYFGCIVGRVANRIKDGKFRLNEVEYSLPVNNGPNSLHGGLRGFDKVVWDVVDHKDGECPSITFQYHSKDGEEGYPGDVTIRATYSLPEAATLRLDMEATPENKATPISLAQHTYWNLAGHASGDILNHSIQIWGKHITPVDENTIPTGEIMPVNGTSFDFTTEHKIGERINDVPGGYDHNYMLDCGDEKNGLKHAAKLRDPSSLRTLELWTDAPGMQFYTANYVNDISGKGGAVYEKHAGVCLETQGFPNAINQPNFPSVVVRPGEKYKHTMLFEFSN

SEQ ID NO: 44124 - protein, 138 aa, Sorghum bicolor
  Clone ID: SORBI-28MAY03-C26006_1.pep
MVAPVPALLRRGRMDRHIEMSYCRFRALKVLAKNYLDVEEHELFGQIGQLLEETDMSPADVAENLMPMSKKKKKRDANVCLENLVEALKQAKEDAAKAKEKAEAAKKKAQEEDEAKKGKGQDEGDKTSESKMSNGHIK

SEQ ID NO: 44125 - protein, 149 aa, Sorghum bicolor
  Clone ID: SORBI-28MAY03-C29919_1.pep
TRTSSIKLRQLHSLRLLLHLSSIKLRQFHSLGPLRRRGCSESYGYSGSPSHRGNSGMKPSSPFAQSSGGSGSYGSGRLPTAQILPQAVPISSSSTSGSSGNRVPLDDVVEKVATMGFSREQVRAPVRRLTENGQNVDLNVVLDKLMNGR

SEQ ID NO: 44126 - protein, 462 aa, Sorghum bicolor
  Clone ID: SORBI-28MAY03-C30039_1.pep
TRIKNKKDQRLNDQRMFPRAIVRQPSATNGFLSGNIDNEVGRTQASSSFTSNSILRSLMGALEEIELHAHSETVRSGHSQMYLCLLREQQLHELIPFSRMTDEIDQDEGTACTLLKHMVLNLYEHVGVRMHRLSVCHWEVKLWLVCDGQASGAWRVVVTNVTGHTCTIDIYREVEDPSTHQLLYHSATATAGPLHGVALNEPYKPLDAIDLKRYAARKNETTYCYDFPLAFETALKRLWKSSSYGVSEANERNQLYAEVKELIFVDSDGAWGTPLVSFERPPGINDIGIVAWNMKLSTPEFPSGREIIVVANDVTFKAGSFGPREDAFFDAVTNLACERKLPLIYLAATAGARLGVAEEIKSCFHVGWSDDESPERGFQYIYLTTQDYSRLSSSVIAHELQLENGETRWVVDTIVGKEDGLGCENLHGSGAIASAYSKAYKETFTLTFVTGRAVGIGAYLAR

SEQ ID NO: 44127 - protein, 185 aa, Sorghum bicolor
  Clone ID: SORBI-28MAY03-C30066_1.pep
MAFFRGLTAVSRLRSRMAQEATTLGGVRWLQMQSTSDLDLKSQLQELIPEQQDRLKKLKSEHGKVQLGNITVDMVLGGMRGMTGMLWETSLLDPEEGIRFRGLSIPECQKVLPTAVKGGEPLPEGLLWLLLTGKVPTKEQVDALSKELLARSTVPAHVYKAIDALPVTAHPMTQFTTGVMALQVE

SEQ ID NO: 44128 - protein, 391 aa, Sorghum bicolor
  Clone ID: SORBI-28MAY03-C30330_1.pep
MLESRRRGLLLVRQPTSRVLARPYLHPARLFLQHFAADAMGEGSSAGKDAKGKGKGKAKAPAADSLLVARDDSYLEAVTQKRIRLFEEIQARQAVERLNIGGEVIKVTLPDGAIKEGKKWITTPMDIAKEISSGFASSCLIAQVDETLWDMGRPLESDCKLQMFKFDTNEGRDTFWHSSAHILGESIERAYGCKLCIGPCTTRGEGFYYDAYYKDQTLNEEHFGIIESQAKKAVAEKQPFERIEVSRAEALEMFAENEFKVEIINELPEDKTITVYRCGPLVDLCRGPHIPNTSFVKAFACLKASSSYWRGKVDRESLQRVYGISFPDSRRLTEYKHFLEEAKKRDHRILGKAQELFFFHELSPGSCFFLPHGARIYNKLMDFMRQQYRAR

SEQ ID NO: 44129 - protein, 285 aa, Sorghum bicolor
  Clone ID: SORBI-28MAY03-C30809_1.pep
MPVQVGGSKVADPRPARVLDLSPAAVVGDKARASAKKNHRRRHKKASSSPADAAASSISPMQRLFDTSREVFANSYPGFVPPPDAVARLSGILNELKPRGARVAPSMSVFKHADPKSPPPVTYLHFYDSSEFSFGIFCLPKSAVIPLHNHPGMTVFSKILFGSMHLKSYDWAKSLPDSNDNALQNSDGARLARVNTDAVFDASSETVVLYPENGGNLHCFTALTPCAVLDVMGPPYNRDEGRDCAYYGESPYSGSCGGDEQFSWLKEVHSTFEMQGIKMEQHFII

SEQ ID NO: 44130 - protein, 228 aa, Sorghum bicolor
  Clone ID: SORBI-28MAY03-C27455_1.pep
MASSAPGRGGRQLILPAAAVALMVIVGAEPAAACYPRVFSFGDSLTDTGNFRFYYGNNSGEPALRPPYGETFFRRATGRFSNGRLVLDFIADTMGLPFVRPYLSGRRAEDFACGANFAVGGATALGPDFFRSRGFDIGDGRVHLGLQMKWFHDLLELLCRSGRSGCSDMISQSLFIVGEIGGNDYNLPLLSRVPIEKIRSFTPSVVAKISSTITELIGLGAKNLVVPG

SEQ ID NO: 44131 - protein, 182 aa, Sorghum bicolor
  Clone ID: SORBI-28MAY03-C2782_1.pep
MAPQAWVVAENGEDLQRPREFVPLSELEDVGVLYWHLDPKKSESEEELAKIRKDRGYSYMDLIEICPDKLENYEEKVKNFFREHMHPDEEIRYCLEGSGYFDVRDKDDKWIRIWIKEGDMIILPAGIYHRFTLDSAKYTKLMRLFIGVPVWTAFNRPQEDHPARQEYVKNVSAGTGFALAAH

SEQ ID NO: 44132 - protein, 282 aa, Sorghum bicolor
  Clone ID: SORBI-28MAY03-C27832_1.pep
TTNPMPPHRAGGAAGGGDTSAFFAATLVLWAVSVGFEIGVRGRRELAPVAAGFAFFQAANAAVRGSVSRDPLFVNTAVSLLHSSLTSVSVIFVLVHQWRNKGFETMFEHEELFGGSWIGAYSALCFSCGYFAYDQLDMLRYRLYSGWIPGILMHHLILLICFTLALYRNVTINYLILSLVCELHSIFLHVRKVRRMVGFRDFHRTMVKLEWVLNWTTFVTARVICHILITYKLIADAHKFGKGIELPLALLGMAGMNLLNIFLGLDLLKAFTRERNQQNHQD

SEQ ID NO: 44133 - protein, 337 aa, Sorghum bicolor
  Clone ID: SORBI-28MAY03-C27883_1.pep
MSSSPTPAAGTAAAPHVVEDCLGFVQLLSDGTVRRSTDYSMLRPTGRVPSDSDLPVQWKDVVYDDAHGLRLRMYRPTNAGATKKKLPVLVYFHGGGFCLLSFEMTSFHAAALRLAAELPALVLSADYRLAPEHRLPAALDDAESVFSWLRAQAMADPWLAGSADFARVFVTGHSAGGNISHHVAVRLAGCVMLWPYFGGEEPTPSEAACPADQVMGPALFDQMWRLALPAGATKDHPFANPFAPGSVQLGDLGAAFPPVLVVDPDQDPLHDRVVDYVARLKAAGKDVELVVFAGQGQGHGFFATEPCGEAADELIQVIRRFVHGRLSDCQSRVDGSN

SEQ ID NO: 44134 - protein, 378 aa, Sorghum bicolor
  Clone ID: SORBI-28MAY03-C27820_1.pep
LLVLISGPGFQGQAPAPGPNPSGAQEILEAEAEGEKTMTTREPHEASRRDGRDPHGRRPHSSSRSRRDDPSPRRRRDDRRRESDRSHYRSRDEESAEVADHDQKRDRDTAQGDDPPNAESKSASDVKNGPSTRHERSPRGTKRFSESREASRPRSFFQHNERGSAGQGGRHYDRQASDYGRQRDHLSDREKQKTEGHSLQGKVELDQQKKDGDSTWKHDGFFQLEEEAPLAKKRPPFQEMKIQESAATVTEPDSRSRKLDQPGLTSAVREERRNYHARGFGNHRPFLRPDDRGFRRGFPDHRSDGQRNGYDSRGRFPGRGGMDRDRFNNPYGGRSNVEQASGDQEEKWKHDLYDQTNRSPPPKTEEEQIAKVEALLAL

SEQ ID NO: 44135 - protein, 185 aa, Sorghum bicolor
  Clone ID: SORBI-28MAY03-C332_1.pep
FGQRAPHRASTRDSSPVRRTLPSKQDKERSYDGDRAKSPPRKRRSRSSERDHDSERDRSDRDRGRYKDREHDRYARDHRDRDHHRSSYSDRDDERRGREKRDRDSDRNRHSSSRRSRSRSPVRGRTDGDKHRSSPFGRAPESSNLAKLKDLYGDATNTKNDAGDDRAHRDSGTEEVIRLGGARWR

SEQ ID NO: 44136 - protein, 192 aa, Sorghum bicolor
  Clone ID: SORBI-28MAY03-C33209_1.pep
MDKKKVAVPTVCHGHSRPVVDLFYSPVTPDGYFLISASKDSNPMLRNGETGDWIGTFQGHKGAVWSACLDTNALRAASGSADFSAKIWDALTGDVLHSFEHKHIVRACAFSEDTHMLLTGGFEKILRIYDLNRPDATPREIDKSPGSVRTVTWLHSDQTILSSCADLGGVRLWDVRSGKIVQTLETKSPVTS

SEQ ID NO: 44137 - protein, 586 aa, Sorghum bicolor
  unsure (1)..(586): unsure at all Xaa locations
  Clone ID: SORBI-28MAY03-C33298_1.pep
MVHETRSRVHAVAQEEGKVASKKQKSENEDQERGQHVPSKNKKPVDNKGQDGESEAPTKSKKLKADESEPNGREAAARDFAEFCKALGEHLSLDDMRNILEANEQDASGSEDAVVLRCEDMMFYGPLEKCPVCGGQLEFKGWKYRCTGNYSEWARCTFSSNDPSRRSGPIEVPDDIKDDFIRKWLKQHERGEFPKRDVDEEAHIFSGMMIALSGRMSRSHGYFKEQIMKHGGKVNNSVLGVTCVVASPAERDKGGSGGFAEALERGTPIVSENWIIDSIEKKEVQPLAAYDIVSDVVPEGRGLPLGQLDPSEEAIETLAAEVKLAGKRSVHKDSKLXKDGGCVFEKDGSTCNCAFAVCDLGCQMNELCIMQLIMVPENRLHLFYKKGPIGHDQMARGRVEDFGSRINDAIKEFVRLFEEVTGNEFEPWERQKKFEKKSMKMYPLDMDVGVDVRHGGAALRQLGSAAAHCKLDPSVSFLVKQLCGQEIYRYALMEMAQDLPDLPIGMLTDLHLKRGEDMLLQIRGDAESVAESGPEADAFWTEVSSKWFTLFPTTRPYTMRGFEQIADXSSGFETVRDINDASHLIG

SEQ ID NO: 44138 - protein, 251 aa, Sorghum bicolor
  unsure (1)..(251): unsure at all Xaa locations
  Clone ID: SORBI-28MAY03-C34192_1.pep
LDLGPGRPVRLPPRTPRLDPSAGGALLALIRRAEPPPPLPRSSSHSSQLPAPLAGLQPPASASGDVTSNYSLRCPPPTSAPSPSLLGLLHNSMPSRQDHPISSTNGGPYDGGKPAIPKLNATCSLQSNPPLGPIVFGLLHQCCHERVPLALAMHPXGTCKSVTVSXLFSYLRGWGSRAMSGFGHGMRTAMANNPMAMGARMGMNHGAHALSQLGQLPQQQQQQHDIGNQLLGGFRSANGFNNIQYDWKPSQ

SEQ ID NO: 44139 - protein, 407 aa, Sorghum bicolor
  Clone ID: SORBI-28MAY03-C3450_1.pep
MRGLLACASTLARRATAPARVRHLAGAAEAAEAELKKTALYDFHVAHGGKMVPFAGWSMPIQYRDSIMDSTVNCRANGGLFGAAHMCGLSLRGRDAIPFLESLVIADVAALRDGTGTLTVFTNDKGGAIDDSVVTKVTDHHIYLVVNAGCRDKDLAHIEEHMEAFNKKGGDVKWHIHDERSLLALQGPLAAPTLQLLTKEDLSKMYFSDFKLIDINGYSCFLTRTGYTGEDGFEISVPSENAVDLAKAILEKSEGKVRLTGLGARDSLRLEAGLCLYGNDMEQHITPVEAGLSWAIGKRRKSEGGFLGADVILKQLQEGPKIRRVGMITQGPPARSHSELVSSSGESIGEVTSGGFSPCLKKNIAMGYVKSGMHKAGTEFKVVVRGKSYDAVVTKMPFVPTKYYRPS

SEQ ID NO: 44140 - protein, 130 aa, Sorghum bicolor
  Clone ID: SORBI-28MAY03-C29477_1.pep
QKRAIRIASQIHCGVAAINDFASSYMCQSLPFGGVKDSGFGRFAGVEGLRACCLVKSVVEDRLWPYIKTVIPKPIQYPVSEHGFEFQQLLVETLYGYSMWDRLRSLVNLIKMVTEQNSASVSNATTKKRR

SEQ ID NO: 44141 - protein, 85 aa, Sorghum bicolor
  Clone ID: SORBI-28MAY03-C29023_1.pep
TKSTYITHINHNKGVQQVHHTTTRPTHANTMKHPIWCTKPTCIINQELHHASCIIYQHDVHCLISRKLNPNVRAFLCTKLCSSSI

SEQ ID NO: 44142 - protein, 244 aa, Sorghum bicolor
  Clone ID: SORBI-28MAY03-C29612_1.pep
HEDCEEAEEESNRNLLEQARLLEEEDEDLCDTEEAKIAFRAVKVKFAALYRSLAGTKPVFIYDPPSDTIEEHLTAKEMERQADISGWPVCSQAQHFATLALEWYNSTKKTHKFEIAKVLFSKCFTDVDHNTYAHVNFTATPTSDSHLPKRLFFAELMLVPNLQACKDTDPIRVLSVSAIDDSCFGGCHEMVRDIKVAIRKDMDYERCHACSERIKHPRGDQFVAGHNRTRMPYVSTFPWTPESE

SEQ ID NO: 44143 - protein, 133 aa, Sorghum bicolor
  Clone ID: SORBI-28MAY03-C29688_1.pep
SMRGRCGCWPGDASPAPGPAGHVHSYERSPRVSNVAYDIVNGEATPVRDAGAPVYVTIGDGGNIEGVADNFTRPQPSYSAFREASFGHATLEIKNRTHAYYSWHRNHDGAKVVADGVWLTNRYWMPTTDDDTN

SEQ ID NO: 44144 - protein, 133 aa, Sorghum bicolor
  Clone ID: SORBI-28MAY03-C29819_1.pep
MLTSVPPLLCPPLPPFPHPSAMQGSQSQMMPQMPQHMMGLNQMHPGSVPPGTVPPMGGFPSGMGNIQGASGSSGIQNFPMGGMYNRPQGQMAPQGQMTSIPGLSSYQGMGNVGLTPPPPPPQHPPPRGGSAHQ

SEQ ID NO: 44145 - protein, 210 aa, Sorghum bicolor
  Clone ID: SORBI-28MAY03-C2982_1.pep
REGGCAWMESFVEGDPPTGGSVPTRAGCSIRQPAKLSAFTRSPRSRLPRGGSALRGTVREATVDPIMEPPQPTVDSLARRPRVPSVLPAMLSPRAREPRALRVRVRAGHPVTYQEVTEDPNIEPPEVSVDRLMMRQQVRSFLAGMLSPREKEIIEHRFGIHDGQPKTLHVIGDMYGLSKERIRQVQNKALDKLKNTISAQGFHVYFDLLT

SEQ ID NO: 44146 - protein, 401 aa, Sorghum bicolor
  Clone ID: SORBI-28MAY03-C36006_1.pep
YDKLDISDEGTEQVELVHVQLKRAKERVDMPDDEFYHELLSLYNKSHDPSAELDTLGRLSEKLHLTTITDLTQESLALHEMVASGGGNDPGEHIEKMSMLWNKIKDFVQTQNPGTRPPVTTKVMDSNGEPRPINIPDEFRCPISLELMKDPVIVATGQTYERAFIEKWIASGHHTCPNTQQRMPNTTLTPNYVLRSLIAQWCEANGIDPPKRPTEADKPTSSCSPSERAIIDALLSKLCSADPEEQRSAAAELRLLAKRNANNRICIAEAGAIPLLLSLLSSSDLQTQEHAVTALLNLSIHEDNKSSIILSGAVPGIVHVLKNGSMQARENAAATLFSLSVVDEYKVTIGGTGAIPALVVLLSEGSPRGMKDAAAALFNLCIYQGNKGRAIRAGLVPLIMG

SEQ ID NO: 44147 - protein, 543 aa, Sorghum bicolor
  Clone ID: SORBI-28MAY03-C36080_1.pep
MEAMTGGKFLEKFRLYETRSKFYLIGRDKSRIHWRVLKIDRLESTELGVEEDPTIYTEDECQELLCRIHVGNMLTGGLKFVTKCYGIVGFVKFLGPYYMVIITRRRKIGTICGHEIYSVGKSEMIAIPSVIVWPNVAYSRDENRYKRLLCSVDLSKDFFFSYSYNIMRSLQKNISEKNTGQVVYETMCVWNEFLTRAIRNHLKNTCWTVALVHGFFKQSKLSVSGKDFWLTLIARRSRHFAGTRFLKRGVNEKGRVANDVETEQIVFEDTSDGIPTQIASVVQHRGSIPLVWFQETSRLNIRPDIILKPDVDYKATRLHFENLALRYGNPIIILNLIKTREKKPRESLLRAEFAKAIHYINKSLPDDKRLKFLHMDLSKLSRRKGTNVLALLNKVASDVLDLTEFLHCEISTSTKPDDTSSGEETVGRPLDDRSSRDQTECAAKLAPLLLQKGVLRTNCIDCLDRTNVAQFAYGLVALGRQLHVLGLIEAQKIELHDPLADDLMDFYERMGDTLAIQYGGSAAHNKIFCEQRGQWKAATQSQE

SEQ ID NO: 44148 - protein, 277 aa, Sorghum bicolor
  Clone ID: SORBI-28MAY03-C3619_1.pep
MAGQPPPPGGSEDDFLEHFFAFPSAASAAAGGHAGAGAGGDHPFPLALSLDAAAEPKPDRDPVQLAGLFPPVFAGAGGVQQPHLRGPPPPQMFQAQPKPGEGGMAPQPPAPRPKVRARRGQATDPHSIAERLRRERIAERMRALQELVPNTNKTDRAAMLDEILDYVKFLRLQVKVLSMSRLGGAGAVAQLVADIPLSVKGEASDSGSTQHIWEKWSTDGTEKQVAKLMEEDIGAAMQFLQSKALCMMPISLAMAIYDTQHSQDGHSLMKPEPNTSS

SEQ ID NO: 44149 - protein, 138 aa, Sorghum bicolor
  Clone ID: SORBI-28MAY03-C36347_1.pep
ALKKGEDAGLALAKKVYAYIHRNGYKTKLMVAAIRNKQDVFSLLGIDYIIAPLKILQSLEESVTDPDVKYGYVPKLTPAIGKTYNFTEEELVKWDQLSLSAAMGPAAEELLASGLEGYVNQARRVEELFGKIWPPPNV

SEQ ID NO: 44150 - protein, 165 aa, Sorghum bicolor
  Clone ID: SORBI-28MAY03-C67702_1.pep
DGDVNTGGTGGSKNKLFLDMQALKAKISGLASNLSAEAGGKGADKKNLTDQRDLFQRILDFVKYGDCPEESIKIAGKRDVLRVSSWSELIQLNFLKRFLGKGFLKHVQENGLLQDIFDIKVDKAETLSSTDKKIFRSEEEKERALKLNKERRLAQVRKNAVMLDD

SEQ ID NO: 44151 - protein, 165 aa, Sorghum bicolor
  Clone ID: SORBI-28MAY03-C1846_1.pep
MDGLVGLLKVRVVRGINLAYRDARGSDPYVVLRLGKKKLKTSVKKRSVNPIWHEELTLTVTDPSQPLKLEVFDKDTFSRDDPMGDAEIDVAPLIEAVNMNPEEIRNGAIIRSVRPSTKNCLADESHVCWRNGKFVQDMILRLKNVESGEIQLQLQWVNISPVAAR

SEQ ID NO: 44152 - protein, 232 aa, Sorghum bicolor
  Clone ID: SORBI-28MAY03-C18303_1.pep
MASLQNLICSVSKQLVVPNCAVTAKPNGAPPSVVAASSKEGSLNDSKVTKRRLALFGAGALATGLLKTGSAFAEEVPKNYKSYVDAKDGYSYLYPAEWRDFDFLGHDSAFKDKNFALQCVRVGFIPTEKTDVRDLGPMDEAIFNLVNNVYAAPNQIPSVYDMQERTVDGKNYWTFEYDLEAPGYGVSAFATVAIGNGRYYTLIVTANERRWSRLRNKLKVVADSFKISDLTA

SEQ ID NO: 44153 - protein, 164 aa, Sorghum bicolor
  Clone ID: SORBI-28MAY03-C18668_1.pep
RAGEVRLSFIVNARGRPDIPLLEGFYGNAFAYSVAAATAGELCGGDLGFALELVKKAKSAVTYDYLVSVADLMVLTGRPLFEVSRTYIVSDISHAGFKSIDFGWGEAVYGGPAKGGEGPLPGVTNYFSRAKNGKGEEGTVVPICLPKDAMEKFQLEVEGLTAEL

SEQ ID NO: 44154 - protein, 183 aa, Sorghum bicolor
  unsure (1)..(183): unsure at all Xaa locations
  Clone ID: SORBI-28MAY03-C1820_1.pep
MADFSKESCPSVKNILLLDSEGKRVAVKYFSDDWPTNASKLAYEKSVFTKTLKTNARAEAEITLFDGYIVVYKFVHDLHFFXVTAGDDENELILASVLHGFSDSVGLLLRGDVEKRTALENLDLILLCIDEIVDGGIILETDANTIAGKVATNAVDGSVPFSEQTISQALATAREHLARSLLK

SEQ ID NO: 44155 - protein, 40 aa, Sorghum bicolor
  Clone ID: LIB3480-026-P1-K1-A5.pep
MQYHWKVATNAVDGSVPFSEQTISQALATAREHLARSLLK

SEQ ID NO: 44156 - protein, 83 aa, Sorghum bicolor
  unsure (1)..(83): unsure at all Xaa locations
  Clone ID: LIB3476-003-Q6-K2-B5.pep
MADFSKESCPSVKNILLLDSEGKRVAVKYFSDDWPTNAGGVAYEKSVFTKTLKTNARXEAEITLFDGYIGVYKVGHDLYFFWR

SEQ ID NO: 44157 - protein, 225 aa, Sorghum bicolor
  Clone ID: SORBI-28MAY03-C188_1.pep
YRPYLGVGLGPLSFLTKLRIPHPGRVGGRFFIKYGMPAMLSWVLGGNSSKLEGRPLSCRLSDKANDQLYRWFEDDDALEQAMGGEWYLFPTSEGNSNSFQPIRLIRDEQRSLSVGSQSDPNDTDSSLSLPFPQISERHATITCKNKAFYLTDHGSEHGTWITDNEGRRYRVPPNFPVRFHPSDVIEFGSDKKAMFRVKVLNTLPYESARSGKQQGQQQQQVLQAA

SEQ ID NO: 44158 - protein, 179 aa, Sorghum bicolor
  Clone ID: SORBI-28MAY03-C18834_1.pep
MAAALLRRALHLRRVLPSPAVTAASAQRLAPTFSTTTPTPTTSQQSAATTTVDLSSDESRRRLLNRLVYRSKQRGFLELDLVLGTWVEQHVHGMDEANIRALLQVLDLENPDLWKWLTSQEQPPEDLNSNPVFAAIKSKVTDNLTKHASPETRSTPGQPWVRGWDDIKKGKDGPKYGNQ

SEQ ID NO: 44159 - protein, 272 aa, Sorghum bicolor
  Clone ID: SORBI-28MAY03-C37650_1.pep
MSGAVLVAIAASIGNLLQGWDNATIAGAVLYIKKEFQLQNEPTVEGLIVAMSLIGATIITTFSGPVSDWIGRRPMLILSSILYFLSSLIMLWSPNVYVLLLARLVDGFGIGLAVTLVPLYISETAPPEIRGLLNTLPQFSGSGGMFLSYCMVFGMSLLPSPDWRIMLGVLAIPSLFFFGLTIFYLPESPRWLVSKGRMAEAKKVLQKLRSKEDVSGELSLLVEGLEVGGDTSIEEYIIGPATDAADDHVTDGDKEQITLYGPEEGQSWIARP

SEQ ID NO: 44160 - protein, 388 aa, Sorghum bicolor
  Clone ID: SORBI-28MAY03-C3787_1.pep
ARGQDGVQLMDISSQILFNRVMAQLGLCAFRAGLINEAHGCLTELYSTGRVKELLAQGVQQSRYHEKTPEQERLERRRQMPYHMHINLELLEATHLICAMLIEVPNMAASTYDKRRPMSKTFRRLLEVSERQTFVGPPENVRDHVMAATRALNKGDHQKAFSVINSLEIWKLLRNRDHVLEMLKLKIKEEALRTYLFSYSSCYESLSLNQLTTMFDLSEQHAHSIVSKMMMHEELHASWGPPTKCIVFHSVDQTRLQGLLFQMADKLSVLVESNERAYEARTGGTLEGVPPRRRGDGQDSSNMGKWQENFVSSQGRQGGGNRFGYSGRGGGSGQSGGHQRDRGNQGSRGGYGGGSRFQDGRGRNQSGSSARGGDGGARMVNLNRVGRV

SEQ ID NO: 44161 - protein, 278 aa, Sorghum bicolor
  unsure (1)..(278): unsure at all Xaa locations
  Clone ID: SORBI-28MAY03-C38224_1.pep
MAAAGSSRDSALGPRIPRRARYFGLENFGNTCYCNSVLQALYFCVPFRDQLLEYYANNKNTGDVEENMVTWVAELFPPMSRXEKKTGVGAPKRFMHRWKIQDEIFRSYMHHDADEFLNFLLYDRVDNLEKECNAAREPLQNYSCKKNTDDTIEDHPNSSHTDLAAKRVHTCFQGLLTQISQAKKKTGVIAPKRFVQRVKKQNELFRSYMHQDAHEFLNFLLNELVDILEKESSAAKDSPQLSSPEKAPNGPVQPLANGVKKEPPVTLVHKNFQGILTN

SEQ ID NO: 44162 - protein, 283 aa, Sorghum bicolor
  Clone ID: SORBI-28MAY03-C38561_1.pep
HEGDIDLTNSLWTYQIGLKGEFSRIYSPEKQGSAGWSSMQNDDTLSPFTWFKTTFDAPEGNGPVAIDLGSMGKGQAWVNGHLIGRYWSLVAPESGCPSSCNYAGNYGDSKCRSNCGIATQSWYHIPREWLQESDNLLVLFEETGGDPSQISLEVHYTKTICSKISETYYPPLSAWSRAANGRPSVNTVAPELRLQCDEGHVISKITFASYGTPTGDCQNFSVGNCHASTTLDLVAEACEGKNRCAISVTNDVFGDPCRKVVKDLAVVAECSPPSANKEPRDDM

SEQ ID NO: 44163 - protein, 125 aa, Sorghum bicolor
  Clone ID: SORBI-28MAY03-C34554_1.pep
PGKKDGGGDKKDKGAGDGGDKKKDGGGEEKKDKAAAAAASVAPLPLADAAMYQMPPHYGYGAYPPAPGGYYGAAPRPPPNHAGGFYHPNAGVHYPPAPAYGYGGPSHLHAPQMFSDENPNACSVM

SEQ ID NO: 44164 - protein, 365 aa, Sorghum bicolor
  unsure (1)..(365): unsure at all Xaa locations
  Clone ID: SORBI-28MAY03-C35037_1.pep
SQTSSLGTFTVLSYLILADAYXLQVMHXSYXCPTXGXLTWTYXKTKXXLREIXWLXHADIICLQEVQVNHXEDFFSPELDKHGYQALYKKRTTEVYSGNPMAIDGCATFFRRDKFSHVKKYEVEFNKAAQSLTDAIIPAAQTRVALSRLIKDNIALIAVLEAKFGNHGAENPGKRQLLCVANTHINVHQDLKDVKLWEVHTLLKGLEKIAVSADIPMLVCGDFNSTPGSSPHALLAMGKVDQHHPDLAIDPLGILRPPSKLNHQLPLVSAYSAFARMVGVGYDLEHQRRRTDPATNEPLFTNCTRDFTGTFDYIFYTADSLTVDSLLELLDEESLRKDTALPSPEWSSDHIALLAEFRCKPRIRR

SEQ ID NO: 44165 - protein, 189 aa, Sorghum bicolor
  Clone ID: SORBI-28MAY03-C3536_1.pep
WKAADIEILNTFQLLSAKPVVYLVNMSEKDFQRKKNKFLPKIHAWVQEHGGETILPFSCAFEQKLVDMPEDEAAKYCAENQITSMIPKIIKTGFAAIHLIYFFTAGPDEVKCWQIRRQTKAPQAAGAIHTDFERGFICAEVMKFEDLKELGSESAVKAAGKYKQEGKTYVVQDGDIIFFKFNVSGGGKK

SEQ ID NO: 44166 - protein, 213 aa, Sorghum bicolor
  Clone ID: SORBI-28MAY03-C35604_1.pep
KNKSLDALQIFKHHDGVVEDVAWHLRHEYLFGSVGDDHHLLIWDLRSPAPTKPVQSVVAHQGEVNCLAFNPFNEWVVATGSTDKTVKLFDLRKIDTSLHTFHNHKEEVFQVGWSPKNETILASCCLGRRLMIWDLSRIDQEQTPEDAEDGPPELMFIHGGHTSKISDFSWNPCEDWVIASVAEDNILQIWQMAENIYHDEDDLPISDEPAKTS

SEQ ID NO: 44167 - protein, 224 aa, Sorghum bicolor
  Clone ID: SORBI-28MAY03-C3373_1.pep
MKFLEYTPFDSINLFLEQLNLGDCTIRGNLEAFSCKHTATDRRLSISLEHEILDYLGKSADSDPSSPVEHLSSRSSRKTLIYLVLTLGHIYPDYDFSAVRAHLFFQEEELESFKQMVDTYLSDASRQWAATNEGSSLLDSMTKAIDEVIKIRECDIYSYNPDSDADPVLEKGAIWSFNYFFYNRKLKRVVSFRCYCTSKLSGDDFLTGVASDGEEEDALIDMDI

SEQ ID NO: 44168 - protein, 320 aa, Sorghum bicolor
  Clone ID: SORBI-28MAY03-C3596_1.pep
ARGRHIYGQAIKVNWAYASTQREDTSGHFHIFVGDLSSEVNDATLYACFSAYPSCSDARVMWDNKTGRSRGYGFVSFRNQQEAETAITEMTGKWLGSRQIRCNWATKNNSEEKPETDNHNAVVLTNGSSSNSATDASQDGGSKENPENNPDCTTVYVGNLGHEVNRDELHRHFYSLGVGAIEEIRVQQDKGFGFVRYSTHGEAALAIQMGNGLVVRGKPIKCSWGNKPTPPGTSSKPLPPPVAPYQPAVAMPGVPQGFTAAELLAYQRQLALSQAAAGQIAGQHGLAGQVSAGLLAAAGSQALYDGYPNQSSAQQLMYYN

SEQ ID NO: 44169 - protein, 208 aa, Sorghum bicolor
  Clone ID: SORBI-28MAY03-C3599_1.pep
VRADEVITAFGRLGTMFGCDYYNIKPDLVSLAKALSNAYVPIGATLVSQEISDVIHSQSNKLGSFAHGFTYSGHPVACAVAIEALKLYRERDIPGHVKQIAPKFQDGIRARADSPIIGEIRGLGMIMGTEFTNNKSPTDLFPAEWGVGAIFGEECQKRGMLVRVAGDAIMMSPTLIMTPAEVDELVSIYGEALKATEERVAALKSKKN

SEQ ID NO: 44170 - protein, 346 aa, Sorghum bicolor
  Clone ID: SORBI-28MAY03-C42127_1.pep
MEALVVRRLGDPTLAPGGEASPFAAVSGDHPVPEISSPTAVRVRVAATSLNFATFLQVQGKYQERPPLPFVPGSDYSGVVDAVGPGVRGLRPGDRVCSFTGLGSFADFIVAEEKQLFLVPDGCDLVTAGALPVAFGTSHLALVHRAQLKAGQVLLVLGAAGGVGVSAVQIGKVCGAVVIAVARGAEKSEYLKSIGADHVVDSSKDNVVESAKSFLKARGLKGVDVLYDPVGGKLTQDSLKLLSWGAHILVIGFASGDVPVIRANIALVKNWTVHGLYWGSYLIHRPRVLIDSLNELLSWLSKGLIKVQISHCYRLVEAHLAFSALRDRKAVGKVMIVMGPSAVSRL

SEQ ID NO: 44171 - protein, 237 aa, Sorghum bicolor
  Clone ID: SORBI-28MAY03-C4214_1.pep
MALGGLGVRAAPFTYAAHALAVAAAAMVLVWAIQFRGGLAIEATNKNLIFNVHPVLMLIGYIIIGGEAIMVYRVLPTTNHDTTKLIHLILHGIALVLGAVGIYFAFKNHNESGIANLYSLHSWIGIGTITLYGIQWIIGFVTFFFPGAAPNVKKGVLPWHILFGLFVYILALANAELGFLEKLTFLESSGLDKYGTEAFLVNFTALVVVLFGASVVVAAIAPVRLEEPQGYAPIPEN

SEQ ID NO: 44172 - protein, 298 aa, Sorghum bicolor
  Clone ID: SORBI-28MAY03-C4246_1.pep
PRVRGRVGEIWNAMSTLTKSMCWKMVNKTKDKLNQVGMVIFQKPMDNICYEKRSENNPPLCKESDDADAAWNVPLEACMHKLPVGSKVRGSKWPEFWPQRLEKTPFWTDGSKVGVYGKPANEDFEADNAHWKRVVSKSYVNGMGIDWSKVRNVMDMRAVYGGFAAALRDQKVWVMNIVPIDSPDTLPIIYERGLFGMYHDWCESLSTYPRTYDLLHADHLFSKLTKRCKLMAVFAEVDRVLRPQGKLIVRDTADTINELESMAKSLQWEVRMTYTKGNEGLLCVEKSMWRPKELDAST

SEQ ID NO: 44173 - protein, 127 aa, Sorghum bicolor
  Clone ID: SORBI-28MAY03-C42465_1.pep
MEVRSEQGLMAGRDLFGMPKSPPAPVPGPPASAAMQSVRMAYTADGTAVYAPVSSSAATPSYQPQGPAHGTSMSAATVVGGNGASAVPGMGEPVAKKKRGRPRKYGPDGSMALALVPASAATGSPAT

SEQ ID NO: 44174 - protein, 147 aa, Sorghum bicolor
  unsure (1)..(147): unsure at all Xaa locations
  Clone ID: SORBI-28MAY03-C4265_1.pep
KHPAQIQSPLPVHKPHQPASPHSSTGRPRRRERERESDRXEAAAAAAGVELGSSKPQIATQAEMAEARVPLAYRDQCAHLLIPLNKCRVAEFYLPWKCEPERHAYEKCQYELVMERMLQMQKIREAQETKVKGGASIGLIPATAKLS

SEQ ID NO: 44175 - protein, 164 aa, Sorghum bicolor
  Clone ID: SORBI-28MAY03-C3629_1.pep
PRVRQRRTTDHEAMTNMKTEFMSLWDGFTTDQNARVMVLAATNRPSELDEAILRRFTQIFEIGIPVQSERSKILQVVLKGENVEKDIDYDHIARLWDQPTGSEDLEISKQATLDPMRALLGYGKNGRQLDKPRPLRQSYLERALSTSRKGKKVWKFRTAVTLGV

SEQ ID NO: 44176 - protein, 128 aa, Sorghum bicolor
  Clone ID: SORBI-28MAY03-C36790_1.pep
AQELFEKPFFQSVARALRPGGVVCTQAESIWLHMHIIEDIVVNCRQVFKGSVNYAWTTVPTYPSGVIGFMLCSTEGPAVDFQHPVFNIEEDEHSTKAKGPLKFYNSEIHTASFCLPSFAKRVIESKAN

SEQ ID NO: 44177 - protein, 186 aa, Sorghum bicolor
  Clone ID: SORBI-28MAY03-C37260_1.pep
TVYQLCKQAVSQARAGADVVSPSDMMDGRIGALRSALDAEGFHDVSIMSYTAKYASSFYGPFREALDSNPRFGDKKTYQMNPANYREALIETAADEAEGADILLVKPGLPYLDIIRLLRDNSALPIAAYQVSGEYSMIKAAGALGMVDEQKVMMESLMCLRRAGADVILTYFARHAAAVLCGIGPK

SEQ ID NO: 44178 - protein, 126 aa, Sorghum bicolor
  Clone ID: SORBI-28MAY03-C37335_1.pep
SNVIDLGTVAHAALSTVSVIIYFCCFVMGFGPIPNILCAEIFPTRVRGLCIAICALTFWIGDIIVTYSLPVMLNAIGLAGVFGIYAVVCLIAFVFVFLKVPETKGMPLEVITEFFAVGAKQAAAKA

SEQ ID NO: 44179 - protein, 226 aa, Sorghum bicolor
  Clone ID: SORBI-28MAY03-C37576_1.pep
MASTVSFSPANVQMLPARSGRGHAAFGSCSAVPRAGPRLRSTAVRVSSEQEAAAAVRAPSGRTIEECEADAVAGKFPAPPPLVRPKAPEGTPEIRPLDMAKRPRRNRKSPALRAAFQETSISPANFVLPLFIHEGEEDAPIGAMPGCYRLGWRHGLLDEVYKARDVGVNSFVLFPKVPDALKSPTGDEAYNDHGLVPRTIRLLKDKFPDIVIYTDVALDPYSSDGH

SEQ ID NO: 44180 - protein, 159 aa, Sorghum bicolor
  Clone ID: SORBI-28MAY03-C3651_1.pep
MEVQKRLHEQLEIQRKLQLRIEEQGKYLQMMFEKQSQSSTDKVQDPSSRDTVAKPTRPRDRRLQTRERDRGAPPREPGATGGRRPPLCAAGSRVPLPAASLPHRHRRQEAIVPPSFFPPPPHPSSTLSQSSNKDSGATMGPLPAAARPSPASRGVLLSR

SEQ ID NO: 44181 - protein, 249 aa, Sorghum bicolor
  unsure (1)..(249): unsure at all Xaa locations
  Clone ID: SORBI-28MAY03-C48121_1.pep
MPERVASLDVFRGFTVAMMILADDAGGAWPGINHSPWFGVTVADFVMPAFLFIIGVSAALVFKKMPNKTDATKKAAIRASKLFILGVILQGGYIHGRHKLTYGVDLDHIRWLGVLQRIAIGYFVAAMSEIWLVNNNLVDSPVSFVKKYFMEWFMAIAITVLYVALVFGLYVSNWEFQIQTSNSTLSIPSNSIESKMVQCGVRGSLGPPCNAVGLVDRVLLGEXHLYKNPVYKRTKECSINSPDYGPLPP

SEQ ID NO: 44182 - protein, 266 aa, Sorghum bicolor
  Clone ID: SORBI-28MAY03-C47665_1.pep
PICIERRNNKRQSRPANCSVDPDPLHEVVGWGPRAAPSQSWPSYPVGPARRHARTTPPFVAPAMGPTGTSCQILAHCRSVMTYALCLLDDFSLVLLPWPSMKIWPHPTRLHLHGENLGLFRPRSVGDTAAAGGSPAAPHGGGTGTGTLAVAEGVLVHEDLPAPALHAAERPVASVHVDVHALGELCVAQAAALQEGARGRRRDRRNPLRRLLLVVVAGAVDHEGGLADDLRRRRCLPLPAGVALAVGLQENAQPGHGASQKRPRAE

SEQ ID NO: 44183 - protein, 226 aa, Sorghum bicolor
  Clone ID: SORBI-28MAY03-C4831_1.pep
VYEETYKSLKSRGVRFPGRDNESLAPIFTPPRSVAEADVDSSLPQQAFEDIHVHTYTAEETKEAFDVARNSIELLSTVLSSSPEQDALQDDLTATLVQQCYQSQHTIQRIIETVGDNEAVLFEALSVNDEIQKVLSKYEEMKQPRASEHAEQRPVVIPIATEHEDSTAIGNEDALVRKPAAARARSGGDDDILDDLDEMIFGKKGGSSSQDGPKKPDPKKDDLISF

SEQ ID NO: 44184 - protein, 195 aa, Sorghum bicolor
  unsure (1)..(195): unsure at all Xaa locations
  Clone ID: SORBI-28MAY03-C49034_1.pep
TRLSRSLLRSFPCRLHVGGPRSSLPGKSPTTRPCPSPPATSLPXANPPPSSPTRLPPPGPCPGPPASSLPPRSPPSPPPPPTRAPPAPRAPPPPRPPPPXTTGPRPPATPPTPRLPPMQCYPNYSSLRCSAATPTHPXPSPRFPRHAPRSPGTGRPASXLPIPEGAPPPAPPPLSLPTHTPMQSLPSPCYPIFYL

SEQ ID NO: 44185 - protein, 163 aa, Sorghum bicolor
  Clone ID: SORBI-28MAY03-C38742_1.pep
IKESMLEGSRTRKGLSYAESHETKIHDSACSQERNPKDESDGHKDLDQQKNNTTKKDKPAAEPIVVPIVLRMSDFDHKALLEEWIATRAFRDNCIPQDHRKLINNLKLIQDYLCSFESQGLTIVDISANSFPQTLDWLHSYLLQCIERGLLAACSESCNQGGN

SEQ ID NO: 44186 - protein, 146 aa, Sorghum bicolor
  Clone ID: SORBI-28MAY03-C38904_1.pep
RCFLWLGGFRSSELLKLLVNQLEPLTEQQLMGLSNLQQSSQQAEDALSQGMEALQQSLAETLAGSLGPSGSSGNVANYMGQMAMAMGKLGTLENFLRQADNLRQQTLHQMQRILTIRQAARALLAIHDYFSRLRALSSLWLARPRE

SEQ ID NO: 44187 - protein, 257 aa, Sorghum bicolor
  Clone ID: SORBI-28MAY03-C39441_1.pep
MGISRPLAALVLALLIAVAGATAEEPVVEADSLAGAVEAAAALRTEEAAEAAALRAELGQLQAKISALESDIAERSQVLKNKDDAIANLEKAIETKSKTIASLQGEIASLQAKGSVAAEEEASKANARAIELEKQIDKLKKDIEAQNSQKAALESRANNAEKKVEELNEKLNAIQKESDERKRKIKKTERALKVAEEELMRLQLEATAKAKQLTEVHGAWLPPWLAAQYAHYVEVVSGYWNQHGRPAVHNVLHKASE

SEQ ID NO: 44188 - protein, 121 aa, Sorghum bicolor
  Clone ID: SORBI-28MAY03-C3882_2.pep
AGPVAATEWSSGLCACFDDCGLCCLTCWCPCITFGRIAEIVDRGATSCGAAGAIYTVLACFTGCQWIYSCTYRSKMRAQLGLPDVGCCDCCVHFCCEPCALCQQYRELKARGFHPDLGWDV

SEQ ID NO: 44189 - protein, 176 aa, Sorghum bicolor
  unsure (1)..(176): unsure at all Xaa locations
  Clone ID: SORBI-28MAY03-C3882_1.pep
MYPAKPTAAAASAPVVGTPASPSPGPVAATEWSSGLCACFDDCGLFAVCMHAMQHCLTCWCPCITFGRIAEIADRGATSCGAAGAIYTVLACFTGCQWIYSCTYRSKMRAQLGLPDVGCCDCCVHFCCEPCALCQQYRELXGRGFHPDLGWDVNAQKAAANAAAGMYPPAAQGMGR

SEQ ID NO: 44190 - protein, 236 aa, Sorghum bicolor
  Clone ID: SORBI-28MAY03-C3961_1.pep
APRCRACLLSGGDTSASARGKGQDADVNIDTNAITIEDEHVVAKSEAVIESFDDDQKTEDSKEDAQLTTATDVDDDMEEGELPEEPEEKSDVDMSEIEGETTAERAAVEPDQSPITQSGVADASPSRNADASPAREPSPNPVQAGATSRPQNTSTTTEAREPSTNPAQAGASEQRNTRTINFERAGQNRQARFQRPQQPAAGAQQPVAARGRGQSVTLRKDAAGRGSRGRGGRGQS

SEQ ID NO: 44191 - protein, 293 aa, Sorghum bicolor
  Clone ID: SORBI-28MAY03-C40874_1.pep
MRAAATDPPARSMLKRLFDRQLLRISPADRLPSADAGEKDDAEPSSVCLDGMVRSFMEDGVGGGDKAGHGGRYCNCFHGGDNSDDEEDDEAAAASDVAETIKGLVHCATLRERNLLADVCAHLERPPAAGARRRDLLRLVASSLRAAGHDAAVCVSRWDKSPSHPAGEHAYIDVLLPAASDRGACERVLVDADFRSAFEVARPTKAYRALLQRLPPVFVGKDDRLRLLVAAAAAAARASLRKRGLHLPPWRKPEYMRAKWLSPYEREAPPADAAAGEEKDDGEGPGTGTGTAA

SEQ ID NO: 44192 - protein, 334 aa, Sorghum bicolor
  Clone ID: SORBI-28MAY03-C5070_1.pep
MADKPSRALVLYAAGHATVLTPPAGSAAAGSHLDAFASRASCGLLTLRSPPASHPTTGAEDNSSTILELAQLLDVYDHLYPGKNADSGQEVAQVDPQELVVPKLSERFMGLRAALVTSCPRVSSFAANLGFQVFQTNDFAPQSGSSGVTKEVGLINRAFDLLGFSDGNVQETSEFDLVFMHVAMENTSSKLGKLGMKTDLNRLEKLVGAVMESAPVGSAIASRIHVSVILSYGSASGNKDEFSLLTSSTEADSDLNLLRPRQSYTMKAGHTLDDVRLHHPILLAQWQEGVTRVDLAKGFSFEEFIKHGGNLAMLAERFLHEVAFKLWKAPKYGA

SEQ ID NO: 44193 - protein, 79 aa, Sorghum bicolor
  Clone ID: SORBI-28MAY03-C51257_1.pep
PIGEPRVLDVDAGFLPAGPSARVGPNMNPDEELRKLKDRFATWKKDYKSRLKETKVNLNKVGTHDEKSRKRWWGKKSSK

SEQ ID NO: 44194 - protein, 387 aa, Sorghum bicolor
  Clone ID: SORBI-28MAY03-C50803_1.pep
VTRGHYGTTVSYFGFVSDVLELSEKFQKHFGPLRYFVAGFLKFLCLPKYSFELEYLPVSDVNDAEHTILVGQEKVDASDLYDDVVRRSRAECLPRASSLSSIDSIMSTGMSGAELEVCSPRANNEPSEVVRALDPKSKRLSLGRASTFKEPEEVLHPHSHGTSTPNWRRSKSKSRTEKARPGLSATNDAKSSKVNTDKEDTSSTISDPGPVAVWDSGPKWDDEPKWDNQPNWEPETSIELHSPREDIELGLTKELVPSLDERWTVRKGRYLGVLVCNHSCKTVQSLSSQVVAPKAEYDDNCLDLLLVGGSGRLRLLRFLVLLQFGARGSLPNLEYVKVKSVRLKAGPNTHDGCGIDGELLHVKGQVRCSLLPQQCQLMGRPVKNLVQ

SEQ ID NO: 44195 - protein, 152 aa, Sorghum bicolor
  Clone ID: SORBI-28MAY03-C52737_1.pep
ALVLPASSSHNKSVYSTSSHGFSAQANRLTCCSSLLDPTFIRFALAQGTRRRLGDREAGSAYGLRGDGNLHLNIVSSKYDDITLGRIEPFVYKWTSAQRGSISAEHGLGLMKAEKIHYSKSPEAVQLMASIKKLLDPNSILNPYKVLPQSVL

SEQ ID NO: 44196 - protein, 205 aa, Sorghum bicolor
  Clone ID: SORBI-28MAY03-C5669_1.pep
MAATTTTILLLLVAATAASAADLSVYHNVHPPSPSPLESIIALARADDARLLFLSSKAASSSGGVTSAPVASGQTPPSYVVRAGLGTPVQQLLLALDTSADATWSHCAPCDTCPAGSRFIPASSSSYASLPCASDWCPLFDGQPCPASQDASAPLPTCAFSKPFADTAFQASLGSDTLRLGKDAIASYAFGCVGAVTGPTTNLPK

SEQ ID NO: 44197 - protein, 80 aa, Sorghum bicolor
  Clone ID: SORBI-28MAY03-C4290_1.pep
MAEESGRPLPKFGEWDVNDPASADGFTVIFNKARDEKKGGNGQDTDSPSKDTRTERVESYAAKPSTKKWFCCVTASPTQS

SEQ ID NO: 44198 - protein, 281 aa, Sorghum bicolor
  Clone ID: SORBI-28MAY03-C45167_1.pep
MSGLYSQGFSPARTLSPQIRSNPDADSQYLAELLAEHQKLGPFMQVLPICSRLLNQEIMRVSSMVHDHGFSDLDRRRFRSPSPMSSPIVRPNLHGNGFGPWNGMHQERLGLPPPGTSMDWQGAPPSPGSYIVKKIVRLEVPVDSYPNFNFVGRILGPRGNSLKRVEASTGCRVFIRGKGSIKDTEKEEKLKGKPGYEHLNEPLHILIEAELPANVIDTRLRQAQEVMEELLKPVEESQDFYKRQQLRELAMLNSTLREDSPHPGSVSPFSNGGMKRAKPSQ

SEQ ID NO: 44199 - protein, 326 aa, Sorghum bicolor
  Clone ID: SORBI-28MAY03-C43733_1.pep
ARGSIIPRLKAFSDWILKAMALGNLEDIFPAASREYAPLVEELWKDPAIQATYRRRTELPFLPPAANYFLDKAVDISRPEYELSDIDILYADGITSSDGLASTEFSFPQLSLGGLGVDEPDAQDTLLRYQLIRINSRGLHENCKWLQMFDDVRLVIFCVAASDYDEYYEDANGTIVNKMVESRRLFESIVLHPTFEQMDFLLLLTKFDLLDQKINNSPLTSCDWFDDFTPLISRNLLSGGSSKPTRSSTGATLSQMAAHYMATKFKRLFQSLTDRKLYVSYVNALDQESVRSAIRYGREIVKWEEEKPVFGASETVYSEEPSSFTH

SEQ ID NO: 44200 - protein, 338 aa, Sorghum bicolor
  Clone ID: SORBI-28MAY03-C46704_1.pep
MSAGTRADEVVVQVRQLVVVVAVAVMATSCFSSSEAQLQGACYNATCPAAESLIETIVHAAVRKDAGNGPGLIRLFFHDCFVRGCDASVLLDDPTGTPGNRTVEKTSQPNFPSLRGFSVINRAKRVVERRCPGTVSCADIVAFAARDAARIMGGIRFAMPSGRLDGRVSNASEATANLPPASFNLTQLLARFASKNLTADDLVTLSGAHSIGRSHCSSFANTRLYPQLDATLNVTLAARLRAKCPAAPGGKDRVVDLDFRTPLQLDNQYYSNVATHEVVFGSDQALGDRNDTAALVALYAANRKIWSQKFAAAMVKMGSIEVLTGPPGEVRLKCNKVN

SEQ ID NO: 44201 - protein, 160 aa, Sorghum bicolor
  Clone ID: SORBI-28MAY03-C45912_1.pep
MISARTAASPASPASAWKRGGGRSEVGGGSSCDGCRTYRNTLRRSAAAAKVRAVPPRRVEAVAMGSAAETEKEKEEQQEVVAGAGGLVEDHYDEDSAAEEVPIMPWAFSVASGYTLLRDPHHNKGLAFTEKERDAHHLRGLLPPAVVPQQLQVKKIMHNL

SEQ ID NO: 44202 - protein, 446 aa, Sorghum bicolor
  Clone ID: SORBI-28MAY03-C4710_1.pep
HEGGAAVSAAKAVGYYNAGTVEFIVDTLSGEFYFMEMNTRLQVEHPVTEMIVGQDLVEWQIRVANGERLPLSQEQIPLNGHAFEARIYAENVPRGFLPATGTLHHYRPVPSDPTVRVETGVEEGDTVSMHARPMIAKLVVWGESRTAALVKLKNCLSNFQIAGLPTNIGFLQELASHSAFEKGLVDTHFIERYKDDLLSISTKSSEESHGVAVLGAILAAACICKKDHITFKESQRANNTLSVWYNNPPFRMHHFARHPLDLELEENDGFSEKLLKLCTTHKSDGSYFIETEDGTSGLDVKVDHKGDHDFRVDVSGLQTDVTLASYSKGNSKHIHVWHGKHHHHYRQTVRAEHAVDDPSQPCHASEGKSHPKGSVLAPMAGLVVKVLLEDGAQVEAGQPVMVMEAMKMEHVVKAPRAGYVDGLKVTAGQQVFDSSVLFTIKDNIAN

SEQ ID NO: 44203 - protein, 351 aa, Sorghum bicolor
  Clone ID: SORBI-28MAY03-C5593_1.pep
MNDGTRKRVLINAFTVRALRDTFPPARAAGIMALSVTSSYYEVTEIATRILPNIVVLTFDPDSDVRTKAFQATDQFLQIAKQHHEKLTTGDNRVAESTGVKLKPGNAGLLGWAMSSVTQKGKPSDHARISTANASNSQASTTSTAAPDTQASTLAYAPSTSNSLDQAAPASARSSVDGWGELDDGNIHEENSSDKDGWDDVDPFEDKPSPSLLSNIQAAQKRPVVQPKQAVANSSKSNPLKAPKSEDDPLWGPIAAAPPKSAVKSADIKPSTSHNDEDDLWGSIAAPPPKSSGKPLKPAAANSDDLWGAIAAPPPATKARPLASSGRGRGTKPAQPKLGAQRIGRTSSTGM

SEQ ID NO: 44204 - protein, 190 aa, Sorghum bicolor
  Clone ID: SORBI-28MAY03-C5588_1.pep
MDSSLASAAAIADQRQKIEQYRHILASVLSSSPPDISQAKRFLDHMVSDEVPLVVSRQLLQTFAQDLGKLESDAQKEVAHYALTQIQPRVVSFEEQVVVIREKLAELYESEQQWSKAAQMLSGIDLDSGIRMLDDTNKLSKCVQIARLYLEDDDAVNAEAFINKASFLVTNSHQEVLNLQYKVCYARILD

SEQ ID NO: 44205 - protein, 286 aa, Sorghum bicolor
  Clone ID: SORBI-28MAY03-C56157_1.pep
HEGQMQGCAFTLGLGEPNLAGKPVLQYDRVVRPHELHALKPKPAPEPKSGYRNREHETLFTMYQILESWLRAASQLLTRLNERIEAKSWEAAASDCWILERVWKLLADVEDLHLLMDPDDFLRLKSQLAVRAAPGSDASFCFRSRALLHVANTTRDLKKRVPWVLGVEVDPNGGPRVQEAAMKLYHSRRRGEGEDAGKVGLLQAFQAVEVAVRGFFFAYRQLVAAVMGTAEASGNRALFVPAEGMDPLAQMFLEPPYYPSLDAAKTFLADYWVQQMAGASAPSRQS

SEQ ID NO: 44206 - protein, 145 aa, Sorghum bicolor
  Clone ID: SORBI-28MAY03-C56339_1.pep
MGLLDQLWDETVAGPRPDSGLGRLRKYSSFSPSSSSSSSSSFPPAPAPAAATSDAPAPAVTRSITIARPPSLSVDASPRAESYSSSVPSSPATTPDSPFATATTPKTDGWRRFRRKTKVSDGPEPAVGPRSPTVYDWVVISSLDR

SEQ ID NO: 44207 - protein, 149 aa, Sorghum bicolor
  Clone ID: SORBI-28MAY03-C4934_1.pep
LAELLLGQPLFPGESAVDQLVEIIKVLGTPTREEIRCMNPNYTEFRFPQIKAHPWHKIFHKRMPPEAIDLASRLLQYSPSLRCSALDACAHPFFDELRAPNARLPNGRPFPLLFNFKHELANASPDLINRLVPEHIRRQNGVNFGHVGS

SEQ ID NO: 44208 - protein, 534 aa, Sorghum bicolor
  Clone ID: SORBI-28MAY03-C4976_1.pep
MDFRGIRWRKALPMCLALVALQACLPARAAAPKTYIVQMAASEMPSSFDFHHEWYASTVKTVSSVQLEGGADDPYARIVYNYETAFHGFAAKLDEDEAERMAEADGVVTVLPETVLRLHTTRSPDFLGISPEISNSIWSAGLADHDVVVGVLDTGIWPESPSFSDKGLGPVPAKWKGLCQTGRGFTIANCNRKIIGARIFYNGYEASSGPINETAELKSPRDQDGHGTHTAATAAGAPVPDASLFGYASGVARGMAPRARVAAYKVCWAGGCFSSDILAAVDRAVADGVDVLSISLGGGSSPYFRDSLAIASFGAMQMGVFVACSGGNAGPDPISLTNQSPWITTVGASTMDRDFPATVTLGNGANITGVSLYKGRRNLSSKEQYPLVYMGGNSSIPDPRSLCLEGTLQPHEVAGKIVICDRGISPRVQKGQVVKNAGGVGMILANTPANGEELVADSHLLPAVAVGESEAIAAKKYSKTAPKPTATLSFDGTKLGIRPSPVVAAFSSRGTNFLTLEILKPDVIAPGVNILAAW

SEQ ID NO: 44209 - protein, 498 aa, Sorghum bicolor
  unsure (1)..(498): unsure at all Xaa locations
  Clone ID: SORBI-28MAY03-C4964_1.pep
MEAMEELSELAESMRQAASLLADDDPSDDAAPRRPTTFLNAVALGNVGAGKSAVLNSLIGHPVLPTGENGATRAPIVVDLQREPGLSSKAIVLQIDSKSQQVSASALRHSLQDRLSKGASGGSGRGRADEIYLKLRTSTAPSLKLIDLPXIDQRGLVGSMIKEYAGHNDAILLVVIPAMQAADVASSRALRLAKDIDSDGTRTVGVISKVDQAGGDAKTIACVQALLSNKGPKNLPDIEWVALIGQSVALASAQSPGSENSLETACRAEAESLKNILTGAPQNKLGRTALVDTIAKQIRKRMKVRVPNLLSGLQGKSQMVQDELARLGESMVQSPEGTRAVALELCREFEDKFLAHITSGEGSGWKIVASFEGKFPDRIKQLPLDRHFDLNNVKRIVLEADGYQPYLISPEKGLRSLIKIVLEMAKEPSRLCVEEVHRVLLDIVNASANATPGLGRYPPFKREVVAIASNALETFKNDAKKMVVALVDMERAFVPPHT

SEQ ID NO: 44210 - protein, 205 aa, Sorghum bicolor
  Clone ID: SORBI-28MAY03-C5000_1.pep
MELPWGMLLLLVLSVSSSSSSSAAATLAVSAPPPVPAPRHAQDAEGLLINGNFETAPRKLNKTLIVGRHSLPGWTVQGHVEYVSGGPQPGGMFFAVPHGVHALRLGSRASASQNVTVRPGALYALTFAATRTCAQDESLRVAVSPSLSAPADVAVRTLYSGASADTWAWGFRASSPVAQVTFANPGVQEDAACGPLLDAVAIKEL

SEQ ID NO: 44211 - protein, 171 aa, Sorghum bicolor
  Clone ID: SORBI-28MAY03-C50232_1.pep
ARGLTGPSGKIMLLPEEDPNATHIMIATGTGVAPFRGYLRRMFMEDVPNYRFGGLAWLFLGVANSDSLLYDEEFTSYLKQYPDNFRYDKALSREQKNRSGGKMYVQDKIEEYSDEIFKLLDGGAHIYFCGLKGMMPGIQDTLKKVAEQRGESWDQKLSQLKKNKQWHVEVY

SEQ ID NO: 44212 - protein, 123 aa, Sorghum bicolor
  Clone ID: SORBI-28MAY03-C50427_1.pep
NYMAPERISGSSYDYKSDIWSLGLVILECAIGRFPYIPSEGEGWLSFYELLEAIVDQPPPSAPADQFSPEFCSFISSCIQKDPAQRMSASELLNHPFLKKFEDKDLDLRILVEDLEPPMNIPE

SEQ ID NO: 44213 - protein, 360 aa, Sorghum bicolor
  Clone ID: SORBI-28MAY03-C5064_1.pep
WCLFKKSRGSGTRLESLGYLPQSDMVQKFWKLCEQQLNISDETEDEDANEEYIEDTNRGAGMIAAAKLVLADTVSKDYLGPEIVSHYVSHGASTTEIIKHLITSLKKNTNFDMGALFFEALKRAYERYMAHVHEGENQILTGKSYSECQDLASHLAGSYVGAARIKNKSDILKIIQDGVSFAFVDLPNQLSFLEAALLPFVSKLQSSDIPDILADVEKRTQDTNMVGDQGAWRPYFTFVEHLRDKHAKNEVLHEEEEKPVRRRGRPRKVRDVPDVPDLRSGRDVRGKKLFRDDGHNSSGEESISASDHQGHGEDDDSDGDADQPLINTIRSSAAKLRSLKIAQQGTSSHKGVSGPSGSNS

SEQ ID NO: 44214 - protein, 269 aa, Sorghum bicolor
  Clone ID: SORBI-28MAY03-C5761_1.pep
MGSDVPMSPELEQVDGEIQDIFRALQNGFQKMDKIKDSSRQSKQLEDLTAKMRECKRLIKEFDRILKDEEKKNTPDVNKQLNDKKQFMIKELNSYVTLRKTYQSSLGNKRIELFDTGNDQVADETPVQMASEMSNQELISAGRKQMDQTDQAIERSKMVVAQTVEVGAQTAATLSQQTDQMKRIGNELDSVHFSLKKASQMVKEIGRQVATDKCIMAFLFLIVCGVIAIIVVKIVNPHNKNIRDIPGLAPPAMNRKLLSVDAFGGLRAL

SEQ ID NO: 44215 - protein, 339 aa, Sorghum bicolor
  Clone ID: SORBI-28MAY03-C6046_1.pep
YILGVQMSAGAGAAVEKIRAAGLLRTQGLIAGKWVDAYDGKTIEVQNPATGEVLANVPCMGSRETSDAIASAHSTFYSWSKLTAGERSKALRKWYDLIISHKEELALLMTLEQGKPMKEALGEVNYGASFIEYFAEEAKRIYGDIIPPTLSDRRLLVLKQPVGVVGAITPWNFPLAMITRKVGPALACGCTVVVKPSEFTPLTALAAADLALQAGIPAGALNVVMGNAPEIGDALLQSTQVRKITFTGSTAVGKKLMAGSANTVKKVSLELGGNAPCIVFDDADIDVAVKGSLAAKFRNSGQTCVCANRILVQEGIYEKFATAFIKAVQSLKVGNGLEE

SEQ ID NO: 44216 - protein, 187 aa, Sorghum bicolor
  Clone ID: SORBI-28MAY03-C6065_1.pep
LKKVLLRKDKYLDWRKRIMLAMDAAIGMEYLHSKDIVHFDLKCDNLLVNVKDPSRPICKVADFGLSKMKQATLVSGGMRGTLPWMAPELLTMSGTKVSEKIDVYSFGIVMWEILTGEDPYDGMHYGGVIGGILSNTLRPPVPTSCDPEWRKLMEQCWSTEPERRPTFTEVASRLRAILEASQRESPR

SEQ ID NO: 44217 - protein, 403 aa, Sorghum bicolor
  Clone ID: SORBI-28MAY03-C61076_1.pep
TRVKSLLKNYNIDPKCIGRLELGGETVIDKSKSIKTWHEEIFEESGNTDIEGVDSSNACYGGTAALFNCVNWVESNSWDGRYGLVVCTDSAVYAEGPARPTGGAAAIAMLIGPNAPISFESKYRGSHMAHVYDFYKPDLASEYPVVDGKLSQTCYLMALDSCYNVFCKKYEKNEGKQFSIFDADYVVFHSPYNKLVQKSFARLYYNDFLRNCSTVDEESREKLAPYAGLSSEESYQSRDLEKASQQVAKNLYDSKVQPTTLIPKQVGNMYTASLYAALASIIHNRHETLAGQRIVMFSYGSGLTSTMFSFKINEGQHPFSLLNIANIMDVSKKLKARHVVPPKKFVETLKLMEHRYGAKDFVTSQDTSLLSAGTYYLTHVDSMYRRFYDVKGDSVTTAISNGH

SEQ ID NO: 44218 - protein, 297 aa, Sorghum bicolor
  Clone ID: SORBI-28MAY03-C534_1.pep
MMAAAAAVSAVPMPSRLTLRAHPCSSAAPLPMRALPFLRSRLRSLTTAYAVKQDAALWTPAPVSAVSAATADGSISYVVVDLSDAADLVDSYTTPGQYLKIRVPSAGDELKPAFMAIASPPGAGPRFEFVVKTVPGTTAEKLCTLRDGDVVELGAVTGDGFALDKINPPDVAQAVLMFATGTGISTIRSLIEFGFAANERADVRLYYGARNLQSMAYQERFKNWESTGVKIIPVLSRPDDSWNGERGHVQDAFFKNKNIVNPSSTGAVLCGQNEMQEEITSALVADGVSRDKILTNY

SEQ ID NO: 44219 - protein, 373 aa, Sorghum bicolor
  Clone ID: SORBI-28MAY03-C5372_1.pep
FVGSGAYAAHWTGDNKGTWENLRYSISTMLNFGIFGMPMVGSDICGFYPAPTEELCNRWIELGAFYPFSRDHANFASPRQELYVWESVATSARNALGMRYKLLPYLYTLSYQAHLTGAPVARPVFFSFPDFTPCYGLSTQFLLGASVMVSPVLEQGATSVSAMFPPGTWYNLFDMRKVVVSKSSAPVTLEAPLNEINVHVFQNTILPMQRGGFVSKDARATPFTLVVAFPFGATQADAEGAVYVDDDERPEMVLAEGQATYARFHASVRGKAVTVRSEVLMGSYSLHKGLVIEKLSVLGLEGTGKDLAIQVDGTDATTAVATSSPYFAAGGNAKLHGEEGVEDSNKSVMVEVGGLALPLGKSFTMTWNMRIEA

SEQ ID NO: 44220 - protein, 233 aa, Sorghum bicolor
  Clone ID: SORBI-28MAY03-C5265_1.pep
PAAIHHAGDGGARSHAREQPRAQQRGVADARHLAERHRIRPVRAREQQATAGPPLLLRLRQRRRRSRQRRHSFRIRTKRKSKHTRSRRSDDSEDEEEEGRRGRDRKKSSRSKKHERSDEDSSDDSDSDRQRHRKSRKDRKRRRSHRRSDDSLDEKDVSGDEERRHRRHRKRSHHRRDASDCDNGGSDSADNKKRSSRRRRHRRSGSSGLDDDERHDHRGAKRSGEKSRDRKRS

SEQ ID NO: 44221 - protein, 184 aa, Sorghum bicolor
  Clone ID: LIB3476-004-Q6-K1-G9.pep
MPATAGRVRMPANNRVHSSAALQTHGIWQSAIGYDPYAPENNKQQPGRPSWCVSANAAAAAANDASAAASAAAASGSGSGDGNAYTKRKSKHTRSRRSDDSEDEEEEGRRGRDRKKRSNRSKKHGRSDEDSSDNSDSDRQRHRKRRRSHRRSEDSLDEKDVSGGEERRHRRHCKRSHHRRDASD

SEQ ID NO: 44222 - protein, 214 aa, Sorghum bicolor
  unsure (1)..(214): unsure at all Xaa locations
  Clone ID: SORBI-28MAY03-C54866_1.pep
MALLSDLINLDLSDCTEKIIAEYIWVGGSGMDVRSKARTLSGPVDDPSKLPKWNFDGSSTGQAPGDDSEVILCPRAIFRDPFRKGKNILVMCDCYEPNGKPIPSNKRHGAATIFSHPDVKAEEPWFGIEQEYTLLQKDTNWPLGWPLGGYPGPQGPYYCAAGADKSYGREIVDAHYKACLYAGIDISGINGEVMPGQWEFQVXAPAVGVSAGDQ

SEQ ID NO: 44223 - protein, 305 aa, Sorghum bicolor
  Clone ID: SORBI-28MAY03-C55548_1.pep
MDSTAAAAAAATAAAPVLLVTNDDGIDAPGLRFLVDQLVAAGRYRVLVCAPDTDKSGVSHSITWRAALRCKRVDITGATAFGVSGSPADCASLGISGKLFDGLVPDLVLSGINIGNNCGYHVIYSGTVAGAREAFLYGIPAISMSYDWVAGRSSVNELKVSAEVCMPLINAIVTEIKNGTYPQGSFLNVDVPTDAAHHKGYKITKQGTYMARISWEQTVYKKPAVESYQTANMDVDGEKDSELVTSENDLLFKRVIVGRSADGVEGDEMDYKSLVDGYITVTPLGALSHSEPDAIPYFKACVSRL

SEQ ID NO: 44224 - protein, 222 aa, Sorghum bicolor
  Clone ID: SORBI-28MAY03-C55628_1.pep
MVSLRRRRLLGLCSGKDSLPVDLPKPIENEKTVEVVHSNVKPFSVHPLPLAKTSDVLTKSSNGSDDSKEEKTQYYPGKEIKRRKRHRRKQYVDQEPCIMRGVYFKNMKWQAAIKVDKKQIHLGTVGTQDEAARLYDRAAFMCGREPNFELSEEEKQELRKYTWEGFLAVTRNTITSKKQRKVGLPRRSKADLFMGQSDGDTEMANGGGSSNSDNGDAETSAS

SEQ ID NO: 44225 - protein, 375 aa, Sorghum bicolor
  Clone ID: SORBI-28MAY03-C6508_1.pep
MASGGGGGVSVAPGGSGLGYDVGEVWGDLEPFFFDEAEAVADHERRMRREQEEAQKAAQRLQDAIARKSANKAALAKISDYDPKQDGKYFNRFHFADFSKFDLDEESPLGPMRYTNIIYNKGDEHWKSAAVNILSVKIASLDVGFPIDVYGTVIFRDSIDYKCVYLFHREKDNCQPIHSSDESLILTGPKRGLFLLDDVYVEIDLKIKDCQVQEEKELSKGFFNIARGPSRYLDKCEVESKKLATRLSTMEVTYAVVNNAVEATIAVEVLRGEFYGKIIACTTKVPNHLVLHDSKLAGVMSKDNSNSTGVIQLLRSIVSVPLEEMLLVTIVAQTGDAECERTIEFTPHISGGDRDVITVGVTKLSVTVAWSLISQ

SEQ ID NO: 44226 - protein, 100 aa, Sorghum bicolor
  Clone ID: SORBI-28MAY03-C65401_1.pep
LPSFRRPRGLCLVRSLPCPVQHCCSGIDAGQRTCARPKCCGLATDYIYVVPASPRWRASLGRRRISMSCRCGLGQGTVAADDKGAGDRVMFHINWSCGLL

SEQ ID NO: 44227 - protein, 430 aa, Sorghum bicolor
  unsure (1)..(430): unsure at all Xaa locations
  Clone ID: SORBI-28MAY03-C6592_1.pep
MAPRWAPPAGLVVLVALLALLLAPAAVVRGDKPVRGGASSSVAGVETEASSAVFPLYGDVYPHGLYYVAMNIGNPPKPYFLDVDTGSDLTWLQCDAPCRSCNKVPHPLYRPTKNKLVPCVDQLCASLHNGLNRKHKCDSPYEQCDYVIKYADQGSSTGVLVNDSFALRLANGSVVRPSLAFGCGYDQQVSSGEMSPTDGVLGLGTGSVSLLSXQFKQHGVTKNVVGHCLSLRGGGFLFFGDDLVPYQRVTWTPMVRSPLRNYYSPGSASLYFGDQSLRVKLTEVVFDSGSSFTYFAAQPYQALVTALKGDLSRTLKEVSDPSLPLCWKGKKPFKSVLDVKKEFKSLVLNFGNGNKAFMEIPPQNYLIVTKYGNACLGILNGSEVGLKDLSILGDITMQDQMVIYDNEKGQIGWIRAPCDRIPKFGSSALL

SEQ ID NO: 44228 - protein, 109 aa, Sorghum bicolor
  Clone ID: SORBI-28MAY03-C66797_1.pep
AAAARRAGQVHRRAPADATTTLVLPLLAELGKSIGVHPLLLMVPGTVGAQLSYLLPTATPGNVVGFGTGYITIKDMVVTGMPIKLVGIAALTILLPTLGSLVFGMDSKM

SEQ ID NO: 44229 - protein, 193 aa, Sorghum bicolor
  unsure (1)..(193): unsure at all Xaa locations
  Clone ID: SORBI-28MAY03-C56707_1.pep
MSAAHQPEPTAPAAAASCGGGGDSTIKNARHRTSTLKQCYHLAISNALYLLLAPAVAYASHRFSHHTASDVTAAAAFASNPPFAVSLLVLSAVLATAYLMRRPRAVYLLDFACYKPGAGHVVTRETFMRQSEAXGVFTPDNLAFQRKILERSGLGQGTFFPAAVLNSPPNPCMAEARAEAEAVMFGAIDQVLA

SEQ ID NO: 44230 - protein, 352 aa, Sorghum bicolor
  unsure (1)..(352): unsure at all Xaa locations
  Clone ID: SORBI-28MAY03-C56893_1.pep
ARGARRAGGGDHAHARMAEQLLSTAVHDTLPGSYVRPESQRPRLAEVVTGARIPVVDLGSPDRAAVVAAIGDACRSHGFFQVLNHGVHADLVAAVMAVGRAFFRLSPEEKAKLYSDDPARKIRLSTSFNVRKETVHNWRDYLRLHCHPLDEFVPDWPSNPPGCLDSMSTSCNAVRPPACTRYAALSGCLGLXASYMNETLGEQEQHMAVNFYPPCPEPELTYGLPAHTDPNALTILLMDQDVAGLQVLHGGKWVAVNPQPGALIINIGDQLQALSNGQYRSVWHRAVVNSDRERMSVASFLCPCNHVVLGPAKKLVTEDTPAVYRSYTYDEYYKKFWSRNLDQEHCLELFRT

SEQ ID NO: 44231 - protein, 666 aa, Sorghum bicolor
  unsure (1)..(666): unsure at all Xaa locations
  Clone ID: SORBI-28MAY03-C57456_1.pep
TRRARSGNSDTSSKRVEQINHKWQFHLSLDEDGTDNSSLFKEKLTQALRYFKESTDQHLLVQVWAPVKNGDRYVLTTSGQPFVLDHQSIGLLQYRAVSMMYMFSVDGENVGELGLPGRVYKQKVPEWTPNVQYYSSGEYQRLNHAISYNVHGTVALPVFDPAAQSCIAVVELIMTSKKINYACEVDKVCKALEAVNLKSTEILDHPNVQICNEGRQAALVEILEILTVVCEEHKLPLAQTWVPCKYRSVLAHGGGLKKSCLSFHGGCMGEVCMSTSDVAFHVIDAHMWGFRDACVEHHLQRGQGVSGKAFISHKPCFSKDIQKFCKLTYPLVHYARMFGLAGCFAICLQSSYTGNDDYVLEFFLPPDCIDEDDQNALLESILTLMKRCLRSLKVVGDRYSSGASLQLSNVLKLENEEFKTDAQFDNSDGSLHESPGGDRHGGAHKFDNGNKKVLDLTEGQLLTDDYSQDNGTSAGRPNGSGASDSSLLHKTNKPPERRRGKAEKTISLEVLQQYFSGSLKNAAKSLGVCPTTMKRICRQHGISRWPSRKINKVNRSLSKLKQVIESVQGSDAAFNLTSITGPLPIPVGPSSESLNVERLTQSKVAELSNLAVDGDRDSLQKSLENDDHFGIVMAHQGFIDXNNDSQLEADKASHSRSSSGEGSINS

SEQ ID NO: 44232 - protein, 389 aa, Sorghum bicolor
  Clone ID: SORBI-28MAY03-C57848_1.pep
HEEDDDDDNGDPEPLRNESDGKIITNDDVLGDEVPYDQQEALRVLCYRLLEMPLVRGHSQFPGSHPVSLNSENLQLLRQRYYFATWKADGTRYMMLIMRDGCFLIDRNFCFRRVQMRFPHKSLEGLHDMTLIDGEMIIDTVPDSGLKRRYLAYDLMALGAVSKTKLPFSERWKMLEDEIIRPRYHEKKQFESGAKSNPLYKYDMELFSVRRKDFWLLSTVKKVLKEFIPSLCHDADGLIFQGWDDPYVTRTHEGLLKWKYPEMNSVDFLFELTNDNRQLVFLYERGKKKLMDGARIAFTDDVDPSSVAGRIVECSWNKEEQCWACMRIRSDKSTPNDINTYRKVMRSITDNITEEKLLEEIDEIRRLPMYADRMHAHTKMAQQRRRLPP

SEQ ID NO: 44233 - protein, 233 aa, Sorghum bicolor
  Clone ID: SORBI-28MAY03-C60226_1.pep
MEVVSCSHSCSALHQTPASAWRLRGGTALGLGLGHAKPSRPRRYTVMCVGTTRGSASSPGGSGKVHAAQGFHVSDVDAALQGIPSMKVGEVKKVMIQGLPEGPDGSPISTGFWEWKPKLTVYYERSGVENSKAPAVLFLPGFGVGTFHFEKQLRDLGRDHRVWTMDFLGQGMSLPGEDPAPSSISSEEVFWGFGQDSQPWAEELVYSVDLWQNQVQRFIEEVIREPVYIVGNS

SEQ ID NO: 44234 - protein, 470 aa, Sorghum bicolor
  Clone ID: SORBI-28MAY03-C604_1.pep
TRPPRRRRGRDDDHDPHAAGSGGDTGALLASVRRLLLSEAPTAAAAAEEEEEEPRRFPKRWAIVFLCFSAFLLCNMDRVNMSIAILPMSAEYGWNPQTVGLIQSSFFWGYLLTQIAGGIWADTVGGKTVLGFGVVWWSIATALTPVAAKLGLPFLLVVRAFMGIGEGVAMPAMNNILSKWVPVSERGRSLALVYSGMYLGSVTGLAFSPLLIHKFGWPSVFYSFGSLGAVWVTTWATKAYSSPLEDPGISAAEKKLIASQSTAGEPVKTIPWRLILSKPPVWALIVSHFCHNWGTFILLTWMPTYYNQVLKFNLMESGLVCVLPWFTMAVSANVGGWIADTLVSRGVSVTTVRKIMQSIGFLGPAFFLTQLSHVDSPAMAVLCMACSQGTDAFSQSGLYSNHQDIGPRYAGVLLGLSNTGGVLAGVFGTAATGYILQHGSWDNVFELSVVLYLVGTLVWNVFSTGEKILD

SEQ ID NO: 44235 - protein, 104 aa, Sorghum bicolor
  Clone ID: SORBI-28MAY03-C7005_1.pep
MVRKAKVEFDEQPPDNFDPKNPYGDPVAMLEYREHLVREKWIQIETAKIIRERLRWCYRIEGINHHQKCRHLVDQYLESTRGVGWGKDARPPEFHEPKKTVEAE

SEQ ID NO: 44236 - protein, 216 aa, Sorghum bicolor
  Clone ID: SORBI-28MAY03-C70115_1.pep
LLAEYGKCISGSTFVIQGFGNVGSWAARLIHEKGGKIIAIGDVTGSIKNMSGIDIPALMKHKNEGHAMKDFHGAEVMDSTELLVHECDVLVPCALGGVLNKDNAPSVKAKFIVEAANHPTDPEADEILAKKGVVVLPDIYANSGGVIVSYFEWVQNIQGFMWDEEKVNNELEKYMSSAFQHIKAMCKSLDCNLRMGAFTLGVNRVARATLLRGWEA

SEQ ID NO: 44237 - protein, 180 aa, Sorghum bicolor
  Clone ID: SORBI-28MAY03-C7013_1.pep
MLPMAVHPTTTPALSPRTRVSPPRPSTSLAATSSTPCSRTVSLKSSRLRLRSLRSVVAAAAADAVGAEEEEVQLSGGVDAVDEEEAENKVVVPERQDPMLVLKFIWMEKNIGIALDQLVPGYGSIPLSPYYFWPRKDAWEELRAKLEEKEWISQKQMIILLNQATDIINLWQQGGGSLST

SEQ ID NO: 44238 - protein, 178 aa, Sorghum bicolor
  Clone ID: SORBI-28MAY03-C72562_1.pep
AGGYGAHYGGAGGGAVQQYGYQQKDAYGGATAGGKVKKTGYQYQEAYGGTGAGAGGYGAHYGGGAAAVQKHHGYMQDVYESETESESDESDCDEAFPPRGGVQHSYGAYKQEKHHGAGNLGGVRRYESYETREELGGGRRYESYQSSVQYTGGSGGGGGGGYATCSPIKNRHLLRYGA

SEQ ID NO: 44239 - protein, 181 aa, Sorghum bicolor
  Clone ID: SORBI-28MAY03-C7230_1.pep
LLMTKEQLFDMTCMTLGGRAAEEVLIGKISTGAQNDLEKVTKMTYAQVAVYGFSEKVGLLSFPQKDDGFEMTKPYSNQTASIIDDEVRDWVGKAYKKTVELITEHKEQVAQIAELLLEKEVLHQDDLTRVLGERPFKALEPTNYDLFKQGFQDDDDKSQATSENAELPDDSSPPLGEVVPT

SEQ ID NO: 44240 - protein, 243 aa, Sorghum bicolor
  Clone ID: SORBI-28MAY03-C47301_1.pep
MSVPGAPSGRGSGGGGGSRSFDFGADDVLCSYDDFAAPSEPKRPDPADKDFHDSRLGRPFVKPYEQESYGKEDVLSAVEKCMKKYADNLLRSLEGITSRLSQLEIYCYKLERSIGELRSDVLRDETDHRLKSLEKHLHEVHRSIQILRDKQELAEAQKELAKFQLTQDTSKKKEDVPTPSIPEQKKLEENPDTSNQQLALVLPHQVNLPSLAPRASESVQQYKDQPVQQSAPTPPVPQQDRYV

SEQ ID NO: 44241 - protein, 208 aa, Sorghum bicolor
  Clone ID: SORBI-28MAY03-C4787_1.pep
FISLFVKALGGSVAGSDKKILFLCGDYMEDYEVMVPFQSLQALGCHVDAVCPDKGAGEKCPTAIHDFEGDQTYSEKPGHDFTLTASFESVDASSYDALVIPGGRAPEYLALNDKVISLVKAFADNGKPIASICHGQQILSAAGVLKGKKCTAYPAVKLNVVLGGGTWLEPDPIHRCFTDGNLVTGAAWPGHPEFVSQLMALLGIKVSF

SEQ ID NO: 44242 - protein, 365 aa, Sorghum bicolor
  Clone ID: SORBI-28MAY03-C4827_1.pep
VKALKEKLRLPVGSCELAVPLNAKARLYTVDRRREAYATILHSASEYVCGAITAAQSIRQAGSTRDLVILVDDTISDHHRKGLESAGWKVRIIERIRNPKAERDAYNEWNYSKFRLWQLTDYDKVIFIDADLLILRNIDFLFAMPEITATGNNATLFNSGVMVIEPSNCTFQLLMEHINEITSYNGGDQGYLNEIFTWWHRIPKHMNFLKHFWEGDEEEVKAKKTRLFGANPPILYVLHYLGRKPWLCFRDYDCNWNVEILREFASDVAHARWWKVHNKMPKKLQSYCLLRSRLKAGLEWERRQAEKANFTDGHWKRNITDPRLKTCFEKFCFWESMLWHWGENKNNSTQNSAVPATPTASLSSS

SEQ ID NO: 44243 - protein, 269 aa, Sorghum bicolor
  Clone ID: SORBI-28MAY03-C49158_1.pep
LTHADCRVPLPPCPALLGLQPPPAPAATAHRPTTCFFQHRLTLHSPVLSSPLLSSTSDLPDPEAAVRSVPQACPCAQQRRRLEAGPSARNDGRALAARARGGGRGPDASPGPGHGIRIGSLGQNRTTDMVENVRVDTCLLTNTTNGVRIKSWQGGMGFARDLRFENILMKNVSNPIIVDQYYCDQPTPCANQTQAVEVRKVEFANIRGTSATAQAISIACSDTVPCRELELANVNLTLAEGGGRATALCYRASGKSVGTVVPPSCLAKS

SEQ ID NO: 44244 - protein, 251 aa, Sorghum bicolor
  Clone ID: SORBI-28MAY03-C49228_1.pep
MAMLSRAASSAARRPALLPPRLLAARAMASSLFGHVEPAPKDPILGVTEAFLADPSPDKVNVGVGAYRDDNGQPVVLSCVREAERRIAGNLNMEYLPMGGSIKMIEESLKLAYGEDSGFIKDKRIAAVQALSGTGACRLFADFQKRFLPDSQIYIPTPTWSNHHNIWRDAHVPQKTFTYYHPESRGLDFSGLMNDIKNAPDGSFFLLHACAHNPTGVDPTEEQWREISHQFKVKKHFPFFDMAYQGFASGD

SEQ ID NO: 44245 - protein, 238 aa, Sorghum bicolor
  unsure (1)..(238): unsure at all Xaa locations
  Clone ID: SORBI-28MAY03-C50212_1.pep
LLAAPGLLPEVGCPFCRATAPGRGPVRAYLGVXGYRFSSPAGAICSGLGARAVPSASLGSRHDPLLSANFTHDPXRDVESVLTGYKKEPESESQLEKLLPYIISSFSPDKSVAESVEELKKCSRSGDAAVAEWANEALAGIEKGAPFSLCLTQKHFSQVASAYRTSEHYLSKLAGVMKLEYRIALRSSVRNDFVEGVRAVLVDKDQNPKWNPATLEEVNMGEVESVFEPLGAEAELSV

SEQ ID NO: 44246 - protein, 214 aa, Sorghum bicolor
  Clone ID: SORBI-28MAY03-C7985_1.pep
MASSASRFIKCVTVGDGAVGKTCMLICYTSNKFPTDYIPTVFDNFSANVVVDGTTVNLGLWDTAGQEDYNRLRPLSYRGADVFVLAFSLVSRASYENIMKKWIPELQHYAPGVPVVLVGTKLDLREDKHYLMDHPGLVPVTTAQGEELRRQIGAMYYVECSSKTQQNVKAVFDAAIKVVIQPPTKLREKKKKKSRKGCSMVNLFCGRKMLCFKS

SEQ ID NO: 44247 - protein, 204 aa, Sorghum bicolor
  Clone ID: SORBI-28MAY03-C80199_1.pep
MACLHDHSCEDHNCAADWSLYNHVDVPKVVALNESVPGSVKSVFKPWEQRLDTSGGFLESNDGDPELLIFSPFTSDVKIKSISVVGGADGTSPSRMSAFINREGIDFSDAQNMQPVQEWELAENLQGALEYQTRYSRFQGVANLTLHFPDNFGGDTTKIYYIGLRGEATQNKRDVVATIVYEVMPNPSDHKTKSETGGGFSHVE

SEQ ID NO: 44248 - protein, 156 aa, Sorghum bicolor
  Clone ID: SORBI-28MAY03-C80237_1.pep
ARGNVRPDLVKGGGGGGRLPSEFAAATEGRSMLSTWCPQAAVLEHDAVGVFLTHSGWNSTLESICGGVPMVCWPFFAEQQTNCRYKRTEWGIGMEIGSDVRRGEVEALIREAMEGEKGREMRRRVTELKESAVAAARPDGRSMRNVDRLIDEVLLA

SEQ ID NO: 44249 - protein, 455 aa, Sorghum bicolor
  Clone ID: SORBI-28MAY03-C8098_1.pep
MASALLRGWPRGLAGRVFPLLAAPNPLVRCVSRFFHRPRNVATISRVKGDESRKPYTRHHNSSVNFIIFSQDNMYSGITHGIKNIETSGTIAQVAEGERGDKDASQVAGDERGDKDAYRTTKHTGCLEDLEDQRGKHLVSDDEEISEDNGYTLSNILEKSRHCDGSIYRSMDIWWKKQYRIAERNETRVEAMMFSDPTNVIIRNGIRMHHGRACMLQILSLELAEISVDGGLVELYGYIAVRDELDPLLNYIINFSRDDPIVVEQGSLINMAGPKRAIDFFDQALIEYDMRIKTGEQEKDDLQLIDGASIIGPSVMWDRPFTCRFAGDCGTVKLTAARLYDAVEATVEVLILEVQKKFNLSVGCITSDLDEEIRLFNGAIMESRALKRSVVAVTMYYSLDLKFNVGALSSSLEQHFCSFKAKTHGHDVQEIKTGFGLISVKVTWSTMLRGYYGDA

SEQ ID NO: 44250 - protein, 556 aa, Sorghum bicolor
  Clone ID: SORBI-28MAY03-C6767_1.pep
EATVKSYPPFIEAMKRRGVDDMDLVMVDAWCAGYYSEADAPSRRLGKPLIFCRTESDSPMENGYARPVEGIHVVVDMQNNAVIEFEDRKLVPLPPPDHLRNYTPGETRGGVDRSDVKPLIINQPEGPSFRINGYFVEWQKWNFRIGFTPKEGLVIYSVAYVDGSRGRRPIAHRLSFVEMVVPYGDPSEPHYRKNAFDAGEDGLGKNAHSLKKGCDCLGYIKYFDAHFTNFTGGVETIENCVCLHEEDHGILWKHQDWRTGLAEVRRSRRLTVSFICTVANYEYGFYWHFYQDGKIEAEVKLTGILSLGALMPGESRKYGTTIAPGLYAPVHQHFFVARMDMAVDCKPNEAHNHVVEVNVKVESAGTHNVHNNAFYAEEKLLKSELQAMRDCDPSSARHWIVRNTRTVNRTGQPTGYRLVPGSNCLPLALPEAKFLRRAGFLKHNLWVTQYKRDEMFPGGEFPNQNPRIHEGLPTWVKKDRPLEETDIVLWYVFGLTHIPRLEDWPVMPVEHIGFMLMPHGFFNCSPAVDVPPSSSDADVKEAESPKAIQNGLVSKL

SEQ ID NO: 44251 - protein, 176 aa, Sorghum bicolor
  Clone ID: SORBI-28MAY03-C6801_1.pep
MSQAREVRYTARSITPPADRNGTSSSPPPKRRSPSRSPPPKSASRSPRPRSPKRRSTSRSPPRRRGRSRSRDRSRSRSPDDRNPGTNLYVTGLSTRVTEEDLQKFFSKEGKVKNCHVVLDPRTKESRGFAFVTMDTLEDARRCIKYLHRTVLEGRLVTVEKFTWCWAASTSTWLVQ

SEQ ID NO: 44252 - protein, 194 aa, Sorghum bicolor
  Clone ID: SORBI-28MAY03-C6757_1.pep
MKALVVTVLLLLSSTLAVSQWCVCRQDATQAALQKTIDYACGSGADCNSIHENGACYNPNTVPAHCSWAANSYYQNNKAKGATCDFTGTATLTTSDPSSSGCSYPTSASAAGTMTPTTGGTMGGTPGTFTPGTGTGTTGTGMGTGTATGTTGFGGLGPGTNAGMDTAAAAGLLLPTAGLATALAALLFSAIVLA

SEQ ID NO: 44253 - protein, 137 aa, Sorghum bicolor
  unsure (1)..(137): unsure at all Xaa locations
  Clone ID: LIB3476-024-P1-K1-B7.pep
SPPRSRRRSLWSSAAPXASRPACTRTTLHQRFLVSELLERLKGTPGLGVPGDAPVLPHQFLVGCGMWMSPNAMVRGQREHSKQTLHTQRKREQHFSLGMCSNGNLSLLCKLCAAFQLSKSTERDFEKGKLFLGRTSV

SEQ ID NO: 44254 - protein, 341 aa, Sorghum bicolor
  unsure (1)..(341): unsure at all Xaa locations
  Clone ID: SORBI-28MAY03-C691_1.pep
TRVVVSFFFASEXQLPWRWGMKYFWDTLLEADLESDALGWQYISGSLPDGRELDRIDNPQFEGYKFDPHGEYVRRWLPELARLPTEWIHHPWDAPSFVLQAAGVELGSNYPRPIVELDAANSRLQDALSVSWELGAASRAAMEYGMEDGLGDSTSEPQIVFPLQLRMEVDXLPAQPAIHTPAVAGMQLPGCNVPSMTPVVINLVVXLTGCPGDMCYSSDKSXSSIRFIAGSGRVGSISXGGSGNTVRMNGNHQQQNLQNNMHRVLGIAPSVSEASSSWTGREGGVVPVWSPPAASGHSDPYAADEADISSRSYLDRHPQSHTMMNWSQLSQSLTTGWEVDN

SEQ ID NO: 44255 - protein, 197 aa, Sorghum bicolor
  Clone ID: SORBI-28MAY03-C6931_1.pep
MFSGTQQKCKVCTKTVYPMDQLSTDGVAFHRSCFKCQHCKSTLSLSNYSSFEGVPYCKAHFEQLFKETGSYNKSFQSQSPAKITPEKLAPELTRSPSKAARMFSGTQDKCATCGKTAYPLEKVTVEEKAYHKSCFKCSHGGCAITPSNYAALEGILYCKHHFSQLFKEKGSYNHLIKCASVKRAAEAQPEQPASDSS

SEQ ID NO: 44256 - protein, 174 aa, Sorghum bicolor
  Clone ID: SORBI-28MAY03-C6955_1.pep
MASLTGLAANPNPNKSFEILPNPGDSVSSLSFSPKSNLLVATSWDNQVRCWEIVGGNSQPKASISHDQPVLCSAWKDDGTTVFSGGCDKQVKMWPLLSGGQPQTVAMHDAPVKEVAWIPQMNLLVSGSWDKTLRYWDTRQANPVHIQQLPERCYALTVNYPLMIVGTADRHLVV

SEQ ID NO: 44257 - protein, 221 aa, Sorghum bicolor
  Clone ID: SORBI-28MAY03-C8837_1.pep
MSEVFEGYERQYCEASASLSRKCTAASALDGEKKKQKLSEIQSGIEEAESLIRKMDLEARSLQPSIKAGLLAKLREYKSDLNNVKSELKRISAPNARQATREELLESGMADTLAVSTDQRGRLMMTTERLNQSTDRIKESRRTMLETEELGVSILQDLHQQRQSLLHAHTTLHGVDDNIGKSKKILAAMSKRMDRNKWIIGGIITALVLAILLILYFKLAH

SEQ ID NO: 44258 - protein, 124 aa, Sorghum bicolor
  Clone ID: SORBI-28MAY03-C895_1.pep
MAGTTRRSRKSSSSSSSAQQQLAAGALLVAVVVLVAASSSGVLVAVEAVCDMSNEQFMSCQPAAAKTTDPPAAPSQACCEALAGADLKCLCGYKDSPWMSVYNIDPKRAMELPAKCGLATPPNC

SEQ ID NO: 44259 - protein, 393 aa, Sorghum bicolor
  Clone ID: SORBI-28MAY03-C903_1.pep
NASAKGIQMEEPFDVFEESPSMRRAPVSRRVDDMFGQIKSKLPGAPRFLMCLLPERKNCEVYGPWKRKCLAEFGIVTQRLAPTRVNDPYLLNLLMKINAKLGGLNSLLQVEASPSIPHVSEVPTIILGMDVSHGHPGQDRPSVAAVVSSRQWPLISKYRASVHTQSARLEMMSFLFKPRGTDDDGLIRESLIDFYTSSGKRKPDHIIIFRDGVSESQFTQVINIELDQIIEACKFLDEKWSPKFTVIVAQKNHHTKFFQTGSPDNVLPGTVVDNKVCHPKNFDFYMCAHAGMIGTTRPTHYHVLHDEIGFSADEMQEFVHSLSYVYQRSTTAISVVAPICYAHLAAAQVGTFLKFEEMSDTSSSQGGHTSAGSAPVPELPRLHEKVRSSMFFC

SEQ ID NO: 44260 - protein, 206 aa, Sorghum bicolor
  Clone ID: SORBI-28MAY03-C9072_1.pep
MERELLETFDAAKKAADATAADGDSPEADRCLDALRRLRDIRVNTDILVSTQVGKRLRPLTKHPHSGIQAVAADLFGYWKKVVLEESGKKNGGSENERSSDSSGKVEKVRPMKVEKNSASASMKVEKRDVDVRGQKPGSVKVEKTASNGSRTQSVKVERVSKEVSRTPDAKKPASTPSGAPKLTSLVKCNDPTRDKIRELLAEAFA

SEQ ID NO: 44261 - protein, 324 aa, Sorghum bicolor
  Clone ID: SORBI-28MAY03-C8925_1.pep
MLGVEPEGRRGASASAAAAGWGARRLPFSRPPPLAGCQLGGCGGAGGSAAYGAAVGGEAIWRFRLSAGRGGVPYVGDYYHQAGMAKRGATSKQSTSFSPTSMKDIPSKSRSSSDQHTYLQVDALGRVSFSSIRRPRSLLEVDHPSSADGSHDQKSTVRPLEKEPMLAARVTVEDALCLLLEVDDTDRLLQSSQSQDNIFQLKRRRQVLLEGLAASLQFVDPLGPSISGHSSGLALKDDVVFLRIVSLPKGRKFLARYLRLLVPGSELTRIVCMAIFRHLRFLFGGLPSDSSAAETTVALAKTLSSCVHHMELGALSACLAAVVC

SEQ ID NO: 44262 - protein, 181 aa, Sorghum bicolor
  Clone ID: LIB3476-055-P1-K1-F7.pep
RSISGTRNPGVIGDRRSISRGSSLTVDWAEDVEFSNWGDQDVFENEEFHESKRWWSSNSSVQQGDSNSRPLSRTSSYPQQPLQHRSSEPIVLPKTSSFTSFPPPVAAAGGRSPYPAQGLTRHGSIPSIGAGLQMGSPGMSLSASPYHMVGPSHGLPYTGGMPYGALNLPVNKSVQNDWSNH

SEQ ID NO: 44263 - protein, 241 aa, Sorghum bicolor
  Clone ID: SORBI-28MAY03-C7404_1.pep
MRGSMSNYYDDYDDIDEMEDEYDLDDPADDMVDEQRGIRDSDAEDNDYGQPNDKIPDTSSVDARKGRDIQGIPWEQINITRKKYRQSRLEQYKNYENVPNSGEEAMKDCKPTEKGGMYYEFRRNTRSVKSTILHFQLRNLVWATSKHDIYLVSHYSIRHWSALSGVDTELINVQGHVAPREKHAGSLLEGFSQTQVSTLAVKDNLLVAGGFQGELICKHLDREGISFCCRTTYDDNAITNA

SEQ ID NO: 44264 - protein, 110 aa, Sorghum bicolor
  Clone ID: SORBI-28MAY03-C7224_2.pep
MQASRARLFKEYKEVQREKSADPDIQLICDDSNIFKWTALIKGPSETPYEGGVFQLAFAIPEQYPLLPPQVRFLTKIFHPNVHFKTGEICLDILKNAWSPAWTLQSVCRA

SEQ ID NO: 44265 - protein, 185 aa, Sorghum bicolor
  Clone ID: SORBI-28MAY03-C7224_1.pep
MQASRARLFKEYKEVQREKSADPDIQLICDDSNIFKWTALIKGPSETPYEGGVFQLAFAIPEQYPLLPPQVRFLTKIFHPNVHFKTGEICLDILKNAWSPAWTLQSVCRAIIALMAHPEPDSPLNCDSGNLLRSGDIRGYQSMARMYTKLAAMPKKGYAVEHMPGQEHMAVHASLHVVRSALCCL

SEQ ID NO: 44266 - protein, 340 aa, Sorghum bicolor
  Clone ID: SORBI-28MAY03-C77950_1.pep
MAPPPHRHLLLLLLLLPLVLLAATPAGADDLVSELQSLRARSPSGVIHLTGTRVTRFLTAPSSRRPYSVLVFFDAASLHSKPDLHLPQLRTEFALLSASFLAHNPDSGDLFFADIEFAESQHSFHQFGVNSLPHVRLIRPEHATLSKSEQMDQSHFSRLADSMAEFIESRTGLEVGPIVRPPLLSRNQIILLGILFLISIPFMIKRIIDGETLLHDRRVWMAGALFVYFFSVSGGMYGIIRHTPMFLTDRADPNKLVFFYQGSGMQLGAEGFAVGFLYTLVGLMIAGVTHLLVKVESLQTQRFAMLAVMAIGWWAVRKVIYLDNWKTGYSIHTFFPSSWR

SEQ ID NO: 44267 - protein, 77 aa, Sorghum bicolor
  Clone ID: SORBI-28MAY03-C750_1.pep
MAEIEIKTAPADFRFPTTNQTRHCFTRYVEYHRCVNAKGDDAGDCEKFAKYYRSLCPGEWVEKWNEQRESGTFPGPL

SEQ ID NO: 44268 - protein, 493 aa, Sorghum bicolor
  unsure (1)..(493): unsure at all Xaa locations
  Clone ID: SORBI-28MAY03-C7075_1.pep
MICGVALLLASLCWASLHEGSVRRNKVASFVMEGPQGSRNVTKHNKRKSPVQRWRPASTEAVPQKDDITETSNSESKKIIEVCIASSESLASDGTTNVVVEVTTNDASSSKYNLSLEYSSTKVVIEDNVEVSGFNKDLVVSNVSGTYSSSIEVDAPLIRFVKGKGGSTQKQIEEGAGVKIIFPSSRVGTSVVLEGKSAEGIRKASQMIADVLEEAVKSRQLDYSHFISLPLALRPYLVEKRNHFQSXILGEEDSDKDESRRTCLKLGLXLDCGIDKSIFIKPKTFHLESFMCDXFQISPMFYDVLKSICXSCSLQALRSLLLAYRLRXLTCMKGSPAKARVVYAPVLEVGGEGRLARACRLISNPLGGLAFMYGAHARALLLHAPVMEVGHGGRQYRARAIADYSDLFDAWDIFRKYGNEDWGEYPIHEVHLSQRFKFDKSGYYYCCPCLQRCTQSEICSCDHVLGLLHNNNNNNNNKTAVHEAFNFVISGMP

SEQ ID NO: 44269 - protein, 200 aa, Sorghum bicolor
  unsure (1)..(200): unsure at all Xaa locations
  Clone ID: LIB3476-029-P1-K1-A4.pep
QPRVRRAVGHRARQIFPRLEAAHVRLQVTPRKGSVCRNKVASFVMEGPQGSSNVTKHNKRKSPVQRWRPVSTEAVPQKDDITETSNSGSKKIIEDCIASSESLASDGTTNVVEVTTNDASSSKYNLSLEYSSTKVVIEDNXGGIWLNKDLVVSNVSGTYSSSIEVDTPLIRXVKGRVGLRRSRLKRILELKLSSHHQERG

SEQ ID NO: 44270 - protein, 103 aa, Sorghum bicolor
  unsure (1)..(103): unsure at all Xaa locations
  Clone ID: LIB3480-021-P1-K1-E8.pep
PVDFGIDKSIFIKPKTFHLTVLMLKLWNKDRIAKAADVLQSVSTKVNEALENRPISIQLRGLTCMKGSPAKARVVYAPVLEDGGXWRLPRACKVITDCLCQVR

SEQ ID NO: 44271 - protein, 193 aa, Sorghum bicolor
  Clone ID: SORBI-28MAY03-C7909_1.pep
NNVASLWFMSLFICIFATSILEMRWSGVGIDDWWRNEQFWVIGGVSSHLFAVFQGLLKVIAGVDTSFTVTSKGGDDEEFSELYTFKWTTLLIPPTTLLLLNFIGVVAGVSNAINNGYESWGPLFGKLFFAFWVIVHLYPFLKGLVGRQNRTPTIVIVWSILLASIFSLLWVRIDPFLAKDDGPLLEECGLDCN

SEQ ID NO: 44272 - protein, 399 aa, Sorghum bicolor
  unsure (1)..(399): unsure at all Xaa locations
  Clone ID: SORBI-28MAY03-C10508_1.pep
KTPLESGPSWQHHAPPTGPQLAAVGPAITAPRFRTTLPCCTRPRSRRLTSWRRAALPKDEDYYLIDAEESIGDGFSFSGGKYGEGPSKSDEWFAQGKMVNAYQIYGDKGKAKDPFFGLTMGSESQSSDDVFRWFCVEAGSSSNPKVLLIHGLPSQAYSYRNVMPVLSDKYHAIAFDWLGFGFSDKPQPKYGFDYTLDEYASSLESLVNAVAPDKLSIVVQGYFAPVAVKYASEHQDKLNHLVLVNPPITDKHVNLPSTLASFSNFLLGEIFSQDPLRASDKVLTSCGPYLMKXEEDAMVYRRPYLVSGSSGFALNAISKAMKKDLKAYIESMRNILRSNSWKTKTTVCWGMRDRWLSYDGVEDFFGGLNQKIVELPMAGHHVQEDRGEELGNMIKSILR

SEQ ID NO: 44273 - protein, 154 aa, Sorghum bicolor
  Clone ID: SORBI-28MAY03-C107500_1.pep
MKHPDPIGEGLAMEAFAEAAGPDGIVPGHHAPLGPPGRAAAPTAAGQGIRPVPRIHHAPVLRVATQEDSAAYALAIMKHPDPIGEGLAMEAFAEAAGPECIVPGQQAPLRLMGLKVWPLDIDMKFLEPFGRELQSMKKFMDKSCSVMDSSMANK

SEQ ID NO: 44274 - protein, 470 aa, Sorghum bicolor
  Clone ID: SORBI-28MAY03-C10848_1.pep
HEALVYPALVLAYMGQAAFISQHHNIESSYHIGFYVSVPETLRWPVLVIAILAAVVGSQAIITGTFSIIKQCSSLSCFPGVKIVHTSSTVHGQIYIPEINWMLMILCLAVTIGFRDTKHLANAQGLAVITVMLVTTCLMSLVIVLCWNKSIFLALGFLLFFGTIEVIYFSAALVKFHEGAWVPITLSFIFMVVTCVWHYGTIKKYEFDVQNKVSVNWLLNLGPSLGIVRVRGIGLIHTELMSGIPAIFSHFVTNLPAFHQVLVFLCVKSVPVPHVEPEERFLVGRIGPKEYRLYRVIVRYGYRDVQKDDLEFEKELVSNIAEFIRSSGEYDKNGFVEDTDKPSEKLSTISTGINMWEEDGELDASGTPHKEIDPHNAVPKQKKARFMIPKSAQVDSEVRRELQELMDAREAGMSFILGHSYMKAKSGSSFIKRIVINFFYEFLRKNSRGPAYAANIPHASTLEVGMVYQV

SEQ ID NO: 44275 - protein, 132 aa, Sorghum bicolor
  Clone ID: SORBI-28MAY03-C8186_1.pep
MAFTMRAVKVPPNSASLEEARHRVFDFFKQACRSIPTVMEIYNLDDVVTPSQLRSTIAKEIRKNQNVTNPKVIDMLLFNGMEELNNIVEHAKQRHHVIGQYVIGQEGLVHDLGSKDQGNSDFLKKFYTSNYF

SEQ ID NO: 44276 - protein, 314 aa, Sorghum bicolor
  unsure (1)..(314): unsure at all Xaa locations
  Clone ID: SORBI-28MAY03-C8210_1.pep
MAAAATPPGGRPSSSSISRRAAAVVPALLLLAAAMAASAADAQPSPGYYPSSRFRPVPFNRAYTNKWGPQHQTLSGDHSALTIWLDRTCGSGFKSKHAYRNGYFSTRIKLPAGYTAGTNTAFYLSNNEAHPGFHDEIDMEFLGTIPGEPYTLQTNVYVRGSGDGRIVGREMRFHLWFDPTAAYHTYAILWNPDAITFFVDDVPVRRYERRTELTFPDRPMWVYGSIXDASDWATDDGRHRADYRYQPFVARLDRFVVAGCSVSAPPACRPVPASPAGAGLTAQQYAAMRWAQRDHMVYYYCNDFRRDHSLTPEC

SEQ ID NO: 44277 - protein, 326 aa, Sorghum bicolor
  Clone ID: SORBI-28MAY03-C8150_1.pep
MAMEKAASFLSSLLGGGGGGVGQPAATVKSIFIYPIKSCRGLAVPQAPIASTGFRWDRQWVVVNAKGRAYTQRVEPKLALVQVELPPEAFDEDWQPTPDDHMVIRAPGMDTLKIPLAAEHATIDDVSVWEWSGSAYDEGAEAAEWFSTYFGKPSRLVRFKEASETRPTDPDFAQGYKIAFNDCFPFLIASQGSLDALNEILKEPVPMNRFRPNILVDGCHPYSEDLWKTIKINNLTFLGVKLCNRCKVPTINQENGIPGTEPTETLLTFRSDQVLRPSHKNKRQVYFGQNLVCKESLSGKGKGKIIKVGDPVYVLQAFASSDEAPA

SEQ ID NO: 44278 - protein, 107 aa, Sorghum bicolor
  Clone ID: LIB3476-044-P1-K1-F2.pep
MERAASFLSSLLGVAGGDSGAPAATVKSVLVYPIKSCRGISVAQAPITATGFRWDRQWMLVNSKGRAYTQRVEPKLALVEVQMPPEAFAEDWQPTPDDHMVIRAPGM

SEQ ID NO: 44279 - protein, 71 aa, Sorghum bicolor
  Clone ID: SORBI-28MAY03-C8261_2.pep
MGGGMEVHKNRWIEEWNAGRENLEFNFRWTRRSLAVIGLFGLAVPILVYKGIVREFHMQDEDAGRPYRKFL

SEQ ID NO: 44280 - protein, 71 aa, Sorghum bicolor
  Clone ID: SORBI-28MAY03-C8261_1.pep
MGGGMEVHKNKWIEEWNAGRENLEFNFRWTRRSLAVVGLFGLAVPILVYKGIVRDFHMQDEDAGRPPRKFL

SEQ ID NO: 44281 - protein, 227 aa, Sorghum bicolor
  unsure (1)..(227): unsure at all Xaa locations
  Clone ID: SORBI-28MAY03-C8305_1.pep
YPPCQRPGARYTQGVWGCLRADEALLQLHGSNHSQPYPMDGLQLLLVXTLPSYLGLLEVLVYKVYVDEDASISTIERRASLKEFYAIIYPFLQQLEGNLMDKDCKDKGWCKESAAGGGRKLVADDDREDECGICLETCTKMVLPNCNHAMCINCYRDWYTRSQSCPFCRGSLKRVRSRDLWVLTGDDDVIDTVTLEKENVKHFLSFIDSLPLIVPDNMLLVYYDYLV

SEQ ID NO: 44282 - protein, 220 aa, Sorghum bicolor
  Clone ID: SORBI-28MAY03-C8750_1.pep
VHRRFLCDIASRKPHLTHHPTVIRRYNAFAVCYSNKALFALLYFFSFVLDGVDGWFARKFNQASTFGALLDLVTCMVCTACLLALLSQFYIPGLFFLILLGLDITSHWFQMYSSFLSGKTSHKDVKHTGNWLLKLYYGYRPFMAFCCVSCEVLYIILFLFADEKSTSLLSVCKGVLNQNPVVVLVFISTLVGWAVKQVTNVIQMKTAADACVVYDLKRSK

SEQ ID NO: 44283 - protein, 272 aa, Sorghum bicolor
  unsure (1)..(272): unsure at all Xaa locations
  Clone ID: SORBI-28MAY03-C12387_1.pep
MAALCSASPAISAAASLGSPARRVASLLRLRLRTASCSYSLASSPRAAAAGVPSWRARRRFVASAASTTDAEECSGVETLIPPDNRIPATIITGFLGSGKTTLLNHILTAHHGKRIAVIENEFGEVDIDGSLVAAQTAGAEDIMMLNNGCLCCTVRGDLVRMIGELVNKKEWKFDHIVIETKGLANPAPIIQTFYAEDVVFNDVKLDGVVTLVDAKHARLHLDEVKPKGIVNEAVQQIAYADRIIVNKVDLGNEPEVXYLVERNKGINRMAN

SEQ ID NO: 44284 - protein, 594 aa, Sorghum bicolor
  unsure (1)..(594): unsure at all Xaa locations
  Clone ID: SORBI-28MAY03-C12526_1.pep
MLPSSGGGRCRGRHLLLGFGLAVAALLALASASESDHKYKTEEPVKLWVNKVGPYNNPQETYNYYSLPFCQPSENPTHKWGGLGEVLGGNELIDSQLEIKFLKNVEKGSICTLELDAKKVQQFADAIESSYWFEFFIDDLPLWGFVGETDKNSENKHYLYTHKNILVXYNDNRIIHVNLTQESPKLLEDGKKLEMTYSVKWVATDVSFARRFEVYLDYPFFEHQIHWFSIFNSFMMVIFLTGLVSMILMRTLREDYAKYAREDDDLESLERDVNEESGWKLVHGDVFRPPRSXVFLSALVGIGTQLAALSRLVIVLAIVGMLYIGRGAIITTFIVCYALTSFISGYVSGGLYSRNGGKNWIKAMVLTASLFPFLCFSIGFALNTIAIFYRSLAAIPFGTMVVMFVLWAFISFPLVLLGTVVGRNWSGAPNNPCRVKTIPRPIPEAKWYLTPSVISLMGGLLPFGSIFIEMYFVFTSFWNYKVYYVYGFMLLVFVILLIVTICVTIVGTYFLLNAENYHWQWTSFSSAASTALYVYLYSIYYYHVKTKMSGFFQTSFYFGYTLMFCLGLGILCGAIGYLGSTLFVRRIYRNIKCD

SEQ ID NO: 44285 - protein, 187 aa, Sorghum bicolor
  Clone ID: SORBI-28MAY03-C1243_1.pep
QDVQRKVHDELDRVVGPGEAVTESDTASLVYLQAVIKEVLRLHPPGPLLSWARLATSDVNVGGHLVPAGTTAMVNMWAITHDASVWPEPTEFRPERFVAAAGGEDVVPIMGSDLRLAPFGSGRRSCPGKSLAVATVGFWVATLLHEFEWLPCGGGGGGGVDLSEVLRLSCEMAAPLEARVVPRRHAV

SEQ ID NO: 44286 - protein, 63 aa, Sorghum bicolor
  Clone ID: LIB3476-030-P1-K1-C12.pep
LRITEKEKITVTLIIWYTTLPSSRLTAGRYYMQQQQLVSYITHTHTHTHTHTIKHQTGWWLLR

SEQ ID NO: 44287 - protein, 257 aa, Sorghum bicolor
  Clone ID: SORBI-28MAY03-C1293_1.pep
MAANFWTSSHCKQLLDPDDVDLVPAADRERGITPEEFRLIKIHMSFHIWRLAQQVKVRQRVIATAVTYFRRVYTRKSMSDYDPRLVAPTCLYLASKVEESTVQARLLVFYIKKMCGSDDKYRFEIKDILEMEMKLLEALDYYLVVFHPYRPLLQLLQDAGITDLTQFAWGLVNDTYKMDLILIYPPYMIALACIYIASVLKDKDTTAWFEELRVDMNIVKNISMEILDFYDTYKIDPQRGIPEDKISSVMNKLPAKA

SEQ ID NO: 44288 - protein, 147 aa, Sorghum bicolor
  Clone ID: SORBI-28MAY03-C12715_1.pep
CNAGTCGAFDLSKDDGTQTSKILTTDDALMGLDYDPGNGLGATNGENDYESGLLEFDPVNHHNSYCPWVNRNVVVACCNNIGSSSSSSAPSGWQLTIDAVDTYQSLGQAQNQIMQSDSAASLYMDDQITRNHKVGRRPSVSRSFGKC

SEQ ID NO: 44289 - protein, 265 aa, Sorghum bicolor
  Clone ID: SORBI-28MAY03-C9229_1.pep
KKKLKLRPVTYLSGSQGSGNDIPHGYIWSPHLVPKPKDWGPKIDVVGFCFLDLASNYVPPEPLVKWLEAGDKPIYVGFGSLPVQDPQKMTEIIVKALEITGQRGIINKGWGGLGTLAEPKDFVYLLDNCPHDWLFLQCKAVVHHGGAGTTAAGLKAACPTTIVPFFGDQPFWGDRVHARGLGPPPIPVDQFGLQKLVDAIKFMVKPEVKDKAVELSKAMESEDGVTGAVRAFLRHLPSKTEEQSLPQSSGFLEFLGPLSKCLGCS

SEQ ID NO: 44290 - protein, 174 aa, Sorghum bicolor
  Clone ID: SORBI-28MAY03-C9452_1.pep
MDPNGLKTGGLLLPTIERRCTSPPSVIVIGGGISGVAAARALSNSSFKVTVLESRDRIGGRVHTDYSFGCPIDMGASWLHGVCNENSLAPLIGYLGLRLYRTSDDNSVLYDHDLESYALFDKDGNQVPKETVDKVGETFERILEETVKVRDEQEHDMPLLQAISIVFERHPHLK

SEQ ID NO: 44291 - protein, 286 aa, Sorghum bicolor
  Clone ID: SORBI-28MAY03-C9579_1.pep
EPVSKPSPFSTSEIWSWTAIFVASFGVAYFNPTALGTTAKTCLPFLLAANVLGYMVGSGLPAGVKKVLHPVISCALSADLAAAAYGYLSGSGFDAVLGDYLTKAASNPGAGDILMGFLGSVIISFAFSIFKQRKLVKRHAAEIFTSVAIGATFSLYSTAIIGRLVGLEPSLTISMLPRCITLALALSIVSFFEGVNSSVTAVVVVLTGLLGANFVLAAMEKLRLNDPISRGIATAASAQGLGTAALSAKEPEALPFCAISYSFTGIFGSLICSIPAVRQSLIFIAG

SEQ ID NO: 44292 - protein, 125 aa, Sorghum bicolor
  Clone ID: SORBI-28MAY03-C9651_1.pep
TSPEGFSYYYNSITRSLKWEKPEEYVLYEQQQQQQQQQQQQQQQKLLLLQQHQQKIAVQQLQSPPQGQSLISMQPIQQLPQAQGQTQMHMKQQELNYSQFQAAGSIDPNRIQQGIQAGQERAWKS

SEQ ID NO: 44293 - protein, 220 aa, Sorghum bicolor
  Clone ID: SORBI-28MAY03-C1034_1.pep
MGQQSLIYAFVARGTVILAEYTEFTGNFTTIASQCLMKLPASNNKFTYNCDGHTFNYLVEDGFTYCVVAVESVGQQIPIAFMDRVKEDFTKRYGGGKAATAAANSLNREFGSKLKEHMQYCVDHPEEVSKLAKVKAQVSEVKGVMMENIEKVLDRGEKIELLVDKTENLRSQAQDFRQQGTNVRRKMWLQNMKIKLIVLGIIIALILIIILSVCHGFKCH

SEQ ID NO: 44294 - protein, 444 aa, Sorghum bicolor
  unsure (1)..(444): unsure at all Xaa locations
  Clone ID: SORBI-28MAY03-C1047_1.pep
MGEVAALRQLVGQVQELWDLYGANAHPIPRWYLLDFEHGSIKDDYCGGRPGYNSELLKIMETNQSPPRKRPRRDRNREKAPSNKTEVMQQEIWRDFPEDLFETVIARLPVAAIFRFRTVCRKWSSLLGXSDSFSHQYSEAPRGLPWFYTITHENANNNVAMYDPSLKKWHHPSVPLTPSKIVIPAASVGGLVCLLDLSHRNFYICNPLMQSLKEIPPRSVQGWSRVAVXGMVLNGRSSSDGYKVMWLGNDGTYEVYDSTKNMWSCPGSFPPGIKLPLALNFRSQPVAVGSTVYFMCAEPDGVLSYDVSTGIWRQFAIPLPLHLTDHTLAEFQGRVMLVGLLCKNAATCVCIWELQKMTLLWKEVDRMPNIWCLEFYGKHMKMTCLGNSGLLMLSLKAKRMNRLVTYNLFKREWQKVPDCMLPCSRKKQWIACGTAFDPVPCALA

SEQ ID NO: 44295 - protein, 151 aa, Sorghum bicolor
  Clone ID: SORBI-28MAY03-C979_1.pep
SGIRRGGARLLVRSNNATNASTSTASPPPFPGPQPMAVYSSIWNADDWATQGGRVKTDWSHAPFEATFREVRVDGCAWAANATDGDAGEVRRCSETSWGKEGRYWWKEKEMSELSVHQSHQLVWARAHHLVYDYCVDTDRFPVQPPECAGR

SEQ ID NO: 44296 - protein, 164 aa, Sorghum bicolor
  unsure (1)..(164): unsure at all Xaa locations
  Clone ID: LIB3476-009-P1-K1-B8.pep
VWNPSQVVFMVDDTPIRVYENRQNATVHGAHHRSNNATNASTSTASPPPFPGPQPMAVYSSIWNADDWATHGGRVKTDWSHAPFEATFREVRVDCCAWAANATDGDAREVPRAAXTSWGKEGXYWWKEKECSCCHQSTNSVAPPPLLHFWCTDVPLALMPAVYL

SEQ ID NO: 44297 - protein, 154 aa, Sorghum bicolor
  Clone ID: SORBI-28MAY03-C14565_1.pep
MTSTVTTTVGCGGLPVRPSSSSTARRGRPRRCAVRAQAAGADASNDKSVEVMRKFSEQYARRSNTFFCADKTVTAVVIKGLADHRDTLGAPLCPCRHYDDKAAEVAQGFWNCPCVPMRERKECHCMLFLTPDNDFAGKDQVISLEEIKEATSKF

SEQ ID NO: 44298 - protein, 282 aa, Sorghum bicolor
  Clone ID: SORBI-28MAY03-C14515_1.pep
MATAHLLRRASSAFLFSTTNPLRSCFPLVRLQHPRAAMATDSSVAPFQKIQIQREDTTFDAYVVGKENAPGIVVLQEWWGVDYEIKNHAIHISQLGGGYRALIPDLYRGKVALDVAEAQHLMEGLDWQGAVKDIQASVKWLKSNGSPKVGVTGYCMGGALSIASGVLVPLVDAVVAFYGTPSSELADPSKAKAPIQAHFGEHDSFVGFSDVTAAKSLEEKLKSSGIPYEVHIYPGCSHAFMNTSPEALKRKKGMGLTDENQEAVDLAWSRFSSWMGRFLGSA

SEQ ID NO: 44299 - protein, 176 aa, Sorghum bicolor
  Clone ID: SORBI-28MAY03-C14649_1.pep
CLEGIPPAPRGMPQIEVTFDIDANGIVKVSARDKATGKEQEITIKSSGGLSEGEIEKMVKEAELHAQKDQERKSLIDLKNSADTTIYTIEKSVSEYKDKVPAEVTKEIESAVSDLRAAMAEDDLEKIKQKLEAANKAVSKIGEHMQQGGGGGSAGSSSGGDQTPEAEYQDAKEAKM

SEQ ID NO: 44300 - protein, 167 aa, Sorghum bicolor
  unsure (1)..(167): unsure at all Xaa locations
  Clone ID: SORBI-28MAY03-C15443_1.pep
MATTNGSSKVFEVPKVEVRFTKLFIDGKFVDAVSGKTFETRDPRTGEVIATVAEGDKADVDLAVKAAREAFDNGPWPRMTGYERGRILHKFADLIDEHVEELAMLDTVDAGKLFLVGKVRDIPGAAHLLRYYAGAADKIAPPTRXHGETLKMAQRMHGYTLKEPVGV

SEQ ID NO: 44301 - protein, 144 aa, Sorghum bicolor
  Clone ID: SORBI-28MAY03-C11153_1.pep
PTTSPSLVASAQGLQNEEFSPSQLSKMFGSHATMMANTLRTPIIVFTQTGSMAVLLSHYRPSSTLFAFTNEERVKQRLALYQGVIPIHMQFSDDAEETFSRAISSLLKAQYVKKGDYVTLVQSGVTSIWREESTHHIQVRKVQV

SEQ ID NO: 44302 - protein, 248 aa, Sorghum bicolor
  Clone ID: SORBI-28MAY03-C11221_1.pep
RQYRGKLERKAVLKAICAGFEETTEPNVCLSDDMETNECLNDNGGCWQDKSANVTACRDTFRGRVCECPTFNGVQFKGDGYSNCEPAGPGKCLINHGGCWHETRNGKTFSACQESGDGKCRCPAGFRGDGVKQCEDIDECKERKACQCSECNCRDTWGGYDCTCSGDLLYIREHDTCISKTTVQAKAAWAAVWGILIVVAVVAVGSYVVYKYRLRSYMDSEIRAIMAQYMPLDNQGDVPNHTHDEDRS

SEQ ID NO: 44303 - protein, 163 aa, Sorghum bicolor
  unsure (1)..(163): unsure at all Xaa locations
  Clone ID: SORBI-28MAY03-C11272_1.pep
MLRVAGRRLSSALSWRPATAAAGTRGPLAGTLPGRDDDDTRDRRARFAIDSPFFAAARGFSAETLVPRNQDVGLAELPPTVAAVKNPSGKIVYDESNHERYPPGDPSKRAFAYFVLSGGRFIYASLLRLLILKFVLSMSASKDVLALASLEVDLSSIEPGTTX

SEQ ID NO: 44304 - protein, 218 aa, Sorghum bicolor
  Clone ID: SORBI-28MAY03-C1141_1.pep
EDTFTGLMAQSRGVQCHEKTEKSEMRQLVQALVDKYNEDHNLFEDLAHELKDVLHYQSIIENLNLYYHFNFKTKIKGAGPNELSMDNLFFVEVKFIGKGKLIELQANCFCAVNPDDNGPCFGCTKHGDVGMKHPSSSVGYTAGHLNVGLPFGFIAKWKRDYEDEEDDDKYVKAKEAELRQMFKGLDNPDVMKKLCTPPPWATKRKAQEWNITVHCTCV

SEQ ID NO: 44305 - protein, 481 aa, Sorghum bicolor
  Clone ID: SORBI-28MAY03-C11894_1.pep
PEGVALRSRRPPPAAAAAAPGAWRSRTCCAAAPPPAGRRRAGTAPRAGPPPRDAPARRPPPAPPAPRARGPAPAPPRAAPRASPAATGAAAAPPIPAGVRRPPPPPAPSSPAPGFDGHNGSAAAVYAKEHLLGNVLSCVPTDLSRDEWLAALPRALVAGFVKTDKDFQTRAHSSGTTVTLAIIDGSVVTVASVGDSRCVLEAEGSIYYLSADHRFDANEEEVGRVTECGGEVGRLNVVGGAEIGPLRCWPGGLCLSRSIGDQDVGEFIIPVPYVKQIKLSNAGGRLIISSDGVWDALTAEVAFRCARGLPPEAAAEQIVKEAVESKGLRDDTTCIVIDIIPPEKPKCTIESPKTPGKGLVLLKKFFLRKTASDSLSLADKDNYPEPDLVEEVFEDGCPSLSRRLNSEYPVRDMFKIFACAICQIELESGQGISIHEGLSKPGKLCPWDGPFLCHSCQEKKEAMEGKRHSRDSSSRNSGSSE

SEQ ID NO: 44306 - protein, 405 aa, Sorghum bicolor
  Clone ID: SORBI-28MAY03-C12285_1.pep
MAAEMVKAATSDKLKEMDWAKNIEICELVAQDPGKAKDVIKSIKKSIGSRSKSTQLFAVMLLEMLLNNCGEPIHRQVIDNGLLPILVKIVKKKTDLPVREKIFLLLDATQTSLGGAKAKFPQYYEAYYELVSAGVQFSNRPNVVVTRAEVPVPEPRTEPNNESLATRLNEAQQELHAQPAPDASIVQKASSVMEVLRDVLNSMDPRHPEGATDEFVLDLVEQCTFQKQRIMHLVMTSRDEMVVSQAIELNEELHKVLVRHDALLSVHPTTTVPSNIKEEEEEEDAESLYRRLRKGKALSQDYTDDSVPSFRSMPEDKLRRPLTIQSPHPDKRLGALNIRSPDREEPRPDPAPLIPPPPSKHAERERFFREKSIDGVASLPGHLRGLSQHSRDGSSSCSGSTDYGD

SEQ ID NO: 44307 - protein, 221 aa, Sorghum bicolor
  Clone ID: SORBI-28MAY03-C1696_1.pep
MAAAASATAISGVVLPHAFLSHRSPPPQVLAVASSFRRLSLCASPRRTTHIIARADASAEAGEPETEEPVTSSAESEEEVAEGAVAVAEAEEEEAEEPPPPSKPKVKFGEIIGILNKQFIEEAEKVKTVPDLRPGDIIELRMQRPNKRRLSLFKGIIIAKHKAGVHTTIRVRRIIAGVGVEITFPVYSPRIKEITVIRHRKVRRAKLYYLKDKLPRFSTFK

SEQ ID NO: 44308 - protein, 78 aa, Sorghum bicolor
  Clone ID: LIB3480-035-P1-K1-G11.pep
TSTHRFHKSNKNPSKFNIIGLLLEVQHHRVQHPSLMQVQDTSLLQFDIQPYSGSEKRFATRNRNGGGRSCSVIISYFT

SEQ ID NO: 44309 - protein, 214 aa, Sorghum bicolor
  unsure (1)..(214): unsure at all Xaa locations
  Clone ID: SORBI-28MAY03-C16157_1.pep
HEGSFKTKLANGGRSRVGRFYLSLLCWHTGLLCLEVLDPGTWKLLGGGHEAVYAAVKLPLFSSETAAIXDIPHSILXLEGSSISATLSQVGARILVTXYIVWSFPETQSPVLGASLVLSWSITEVIRYSFFGLKEAFGITPFWLLWLRYSTFTLLYPIGLISEVGLIFVAMPHMKGRSFYICAALTSLYIPGFPYLYRYMLAQRKKVLSKAKTA

SEQ ID NO: 44310 - protein, 242 aa, Sorghum bicolor
  Clone ID: LIB5049-002-R1-XP1-G4.pep
PAGPGTLQWRVFLQKKTLQWRLYLSVYNWVSFFGWLLVLYHAILALLGGGHEAVYDAVKLPLLFSQTAALAEILHSITGFVSSPISATLPQVGIRTSVLWFIVWRFPETQSHVCLTSLVLSWSITEVIRYPFFGLREAFGITPFWLLWLRYSTFIVLYPIGLISEVGLIFTAMPHMKGRSFYICAALTTIYIPGFPRMYRYMLAQRKKNLSQSKAESRMTLQTSLTVPDRETSVSASLEDAL

SEQ ID NO: 44311 - protein, 219 aa, Sorghum bicolor
  unsure (1)..(219): unsure at all Xaa locations
  Clone ID: LIB5048-004-R1-XP1-D10.pep
MEGVPSKKNSSMAGDNGSVVRRLYLSVYNWVSFFGWLLVLYHAILALLGGGHEAVYDAVKLPLLFSQTAALAEILHSITGFVSSPISATLPQVGIRTSVLWFIVWRFPETQSHVCLTSLVLSWSITEVIRYPFFGLREAFGITPFWLLWPRYSTFIVLYPIGLISEVGLIFTAMPHMKGRSFYICAALTTIYIPGFPRMYRYMLAQRKKDLSKSXGEAA

SEQ ID NO: 44312 - protein, 159 aa, Sorghum bicolor
  Clone ID: SORBI-28MAY03-C17600_1.pep
MARRLLAFLLAASLLLPLARPEDSSTSSTSNLSPAANTTAYDELGLRGFPRGLLPANVRAYTLDAGSGDFAVHLRSSCRIVLPAGSYLAAFSDRLTGRLDDRRISGLDGIRVRAFFRWWSITGIRADGDQLVFEVGSVSAKFPARDFNASLECPDQAAA

SEQ ID NO: 44313 - protein, 194 aa, Sorghum bicolor
  Clone ID: SORBI-28MAY03-C17955_1.pep
MATATATTSPLFSLSSLCASLPSPTRIPTSLSLRALSPRARLSASLPFASPLGGYGTWAATSTSSAGRLRRRGLEVVCEATTGRQPDSVKKRERQNDKHRIRNHARKAEMRTRMKKVLRALEKLRKKPDAQPEEIIEIEKLISEAYKAIDKTVKVGAMHRNTGNHRKSRLARRKKAIEILRGWYVPNAEPVAAT

SEQ ID NO: 44314 - protein, 232 aa, Sorghum bicolor
  Clone ID: SORBI-28MAY03-C13582_1.pep
MASTHAISKKRKFVADGVFFAELNEMLTRELAEDGYSGVEVRVTPMRTEIIIRATRTQNVLGEKGRRIRELTSVVQKRFNFPEGGVELYAEKVNNRGLCAIAQAESLRYKLLGGLAVRRACYGVLRFVMESGAKGCEVIVSGKLRAQRAKSMKFKDGYMISSGHPVNLYIDSAVRHVLLRQGVLGIKVKIMLDWDPKGKQGPTMPLPDLVTIHEPKEEDEFLRPLAAEIPVA

SEQ ID NO: 44315 - protein, 142 aa, Sorghum bicolor
  Clone ID: SORBI-28MAY03-C14149_1.pep
MCLAEYLPALEDSLNGLLVEASASIGSRRRFIEALAPTFGRPLEADPIFCRRATILSISGIFTFLVHFAIPLQFPKQQPVLTLQSSQHCNADGTPIMSPPINDYPWSPRWDQAEMVERIYDFLTDECQNFKKFCSDAITQQK

SEQ ID NO: 44316 - protein, 91 aa, Sorghum bicolor
  Clone ID: SORBI-28MAY03-C14113_1.pep
MGLQEEFEEYAEKAKTLPESTSNENKLILYGLYKQATVGNVNTDRPGIFYQKDRAKWDAWKAVEGKPKEEAMNDYITKVKQLQEEAAAATS

SEQ ID NO: 44317 - protein, 190 aa, Sorghum bicolor
  Clone ID: SORBI-28MAY03-C13921_1.pep
RSSAWCRAGACPTAGPGGASPRCWWSAGSTGGCAATGRTRVTTSPGSRCWTRGAPRQRRCQDPGGQGLLPRRLRERQPWSSRRPSGACASSVNRKQYKVTVHGYVEPHKVVKRVQATGKKAEIWPYVPYSLVAHPYAAPAYDKKAPPGYVRRVDAVMPVSSYGGPTAAGPQEERLVTMFSVDNPNACSIM

SEQ ID NO: 44318 - protein, 70 aa, Sorghum bicolor
  Clone ID: LIB3480-022-P1-K1-H3.pep
RKQYKVTVQGYVEPHKVVKRVQATGKKAEIWPYVPYSLVATPTPAGDSGAPSSTSPSDLIHSSALSASLV

SEQ ID NO: 44319 - protein, 292 aa, Sorghum bicolor
  Clone ID: SORBI-28MAY03-C14254_1.pep
VWRARTKALGLAPEQRTKLLFAVDGRRRFSPPLPRGYFGNGIVLTNALATAGELLSAPVSRAAGLVQEAVRMVTDDYMRSAVDYFEATRARPSLASTLLITTWSRLEFHGADFGWGEPVMSGPVTLPEKEVILFLAHGKERKSINVLLGLSNLDQNIAVIVQNEICYTPSAPSPSADGGEDVDVAAALRDALARVPVHFHPLAGRLGISPEMKLTVELTGEGVVFVEADAACDLAVVGDLTKPDPAALGQLVYSVPGAKHILEMPPMTAQVTRFKCGGFALGLAMNHCMFDG

SEQ ID NO: 44320 - protein, 301 aa, Sorghum bicolor
  Clone ID: SORBI-28MAY03-C13747_1.pep
MAEPGSTTPPNGSAPATPGTPAPLFSGGPRVDSLSYERKSMPRCKCLPAVEGWGIATHTCVVEIPAPDVSLTRKLGAEFVGTFILIFFATAAPIVNQKYGGAISPFGNAACAGLAVTIIILSTGHISGAHLNPSLTIAFAALRHFPWLQVPAYVSVQVLGSICASFALKGVFHPFLSGGVTVPDVTISTAQAFFTEFIISFNLLFVVTAVATDTRAVGELAGIAVGAAVTLNILVAGPTTGGSMNPVRTLGPAVAAGNYRQLWIYLLAPTLGALAGAGVYTAVKLRDENGETPRTQRSFRR

SEQ ID NO: 44321 - protein, 134 aa, Sorghum bicolor
  unsure (1)..(134): unsure at all Xaa locations
  Clone ID: LIB3480-006-P1-K1-C7.pep
QTDRPTTTGATISTAQAFFTEFIISFNLLFVVTAVATDTRAVRIYIHTWXGELAGIAVGAAVTLNILVAGPTTGGSMNPVRTLGPAVAAGNYRQLWIYLLAPTLGALAGAGVYTAVKLRDENGETPRTQRSFRR

SEQ ID NO: 44322 - protein, 289 aa, Sorghum bicolor
  Clone ID: SORBI-28MAY03-C19165_1.pep
MGDHEARGDDFEKKAEKKLSGWGLFSSKYEDAADLFDKAANSFKLAKNWSRAASVYIKIANCHLKGDSKHEAASAYVEAANCYKKFSPQEAAQALNQSVNLFLEIGRLNMAARYSKDIGEIYQQEQDLEKATDYLERAADLFDSEGQSSQSNTIKQKVAEIAAQLEQYPKATEIFEAIARQSINNNLLKYSVRGILLNAGICQLCRGDPVAITNSLERYQEIDPTFSGTREYKLLADLAASMDEGDVAKFTDAIKEFDSMTRLDPWKTTLLLRAKNELKKREDDEDDLT

SEQ ID NO: 44323 - protein, 175 aa, Sorghum bicolor
  Clone ID: SORBI-28MAY03-C19256_1.pep
MALASRAAAMACVLLALAASAAGAGSHSPAPAPAVDCVTQATTLIDCLDYVQPGSTAKRPSAACCAEVKTAVASPAIVGCLCSLAGNKDLGIPIDMKRVLALPGACGASNAAFSKCNISALSPAGAPAPSSTAGGSSSGGAAASPPKAAAASSPMTATALVAAVAAPLLAYFYLF

SEQ ID NO: 44324 - protein, 126 aa, Sorghum bicolor
  Clone ID: SORBI-28MAY03-C19328_1.pep
LLRWLTTLPPHGSLIALCWLLLPLNLALRAAPAAASPLRQRRRKPSPLPTPPNPRRLRSSCPAPPSPCLSLRAPTPASAPSPLWPGRLPSASVSSTGASSSQSSRQQNLKRRKHMLITKHGRAATC

SEQ ID NO: 44325 - protein, 316 aa, Sorghum bicolor
  unsure (1)..(316): unsure at all Xaa locations
  Clone ID: SORBI-28MAY03-C1940_1.pep
TRDAAGWSDPSPPSSTHSTHLPAAHQSPLPLLRLLRPAASAKLPPIRPRSGHAFSMAEQLSSSQDAPNRPAPAQRVLVTNTHGETLVGLLHHMGSDKXDSLITDLAAALTKQGSSVFRFDFSGNGESEGEFQYGNYKKEAADLHSVVLYLRQEKYNVAAIVGHSKGGDVMVLYASIYNDVPMVVNLSGRFNLEKGIEERLGKEFMDRINKEGYIDVTNKSGKVLYRVTKETLMERLSIDMHASSLSISKECRFFTIHGSADEIIPVEDAYEFAKLIPNHKLRVIEGANHCYTAHRRELSDAVVEAITSSEAGETKP

SEQ ID NO: 44326 - protein, 204 aa, Sorghum bicolor
  unsure (1)..(204): unsure at all Xaa locations
  Clone ID: SORBI-28MAY03-C19814_1.pep
TTTQTNQQPWLVVLINRWWXVLAMVALMVTAAEGFISKKTWSAIRRADRDGPFVGLXCPTPTRWTPSXSSPDFKPSNNIPILDVQGRRFRFGTIGSQNVVMVMTGLSMLNAGLTTQLLLSLFRVKGIVHWGIAGNANEDLQIGDVTIPESWAHLSLWNWQRHGDGAENELPLESAGDYTREYGFLNFSDYTVGQANPELSANTL

SEQ ID NO: 44327 - protein, 145 aa, Sorghum bicolor
  Clone ID: SORBI-28MAY03-C15437_1.pep
MPKIKTSRVKYPEGWELIEPTLRDLEAKMREAENDPHDGKRKCEALWPIFRISHQKSRYIYDLYYRRKEISKELYEFCLDQGYADRNLIAKWKKPGYERLCCLRCIQTRDHNFATTCVCRVPKHLREEKVIECVHCGCRGCASGD

SEQ ID NO: 44328 - protein, 197 aa, Sorghum bicolor
  Clone ID: SORBI-28MAY03-C15664_1.pep
LDTTDLPSLNLPSILHDPLIHLPLPTSPLITLHGSQVPTFTPLMSDPIVHIPVIDVCSAGQAYLVSCGPSITSAVPLLPSLKPLLPEAESLVERSARETLMRLIASTPPASNPQLANVLPVVIPDMPESIYRANNVNKHVDVGPNDKAFGTSCVAAVFGSGIAQAEDEVPSGDDSQEQFAEYDGTSNECDVQHCQKI

SEQ ID NO: 44329 - protein, 207 aa, Sorghum bicolor
  Clone ID: SORBI-28MAY03-C16126_1.pep
RFGDYRKDDPSSFSLHSNFSLFPQFMFNLRRSQFVQVFNNSPDETAYFRMLLNRESITNSVAMIQPSLISFSFDSPPSPVFLDVASIAADRILLLDAYFSVVIFHGMTIAQWRNMGYQNQPEHEQFAQLLQAPHEDAQMIIKGRFPVPRLVVCDQHGSQARFLLAKLNPSATYNSAHDVAPGSDIIFTDDVSFQVFCEHLQRLAVQS

SEQ ID NO: 44330 - protein, 186 aa, Sorghum bicolor
  Clone ID: SORBI-28MAY03-C15710_1.pep
MDEAQVVESKDGTISVASAFAGHQEAVQDRDHKFLTKAVEEAYQGVDNGDGGPFGAVVVRNDEVVVSCHNMVLKHTDPTAHAEVTAIREACKKLGKIELSDCEIYASCEPCPMCFGAVHLSRIKRLVYGAKAEAAIAIGFDDFIADALRGTGFYQKANMEIKKADGNGALIAEQVFEKTKEKFRMY

SEQ ID NO: 44331 - protein, 167 aa, Sorghum bicolor
  Clone ID: SORBI-28MAY03-C17120_1.pep
MNVDKLKKMAGAVRTGGKGSMRRKKKAVHKTTTTDDKRLQSTLKRIGVNTIPGIEEVNIFKDDVVIQFQNPKVQASIPANTWVVSGVPQTKSLQDLLPSIINQLGPDNLDNLKRLAEHFQKQVPGAEAGAAAQDDDDVPELVPGETFEEAAEEKKVPEPEPEEKKES

SEQ ID NO: 44332 - protein, 266 aa, Sorghum bicolor
  Clone ID: SORBI-28MAY03-C17378_1.pep
MVPRDRAHSATTATAAPAENLVQGPILNNKCEKKAPKKVHKSEREKRKRDKQNDLFGELGNMLEPDRQNNGKACILSDTTRILKDLLSQVESLRKENNTLKNESHYVALERNELLDETNVIRGEISELQNELRMRLEGNPIWSHDTSRSNITAPHPATTVFTLQHSAHPQVIATMALPLQQPAVVEQSYAAPRRELQLFPEAAPTEDTEPPQNQGISNNVMRPQARYPPVVTTLPVHVYPVLPRMEDEQCSSGTTSSREEGGVGNR

SEQ ID NO: 44333 - protein, 316 aa, Sorghum bicolor
  Clone ID: SORBI-28MAY03-C24654_1.pep
MSMGHCSEQRTGFEVTKDWNGADQVAIRSPRGASVRVCLHGGQVVSWRNHRGEELLFSSSKAIFKPPKATRGGIPICFPQFGNCGTLEQHGFARNKIWTIDDEAPPLNSGDNNNNKASVDLLLKPSEDDLKCWPHCFELRLRVSLSMDGDLSLISRVRNVNGKPFSFAFAYHTHLSVSDISEVRIEGLETLDYLDNLSQRERFTEQGDAITFESEVDRVYVGCPGVIAVLDHEKKRTFIIRKEGLPDIVVWNPWEKKSKTMTDFGDDEYKQMLCVDAAAVERTITLKPGEEWTGKLELSAVASTNCSDHLDHPGRL

SEQ ID NO: 44334 - protein, 316 aa, Sorghum bicolor
  Clone ID: SORBI-28MAY03-C2169_1.pep
MEKGAPEASPPCARCGKPAQLQCPKCAELKLPRENAAFCTQDCFRAAWSSHKSVHPKPGALASQQSPEGWKYCVRKGRGRALELPRFDWTGPLRPYPISKMRVVPDEIEKPDWALDGIPKIEPDSDLQKRVEIKTPELIERMRETCRIAREVLDAAARVIKPGITTDEIDRVVHEATIARGGYPSPLNYHFFPKSCCTSVNEVINRHASMSGLSVVKSYCGHGIGELFHCAPNIPHYSRNKAVGIMKAGQTFTIEPMINAGVWNDRLWPDDWTAVTADGKRSAQFEHTLLVTETGCEVLTARLPSSPDVFPWLKKP

SEQ ID NO: 44335 - protein, 100 aa, Sorghum bicolor
  unsure (1)..(100): unsure at all Xaa locations
  Clone ID: LIB3481-004-Q6-K1-E7.pep
SAVYYKGVHGDLNETYFVGNVDEASKQLVLCTYECLEKAIAIVKPGVRFREVGEVINRHAGGXGLSVVKSYCGHGIGELFHCAPNIPYYSRNKAVGIMKA

SEQ ID NO: 44336 - protein, 181 aa, Sorghum bicolor
  unsure (1)..(181): unsure at all Xaa locations
  Clone ID: SORBI-28MAY03-C250_1.pep
ASAXNLYQTXYQLNGSAYVISKHISNTWLWDRVRVSGGAYGGFCDFDNHSGVFSYLSYRDPNLLKTLEVYDETARFLRELEMDDDALTKAIIGTIGDVDAYQLPDAKGYSSLMRYLLGITDEERQQRREEILSTSLKDFKEFADAVETIKDNGVVVAVASPDDVEAANKENPVFPEVKKCL

SEQ ID NO: 44337 - protein, 186 aa, Sorghum bicolor
  Clone ID: SORBI-28MAY03-C25405_1.pep
MDARWAVLLALLVASGGGGGVRVCAAGAKGANWLGGLSRASFPKGFVFGTATSAYQVEGAASTNGRGPSIWDSFAHVPGNIAGNQNGDVAVDQYHRYKEDVDLMKSLNFDAYRFSISWSRIFPDGEGKVNPEGVAYYNNLINYLLQKGMTPYINLYHYDLPLALEKKYGGWLSAKMADLFTDYADF

SEQ ID NO: 44338 - protein, 116 aa, Sorghum bicolor
  Clone ID: SORBI-28MAY03-C5358_1.pep
RSDMYVFCCSYTHNVAPRGKFIAFVSAEAETDSPQSELKPGIDLLGSVDEIFYDIYDRYEPVNEPSLDNCFVSTSYDATTHFETTVTDVLNMYTMITGKTVDLSVDLSAASAAEEY

SEQ ID NO: 44339 - protein, 263 aa, Sorghum bicolor
  Clone ID: SORBI-28MAY03-C14771_1.pep
GKSKAYFAKTMDDRFIIKQIKKTEFESFIKFAPDYFKHVYHSLDTGSQTCLAKILGIYQVKQIRHGKEVKIDLMVMENLLFGHNISRIYDLKGATFSRRVTDSNDHDTVYLDQNYVEDMGFSPIYIGGRTKHLLQRAIWNDTAFLTSANVMDYSLLVGVDKEKHELVFGIIDYLRQYTWDKQLETWVKTSLVVPKNVSPTVISPKEYKKRFRKFMAKYFLSVPDTWSPDNSSKPCKSLGQSNHKSVELQNGNNLLQHPTEGCA

SEQ ID NO: 44340 - protein, 240 aa, Sorghum bicolor
  unsure (1)..(240): unsure at all Xaa locations
  Clone ID: SORBI-28MAY03-C14482_1.pep
MAGGDELKLLGMWASPFVLRVKLALSIKGLSYEYVEEDICGGKSELLLKSNPVNNNVPVLIHNAKPVCESLIILQYIDEAFAGTAPTLLPADPYERAVARFWAADIDDKVLAAWMQATRGKTGEDKGEGRRQWSVAVETLEGALRDCGKGKPFFGGDSXVGFVDVVLGGLLGWVQANEEAFGIESLDPQRTPLLXAWSERFGALDTGEPARPEVSRLGGLGRMVLARAPGAAALAAGASN

SEQ ID NO: 44341 - protein, 101 aa, Sorghum bicolor
  Clone ID: LIB3480-019-P1-K1-F9.pep
DIFGGKSELLLKSNPVHNKVPVLIHNGKPVCESLIILQYIDEAFAGTGPTLLPADPYERAVARFWAAYIDDKVRKENPVFQSIASIGCDMAGFVHRWGRHA

SEQ ID NO: 44342 - protein, 394 aa, Sorghum bicolor
  Clone ID: SORBI-28MAY03-C14933_1.pep
MALEGPAERRDEVQVAMGNGNGVAPSQPSRPAGRPPAAAAPYADRRLRLNPNAEHKPQDYSDVRGEYAPAVYSALERHLPPSLLDADRDVKLHFMRDILARYWPQGERNKVQRHREYRQRILHLYKPLHEELYNMHPSVFFLPTFLEAVRSNTEESFRSIMTEPIPGVYSFAMLQPTFCEMLLEEVENFEKWVHAMKFKIMRPNTMNKYGAVLDDFGLEAMLNQFMQQFIAPISKVFYPEVGGGTLDSHHAFIVEYGKDRDLELGFHVDDSEVTLNVCLGKQFSGGELYFRGIRCENHVNSETQHEEMYDYTHIPGRAVLHRGRHRHGARATSSGLRINLLLWCRSSVFREMKKYQKDFPSWCGECQREKRERQSQCVKATKMAFLRGSGGATI

SEQ ID NO: 44343 - protein, 124 aa, Sorghum bicolor
  Clone ID: SORBI-28MAY03-C15244_1.pep
MSSAAGGDGETVRASHILIKHQGSRRKASWKDPDGRIISATTRADAAARLLDLRNQILSGQANFADLAARHSDCSSARRGGDLGTFGRKQMQKPFEDATYALKVGELSEIVDTDSGVHVILRTA

SEQ ID NO: 44344 - protein, 360 aa, Sorghum bicolor
  Clone ID: SORBI-28MAY03-C1533_1.pep
ASGRARAGDPEPERPPPRPPAPRPRPAGRLAGDVAVAVVVAGLPGGPPDEALRDALRDAGAFVAAIVSVELSVDRSGYGLGSGSLPCAPPRAAARAVAGMVGKRFGHRIVRGTEVRTRGPRDFGRDGFRRDPRRYGRDPYWDRRDRERSYDRERDPYHDRDSDRSREHDRERDYEHGGFNREIDYPMDRDHEVDERRPREHDRAAEMHNMDSDNDKDREHGTRKSRPKGRDSRDLSSSSDDLQNDGKHQLDKTIQMREDLENEVNQIKDKISGKEQHIADLQKKAQKLEDELVAARKVSSERQLAVTDLYKHFLQLQDYNDRVKTAEQRLQSLVDAAMVELDIAEDATTRDGSMYENGVV

SEQ ID NO: 44345 - protein, 443 aa, Sorghum bicolor
  Clone ID: SORBI-28MAY03-C15544_1.pep
TRPPSKKSAGPTVERPSRESTTVERYAELAPRATPAKKSPAIVQGSGTKLKDIPNVSFKLSKRKVDENLQSLHTVLYGRKSNNHFLKRNISQFSGFVWTDNQEKQRNKIKEKLEKFNKEKLLDFCEVLDINVKVTTKKEEVSAKLLEFLESPCVTRDVVLTDKKKGKKRGRKSKATSEGASAEKKRKRVQKQAAEDGKENDDADDADPAGSEDASTGEEADGDSEANDHAVSDDELDEPPAKKKSTDAKQVKKETGSDAKHEDTPGKKGSTKPAKGASKASQNSKNEPDAEVKKVGKRAKSSKESVVSPDSNKSNKKVSKSKKDDGKESQNNKAARSSNKNKGKGKGGAAAGTAPTTEQLHAVVSSILKEVDFNTATLADILRQLGTHFEMDLMDRKAEVKRIIEEVINSMSDDEGEEDSEDEAEDNGKVEKSKSDPDGGEEK

SEQ ID NO: 44346 - protein, 253 aa, Sorghum bicolor
  Clone ID: SORBI-28MAY03-C2825_1.pep
VSVCVILLELTSTRPMLPLLMLVLLISKTIADNFNKGVYDQIVVMKGLPFMEAHAEPYMRHLVAGDVVSGPLITFSGVEKVGNIVHALRLTGHNGFPVVDEPPITEAPELVGLVTRSHLLVLLNSKNFMKERFKTSGSFVLRRFGAFDFAKPGSGKGLKIEDLDFTDEEMDMYVDLHPITNTSPYTVVETMSLAKAAILFRELGLRHLLVVPKTPDRPPIVGILTRHDFMPEHIHSLFPNLNPHKYHSASMAG

SEQ ID NO: 44347 - protein, 269 aa, Sorghum bicolor
  Clone ID: SORBI-28MAY03-C2786_1.pep
MAATAAEVPVEAPVRTVKVTNVSLSATVQDIKEFFSFSGDIEHVEMQSGDEWSQVAYVTFKDAQGAETALLLSGATIVDLSVIIAPAPEYQPPPTYSAPPMSGTRVAVGGDNTVVHKAEDVVSSMLAKGFVLGKDAVGKAKAFDEKHGFTSTAGAKVASIDKKIGLSDKITTGTSLVTGKVKEMDQKFQVSDKTKSAFAAAEQKVSSAGSAIMKNRYVFTGASWVTGAFNKVAKAATDVGTMTKEKMAAEEQQKGSGPSSGGHSYTPIR

SEQ ID NO: 44348 - protein, 117 aa, Sorghum bicolor
  Clone ID: SORBI-28MAY03-C28469_1.pep
FLVARGVCAFGGLLLLAGLGMLCWIDQDDGRHSFGHSGGFICPFVPLLPVMCILINTYLLINLGGGTWMRVGVWLVMGVFVYIFYGRTHSSLTDVVYVPVAEANEIYGSPSSSGFVA

SEQ ID NO: 44349 - protein, 432 aa, Sorghum bicolor
  Clone ID: SORBI-28MAY03-C19950_1.pep
MAEPSQQLLRSFVEVPAGSHFPIQNLPFGVFRRQGSAQAQAQAPRPAVAIGDFALDLAAVADAGLFDGPVLSGSPCFHQETLNMFLGMGRPAWREARATLQKILSADEPVLRDNEALRNKCLVPMSDIEMVLPITVGGYTDFFCSVHHARNCGFIFRGPQTPVMPNWFYLPIGYNGRASSIVVSGTDVIRPRGQGHPTGNSSAPYFGPSQKLDFELEMAAIVGPGNELGKPIDINDAEEHIFGLTLMNDWSARDIQAWETIPLGPFLGKSFSTTISPWIVTLDALKPFMCDAPKQEPEPLPYLAEKNHINYDIPLEVWVKPKGQNDASVVTKTNFKHLYWTVTQQLTHHTINGCNMSPGDIFATGTLSGPEPESLGCLLELTWNGQNEIPVGNSTRKYLEDGDEVILTGCCKGEGYNVGFGTCTGKVLPALP

SEQ ID NO: 44350 - protein, 252 aa, Sorghum bicolor
  Clone ID: SORBI-28MAY03-C203_1.pep
PSSRAASAMSLSVAGARTSTSPLPSSFAASSSRPRLLALPLHRRSHGSLASPPAAGRRRLRRLLRVRMARTESTRVGIGCRAPEVELPEPLTGKLWTLDDFDLHSALICNHCPFVKHLKKDIAKLTSFYVEKGLGAVAISSNSVRTHPQDGPEHMAEEAKLFKYPFPYLYDESQEVAKAFGAVCTPEFYLFKKDGRRPFELFYHGQFDDSRPSNNVPVTGRDLSRAIDCALSGQELPFVQKPSVGCNIKWHP

SEQ ID NO: 44351 - protein, 174 aa, Sorghum bicolor
  Clone ID: SORBI-28MAY03-C21141_1.pep
CAPSCYYRRRCNAVLSLLLCGQPSQAFYLVPRPLLQPGSNDIVLFEQFGGDPSKISFVIRQTGSVCAQVSEEHPAQIDSWNSSQQTMQRYGPELRLECPKDGQVISSIKFASFGTPSGTCGSYSHGECSSTQALSVVQEACIGVSSCSVPVSSNYFGNPCTGVTKSLAVEAACS

SEQ ID NO: 44352 - protein, 231 aa, Sorghum bicolor
  Clone ID: SORBI-28MAY03-C212_1.pep
MDAAVAATCSLLLVSGPRSRSSPTTLPSPSLLRPPCKNICCSITTSTTARRQQQHLVAPRLGSKGSSRSISWRCFSSATGGSSTAVTTEKWILDPAGDGDWRHIGYKVARPGAIEIISDDAVTVGRVADKADIVLPIATVSGTHARLEKKGGSLLVTDLDSTNGTYINERRLNPGFPIAIDPGSFLIFGDIHLAMFRVRKMRVEVASTEDEGAQQETKTEVAAAAVEDTAS

SEQ ID NO: 44353 - protein, 500 aa, Sorghum bicolor
  Clone ID: SORBI-28MAY03-C2131_1.pep
MPLAAAAAAVAACPSPIGLTRPLCRIEAHPRRRRRFRSEASSSASAPAPAAVDEGGGAGPCPVVRFDMADFTVADRVNVGLHGRSDEMIFEATVCDPSSELYGSTVVLRQLKSLQAKRRGRRALEVLKKLARRQMMYHSYALQVHGYIAPCNAVPAAVVPFVLVLRYHGSHSLRHWLQLSDWLPTLEATLALDEEQVRRVGDDSVGGPAVTRQLRLIRILMRDLLIGVNYLHSHGLAHTELRLENVHVSPIDKHVKVGILGNAADFHDNDPSSSTTAINNDRRKMMIAFDMRCVGFIMAKMVLRELMDSSTFFKFKSFLTKGNDPSCLREFLLPTLCQNSTSGNIGLQMLDRQWGAGWNLLALLLATKPEERISCVDPLRHPFLCGPKWRINPSANLIRWSLGSTAVRMAEDYIYGHHQRRRLAYFVELMEVLNPNLRTQNWIHLLPGRWRLLYCTGRHIGLTLRQPSPRVLISDVYLTVSSESVDPVFSLTSDTGFRVM

SEQ ID NO: 44354 - protein, 283 aa, Sorghum bicolor
  Clone ID: SORBI-28MAY03-C2185_1.pep
MAAAALLRRSSAARTLLSPALSSRLVASKPHSSSPAPPPPPPAAKAAANTKTFSIYRWDPDSPSTKPHLKDYQVDLSDCGPMVLDALLKIKNEQDPSLTFRRSCREGICGSCAMNIDGDNGLACLTKISSASSASTVSPLPHMFVIKDLVVDMTNFYSQYKSVEPWLKRKDPPPQQGKEIPQTKADRAKLDGMYECILCACCSTSCPSYWWNPEEYLGPAALLHANRWIQDSRDQFTKERLDSINDEFKLYRCHTIKNCTHACPKGLNPAKQIDTIKKLQLEA

SEQ ID NO: 44355 - protein, 434 aa, Sorghum bicolor
  Clone ID: SORBI-28MAY03-C2240_1.pep
TRSASYENQQDIQLMRFADYFGRAFVAVSASQFPWAKMFKESTVSKMVDIPLCHIPEAVIKTASDWISQRSSDALGDFVLWCIDSIMSELSGPSAGPKGSKKVAQQSPRAQAPGFVVLAMALRRKPDVLVNVMPKIMGNNKYLGQEKLPIIVWVIAQASQGDLVTGMFCWAHSLFPTLCAKSSGNPLARDLVLQLLERILSVTKARSILLNGAVRRGASVVPPVSFDLFMRATFPVSNARVKATERFEAAYPTIKELALAGPPGSKTVKQASQQLLPLCAKAMQENNAELTREATDVFIWCLTQNAESYKQWERIYPENIEASVAVLSKIVIDWKDVSPKLSSEALKATVKNFKAKNEAALESATDAGKQASIKEADKHCKVILGKLTRGATCLKSSLVVIGLAVAAGFVLYPDMDLPVEWEKVQAMVSSHLSF

SEQ ID NO: 44356 - protein, 292 aa, Sorghum bicolor
  Clone ID: SORBI-28MAY03-C300_1.pep
MAQIIDGKAIAADIRREVAADVAALSSAHGLVPGLAVVIVGSRKDSQTYVNMKRKACAEVGICSIDVDLPEDISEPALVAEVHRLNADPAVHGILVQLPLPKHINEEKILNEISIEKDVDGFHPLNIGKLAMKGREPLFQPCTPKGCMELLSRSGVTVKGKRAVVVGRSNIVGLPVSLLLLKEDATVSIVHSRTPDPESIVREADIVIAAAGQAMMIKGDWIKPGAAVIDVGTNSVDDPTRKSGYRLVGDVDFAAVSKVAGYLTPVPGGVGPMTVAMLLKNTVDGAKRGIVE

SEQ ID NO: 44357 - protein, 188 aa, Sorghum bicolor
  Clone ID: SORBI-28MAY03-C30043_1.pep
MEAATMAWTAAVVGVGLVYWFVWVMGAAEVKGKRAVDLKMGSITRDKVQDKYTQYWSFFRRPKETATTAASAEKVPAFVDTFYNLVTDIYEWGWGQSFHFSPSLPGRSHRDATRVHEERVADLLGARPGHRLLDVGCGVGGPMRAIAAHSGSNVVGITINEYQVNRARAHNRKAGLDSPRCEVVCGNF

SEQ ID NO: 44358 - protein, 190 aa, Sorghum bicolor
  Clone ID: SORBI-28MAY03-C30389_1.pep
MSVVGFDLGNESCIVAVARQRGIDVVLNEESKRETPAIVCFGDKQRFIGTAGAASSTMNPKNSISQIKRLLGRKFSDPELQSDLASFPFRVTEGPDGFPLVHVRFLGEERTFTPTQLLAMVLSILKAFAEGNLNTAVVEGRFGLPAAFCDLQRRAVLDAATIAGLRPLRLFHETTATALAYGIYKTDLPE

SEQ ID NO: 44359 - protein, 110 aa, Sorghum bicolor
  Clone ID: SORBI-28MAY03-C2479_1.pep
MDANRRASGIQQLLAAEQEAQQIVNAARAAKSARLKQAKEEAEREIAEYRAQMEAEFQRKVAESSGDSGANVKRLEEETAAKIEQLSQQAASISPDVIQMLLRHVTTVKN

SEQ ID NO: 44360 - protein, 239 aa, Sorghum bicolor
  Clone ID: SORBI-28MAY03-C25533_1.pep
MPLPFLCFSSTAPMVTSVLLILRETSPWALVGAAASVALLWLVAWTLEWAWWTPRRLDRALRAQGLKGTKYRLLTGDVRENARLNREARTKPLALGSHDIIPRVLPMLHNVVKEYGTNSFTWFGPVPRVIIPDPELVREVLSNKFGHFGKPRFSRLGKLLANGLANHEGEKWAKHRRILNPAFHHEKIKRMLPVFATCCTDMINRWENSMSSEGSSEIDVWPEFQNLTGDVISRTAFGS

SEQ ID NO: 44361 - protein, 209 aa, Sorghum bicolor
  Clone ID: SORBI-28MAY03-C25605_1.pep
DHAPPRYSTSRARHRPRQLGNFWDWWRKANNITCPKNLLVLLCRASAKAWSWKASCRPWSKRGSRRTSCCASATTGRPRTGSTAEPAVVTAARRSGAADRQALARGAGGRARPSSMVKTGKPPDFVLCIGDDRSDEDMFESIVCPSNSSLKLPASSEVFACTVGKKPSMAKYYLDDTVDVIKMLDGLASAPSQRPRPAVQLRVSFEGSL

SEQ ID NO: 44362 - protein, 328 aa, Sorghum bicolor
  Clone ID: SORBI-28MAY03-C26040_1.pep
HEARMLDHKEAIISHLSWASLFLGFHTLGLYVHNDVMLAFGTPEKQILIEPIFAQWIQSAHGKTTYGFDILLSSTNGPALEAGRNIWLPGWLNAVNENSNSLFLTIGPGDFLVHHAIALGLHTTTLILVKGALDARGSKLMPDKKDFGYSFPCDGPGRGGTCDISAWDAFYLAVFWMLAPGGWVTFYWHWKHITLWQGNVSQFNESSTYLMGWLRDYLWLNSSQLINGYNPFGMNSLSVWAWMFLFGHLVWATGFMFLISWRGYWQELIETLAWAHERTPLANLIRWRDKPVALSIVQARLVGLAHFSVGYIFTYAAFLIASTSGKFG

SEQ ID NO: 44363 - protein, 137 aa, Sorghum bicolor
  Clone ID: SORBI-28MAY03-C26584_1.pep
WLERSLFLLEQAHWFYEDNSVEHNPNLKSLSFKDFTSLMFKSCAALTPDFAHLDDFPKDFWISMFRVPVSGAVILDVSVLRAWLGSARWAGAGWGPPPRLWSSAAADHTSPIREVLEETGCDVSTFLNLDDCIEVSI

SEQ ID NO: 44364 - protein, 434 aa, Sorghum bicolor
  Clone ID: SORBI-28MAY03-C26818_1.pep
MDAADEKGETPQISEDTAHQIGVDPWYQVGFVLTTGVNSAYVLGYSGSIMVPLGWIGGTCGLLLAAAVSMYANALLARLHEVGGKRHIRYRDLAGHIYGRKIYGLTWALQYINLFMINTGFIILAGQALKATYGLFSVPGARNLPSRLAISGFVCALFAFGIPYLSALRIWLGFSTLFSLIYIVIAFVLSLRDGTTSPARDYSIPKSSGSTHVFTTIGAVADLVFAYNTGMLPEIQATIRPPVVKNMEKALWFQFTVGSLPLYAVIFMGYWAYGSSTSSYLLNSVTGPVWVKAVANLSAFFQTVIALHIFASPMYEYLDTKYGSGRGGPFEIQNLAFRVVVRGGYLTVNTLVAAVLPFLGDFMSLTGALSTFPLTFVLANHMYLMVKGPKLSAIQKLWHWLNVVGFTALAVAAAVSAIRLIMRDSSTYHFFADV

SEQ ID NO: 44365 - protein, 170 aa, Sorghum bicolor
  Clone ID: SORBI-28MAY03-C27255_1.pep
MLVQDDVAHPGFLAKQRLNLPVECRDNGYRLSYIWADDPEVREALGIHEGSIGSWSRCTMLTHFRHDLATVIPYHVNLTKAGYRALVYNGDHDMDMTYVGTQEWIRTMGYPIVSDWRPWYANRQVAGFTRTYAHNLTFATVKGGGHTAPEYRPKECQAMLDRWTSAAGQL

SEQ ID NO: 44366 - protein, 172 aa, Sorghum bicolor
  Clone ID: SORBI-28MAY03-C33773_1.pep
GNLPIGCVPKYLLIFKSDDKEDYEPETGCLRWMNEFSEYHNKLLLEELEKLRKLNPGVTIIYADYYGAAMEIFHSPERFGIEEPLVACCGGEGPYGVSLSTACGYGDYKVCDNPDKYGSWDGFHPSEAAYKGIAMGLLRGTYTQPSIASTTSSCPQLTELGSSVEYKVLYDL

SEQ ID NO: 44367 - protein, 176 aa, Sorghum bicolor
  Clone ID: SORBI-28MAY03-C33955_1.pep
DLVGIPPAPRGLPQIEVTFDIDANGIVTVSAKDKATGKEQNITIRSSGGLSEADIQKMVQEAELHAQKDQERKALIDIRNNADTTIYSIEKSLGEYRDKIPSEVASEIEAAIADLRQEMASDDIEKIKAKLEAANKAVSKIGQHMSGGGSGGSQSGSGPQGGGDQAPEAEYEEVKK

SEQ ID NO: 44368 - protein, 787 aa, Sorghum bicolor
  unsure (1)..(787): unsure at all Xaa locations
  Clone ID: SORBI-28MAY03-C34399_1.pep
MGLFRAASGLARVALRRNLSRAAASPFAGGGGAVPRAAPARYFHSTRPRWFAAPEPRAVPLSRLTDSFLDGTSSVYLEELQRAWEADPNSVDESWDNFFRELXVAQAAATSPGLSGQTIHESMMLLLLVRAYQVSGHLKAKLDPLGLEERPVPDVLDPAFYGFSEADLDREFFLGVWRMAGFLEENRPVHTLRSVLERLEQAYCGTIGYEYMHIPDREKCNWLRDRIETVNPREYSYDRRQVMLDRLIWSTQFENFLATKWTTAKRFGLEGAETLIPGMKEMFDRAADLGVESIVIGMPHRGRLNVLGNVVRKPLRQIFSEFSGGTTPVNEGEGLYTGTGDVKYHLGTSYDRPTRGGKQIHLSLVANPSHLEAVDPVAQGKTRAKQYYSNDRDRTKNLGVLLHGDGSFSGQGVVYETLHLSALENYTTGGTIHIVVNNQVAFTTDPESGRSSQYCTDVAKALDAPIFHVNGDDLEAVVHVCELAAEWRQTFHSDVVVDIVCYRRFGHNEIDEPSFTQPKMYKVIRNHPSALEIYQRKLLESGKISKEDIDKLNKKVSTILNEEFQNSKDYVPNKRDWLSAYWTGFKSPEQISRIRNTGVKPEILKRVGEAMTTLPENFKPHRAVKKIFDLRRQMIETGEGIDWAVGEALAFATLIIEGNHVRLSGQDVERGTFSHRHSVIHDQETGEQYCPLDHLVMNQDEELFTVSNSSLSEFAVLGFELGYSMENPNSLVIWEAQFGDFANGAQVIFDQFLSSGESKWLRQTGLVVCLPHGYDGQGPEHSSARLE

SEQ ID NO: 44369 - protein, 311 aa, Sorghum bicolor
  Clone ID: SORBI-28MAY03-C29192_1.pep
MEGDLPTPANARVAVVTGGNKGIGLEVCRQLAGNGVTVVLTARDEARGAAAVEKLRDLGLSDVLFHQLDIIDAPSIARIAEFLKTRFGKLDILVNNAAIGGIEYVHDQDRDSVTSEEKAKLSGMDMDQRLGWLWQNCRETYDDAKTGLRTNYYGTKQLIQVLLPLLQASSDGRIVNVSSHFGQLRLFRNEELKRELNDIDNLTPERLDGLLDMFLKDFEAGAVESNGWPMYFSAYKVAKAAMNAYSRILARRHPELRVNCAHPGYVKTDMTIHSGLLTPEEGGSRVAMVALLPEGGPTGAFFEDFAESSFV

SEQ ID NO: 44370 - protein, 107 aa, Sorghum bicolor
  Clone ID: SORBI-28MAY03-C29228_1.pep
TNLSAYAYHRKSDNSDRELQQELEKDRMQYQPAQRFMDAKVVSQMSPDLRSSYYIPKGVPKADGADRAALHSSMIHGIAPFSGIAAVGGGGGYNKVNAVQYGVSRMY

SEQ ID NO: 44371 - protein, 180 aa, Sorghum bicolor
  Clone ID: SORBI-28MAY03-C29633_1.pep
LLNEWNQELDEMTELEKRTAKGKSMVATFKQCARYLSPLFEFCRKKVLPDDIRQALLVIVECCMKRDYLAAMDQYIKLAIGNAPWPIGVTMVGIHERSAREKIYTNSVAHIMNDETTRKYLQSIKRLMTLCQRRYPALPSKSVEFNSLANGSDLQALLSEENGSGKASEERLRLMPASKE

SEQ ID NO: 44372 - protein, 176 aa, Sorghum bicolor
  Clone ID: SORBI-28MAY03-C29525_1.pep
GAFKHVSQKDIRNLHMLQEMYNEWPFFRVTIDLVEMVFAKGNPGIAALYDKLLVSEELRPLGEKLRANYEETQKLLLQVAGHRDLLEGDPYLKQRLRLRDAYITTLNVCQAYTLKRIRDPDYHVALRPHLSKEIMDPTKAASELVKLNPGSEYAPGLEDTLILTMKGIAAGLQNTG

SEQ ID NO: 44373 - protein, 174 aa, Sorghum bicolor
  unsure (1)..(174): unsure at all Xaa locations
  Clone ID: SORBI-28MAY03-C29650_1.pep
DKIRELLAEAFASASXRTSNDDRDEVRNILDEVDACDPYRVAVKVESALFERLGRSTGAHKTKYRSIMFNLRAENNTDFRRRVLIGEVTPEGLPDISPDEMASDARKQENMQIKEKALFECERAGAPKATTDQFKCGRCGQRKTTYYQLQTRSADEPMTTFVTCVNCNNHWKFC

SEQ ID NO: 44374 - protein, 70 aa, Sorghum bicolor
  Clone ID: SORBI-28MAY03-C29725_1.pep
RLKMGRVAYWRNSLVVRVLTMLRIAPKGVSEVHEMLYETAQHLTRGGETGIFTPMHMVLLRKPVSTEEAK

SEQ ID NO: 44375 - protein, 386 aa, Sorghum bicolor
  Clone ID: SORBI-28MAY03-C29791_1.pep
MGGAAVAVLAAATARRKSGPFVSLLAGAARRLHDAAETAAAEEDKAGTQSRRRRRSSSSLLLGPDFLDTWDPISRDTTPQAPPRCAQADYDRTATIIDGKSIAEDIRFHIAEEVCQMKRSVGHVPGLAVVLVGDRRDSESYVRYKVKGCEEVGIKSLLAKLPGNCSEDEVMDSVSRFNEDPSVHGILVQLPLPEFMDEERILSTISLEKDVDGFHPLNVGNLALRSRNPLFVPCAAKACIELLLQSGIELMGKHVAVIGRSKVVGLPTSLLLQRHHATVSVIHAFTTNPEAITRESDIVISAAGVANLVRGSWLKQGAVVIDVGTNPIEDPTSDYGYRLTGDVCFEEAVNVASAITPVPGGVGPVTIAMLLGNTLDSAKRVYGQSD

SEQ ID NO: 44376 - protein, 134 aa, Sorghum bicolor
  Clone ID: SORBI-28MAY03-C36733_1.pep
MGRRASLTPAPPPGRLAACPAAVLTIGRRPSPTAALPPRALALVEYAAAIYTADLTELFTWTCARCGDLIKAAAGFEMIEIIVDVENCLQAYVGFASDINAVVVVFSGTRLQAYVGWASDINAVIVVFRGTQEN

SEQ ID NO: 44377 - protein, 226 aa, Sorghum bicolor
  Clone ID: SORBI-28MAY03-C37206_1.pep
MASLSPSLHLPCNSRTGFLGKTHGIRPRVLPAGRVGFVRTVVECKESRIGKQPIEVPSNVTLTLEEQFVKAKGPLGELSLSFPGDVKIVKEESGMLRVYKTAETKRANQMHGLFRTLTDNIIVGVSKGFDKKLQLVGVGYRAAVEGNDLVMNLGFSHPVRMAIPEGLAVKVEENTRIPVSGYDKSAIGQFAATIKKWRPPEPYKGKGIRYMDEVVRRKEGKAGKKK

SEQ ID NO: 44378 - protein, 267 aa, Sorghum bicolor
  Clone ID: SORBI-28MAY03-C37906_1.pep
HEGGAEVANYCRERLQVLLRQELRLLGKDLGETSEVEMKEHWDDLFTRCFQRLDDEVSGQASRLVGGVQESRPVAAENVGSTAVVAVVCSSHVVVANCGDSRVVLCRGKEPVELSIDHKPDRKDERARIEALGGKVIQWNGYRVSGILAMSRSIGDRYLKPFVIPKPEVTVFPRAKDDDCLILASDGLWDVIPNEEACKVARRQIQLWHKNNGVASSLCDEGDESTDPAAQAAADYLMRLALKKGTEDNITVIVVDLKPRKKLKSNS

SEQ ID NO: 44379 - protein, 145 aa, Sorghum bicolor
  Clone ID: SORBI-28MAY03-C38015_1.pep
MALHAPVLVLKDSLKRESGAKVHQANIQAAKAVADIIRTTLGPRSMLKMLLDAGGGIVVTNDGNAILREIDIAHPAAKSMIELSRTQDEEVGDGTTSVIVLAGEMLHVAQAFIDKNYHPTVICRAYTKALDDAIAVLDKIAMPVD

SEQ ID NO: 44380 - protein, 407 aa, Sorghum bicolor
  Clone ID: SORBI-28MAY03-C30735_1.pep
MARNNQGHLQLPEMDHIQPKNIPHNESLPLGQKLLLHHGSGAPPRPAHSAQPNPAPRAEPLPPPSPVSIDQSGWDGQHLIHQEGFQRNVRARHSHNISLEPRSASTYPLNSAHMSSFGSTASASSSTSVERNQAPVSLPTRTVPSGAPGITSRALTGRAYYPVVGSSSPSVGAVPTIHGSSGTAIFANGGYAPSTAHTGTVPIYPNGAPATSSGSRAMPHQMVIQNHPHATSAATSTSMRDRIAAASRHARHVSVGHANNGRYRRARSSYYSLHPLMVEAERFMMDQLVFYESRAAAADPHRDMRLDIDNMSYEDLLALGESMGNVSTGLADEKISKCVKEVVCCSSGQMQIDEDDQDDGSCIICLEGYKDKDMLGILKCRHDFHADCIKKWLQTKNSCPVCKAAAA

SEQ ID NO: 44381 - protein, 102 aa, Sorghum bicolor
  Clone ID: SORBI-28MAY03-C30588_1.pep
KEMWRALAGAGSATLSMAYAAAKFADACLRGLRGDAGIVECSYVASQVTELPFFASKVRLGRCGIEEILPLGPLNEFERAGLEKAKKELAESIQKGVSFINK

SEQ ID NO: 44382 - protein, 243 aa, Sorghum bicolor
  Clone ID: SORBI-28MAY03-C30768_1.pep
MDWAAPALTSFVADSSYRHLCCYGAGIAGNVFAFVLFISPLPTFKRIVRNGSTEQFSAMPYIYSLLNCLICMWYGLPFVSYGVVLVATVNSIGAVFQLAYTAVFIAFADAKQRLKVSALLAAVFVVFGLIVFVSLALLDPPTRQMFVGYLSVASLIFMFASPLSIINLVIRTKSVEYMPFYLSLSMFLMSASFFGYGVLLNDFFIYIPNGIGTILGIIQLVLYAYFRKGSSEEAKLPLLVTHT

SEQ ID NO: 44383 - protein, 354 aa, Sorghum bicolor
  Clone ID: SORBI-28MAY03-C31920_1.pep
MGVISTVLGFSGFGFGFSAGIVIGYFLFIYVQPADVKDVKVRPLVEYDSKSLEGILPEIPLWVKNPDYDRIDWLNRFLELMWPYLDKAICRTAQDIAKPIIAENTAKYKIDSVEFETLTLGSLPPTFQGMKVYVTEEQELIMEPCLKWAANPNVTVVIKAYGLKATVQIVDLQVFALPRITLKPLVPTFPCFAKILVSLMEKPHVDFGLKLLGADVMAIPGLYRFVQETIKKQVASMYLWPKTLEVPIMDPSKASKRPVGILLVKVVRAQNLRKKDLLGKSDPYVKLKMSDDKLPSKKTTVKRSNLNPEWNEDFKFVVTDPENQALEVDVFDWEQVGKHEKMGMNMIPLRELPP

SEQ ID NO: 44384 - protein, 189 aa, Sorghum bicolor
  Clone ID: SORBI-28MAY03-C32221_1.pep
NVVNGMTDEDPNGLVVMQIVSESKKDPLQRRHELLVKTELAEALIQSCLENVGELLRTNFGKEILYEIVVGGKDNILEGLTDRIHMLHDAIVSDAAQPKTEDIEHAFENFFSSRVIRRMIIDCPAFAVTLWRKVLEGKCKIWAEGYSSKVVAGFLESPSKEVKDLAKPELQPLVDAGILKVPDPKVVQK

SEQ ID NO: 44385 - protein, 204 aa, Sorghum bicolor
  Clone ID: SORBI-28MAY03-C32515_1.pep
MSGGSTPSSRRNSFNSLSRDLDLPSEQGCLSIVVLGASGDLAKKKTFPALYHLFDQGFIQSGEVHIFGYARSNLSDDGLRERIRGYLKGDPEDLSEFLQLIKYVSGSYDTGEGFQKLNKTISQYEASNKSGSYRRLFYLALPPSVYPSVCKMIRTYCMNPSSHPGWTRVIVEKPFGKDLDSAEELSAQLGELFEEHQLYRIDHY

SEQ ID NO: 44386 - protein, 154 aa, Sorghum bicolor
  Clone ID: SORBI-28MAY03-C33402_1.pep
GKRKRDSKAICCLILRSWRVLRVPGPTPRPVSSSVVDMDDKNQRLENGQGGAMVLPSNSSDRSDRSDKPMDQKVLRRLAQNREAARKSRLRKKAYVQQLESSKLKLASLEQELQKARQQGIFISSSGDQTHAMSGNGAMTFDLEYSRWQEDQNK

SEQ ID NO: 44387 - protein, 83 aa, Sorghum bicolor
  Clone ID: SORBI-28MAY03-C32051_1.pep
LLGATNVAQSLKVDESCKKGVTEEKADEEDVCPICLEEYDEENPRSVTKCEHHFHLCCILEWMERKDTCPVCDQITLVDEMFE

SEQ ID NO: 44388 - protein, 156 aa, Sorghum bicolor
  Clone ID: SORBI-28MAY03-C4181_1.pep
HLGGARGASGSPCPPAAWCGGRTRAPPGTSGRRSGRSPLSTLPAPAPCSGGTRGSRRSGGGLPAPADVVAKLRKVGAAAIVSVGPAKEEKKDGDKKDGDKKDGDKKDGDKKTPPPVILYPHHQWYPYAAAQYHPHPYPPQYVVHSAEEDPNSCVIC

SEQ ID NO: 44389 - protein, 138 aa, Sorghum bicolor
  Clone ID: SORBI-28MAY03-C42567_1.pep
MAPSGDTIAQVHTGLDSSNKTLLKSEALYKYVLDTSVLPHEPDCMRELRLVTDKHQWGFMQSSPDEAQLLRMLLKLTGARNTLEVGVFTGYSLLATALALPDDGKVVAFDVSREYYDIGRPFIESAGVAHKVDFREGP

SEQ ID NO: 44390 - protein, 235 aa, Sorghum bicolor
  Clone ID: SORBI-28MAY03-C42601_1.pep
MSGSAAVKVIGFFDSPFSHRAEAALCLKGVPYELIQEKDLRNKSELLLHHNPVHKKVPVLLHGDRRAVCESLVIVEYVDEAFHGPPLLPADPADRAAARFWARFIEDKCSTSFWLAMWTEGEVQQGFMREIKENLKLLEGQVKGKRFFGGDDVGYLDVAASGFAHWLPVCEEVAGVSVVTAEEYPDLCRWAREYTSHDAVKQCLPDREELLARFSARKDSFVATARSMAPAPEKK

SEQ ID NO: 44391 - protein, 243 aa, Sorghum bicolor
  Clone ID: SORBI-28MAY03-C42667_1.pep
GGGSIPNVHSNTDSSNKTLLKSQALYKYILDTTVLPNEPECMRELRLLTDKHERRNMATPPDEAQLLRMLIKLSGARNAIEVGVFTGCSLLATALALPDDGKVVAVDVSREYYDLGRPIIDKAGVAHKVDFREGPALEHLDALLADEANHGAFDFAFVDADKPNYVRYHEQLLRLVRVGGSIVYDNTLWAGTVALPPETPMNDLDRRFSAAIKDLNVRLSKDERVEVCQLAIADGITICRRLV

SEQ ID NO: 44392 - protein, 247 aa, Sorghum bicolor
  Clone ID: SORBI-28MAY03-C34665_1.pep
MMSIFSNDGLGRFRDSISSETRRSHRRILWDAFSRRGSRGYPESDADDLGFYSTWLDLGDDIFEELGESRYFHRRRHGSIRVSQYSRSRIREHRRAVFDSGNEQSTAACPLGIHPIGRCTCDSFLIAEESSARASISRIVMLTEALFEVLDEIHRQPASLSLSMVSVQAPESVVNSLPCKSYKKLETPQCSDDMEQCHICLTEYEDGDQIRTLPCKHEFHLQCVDKWLKEIHRVCPLCRGDVCEVGS

SEQ ID NO: 44393 - protein, 81 aa, Sorghum bicolor
  Clone ID: SORBI-28MAY03-C350_1.pep
MSRSGQPPDLKKYMDKKLQIKLNANRVVIGTLRGFDQFMNLVVDNTVEVNGNDKTDIGMVVIRGNSVVMIEALEPVAKSQQ

SEQ ID NO: 44394 - protein, 280 aa, Sorghum bicolor
  Clone ID: SORBI-28MAY03-C35526_1.pep
MAGQERRTIDLEEGWAFMQKGITKLKNILEGKPEPQFSSEDYMMLYTTIYNMCTQKPPHDYSQQLYDKYRESFEEYITSMVLPSLREKHDEFMLRELVQRWSNHKVMVRWLSRFFHYLDRYFISRRSLTPLKEVGLTCFRELIYQEIKGQVKDAVIALIDKEREGEQIDRALLKNVLDIFVEIGLGQMECYENDFEDFLLKDTTEYYSVKAQSWILEDSCPDYMIKAEECLKREKERVGHYLHISSEQKLLEKVQNELLAQYATPLLEKEHSGCSALLRD

SEQ ID NO: 44395 - protein, 461 aa, Sorghum bicolor
  Clone ID: SORBI-28MAY03-C3572_1.pep
ARAWGSPRGGTASLEAAGTLPCAHGSRHVITIRGLSLGIALTVYGREEEADTLIEQMTRDQDPILRYGGMYALALAYRGTANNKAIHQLLHFAVSDVSDDVRRTAVLALGFVLYNEPEQTPRIVSLLSESYNPHVRYGAALAVGISCAGTGLSEAISLLEPLTSDVVDFVRQGALIAMAMVMIQTNESYDSRVGAFRRQLEKIILDKHEDTMSKMGAILASGILDAGGRNVTIKLKSRSKHDRLTAVVGLAVFTQFWYWYPLTYFISLAFSPTALIGLNSDLKVPKFEFLSNAKPSLFDYPKPVTQQTATASVKVPAAILSTYAKSKSRAKKEAESKAKEKAEDSSNASTSMQVDGAAAAEKKAPEPEPTFQILTNPARVVPAQEKFIKFLEDSRYKPVKAAPSGFVLLQDLKPTEAEELALTDAPSTAATTNAPASSASEPAAMAVDDEPQPPPAFEYTE

SEQ ID NO: 44396 - protein, 474 aa, Sorghum bicolor
  Clone ID: SORBI-28MAY03-C3630_1.pep
MEPRIGNRFRVGRKLGRGSFGEIYLGTNVQTNEEVAIKLENVKTKHPQLLYESKLYRILQGGTGIPNVKWFGVEGDYNVLVMDLLGPRLEDLFSFCNRKLSLKTVLMLADQMINRVEFVHSKSFLHRDIKPDNFLMGLGKRANQVYVIDFGLAKKYRDTSTHQHIPYRENKNLTGTARYASVNTHLGIEQSRRDDMESLGYVLMYFLRGSLPWQGLKAGNKKQKYEKISERKIATSTEALCRGYPTEFASYFHYCRSLRFEDAPDYQYLKRLFRDLFIREGFQFDYVFDWTILKYQQAQMTTAPTRAIAPPVGQSARGAPVANNNRHSGTEEGRRSGWSDMDPTRRQAPPPVINAGSLAKQKSPVRPETSTSKGPVFSSSTFLGRSSGSSRRPAVSSSREPSTEAEQTRSRTTDASPGAFQRSGAPRWSPQMPDSSDGRRSSSGRRHSSNPKNYESTIRGMQGLNFDGDDRVHY

SEQ ID NO: 44397 - protein, 144 aa, Sorghum bicolor
  Clone ID: SORBI-28MAY03-C36482_1.pep
RLLWWLKLQKEREKAEKKKEKRSDKKAPQKGETSKHSKHSHKKRKLEDVIKVGQDPKRESKESVEQLEKSGLSEEHGAPCFVQTIRDSPESSQDSSKRRKVVLPSPSQAKNGNILRIKIKSNQDSQSALSEKPMVPEQPLVRQM

SEQ ID NO: 44398 - protein, 234 aa, Sorghum bicolor
  unsure (1)..(234): unsure at all Xaa locations
  Clone ID: SORBI-28MAY03-C4618_1.pep
ALVYRAHAVGGGGXTWIHHRGDEGAPKQLSLIQRVGIAVNIADALDYLHHDCGRPTVHCDLKPSNILLNDDMNALLGDFGIARLYADPQSMWAGSISSIGVKGTIGYIPPEYGGGGHVSTSGDAYSFGVVLLEILTAKRPTDPMFTDGLDIISFVENSFPDQISHVIDAHLAEECKNLTQEKKVTENEIYECLVAVLQVALSCTRSLPSERLNMKQVASKLHAINTSYLGSKYK

SEQ ID NO: 44399 - protein, 105 aa, Sorghum bicolor
  Clone ID: SORBI-28MAY03-C46220_1.pep
PSAKSLTTMQRTEQPICPTTITHIYRHEMVSTEITLQVAETTDNIFKDLFCQHIESQSPEPNMLVGREPNMLVGRIWNSFPGSLTANIIQDRTKYTSTIFIRTVA

SEQ ID NO: 44400 - protein, 330 aa, Sorghum bicolor
  unsure (1)..(330): unsure at all Xaa locations
  Clone ID: SORBI-28MAY03-C46705_1.pep
MGDETSTSIAPQEQESTVRAGSVKQQLSRLVLSSLRATVPDVEVEPMVEVSAKFADYQCNNAMGLWSKVKGSGTSFKNPNAIGQAIAKNLPSSDIIESTSVAGPGFVNITLSNRWVAQRIQDMLVNGIKTWAPTLPVNRAGIVLSAPNIAEETLGALXMVYNASRHMCAHVPEFKARAQQGVVRLQGGEEKYREAWKKICDISRSEFDLVYKRLNVVLEEKGESFYNPYIPQVLEELNNKGLIKESEGARVIFIQGHQIPLIVVKSDGGFNYASTDLTALWYRLNVEKAEWIIYVTDVGQQQHFDMFFSAAKMAGWLPDPSEKKFPKTSH

SEQ ID NO: 44401 - protein, 247 aa, Sorghum bicolor
  Clone ID: SORBI-28MAY03-C46723_1.pep
MDNQPLPYSTGQPPAPGGTPVVPGVPGAAGPPPVPHHHLLQQQQAQLQAFWAYQRQEAERASASDFKNHQLPLARIKKIMKADEDVRMISAEAPVLFAKACELFILELTIRSWLHAEENKRRTLQRNDVAAAIARTDVFDFLVDIVPREEAKEEPGSALGFAASGTGVVGGGAPGGAPAAGMPYYYPPMGQPAPMMPAWHVPAWDPAWQQGAADVDHSGSFSEEGQAGFAAGHGGPASFPPAPPSSE

SEQ ID NO: 44402 - protein, 337 aa, Sorghum bicolor
  Clone ID: SORBI-28MAY03-C38650_1.pep
MARHEASASAAAAVPGVDFHLPDEILAVIPTDPYEQLDVAPRITSMAIASRVSRLEADATRLRRDLADRDRAEAELRARLADSDARLAAALDENAKLAKERDSLAATTKKLARNLAKLHAVKKQLMKSLSEDNLLQLSETSQDHNGEDNLTARVPSWKDEVSSSNTSSDTSSRSTMTESVHGGGYKFSITSYMPPKLTPGSTPMISSSSGSPRAYSTGPPSPKFLSGPTSPTKTRSESQLTFSSWQGSSSHQYSAPTSPPQRHSFTGRPRIDGKEFFRQARTRLSYEQFGAFLANIKEFNAQKQSREDTLSKAEEIFGAEHKDLYISFQNMLNRNQS

SEQ ID NO: 44403 - protein, 273 aa, Sorghum bicolor
  Clone ID: SORBI-28MAY03-C3839_1.pep
ARGRATSLVVDSGGGSTVVSAVHDGFVLQKSVATSPVGGEFLTDCMMKSLESKGIVIRPRYSFKKKETSPGEYKIVDLDLPNTTESYRLYCMRAIASDVKESVCRVPDTAFDEVAYANVPTTSYELPDGQTIEVGADRFKVPDILFNPSLSQTIPGIDGFADSTPVRGLQRMVIDSINKCDVDIRKELFSNILLSGGSSSILQLKERLEKEVLEESPQAARVKVMASGNSVERRFSVWIGGSILASLGSFQQMWFSKAEYEEHGVSYIQRKCP

SEQ ID NO: 44404 - protein, 88 aa, Sorghum bicolor
  unsure (1)..(88): unsure at all Xaa locations
  Clone ID: LIB3476-024-P1-K1-H12.pep
CCVFYCTGFCNGSMLLCRKNPSALLSCLVYVNSGLDNCLNSADLLSFTLYPGLHSHXISDQQTIPGIDGFADSTPVRGLQRMVIDSIK

SEQ ID NO: 44405 - protein, 102 aa, Sorghum bicolor
  Clone ID: SORBI-28MAY03-C3809_1.pep
MLTNDDYDPGNGLVLPVCDPVRHHHRYCLWVNANVAAACCISTGSSTALSGWQLTVDAIETLQSLGQAQNQNMQSDSAASLYKDDHVPPSRKLLKRANHSKS

SEQ ID NO: 44406 - protein, 144 aa, Sorghum bicolor
  Clone ID: LIB3481-029-P1-K1-A3.pep
MSRENSAHPSLSCNARVDSGIDASKEEVTGIMLTNDDYDPGNGLGAINVENDYETDLPDFDPIRHHNNYCPWVNGNVAAACCISTGSSTALSGWQLTVDAIETLQSLGQAQNQNMQSDSAASLYKDDHVPPSRKLLKRANHSKS

SEQ ID NO: 44407 - protein, 234 aa, Sorghum bicolor
  Clone ID: SORBI-28MAY03-C38956_1.pep
NQDKTLPFLCTATPRTTPIINSSTVHLSLSTRVSRLQQEDGFVEKETKVQSDNRPSSMEMAVNARDEEKKYDGDDNHLGLGLSLSLGIATTAATPVEVDPPPRQQQQQRAISVAPISSLPAPQWWNGPAGLFFSPSSGMKMDPSLERKHQHQQQQQQQAAATSYSHDMPFLRGIDVNRRATAGETRRGRSCSEDEEPGASSPNSTLSSLSGKRAAPARSSGEVDREADGHTPRA

SEQ ID NO: 44408 - protein, 187 aa, Sorghum bicolor
  Clone ID: SORBI-28MAY03-C40332_1.pep
YDRAFVPLARRLTRLSSGITMLQRIGTGLVLALVAMVVAALVEMRRLGVARDAGLVDQPKAALPMSLWWMVPQYVLFGLSDVFAMIGLQEFFYDQVPDALRSLGLALFLSIFGVGHLFSSFIISAIDGATKKSGASWFSNNLNRAHLDYFYWLLAGLCAVELAAFVIVSRVYVYKKRVSHDNNDAVM

SEQ ID NO: 44409 - protein, 592 aa, Sorghum bicolor
  unsure (1)..(592): unsure at all Xaa locations
  Clone ID: SORBI-28MAY03-C40512_1.pep
MEASSSLCSQVSGFSLPKIWLCLFLVLVLQNCSPALSDSPYLVGMGSYDITGPAADVNMMGYANSEQIASGIHFRLKARAFIVAEPNGKRVVFVNLDACMASQIVTIKVLERLKGRYGDLYNENNVAISGIHTHAGPGGYLQYVVYIVTARGFVRQSFDVIVNGIEQCIVEAHNNLHPGKIYVNKGDILDAGVNRSPSAYLNNPAEERGKYKYNVDTEMTLVKFVDDESGPVGSFNWFATHGTSMSRTNSLISGDNKGAAARFMEDWAEQNGIPKQAAPVNHDGPESLHMASGLPRRVSSIIPEPNEITDDLVQLASSYEASGGRRLSGSSITRRIRSAQQNRPKFVSAFCQSNCGDVSPNVLGTFCIDTGLPCDFNHSTCNGKNELCYGRGPGYPDEFESTRIIGNRQFQKALELFNSASEEIQGKVEFRHTYLDFSQLEVNIPTSTGGQQVVXKTCPAAMGFAFAAGTTDGPGAFDFKQGDAKGNAFWRLVRDLLKEPGKEQVKCQAPKPILLDTGEMKEPYDWAPAILPIQIIRIGQLVILCVPGEFTTMAGRRLRDAVKTVLASDNSGEFNNIHVVLAGLTNTYSQYI

SEQ ID NO: 44410 - protein, 162 aa, Sorghum bicolor
  unsure (1)..(162): unsure at all Xaa locations
  Clone ID: SORBI-28MAY03-C41749_1.pep
RLPARSPPPPPPEPRSLGPPXSTKQWKPPEPPHPAWPAPPHSPPLAPTTAPASPGSRRPRSXPRSRPPRRRRAPSRSAGPGPTPSSPTSRDPPPSXPPPRPDPRHPRGGRGRARQQGTGGRRRRRQERRRQRRRRRWRRRPRSSRRLGRSHVRTPRAAGRSA

SEQ ID NO: 44411 - protein, 179 aa, Sorghum bicolor
  Clone ID: SORBI-28MAY03-C52219_1.pep
ARGSKDLMAVAGEALKTNITTLGPLALPMSEQILFLASLVARKVFGVRGLRPYIPDFKMAFEHFCIHAGGRAVLDTIEKNLELSPWHMEPSRMTLYRWGNTSSSSLWYELAYTEAQGRVRRGHRAWQIAFGSGFKCNSAVWRALRTIDPKKESAVGNPWVEEIHRFPVEVPKVESVIVS

SEQ ID NO: 44412 - protein, 174 aa, Sorghum bicolor
  Clone ID: SORBI-28MAY03-C5053_1.pep
LSVYHNVHPPSPSLYYVNVTGLSVGRALVKAPAGSFAFAHSSGAAWVIDSGTVITRWTAPVYAALRDEFRRQVAAPSGYTSLGAFDTCFNTDEVAAGGAPPVTLHMGGGVDLTLPMENTLIHSSATPLACLAMAEAPQNVNSVVNVVANLQQQNVRVVVDVAGSRVGFAREPCN

SEQ ID NO: 44413 - protein, 82 aa, Sorghum bicolor
  Clone ID: SORBI-28MAY03-C5011_2.pep
MAAAAKASWMVAMSVGAVEALKDQAGLCRWNYALRSIHQAAKANAPSFAQAKKKLAPAERRRADKAEEGMRTVMYLSCWGPN

SEQ ID NO: 44414 - protein, 82 aa, Sorghum bicolor
  Clone ID: SORBI-28MAY03-C5011_1.pep
MAAAAKASWMVAMSVGAVEALKDQAGLCRWNYALRSVHRAAKANAPSFAQAKKKLAPPARRRADRAEEGMTAVMDLSCGGPH

SEQ ID NO: 44415 - protein, 84 aa, Sorghum bicolor
  Clone ID: LIB3476-054-P1-K1-F12.pep
MAGAAKASWMVAMSVGAVEALKDQAGLCRWNYALRSIHQAAKANAPSFAQAKKLAPAPAERRRADKAAEGGLRTVMYLSCWGPN

SEQ ID NO: 44416 - protein, 137 aa, Sorghum bicolor
  Clone ID: SORBI-28MAY03-C52884_1.pep
PLSRMLIEDSGSSKDLKNLFTSTSDQPFLAPPNNLVSVKHSGTVTIKASFKEDIVRFRFPCSGGVIVLKEEVAKRLRMDVGTFDIKYLDDDHEWVKLACNADLEECMEISRLSGSHVIRLLVSDIAAHFGSSCGSSG

SEQ ID NO: 44417 - protein, 182 aa, Sorghum bicolor
  Clone ID: SORBI-28MAY03-C4287_1.pep
LGKVREQAVIQEATVRGPVGEGVGSEADAAARIKEAAEKLHTVEKEKEELLALVSVLQSQVQREQSSTKQVCEERSESCSGADNSPPLTKHVDASDDDVDKACVSDSRSVLVSSDSTEVQLAVDGVDIRPVGDAEWGGFQQSEALIADVREVSPEADGGSLDIPVVNPPPVSDHIQGGATHP

SEQ ID NO: 44418 - protein, 251 aa, Sorghum bicolor
  Clone ID: SORBI-28MAY03-C42773_1.pep
PFLLFCAGPLSKPPSRIPPAQLYGYIAARDERDGMLNYVVSYSRDDPIVVHQGDLIEMTGPKRCISMDSIVLIEFDMRIKNEALEDDDQQLIDGAISCSCYNYIAWKPVVNRITGSSGAVDVSLAVVEHAVEATIEVVISQVLSGLNLSLSSFVDVMDVYEEIKLFNGKIGQSGSLRRFVVSVSHGTTMLLMFKLGNNVQGSLHGCANRQMKFQAKLHGHASQQIKLKFATISVKVTWSTIVDYVSSISIV

SEQ ID NO: 44419 - protein, 256 aa, Sorghum bicolor
  Clone ID: SORBI-28MAY03-C4372_1.pep
TIELETENRLASLLIEEARRLQLEADREGVHAYLRKPNVRHRPNSRFLTATVRGVQQANRVVEVNEMWRAREKELELESKVKSRSNDRDDFRGEKRKSELRNHSSSSRVEQEGTTYNNPYSDQEDGLRDDEIERFLHSRAKRGRGAVGSRMDEPGPYLDSLSRHQDNGPSPDIRVEEKWERRVQGPEKPSFLRSKSTDGHWHKDTLDGRASSSEPLCKKEKKKKSEKKEKREKKKEKDKKKSKHRRHHHHRSTRSE

SEQ ID NO: 44420 - protein, 285 aa, Sorghum bicolor
  Clone ID: SORBI-28MAY03-C44167_1.pep
MSVGRQSYWCYQCRQRVRPRGREMVCPYCDSGFVAEMDDVDALMSHFVGMDPDFHRDPRFGIMEAISAVMRHGMSGMNREVDVRGRPNIFSDLEMEFGSGPWLLFRGQLPGHLTEDNGFDVFINGRRGVGMRRANIADYFVGPGLDDLIEQLTQNDRRGPPPAAQSSIDAMPTVKITQRHLSGDSHCPVCKEKFELGSEAREMPCKHLYHSDCIVPWLEQHNSCPVCRYELPTQGSTTGASCSHTRSTNQSQSSSSSSSSGRTSGRQRRRNPFSFLWPFRSSSSR

SEQ ID NO: 44421 - protein, 186 aa, Sorghum bicolor
  Clone ID: SORBI-28MAY03-C4429_1.pep
MARLYVGNLDPRVTARELEDEFRTFGVLRSVWVARKPPGFAFIDFDDKRDAEDAIRDLDGKNGWRVELSRNASSGRGGRDRYGGSESKCYECGETGHFARECRLRIGSGGLGSGRRRSRSRSRSRSRSPRYRRSPSYGRRSYSPAARSPRRRSVSPARGRSYSRSPQYKRAREDSPYDNGYRRSRS

SEQ ID NO: 44422 - protein, 415 aa, Sorghum bicolor
  Clone ID: SORBI-28MAY03-C4444_1.pep
MAAPYHQPTSLEEVRTLWIGDLQYWTDENYLYSCFAHTGEVRAVLRPRPPGPCLPRRFGCCVSVAPVAARPIPLTVSGALVPGSDRAVGLLRAACSPAGWRPDPAPGRSMGRGDLAPDLTDYLLQETFRVNYPSVRRAKVVTDPNTGRSKGYGFVKFADENEKNRAMTEMNGVYCSTRPMRISAAIPKKSTGSQLQYSAAKAVYPATAYAMPQLQAVLPDSDPTNTTIFIGNLDPNVTEDELRQICVQFGELIYVKIPVGKGCGFVQYASRASAEEAVQRLHGTMIGQQAVRLSWGRSPASKQDPSAVWSQQADPNQWANTYYGYGYDAYGYAQDPSYAYGAYAGYSQYPQQIEGGTRATSVAGSHPGMEQKEEPYDPMNIPDVDKLNASYMAVHGRAMLGRSLWLKTNPLPQPT

SEQ ID NO: 44423 - protein, 145 aa, Sorghum bicolor
  Clone ID: SORBI-28MAY03-C556_1.pep
GATELTVSATLKQKSSSVEGVEKWPYEAAALAFEAIPRTLAQNCGLNVIRIMTQLQGKHANGENAWVGIDGRSGDIVDMKERKIWDSYSVKAQTFKTAIEAACMLLRIDDIVSGIKKKQAPGASAPKQPQIETEGDADNEQMIPE

SEQ ID NO: 44424 - protein, 304 aa, Sorghum bicolor
  Clone ID: SORBI-28MAY03-C56395_1.pep
MNYIIGAFKPPCDISITFSDARTRKQVSVKKDNGKTTMVPVFQSLETISGEVSIAPVPGKRIEHTGVKIELLGQIELYFDRGNFYDFTSLVRELDIPGEIYERKTFPFEFSTVEMPYESYNGTNVRLRYILKVTIGRNYVGNIVEYRDFCVRNYSPVPTINNSIKMEVGIEDCLHIEFEYSKSKYHLNDVIIGKIYFLLVRIKIKNMELEIRRRESTGSGSNTYVETETLAKFELMDGAPVRGESIPVRLFLTPYELTPTYRNINNKFSVKYYLNLVLVDEEDRRYFKQQEITMYRLLESPPAS

SEQ ID NO: 44425 - protein, 225 aa, Sorghum bicolor
  Clone ID: SORBI-28MAY03-C56348_1.pep
RQGPAASGGGSGPTGALSALARAPRSLAARTARSGGSAVASGLPPPPGAPGGLARGAASRSGFVKTPMLRSTQIPTYYGVLLEAIRVGGQQLNIPTSVFSAGSVMDSGTVITRLPPTAYSALSSAFKAGMKKYPPAQPSGILDTCFDFSGQSSVSIPSVALVFSGGAVVNLDFNGIMLELDNWCLAFAANSDDSSLGFIGNVQQRTFEVLYDVGGGAVGFRAGAC

SEQ ID NO: 44426 - protein, 267 aa, Sorghum bicolor
  Clone ID: SORBI-28MAY03-C5733_1.pep
IEEFMRVTTCAYFIQGYGLTETLGPSTVCYIDDMALVGSAGVPATYTEIRLEEVPEMGYDPLGVPSRGEICIHGKSLFAGYYKSPELTNEAIVDGWFHTGDIGEMTPDGILKVIDRKKNIFKLSQGEYVAVEYLEKVYGFPPLVEDIWVYGDSFRSSLVAVVNPHEENTMKWAHSNGYKGSFAEICKLEGLKEYILKELAAVAQKNKLRGFEYIKGIVLDPVPFDIERDLVTATMKKRRKNMQNYYQSEIDIVYKKLEAQKNAAKSK

SEQ ID NO: 44427 - protein, 254 aa, Sorghum bicolor
  Clone ID: SORBI-28MAY03-C5719_1.pep
MDGGGTHPPPEDVFRDFRARRAGMIKALTTDVEKFYQQCDPEKENLCLYGLPNETWEVNLPAEEVPPELPEPALGINFARDGMDEKDWLSLVAVHSDAWLLAVAFYFGARFGFDKESRKRLFVMINNLPTIYEVVTGTAKKQTKEKTPKSSSKSNKSGSKPPRQPEPNSRGSKMPPPKDEDDSGGEEEEEEEDHENTLCGACGDNYGQDEFWICCDACETWFHGKCVKITPAKAEHIKHYKCPNCSGSSKRARV

SEQ ID NO: 44428 - protein, 133 aa, Sorghum bicolor
  Clone ID: SORBI-28MAY03-C44191_1.pep
TRVVVMVCTFVSSFAWSWGPLGWLIPSETFPLETRSAGQSVTVCVNLLFTFVIAQAFLSMLCHLKYAIFVFFSAWVLVMSFFVLFFLPETKNVPIEEMTERVWKQHWFWKRYMDDDNHHIVNGKITANNGASV

SEQ ID NO: 44429 - protein, 149 aa, Sorghum bicolor
  Clone ID: SORBI-28MAY03-C44193_1.pep
MAKHPRDSGAGAVPLSLALSLGGGGVAAEHGSNKRHRRAAAGGGDGGGEFVCKTCSRAFGSFQALGGHRTSHLRGRHGLALGMPAPAKDDAKETTTKQPAAASASHLCHVCGLSFEMGQALGGHMRRHREEAAAATTAQAPPVLLQLFV

SEQ ID NO: 44430 - protein, 117 aa, Sorghum bicolor
  Clone ID: SORBI-28MAY03-C45320_1.pep
MDKCNEMPKEAPAHATGANPAEDEASLKEDITVQTDNKPSASPAPEDPKVSDKEKLAEENQKLKELLQKLLASGNDQMGVITDLSEKVKALERKLARKKRPKVRVHRPSGHVTAKVH

SEQ ID NO: 44431 - protein, 152 aa, Sorghum bicolor
  Clone ID: SORBI-28MAY03-C4571_1.pep
MSLIAGEDFQHILRLLNTNVDGKQKIMFAMTSIKGVGRRFSNIVCKKADIDMNKRAGELTPEELERLMTVVANPRQFKVPDWFLNRKKDYKDGRFSQVVSNALDMKLRDDLERLKKIRNHRGLRHYWGLRVRGQHTKTTGRRGKTVGVSKKR

SEQ ID NO: 44432 - protein, 817 aa, Sorghum bicolor
  unsure (1)..(817): unsure at all Xaa locations
  Clone ID: SORBI-28MAY03-C45757_1.pep
HEEKRLSLLAKAQNRLAKLDELRQAAKNDVEMRFEKEREELETRVESRVRQAEENRMRLLHADMQKRAALKERTARSLVQKATSESKYMEQVRSASSRKRAAAEKKRLRLLEAEKTKAQARLLRIQKAAMTVCSQRESERRKLKEQLDNKLQRAKRQRAEYLKQRGSPRGSTHADYIKHADALSRKLARNWRIFVKSRKTTFALVQAYDAXWGLXEKXCEKXMPFEKLAMXWESPMVLQSTKALLDRLEKRLVISQSVASSSVENVDHLLKRLGSPPRRKAPLSREGKTRAAGKRSAKSSEANSRLPRYSLRVVLCAYMILAHPSAVLSGQGERERQLIESAANFIKEFELLIKTILDGPGQSSDVTGQRKFRIQLANFDKAWCTYLYRFVVWKVKDARLLEEDLVRAACKLELSMMQTCHLAADGHSPNNLTHDMKAIQKQVTDDQKLLREKVQHLSGDAGLERMDSALLDTRSKFFEAKENGSPLAAPVANVSTPLSINSSVKVPLSEVNESSRTNAVGTSSVVRSLFGASSSVGSSPAKQPTENEQMVNEMLHEDASAFAGRSDSASTVEEEFQKKVRETMEKAFWDMVTNSMRGERPDYSQLINLVKEVRDSLHDLAPKEWKEKILENIDLEILSQVLGSGSQDAQYLGQILQYSLDMVRQLSAAAKEDEMKKNHDKLLSELSTNSEVNDNGINSFAIAVIKGLRFILEEIKELQAEVSKARVQMMQQIIKESAGVEYLQKAFADRYGPPENASASLPLTLQWIMTSNNIVEVEWSEHSDCLSIMQSAGQAPALVPVLRAGHGTLVGQPSSSA

SEQ ID NO: 44433 - protein, 243 aa, Sorghum bicolor
  unsure (1)..(243): unsure at all Xaa locations
  Clone ID: SORBI-28MAY03-C45829_1.pep
MASGADAAAALGISGDGEWAAACPPLRRNLQLLAPDEVELAKMLLNEGQIHLFEHWPEPGVDDDKKRGFFDQVRRLNSSYPGGLLSYIQNAKKLLADSKAGKNPYDGFTPSVPSGEVLNFGDDNFVSLEAAGIKEARNAAFVLVAGGLGERLGYKGIKVALPRETTTGKCFLQHYIESILALQEASCKMVDDGCQTKIPFVIMTSDDTNALTIKLLESNSYXGMEPSQVKLLKQEKVACLADN

SEQ ID NO: 44434 - protein, 484 aa, Sorghum bicolor
  Clone ID: SORBI-28MAY03-C4590_1.pep
MELAGAASPRPPPESHVATPRPPPQPPEKDVCEDREDMRVTGEKPCTHQELDVDQTNSSSSFNNSSECENLAPSNDEISGSESNLEIAKTEGDVPSGEKVLKKPDKILPCPRCNSMDTKFCYYNNYNIKQPRHFCKSCQRYWTAGGSMRNIPVGAGRRKSKSSSANCRSILIPGSSVATPGGEASLFPLSINGNQAAVSFGPDSPLCNSMASVLKIGGEQIKSSNPASAAQPRNGENQMCPPCTTSSDGPRNESQKETANAHQNGIIGQSNGVTSVHPIPFFPGPPFVYPWSPAWNGIPTMAAAVCPAPAEAANSSENCTTSSNVQWNVPPIVPVLPPGFCGPIPVPVMPPSVWPFITPWPNGAWNAPWLGPSSTVPSSSPTSSSTCSESGSPVLGKHSRDSKPQGDEKAERCLWIPKTLRIDDPVEAAKSSIWTTLGIEPGDRGMFRPFQSKPERQEQISGAARALQANPAALSRSRSFQETT

SEQ ID NO: 44435 - protein, 313 aa, Sorghum bicolor
  Clone ID: SORBI-28MAY03-C58962_1.pep
MAAFPVLPAPACTSFSPSSVFLTPCSSDGRSTAPRAAAVRGSAVTWAHRTLSARWVPSGLAVARPAARKARLEELDTSNMLLRQRIVFLGSSVDDTSADLIISQLLLLDAEDQTKDIKLFINSPGGSITAGMGVYDAMKFCKADVSTVCFGLAASMGAFLLAAGTKGKRYCMPNARIMIHQPSGGAGGKVTEMGLQIREMMYEKIKINKIMSRITGKSKEQIDEDTKFDYFMSPWEAKDYGIVDSIIDEGKPGLVAPLAGSVRPPKSRVWYLWKASGPTRKIMKHLPSEEKLINNGNGTATGDDEKLKRASAT

SEQ ID NO: 44436 - protein, 150 aa, Sorghum bicolor
  Clone ID: SORBI-28MAY03-C6089_1.pep
GISAHLFAVFQGLLKVLAGIDTNFTVTSKASDEDGDFAELYMFKWTTLLIPPTTILIINLVGVVAGISYAINSGYQSWGPLFGKLFFAFWVIVHLYPFLKGLMGRQNRTPTIVVVWAILLASIFSLLWVRIDPFTTRVTGPDTQTCGINC

SEQ ID NO: 44437 - protein, 229 aa, Sorghum bicolor
  unsure (1)..(229): unsure at all Xaa locations
  Clone ID: SORBI-28MAY03-C60643_1.pep
MAEQQTPTFKLVLVGDGGTGKTTFVKRHLTGEFEKKYMATLGVEVHPLGFTTNFGQIQFDVWDTAGQEKFGGLRDGYYINGQCGIIMFDVTSRITYKNVPNWHRDLVRVCENITIVLCGNKAAGTGPXVLCGNKVDVKERKVKAKTITFHRKKNLQYYDISARPHACREPPFLWLARKLVGNPALEFVAAPALAPPTAQVDEKLLEQYRKEMDDAAQMPLPGELSDDDL

SEQ ID NO: 44438 - protein, 284 aa, Sorghum bicolor
  unsure (1)..(284): unsure at all Xaa locations
  Clone ID: SORBI-28MAY03-C6170_1.pep
MMGGKAALLLALVAVTLAVVEIQADAGYGYGAGYPTPTPKPPAKGPKPEKPPTKGHGHKPEKPPKEHKPTPPTYTPSPKPTPPPATPKPTPPTYTPSPKPKSPVYPPPPKASTPPTYTPSPKPPATKPPTYPTPKPPATKPPTPPVYTPSPKPPVTKPPTPKPTPPVYTPNPKPPVTKPPTHTPSPKPXPTSKPTPPVYTPSPKPPKPSPPTYTPTPKPPATKPPTSTPTHPKPTPHTPIPKPTPPTYKPAPKPTPPAPTPPTYTPPVSHTPSSPPPPPPPPYY

SEQ ID NO: 44439 - protein, 293 aa, Sorghum bicolor
  Clone ID: SORBI-28MAY03-C5386_1.pep
MGEGEAAEVKGGVLQGRYELGRVLGHGNFGRVHAARDLRTGRGVAVKVLVKDKVLRAGMMEQIKREIAVMKRVSHPNIVELHEVMATRSKIYLALELVRGGELFARIVRAGRVKEDVARRYFRQLISAVDFCHARGVYHRDLKPENLLIDEAGNLKVVDFGLSALADHARSDGLLHTLCGTPGYVAPEVFRNKGYDGAKADIWSCGVILYVLLAGSLPFPEDNIAAMFRKMSRGDYRCPPWLSTEARRLIPKLLDPNPDTRITIAQIVETPWFNKPSIAKPVKAFRRRPRRAG

SEQ ID NO: 44440 - protein, 152 aa, Sorghum bicolor
  Clone ID: SORBI-28MAY03-C5518_1.pep
MSLIAGEDFQHILRLLNTNVDGKQKIMFAMTSIKGVGRRFSNIVCKKADIDMNKRAGELSSDELERLMTVVANPRQFKVPDWFLNRKKDYKDGRFSQVVSNALDMKLRDDLERLKKIRNHRGLRHYWGLRVRGQHTKTTGRRGKTVGVSKKR

SEQ ID NO: 44441 - protein, 199 aa, Sorghum bicolor
  Clone ID: SORBI-28MAY03-C54699_1.pep
MARGGDGLQVLSALDAAKTQWYHFTAIIVAGMGFFTDAYDLFCISLVTKLLGRIYYTDTSKDNPGSLPPNVAAAVNGVAFCGTLAGQLFFGWLGDKLGRKSVYGMTLMLMVICSIASGLSFGHTPTGVMATLCFFRFWLGFGIGGDYPLSATIMSEYANKKTRGAFIAAVFAMQGFGILAGGIVTLSTAARNSYPAPSY

SEQ ID NO: 44442 - protein, 150 aa, Sorghum bicolor
  Clone ID: SORBI-28MAY03-C55197_1.pep
MAASSVTTTMMSFRPAAASLLVLMLVVVGSSEVAACGSCPTPPSSPPPPPPSSGGTPCPPPPSSSGKCPKNALKLGVCANVLGLVKVSIGKVPTDSCCPLLDGLADLEAAVCLCTALKANVLGINLDVPVKLTLLLNYCGKSVPEGFVCA

SEQ ID NO: 44443 - protein, 171 aa, Sorghum bicolor
  unsure (1)..(171): unsure at all Xaa locations
  Clone ID: SORBI-28MAY03-C5442_1.pep
SQDTSRPTDRHLQHGEDNCPLCHKSCDIVCTSESDTCGREQECGLAFTYPGIAVLPMLKAWEILKQQRVGEMRIMWDQXMMIDQQAAEQERLFGSKPSPARPQSSSRKVAGARISGVGGAANGTPVRRLSALQSGGRTVSRDGRRDASRPVAPVNYVAIAKEDAVSQASSN

SEQ ID NO: 44444 - protein, 89 aa, Sorghum bicolor
  Clone ID: LIB3476-006-Q6-K1-C12.pep
FSLHRNYACSSKNSVLEILLKLQPKLPNYYLNVLGCHINLLHFVSALCISGDDRFPMQPEGSSFDSENGDDSIPMQSFDTDKCPYVESD

SEQ ID NO: 44445 - protein, 258 aa, Sorghum bicolor
  Clone ID: SORBI-28MAY03-C5539_1.pep
MDAFYSTSSSSSSSGPYGAAAYGGSGWGYDSLKNFRQISPAVQTHLKLVYLTLCVALASSALGAYLHVVWNIGGMLTMLGCVGSIAWLFSVPVYEERKRYGLLMAAALLEGASVGPLIKLAVEFDPSILVTAFVGTAIAFACFSCAAVVAKRREYLYLGGLLSSGLSILLWLQFAASIFGHSTSTFMFEVYFGLLIFLGYMVYDTQEIIERAHHGDMDYIKHALTLFTDFVAVLVRILVIMLKNAADKSEDKKRKKRS

SEQ ID NO: 44446 - protein, 208 aa, Sorghum bicolor
  unsure (1)..(208): unsure at all Xaa locations
  Clone ID: SORBI-28MAY03-C6846_1.pep
MALQYVEAQRQARPDLADWYASLADLYQRKLWHQLTLKLDQFLQLQAAQTGDTIIQLYNNFITDFETKINLLKLAHFAVIASRQYPDKDAAITFLEGVITKLRETRESRINEPILYVKMQIAAINLEKGNQKECKNLLDDGKTTLDSMTDVDPTVHASFYWISSQYHKARQEFAEFYKNALLYLAYTTVESLSESFKLDLXFDLSLAA

SEQ ID NO: 44447 - protein, 247 aa, Sorghum bicolor
  Clone ID: SORBI-28MAY03-C6588_1.pep
QHQEATPTMSTSMATTPTTARAMAPARPPAPRQCCRYLVLPSTGHRRSIAAWSAKKKNPWLDPFDDGPDEEFDYQGMFSGGKQEEDPRPPEDPANPYGFLRFPQGYNPELDSLASKVRGDVRRACCVVSGGVYENVLFFPVVQMLKDRYPGVLVDVVASARGKQVYEMCKNVRYANVYDPDDDWPEPTEYTHMLGVLKNRYYDLIVSTRLAGLGHALFLFMSSARDKFGYVSPNVNSVGAGLFLDEM

SEQ ID NO: 44448 - protein, 146 aa, Sorghum bicolor
  Clone ID: LIB3476-022-P1-K1-B12.pep
QPPRPPPSSLTLSTPESDDVGHHLVARQIGRRGTSLSGGVYENVLFFPVAQMLKDRYPGVLFDVVASAKGKQVYEMCMNVTYANVYDPDDDWPEPTEYTHMLGVLKGDTVDLVVARVSGRDIAICHHLQSCNENKWGHYSQALRHD

SEQ ID NO: 44449 - protein, 289 aa, Sorghum bicolor
  Clone ID: SORBI-28MAY03-C69315_1.pep
MSGISLAVAPRSDPDHGTERQPTAMLGGVMGSLRVIELQLVAFIMVFSASGLVPLIDLVFPVATTIYLLAISRLAFPPLHSKLDAAAAARSPAASQEIFRGSKLFQVYVVLGTTVGLFLPLAHVLGGFARGDDAAVRSATPHLFLLSCQILTENVVGSLGAFSPPVRALVPLLYTVRRVFVIVDWVYDVWANRALTRAATAQEAAWVWFGRYLAAANLVYFSANLFVFLIPRFLPRAFEKYFRMRDEVCAKTAEDKHARGHLSSSSSPAPAAEQQEVGAAKSEVSKKAD

SEQ ID NO: 44450 - protein, 394 aa, Sorghum bicolor
  Clone ID: SORBI-28MAY03-C5765_1.pep
MIVGSNVHHISQSKANLDIVPQQAYSHVQSPASSPVRARRDWDLLGNENHQVIRSEVAATSAERARVGRTSPSTSNHNMKDVPQGTDHDSGAVRFNIESKDQNPSFKDLVRSDASENLDGAEAQVPQETSAQWDSGGSPNLASGLDDANPPYPYLPTVLEEPGRVGSEVAEDDPLPAIDGLRITGEAFPGRELQASGYSIHGTTSCNFEWVRHLDDGSVNFIEGARQPTYLVTADDVDSVLAIEVQPLDDRKRKGEIVKVYANEQRKITCDPETKEHIKKILSMGHVSYEVLLPVRFLDMWEPAVLAIKREGYSVKCNGQRGVIVTEKFQQAMTINIPFGRPTEFSIVSADGAEYNLKPAENAPSRDAIVLILRLFRMKAVEKSKGRRKGIFFK

SEQ ID NO: 44451 - protein, 185 aa, Sorghum bicolor
  Clone ID: SORBI-28MAY03-C57838_1.pep
MSGRRMQPQAQSYYAVLGVQPGATAAEIRAAYHRLAMRWHPDKIAGGRLDAARAEEAKIRFQQIHEAYQVLSDDKRRALYDAGMYDPLDDDQEDVEGFHDFVQEMVSLMATVGREEPVYSLADLQSMLDGMIKDFTAPPQPEPRVFYTGGASGKPSSKEQSTASSRMHPQGFGDAACFSRTAFSR

SEQ ID NO: 44452 - protein, 313 aa, Sorghum bicolor
  Clone ID: SORBI-28MAY03-C58199_1.pep
MGSLATADEPLPPLKYPQPRRDDDIVDDYHGVLVPDPYRWMEELDSKEVKEFVDAQSAVASAVLSTCDHRGRLRGQLTALFDHPRFRAPFKRRGSYFYFHNPGLRPHSALYVQRGLGGAEPDVLLDPNTFSDDGTVSLGMVGVSDDGEHLAYGTSASGSDWVTIRVMRVRDKEHLPDTMSWVKFSRIAWTRDGLGFFYSRFPAPRGDVGGEMDSGIKTDVNLNHEVYYHFLGTEQSQDVLCWRDPDHPKYIYIPEVTEDGKYVILSVSETSEPVNKLYYCDLSALAHGLGGITKQSTHGNGMLPFVKLVDKFE

SEQ ID NO: 44453 - protein, 228 aa, Sorghum bicolor
  Clone ID: SORBI-28MAY03-C58116_1.pep
MRFFKGSEVEVLHEAEVPFGSWRPGEIISGNGHTYLVRYDESPVDSSVAVERVPRRLMRPRPPADDSVRWSLGSILEAFDSYSWKVAEVVRVLGKNQYLVRLLGSSLELSAHSSDLRLRKLWLDDRWVVTQKYSARCLNGGAFGGRSKDGNLDCNLRKDRHIQLENQNAFEGDTSRGMKRKSSAISTHPQCSEITKRLRTPNRDGSPFTPACAVSVHSAEMGQGWRLF

SEQ ID NO: 44454 - protein, 135 aa, Sorghum bicolor
  Clone ID: SORBI-28MAY03-C5876_1.pep
MEVAAASAAASFGLKAADDVDNLRATELRLGLPGTEEEPQQVHKATAAAAAVELPLLPAATTPPAPSTPRGKKRDVVGSGNEDAPKKRDGNADAAPPAAKAQVVGWPPVRSYRKSCFQQQQPPAKSKPAPAAPAD

SEQ ID NO: 44455 - protein, 111 aa, Sorghum bicolor
  Clone ID: SORBI-28MAY03-C5807_1.pep
MKARAKSSGGDSRLSVKKGKAQKDPNKPKRPPSAFFVFMEEFRKDYKEKHPNVKQVSVIGKACGDKWKSLSDAEKAPYVSKAEKLKVEYTKKMDAYNNSSLDHSVWYSDKV

SEQ ID NO: 44456 - protein, 514 aa, Sorghum bicolor
  Clone ID: SORBI-28MAY03-C7731_1.pep
HEDSVEAVPPSIIQNWVDKAPKEDLDLPKRNIFIPNDLSLKCVEEKASFPAMLRKTSFSRLWYKPDTMFFTPKAYIKMDFHCPLSQSSPESAVLTDVFTRLLMDYLNDYAYDAQVAGLCSAVKPNDTGFQVTMVGFNDKMRTLLETVIGKIAEFEVKADRFSVIKEAMTKEYENFKFRQPYQQVLYYCSLILEDQAWPWDEEFSALSHLEASDLGIFLPRLLSKTFIECYFAGNIEANEAKNIVHHLEDVLFNAPISACKPLSPSQHLAKRIVKLEKGLRYYYPAMCSNHQDENSALLHYIQTHQDNVKQNVLLQLLALVGKQPAFHQLRSVEQLGYIALLRQRNDSGVRGLQFIIQSTVKDPANLDARVVNFLNMFEGTLYNMSDTEFKSNVSALIDMKLEKYKNIREESAFFWGEISEGTLKFDRKQEEVAALRELKKEELIDFFNDHVKVNAPQKKILSIQVYGGLHSAEYETIVQNAPPPQSCEITDIYSFRRSRPLYGSFRGGVGQMKL

SEQ ID NO: 44457 - protein, 394 aa, Sorghum bicolor
  Clone ID: SORBI-28MAY03-C7751_1.pep
MHRQKIANSGWAAFDRKWRSADGSGDEGDADSFPALSSFGAPNLASSSITEKNGLKPKPFASVVRPSVDSGAVSNGRGNKNSANHVENGNHGAISASVNKVKLLKDAHSWADSNLIEDVLAAVNNDVSQASDLLKAMVSPDLQTGEDRTSDQLAAVMNNTQGLPSESAGAGKANPDSSKLLPLPLPPMNFPSIPLEPELEEIDDDYLNYRKDALKMMRAATKHSQSASNAFLRGDHASAKEFSLRAQEERAAAEKLNNKAAEEIFRLRNSSNDIWKIDMHGLHASEAVTVLERHLHMIEFQQPGNKSASTEDLAKLESAYSESTTGLNIELAAEKVVLRRPKQYILHVITGMGNHSKGQASLPVAVRGFLIENGYRFDELRPGVFAVRPKFRRR

SEQ ID NO: 44458 - protein, 570 aa, Sorghum bicolor
  Clone ID: SORBI-28MAY03-C798_1.pep
MAEPALLAPDPFADLPFPEFQAPVDGDTFAFEDFDLEDLDLDLDVDFDLDLFASDGQLSQPPPLAPASSSAGSPEGGSSSSGGGGGLRNEESSESSSRSASGTDGSDKGKGEDDEAKRRARLVRNRESAHLARQRKKQYVEELEGKVKAMQATIADLSARISCVTAENAALKQQLGGAAGAAPPLPMPMYPAMYPLPMPWMHPAYPMRGSQVPLVPIPRLKPQQPAPTAAEPPAKKARKTKKVASVSFLGLLCLAMLCGCLISVVHRMYPSVDAGEGAAFGPSHHGRILAVEGPHDNVSDGIDPKPPQSGSETLPALLYLPKNGKHVKINGNLVIKSIVASEKASLRLPGYDGTSPQKQKKEETSLAIPGYVTPLEAGEVMESAKGVMKNELMALAPADGNVYREEDGLLPQWFSEAMSGPLLSSGMCTEVFQFDASPSSAHSNGIIPVYSNTMSNSSQNFTQKLPSACPRTVKNRRISYSETIPLRGSTSNDTEHFKTPPKNESFGSTKPVSSVVVSVLADPREAGDGDGEGRISSKSLSRIFVVVLIDSVKYVTYSCVLPFKSHSPHL

SEQ ID NO: 44459 - protein, 200 aa, Sorghum bicolor
  Clone ID: SORBI-28MAY03-C8203_1.pep
MAAVTNADVEVVDFDLDDDDLMDEDAGPDPAPAPAPASRLRSTIAGDDAPRRTKGRGFREDPNSSAHRDSRFGAGGRADLDSLGGPGPIQSIEGWIVLVTGVHEEAQEDDLQNAFQEFGQVKNLHLNLDRRTGFVKGYALIEYEKFEEAQAAIKELDGAELHEQIMSVDWAFSSGPAKRRNTRKRSPPRARSRTPPRRRH

SEQ ID NO: 44460 - protein, 363 aa, Sorghum bicolor
  Clone ID: SORBI-28MAY03-C62234_1.pep
HEARGSCHLIDYFEGIEGVKKIKDGYNPATWMLEVTTLAQEDILGINFAEVYRNSDLYRRNKALISELSTPPPGSKDLYFPTQYSQSFLTQCMACLWKQHMSYWRNPSYTATRIFFTTVIALIFGTIFLNLGKKIGTRQDLLYALGSMYAAVLFIGIQNGQTVQPIVDVERTVFYREKAAGMYSALPYAFAQVLIEIPHIFLQTVVYGLIVYSLIGFEWTAEKFFWYMFFMFFTFMYFTFYGMMAVAMTPNSDIAAIVSTAFYAIWNIFAGFLIPRPRIPIWWRWYSWACPVAWTLYGLVASQFGDITDVRLEDDEIVKDFVNRFFGFQHDNLGYVATAVVGFTVLFAFVFAFSIKVFNFQRR

SEQ ID NO: 44461 - protein, 112 aa, Sorghum bicolor
  Clone ID: SORBI-28MAY03-C6294_1.pep
MKFIAAYLLAVLGGNLSPSAEDLAAILESVGCEVDNEKMELLLSQLSGKDITELIAAGREKFASVPCGGGGVAVAAAAPAAGGAAPAAEAKKEEKVEEKEESDDDMGFSLFD

SEQ ID NO: 44462 - protein, 189 aa, Sorghum bicolor
  Clone ID: SORBI-28MAY03-C63119_1.pep
LPALLPFCGGVAVAPTAVALPCFPGPPIGYPAWGSPAGVTIRVTLTIPMWLIALANMMVVIHVIGSYQIYAMPVFDMIETVLVKKLHFPPGLTLRLIARTVYVAFTMFIAITFPFFGGLLGFFGGFAFAPTTYFLPCIMWLAIYKPKRFSLSWLTNWICIILGVLLMILSPIGGLRQIILDAKTYKFYQ

SEQ ID NO: 44463 - protein, 140 aa, Sorghum bicolor
  Clone ID: SORBI-28MAY03-C63382_1.pep
MAGTTVCSMCGDVGFPDKLFRCARCRRRFQHSYCTNYYGDAAPAEAGAGVCDWCLSVSGDVVGGKKRQYSSVSGHGKQQQQQQQRLQVEEEEAGRSMQQPASSFASSGCSKGAGKVTGGSEHAEGGRRPRRYKLLKDVMC

SEQ ID NO: 44464 - protein, 102 aa, Sorghum bicolor
  Clone ID: SORBI-28MAY03-C6456_1.pep
RDDPQRALIEREMFGREALNVIACEGSDRVERPETYKQWQVRNLRAGFVQSPLNKEIVMKAKDKVKDIYHKDFVIDEDSGWLLQGWKGRIIYAISTWKPKNN

SEQ ID NO: 44465 - protein, 275 aa, Sorghum bicolor
  Clone ID: SORBI-28MAY03-C675_1.pep
MSSSWNSVGLAVLYQVLGWVAFVAWSFSFYPQVLLNYKRKSVVGLNFDFLVLNLTKHSSYLIYNAALFFSPFIQQQYHDKYGDKEMIPVAANDVAFSLHAVALTAFTVFQVFIYERGTQKVSKVCISISAIVWTAALVCLIIAWPKSDWLWLIDVLNSIQVGMTAIKYIPQAIMNFRRKSTIGWSVGNILLDLTGGVLNFCQMGVQSIDQHTLVNFYGNIGKTLLSLETVFFDVVFIIQHYVLYPVTKDDHGKAIISERVAPLIRPSDKPEEDTV

SEQ ID NO: 44466 - protein, 272 aa, Sorghum bicolor
  Clone ID: SORBI-28MAY03-C67589_1.pep
MRGAKRPLGVVTSWVRRQPPKVKAFLAVVTGMAALVFIRFIVHDHDNLFVAAEAAHALGIGVLIYKLTKEKTCAGLSLKSQDLTALFLAVRLYCSFVMEYDIHTILDTATLVATLFVIYMIRFKLRSTYMVDKDNFALYYVVLPCAGLALLIHPSTSHNIVNRISWAFCVYLEAVSVLPQLRLMQNTKIVEPFTAHYVFALGVARFLSCAHWVLQVLDTRGRLLTALGYGLWPSMVLLSEIVQTFILADFCYYYVKSLVGGQLVLRLPSGVV

SEQ ID NO: 44467 - protein, 154 aa, Sorghum bicolor
  Clone ID: SORBI-28MAY03-C9116_1.pep
DPSAAHDVSICRNSNDVHGSLVDNPLALAGDDPSLQIFLPSQPSTVPLQEELSERANTPNGVHPDDWRISLTLAAGGGGNEESTSVDGLKSQPKVPSKEAGVEPLLDAASALPSMNRCNGSNLNPRRIENIFSHPRQPRSVRPRLCLSLDTDSE

SEQ ID NO: 44468 - protein, 74 aa, Sorghum bicolor
  Clone ID: LIB3476-058-P1-K1-D1.pep
LQEELSERANTPNGVHPDDWRISLTLAAGGGGNEESTSVDGLKSQPKVPSKEAGVEPLLDAGLSPFYEFNSSLL

SEQ ID NO: 44469 - protein, 101 aa, Sorghum bicolor
  Clone ID: SORBI-28MAY03-C915_1.pep
ARGMRFSRCPAVAVLPGVGAWARSCGRPRSPLRFLPVAPPRESFSCYTAHMLRRAVEFGILIQYLFEKFPNWQEIASHAIVDLQVSQTYTRMEPCREKRCL

SEQ ID NO: 44470 - protein, 75 aa, Sorghum bicolor
  Clone ID: LIB5048-011-R1-XP1-B4.pep
NQIWAVQIEVVHPSCTCVLPLSYSSQMDKHFSSASKTPLLTAWLHPCISLRNLKVDNGMASYLLPIWEFLKKILY

SEQ ID NO: 44471 - protein, 132 aa, Sorghum bicolor
  Clone ID: SORBI-28MAY03-C10141_1.pep
QLRPATGSTSGYSSSDVLIILEHIVGALKSLCILLQWDLKPPLVPWCARVCCSQWRDEVQAGVRLGTRVAVPVRRVAHAGGRPVCPRGGNQARSGLHGSAAWCKRGRGKGRGGWGGPAWRSAPRWRRAERRG

SEQ ID NO: 44472 - protein, 255 aa, Sorghum bicolor
  Clone ID: SORBI-28MAY03-C10208_1.pep
MANAGGGPAGEGEWLKVAQLRALLVQAQEQDPRAKEVDNLTLRRFLRARDHNVDKAGAMLLKFLRWRAEAAPGGSVPEEAVRGELEQDKVYMGGVDRTGRPIIVGFLAKHYSANRDMAEFKSFVVYFFDKICARIPRGQEKFLAIMDLKGWGYANCDVRAYIAAIEIMQNYYPERLGKALMINVPFIFLKVWKTMIYPFIDANTRDKFVFVEDKSLRETLRREIDETQLPEFLGGKMPIIPLKDYAQQQPQPVCE

SEQ ID NO: 44473 - protein, 263 aa, Sorghum bicolor
  Clone ID: SORBI-28MAY03-C6976_1.pep
MLELRLVQGSLLKKVLEAIRELVTDANFDCSGTGFSLQAMDSSHVALVALLLRAEGFEHYRCDRNLSMGMNLNNMAKMLRCAGNDDIITIKADDGSDTVTFMFESPKQDKIADFEMKLMDIDSEHLGIPDSEYQAIVRMPSAEFMRICKDLSSIGDTVVISVTKEGVKFSTSGEIGSANIVCRQNQTIDKPEEATIIEMQEPVSLTFALRYMNSFTKASSLSEQVTISLSSELPVVVEYKIAEMGYIRFYLAPKIEEDEEMKA

SEQ ID NO: 44474 - protein, 156 aa, Sorghum bicolor
  Clone ID: SORBI-28MAY03-C70147_1.pep
PRRPRHPLAGQGLGVRRRLRRGLLAQAAPGSPAAARDWGFAGDYVEAMWLMLQQDQPADYVVATEESHTVEEFLQAAFGYAGLNWKDHVVIDKKYFRPAEVDSLKGDSTKARKVLKWKPKVGFQQLVEMMVDHDIELAKKEKVLVDAGYRDPKQQP

SEQ ID NO: 44475 - protein, 176 aa, Sorghum bicolor
  Clone ID: SORBI-28MAY03-C7137_1.pep
MAAALWTLVVLSAAVAALATEWRVAATAAAEAANEVLRAHQLPGGLLPAGITAFHHDAATGRFEAQLEAPCTARFEVGLRYNATVTGVISPGQIAAISGVAAQDLFMWFPVHDIKVDIPSSGVIYFNVGVVKKHLPLAVFDAPPACTPDPLLRTVPQRLEDVGEDGLAMGAAASSR

SEQ ID NO: 44476 - protein, 448 aa, Sorghum bicolor
  Clone ID: SORBI-28MAY03-C7030_1.pep
ARGPGETAPTPAGSPESQPGAGGAADVGGGKKKKLSGGAIAGIAIGSVFGVLLLLALLFFLCRKRSSAPRSAATVEKGRELGMEPMDVEPKGQNGSAAGAGGHNGAAAAVAAPTAAAAAAATAAAAKTGGSTGSKKLIFFGPMAAAPPFDLEDLLRASAEVLGKGAFGTAYKAVMENGSAVAVKRLKDVDLPEPEFRERIAAIGAVQHELVVPLRAYYFSKDEKLLVYDYMSMGSLSALLHGNRASGRTPLDWETRSAIALAAARGVAHIHSTGPTASHGNIKSSNVLLTKNYEARVSDHGLPTLVGPSFSPTRVSGYRAPEVTDIRRVSQKADVYSFGVLLLELLTGKAPTHAVVNEEGLDLPRWVQSVVREEWTAEVFDQELLRYQNVEEEMVQLLQLAIDCSAQHPDRRPAMSEVATRIDDIRRSSLGGGDRQAADSAEGDEPSL

SEQ ID NO: 44477 - protein, 232 aa, Sorghum bicolor
  unsure (1)..(232): unsure at all Xaa locations
  Clone ID: SORBI-28MAY03-C71502_1.pep
MAPPTEDCGWLLYLSLAAKCGDPHRLLGFAAVFVAACVVTSLLHWASPGGPAWGWYWWTRRAAGLGIVRAATIPGPRGLPVVGSMALMTGLAHRKLAAAAQGQASRRRLMAFSLGETRXVVVTADPDVARELLASAAFADRPVKESAYGLLFHRAIGFAPHGAYWRALRRVASAHLFSPRRVAASAPRRAAIARRMLRDLSAAAAAGGGGGGEVVMRRVLHAGSLDHVMATV

SEQ ID NO: 44478 - protein, 302 aa, Sorghum bicolor
  Clone ID: SORBI-28MAY03-C74668_1.pep
MASRAVALLVAVALAAFLLHPAAAAGQKKPATAARREDIPYIRCQVCERIAREISAQVAKKQQALPPSKKVPEIEIIEIAENVCNLKKQEADWMLRIDIVEKGDKLELVEQDEEGHCNAECKTIERACQEVIGYADTDVAEFVYKNNPSADQLMKFLCKDLSKACAKDPPPVPKDRVPGEPFARKPSKDAEMEKILKSMEGMPGAPSMKMYSRDDLMKNNFGTEDDDDEDDEDEDDNFPKNLGKALKDKGSQKKDLKQQVVQQFKDTSKKLKGHVNKVSNVVKKWWKGAKKPAKSSKSKTEL

SEQ ID NO: 44479 - protein, 765 aa, Sorghum bicolor
  unsure (1)..(765): unsure at all Xaa locations
  Clone ID: SORBI-28MAY03-C7661_1.pep
ARGTHPAAVLMPPRSPTPASPGVDFPAGASVLCSLRPPPAGLSPLGMLPGFRLPASSPQGLCLPLVLFHETVARTLTQGSTPMSMDFHPLQQTLLLVGTNVGDIGLWDARAKERLVVRNFKVWDLSKCTMTLQASLVKDPAVSVNRIIWSPDGTLFGVAYSRHIVQIYSYNGGDDLRQHLEIDAHIGGVNDIPVAHPNKQLCIITCGDDKTIKVWEATSGTKQFTFEGHEAPVYSVCPHYKENIQFIFSTALDGKIKAWLYDNLGSRVDYDAPGHWCTTMAYSAHGARLFSCGTSKDGESHLVEWNESEGAVKRTYQGFRKRSMGVVQFDTTRNRFLAAGDEFMIKIWDMDSTGLLTTIDADGGLPASPRIRFNKEGTLLAVSTLDNGIKILANADGLRLLRTLENRSFDASRNATETVTKPLILTAANAAAASSSVAAAPSAITAMNGDSRSLVDVKPRIADESLDKSKVWKLMEITESTQCRSIKLADNMRTSKISRLIYTNSGLAILALTSSAVHLLWKWPRSDRNSGKATASVSPTLWQPPSGIFMTNDTTDNNPEEAVHCFALSKNDSYVMSASGGKISLFNMMTFKTMTTFMPAPPAATFLAFHPQDNNIIAIGMDDSTIQIYNVRIDEVKSKLRGHSKRITGLAFSNVLNVLVSSGADAQLCVWNTDGWEKQKTRFLQIPSGRQSNILDTRVQFHQDQMHFLVVHETQIAIYETTKLEPVKQWPVRENSPPITHATFSCDSQLIYASXMDATVGIFNA

SEQ ID NO: 44480 - protein, 156 aa, Sorghum bicolor
  Clone ID: SORBI-28MAY03-C11802_1.pep
RCNNETYSTELLPMQQLDDIREPSDSAPEISICEPNPCSSMNYGTVPGRHSMSEERQSYLKRLGYPELHSSNFLDLDLLSSSGNSCDEEVFERSSLINSPMDVISVESSTSYSEQGHIDEGRDDTDLSRSSSQLSDVRDYSDRFAHWVANGGMLCY

SEQ ID NO: 44481 - protein, 296 aa, Sorghum bicolor
  Clone ID: SORBI-28MAY03-C11888_1.pep
MDGSRKKKWVAWAVAAAIFVVLMLVTPAIPQDEAYHDFADQRTLFLGIPNTLNVISNIPFFFVGVTGLILCHYKNYFRLSSQGELWSWTLFFAGVTAVGFGSSYYHLNPNDATLVWDRLPMTIAFTSVMAIFIIERVDERAGAKSLAPLVITGALSIMYWRHFDDLRPYAVVQFVPCIALPVMAIVIPPMYTHSSYWLWAAGFYLLAKVEEAADKPIYNWTHQIVSGHTLKHLCAAMVPVFLALMLAKRTIEPERVSLLQKWKISWVTVRERRSKDSITVDVDCNYAAVSNTTSEQ

SEQ ID NO: 44482 - protein, 158 aa, Sorghum bicolor
  Clone ID: SORBI-28MAY03-C12058_1.pep
PVSDEEKDSVRSAYLRRHPDAFWVDFGDLSFLHIKPKAVRYVSGVATALLGSGEFGAAEYKEANVDPISQFSTPITSHMNKDHADDTKLIVQHSTTVKVDFAYMLDVDSLGFNVKAGYDGSVLKLRIPFPRQAQDRKDVKTLIVEMLQAARASSSDPE

SEQ ID NO: 44483 - protein, 416 aa, Sorghum bicolor
  unsure (1)..(416): unsure at all Xaa locations
  Clone ID: SORBI-28MAY03-C12370_1.pep
AGHVLALDFIESVIKKNQSINGHHKNITFKCADVTSPELKIEDNSVDLIFSNWLLMYLSDEEVEKLVGKMVKWLKVGGHIFFREXCFHQSGDSKRKVNPTHYREPRFYTKVFKEGHSFDQDGGSFELSLVTCKCIGAYVKNKKNQNQICWLLEKVKSTEDRDFQRFLDNVQYKTSGILRYERVFGEGYVSTGGIETTKEFVGMLDLKPGKKVLDVGCGIGGGDFYMAENYDVHVLGIDLSVNMVSFAIERAIGRKCSVEFEVADCTTKDYPEDSFDVIYSRDTILHIQDKPALFRSFFKWLKPGGKVLISDYCKNPGKPSEEFAAYIKQRGYDLHDVKAYGQMLKDAGFHDVIAEDRTEQFLNVLRRELGEVEKNKEAFLADFTQEDYDDIVNGWNAKLKRSSAGEQRWGLFIATK

SEQ ID NO: 44484 - protein, 340 aa, Sorghum bicolor
  Clone ID: SORBI-28MAY03-C1090_1.pep
MVLVVLGCSPASPRPACTPNSRRRCSATRQKIIRCSLNEETLLSKHGVVSRQLISCLAASLVFVSPPSQAIPAETFAHPGLCQIATVAAIDNASVPLKFDNPSDDGSAGMMMRGMTAKNFDPVRYSGRWFEVASLKRGFAGQGQEDCHCTQGVYSFDEKSRSIQVDTFCVHGGPDGYITGIRGRVQCLSEEDMASAETDLERQEMIREKCFLRFPTLPFIPKEPYDVLATDYDNYAVVSGAKDTSFIQIYSRTPIPGPEFIEKYKSYVANFGYDPSKIKDTPQDCEYMSSDQIALMMSMPGMNEALTNQFPDLKLKAPVALNPSTSVFDTLKKLLELYFK

SEQ ID NO: 44485 - protein, 101 aa, Sorghum bicolor
  Clone ID: LIB3481-006-Q6-K1-E4.pep
VRFETISGRLAMLAFAAAVAVETTTGSSLFKKLDTMEIEEAAGVCVAVVACAAAFAWASSARNRIGQMFTLGCNAFVDSLIDNIVEALFSEGELQDWSDDI

SEQ ID NO: 44486 - protein, 358 aa, Sorghum bicolor
  Clone ID: SORBI-28MAY03-C8406_1.pep
MMMANPKLHKQALLPPRSPFPTAAAPSPYADRGPIARPQVGAAHHRHGHHQRTSSESFIEEQPPLWLDDLLNEPETPAARQSGGRAGHRRSSSDSFALFDGGAAGAAGAYANGFAGRGRGGGQPAPWGGVQEYYAKPASFGRAHGRPWEQGMPNSAGFRHGGGLPMPMKDKVGGHHGPPNVPREHDHGMDKRTPDDAGHDQKVGAKEGVLPKHAQSEADNKRAKQQYAQRSRVRKLQYIAELEGRVQALQSEGVEVSAEMEFLTQQNIMLDLENKALKQRLESLAQEQLIKRFQQEMFEREIGRLRSLYQQQQQQQQQQVPALVRSNSRDLDVQFANLSLKHKDPNSGRDALSGPLRT

SEQ ID NO: 44487 - protein, 67 aa, Sorghum bicolor
  Clone ID: SORBI-28MAY03-C8472_1.pep
MTEAPFLPRERLFKQQHYFQHLTKHTYLKGRYDVITSVAIPLALAASSMFMIGRGVYNMSHGIGKKE

SEQ ID NO: 44488 - protein, 95 aa, Sorghum bicolor
  Clone ID: SORBI-28MAY03-C8057_1.pep
KSIGSLISSKHINTKYRKLTFYIIPSNISIISLQHRHKPRKLSTSQIMSYDVRATIDLTPKIEESFQPHLFGYRRLSCLNLLIGPNSLSNPKSIR

SEQ ID NO: 44489 - protein, 82 aa, Sorghum bicolor
  Clone ID: LIB5121-003-A1-PF1-A8.pep
PTLVDASASELLAARAAWRASEVMAVLETLKPLEEKLGANIPREAKSCICVMHGGRSRRLSRRFQVCICVSRMVGRIPLFLV

SEQ ID NO: 44490 - protein, 64 aa, Sorghum bicolor
  Clone ID: LIB3476-043-P1-K1-D10.pep
ISHYATVTTQGNCGRRKPCLMMSEPPLTSHQIEESFRPSGGEQELHSYDPHEVGTLMSISCIET

SEQ ID NO: 44491 - protein, 336 aa, Sorghum bicolor
  Clone ID: SORBI-28MAY03-C8521_1.pep
AALREALCGKDVPAKVYVGMRYWHPFTEEAIEQIKRDGITKLVVLPLYPQFSISTSGSSLRLLESIFREDEYLVNMQHTVIPSWYQREGYIKSMATLIENELTKFPVPQKVMIFFSAHGVPLAYVEEAGDPYKAEMEECVDLIMEELEKRGITNPCTLAYQSRVGPVEWLKPYTDETIIELGQKGVKSLLAVPISFVSEHIETLEEIDVEYKELALESGIKHWGRVPALGCEPTFISDLADAVIESLPYVGAMAVSNLEARQSLVPLGSVEELLAAYDSKRDELPPPVIVWEWGWTKSAETWNGRAAMLAVLALLVLEVTTGEGFLHQWGILPRLH

SEQ ID NO: 44492 - protein, 207 aa, Sorghum bicolor
  unsure (1)..(207): unsure at all Xaa locations
  Clone ID: SORBI-28MAY03-C9144_1.pep
MEPRRISASPRPCSGRRVVAARKRPRQEAVVSSVRKLQRREISSRRDRAFAMSAAQERFRNIQLQEEFDTHDPKENTSLLPYLRKRSKIIEIVAARDIVFALSQSGVCAAFSRETNQRICFLNGSPDEVIRSLFYNKNNDSLITVSVYGSENFSALRCRTTRIEYIRRGQPDAGFPLFESESLKWPXFVEFDDVNGKVLTYSAQDST

SEQ ID NO: 44493 - protein, 169 aa, Sorghum bicolor
  unsure (1)..(169): unsure at all Xaa locations
  Clone ID: SORBI-28MAY03-C883_2.pep
IKSYLDISADPATFVQGAIPNLLENTKEEFFQKTIKILKESADICWEKLKDINAITCPSKPEGSMFVMVCESLHILFHVAGHHEGFANNVXSSLDLLQVKLDVSCLSDIKDDMDFCCRLAKEELVVVLPGCAVGYKDWLRITFAIDPSSLEDGLDRLKSFCLRYKKLTK

SEQ ID NO: 44494 - protein, 156 aa, Sorghum bicolor
  Clone ID: SORBI-28MAY03-C883_1.pep
PHGVCRSTLVAAGGRPRRHIPSHPTAFLLGAGPCLLAISCDGCCQNTIKILKESADLCWEKLKDINGVTCPSKPMGSMFVMVKLDLSCLQDIKDDMDFCCRLAKEESVVVLPGRVVGCKDWLRITFAIDPSSLEDGLDRLKSFCLRHSSKPAGRVM

SEQ ID NO: 44495 - protein, 173 aa, Sorghum bicolor
  Clone ID: SORBI-28MAY03-C9865_1.pep
TRGSFTLRLMYEQFQNILKMGPIGQVFSMLPGFSAELMPKGHEKESQAKIKRYMTMMDSMTEAELDSTNPKLMTESRIIRIARGSGRPVRDVMDMLEEYKRLAKIWGKMKGLKIPKKGEMSALSRNMNVQHMSKVLPPQMLKQIGGMGGLQSLMKQMGSKEMSGMFGGMGGER

SEQ ID NO: 44496 - protein, 283 aa, Sorghum bicolor
  Clone ID: SORBI-28MAY03-C13507_1.pep
TRVSTIAAIRVGLLLAPGGEFAFVAFGEAVNQGLLSPQLSSLLFLVVGISMALTPWLAAGGQFLASKFEQHDVRSLLPVESETDDLQDHIIILGFGRVGQIIAQLLSERLIPFVALDVRSDRVAVGRALDLPVYFGDAGSREVLHKVGAERACAAAITLDTPGANYRAVWALSKYFPNVKTFVRAHDVDHGVNLEKAGAMAVVPETLEPSLQLAAAVLAQAKLPMSEIQETISEFRNRHLSELTELCATTGSSLGYGFSRVTSKSKSVTPDDESETVDGALAI

SEQ ID NO: 44497 - protein, 59 aa, Sorghum bicolor
  Clone ID: LIB3480-001-P1-K1-G2.pep
MSEIQETISEFRNRHLSELTELCATTGSSLGYGFSRVTSKSKSVTPDDESETVDGALAI

SEQ ID NO: 44498 - protein, 119 aa, Sorghum bicolor
  Clone ID: SORBI-28MAY03-C14177_1.pep
MASSSSFLLAMAALAALLAVGSCSTLMTWTIGKDSTSTRLVLVASADVSEVAVKDKGATDFSDDLKESPAKTFTYESKEPIKGPLSVRFAVKGQGYRTTDDVIPSDFKPGSVYKTKEQV

SEQ ID NO: 44499 - protein, 119 aa, Sorghum bicolor; identical to SEQ ID NO: 44498
  Clone ID: LIB5047-003-R1-XP1-A4.pep

SEQ ID NO: 44500 - protein, 224 aa, Sorghum bicolor
  Clone ID: SORBI-28MAY03-C14307_1.pep
MSGVFGRVFGKSKAQSQATALASLDKLNETLEMLEKKENLLVKKANLEVEKAKNFTKAKNKRAAIQCLKRKRLYEQQIEQLGNFQLRIHDQMIMLEAAKATTETVDALRTGASAMKAMHKSTNIDDVDKTMDEINDNMENMRQIQDLLSAPMGAAADFDEDELEAELADLEGEELEAELLAPTTTAPSTAPVRVPTAQQSTRPSAQSSKAEDDELAALQAEMAM

SEQ ID NO: 44501 - protein, 147 aa, Sorghum bicolor
  Clone ID: SORBI-28MAY03-C14707_1.pep
DDSGSPTDDSGDEDSDASDSGGEKEKSSKKEASSSKPVQKRKPKARDDEGHEKKKAKKKKDPNAPKRAMTPFMYFSMAERGNMKSSNPDLPTTEIAKKLGEMWQKMSSEEKQPYIQQAQVDKKRYEKESAVYRGEATADVDSGNESD

SEQ ID NO: 44502 - protein, 247 aa, Sorghum bicolor
  unsure (1)..(247): unsure at all Xaa locations
  Clone ID: SORBI-28MAY03-C10886_1.pep
MGGRKLALLVGINYPGTKAELKGCYNDVDRMRRCLIDRFGFDEADIRVLTDADRSAPQPTGANIRRALARLVGDARPGDFLFFHYSGHGTRLPAETGQNDDTGYDECIVPCDMNLITDQDFRELVQKVPEGCLFTIVSDSCHSGGLLDSAKEQIGNSTRQNKTQSREPDERPHSGSGSGFRSFLKETARDLLESEGIHIPHSRHGGDDEDDAYAQPTGDGHTXNRSLPLSTLIEMLKEQTGKDDIDV

SEQ ID NO: 44503 - protein, 327 aa, Sorghum bicolor
  Clone ID: SORBI-28MAY03-C11054_1.pep
TRAQLNEHAKLSMLRNATWTLSNFCRGKPQPSFDQTKPALPALARLIHSNDEEVLTDACWALSYLSDGTNDKIQAVIEAGVCPRLVELLLHPSPSVLIPALRTVGNIVTGDDMQTQCIIDHQALPRLLNLLTQNHKKSIKKEACWTISNITAGNKDQIQAVISAGIIAPLLQLLQTAEFDIKKEAAWAISNATSGGSHEQIKYLVAEGCIKPLCDLLVCPDPRIVTVCLEGLENILKVGEYDKNMGGATADGNLFAQMIDEAEGLEKIENLQSHDINEIYEKAVKLLEAYWMEEEDDTMATAAEAGPTVFDFSQGGNPPAGGGLNFN

SEQ ID NO: 44504 - protein, 350 aa, Sorghum bicolor
  Clone ID: SORBI-28MAY03-C11278_1.pep
MGSAISSSALCWVDLLSGILVCDNIRRFVTGSKGDDLVFTFIPLPEECALKPDPLFRWGRAPEGYRSMCCMSSDSIRFVSMDNHSHEHSITEVILRTWTLTFPLRNKLRNNWKWEKDSALCMENLFDTFPILKKDSKLQQLVLSRPIIYGLTHAVHLSVTDLEYMLEHQHWKVSAFYELQIDMDMQMVSSVFKLPSGSPIVPPSHIFASAVGHYMNSTELHPAKSTACEVQAAETEGVLDSMRKKVANFSTAFGVQAAEGEEADESMGKVSAKKCYDLPEGKYPPEFIATHMRLKQQHEKEECRKKYILQRDERKKMMSKERKKGRLSSKGGLSSKEGALSVTTTKASTQ

SEQ ID NO: 44505 - protein, 151 aa, Sorghum bicolor
  Clone ID: SORBI-28MAY03-C11739_1.pep
MGILDHLSHLCSLTETKEALKLRKKRPLQTVNIKVKMDCEGCERRVKSAVKSMRGVTSVAVNPKQSKCTVTGYVEPAKVLQRVKATGKNAEMWPYVPYALTTYPYVGGAYDKKAPAGFVRSAPQAMAEPSAPELKYMNMFSDENVNACTVM

SEQ ID NO: 44506 - protein, 548 aa, Sorghum bicolor
  Clone ID: SORBI-28MAY03-C11438_1.pep
HEASKKIEIPNGRVGVIIGKAGETIRYIQLQSGAKIQVTRDHEAEPGALAGPVELSGNPDQISKAEQLIKEVLAEADAGSSGGGSGRKYNAPQPGGETFQMKIANNKVGLVIGKGGETIKSMQQKTGARIQVIPLHLPAGDTSTERTVHIDGTPEQIESAKQLVIEVTSENRARNPMSGGYSQQGYRPPRPQSNWGPPSAPPQQPGYGYMQPGAYPGAPPQYGAPQQPYGSYPPTSGGYQTGWDQSQNQQSHTTPPGTGYDYYSQQQQPQQQQSAPGTAASTDATSYNYGQPSTYASQGYDSTYTQQSGGQQAYGHDGYSGYQTQGQQQGYSQQTGYDQQGYGASAYGSAANSTQDGSAASYGGPGGASQASPGQQSPTPAASHPGYASQPPTSAAASYPTQGSAPSGYGAPPPQSGYGTQPPGYGQGAYGQPSPQGQKPPASSPYGQAPPPGSAQGGYGQYGYSQPAYGAPPAYPGAPHSSHPGYGQQQSYGDAYGSGNYGQPPAYSTEATAAAASQDHSAAPAAAPATTAAPAPDNSGGAQTSAET

SEQ ID NO: 44507 - protein, 330 aa, Sorghum bicolor
  unsure (1)..(330): unsure at all Xaa locations
  Clone ID: SORBI-28MAY03-C1180_1.pep
MKERSGSRAAVDERYAQWKSLIPVLYDWFANHNLVWPSLSCRWGPQFEKATYKNRQRLYLSEQTDGSVPNTLVIANCEVVKPRVAAAEHISQFNEEARSPFVKKYKTIVHPGEVNRIRELPQNSKIIATHTDSPDVLIWDVEAQPNRHAVLGASESRPDLILTGHKENAEFALAMCPAEPYVLSGGKDKSVVLWSIQDHISALGDSSSSPGASGSKQSGKSATEKESPKVDPRGIFHGHDSTVEDVQFCPSSAQEXCSVGDDACLILWDARTGTGPAVKVEKAHSGDVHCVDWNPLDVNYILTGSADNSVRMWDRRKLGSGGASSPIHKF

SEQ ID NO: 44508 - protein, 415 aa, Sorghum bicolor
  Clone ID: SORBI-28MAY03-C16172_1.pep
MAMEETSKITGRMKGGLRTMPFIFANEVAEKLAVVGFSTNMLTYLTTQLHMPLAKAATTLTNFGGTSAATPLIGAFLADVCIGRFWTIAAASVVYQVGMALLTVSAALPQFRPPPCKPGGAVTCQEAAPWQLAVLYVSLLLNAVGAGGYRPCIVAFGADQFDESRAAERARSWGFFNWYYFCNGASMLLAVTAVVYVQDNVGWGWGLGVPAFCMGVSVAAFVAGAPGYRRLEPAGSPFTRLAQVVVAAVKKRRLPAADVVPARLYENDDLDAPISMYGKLVHTDQLSFFDRAAIVTDGDMVTQTDADSGKPSAAPVPNPWRLSTVHRVEELKSVIRMGPIWAAGILVITGSSTQHTFSLQQASTMDRRLAPGLSTFQIPAGSMTVFALLAMLLTLFLYDRVLVRVARRFTGLDRG

SEQ ID NO: 44509 - protein, 112 aa, Sorghum bicolor
  Clone ID: SORBI-28MAY03-C15339_2.pep
MVAAKKTKKSTDNINNKLQLVMKSGKYTLGYKTVLRTLRNSKSKLVIIANNCPPLRKSEIEYYAMLAKVTVHHFHGNNVDLGTACGKYFRVCCLSIIDPGDSDIIKTTPGEQ

SEQ ID NO: 44510 - protein, 112 aa, Sorghum bicolor
  Clone ID: SORBI-28MAY03-C15339_1.pep
MVAAKKTKKSTDNINNKLQLVMKSGKYTLGYKTVLRTIRNSKSKLVIIANNCPPLRKSEIEYYAMLAKVTVHHFHGNNVDLGTACGKYFRVCCLSIIDPGDSDIIKTTPGEQ

SEQ ID NO: 44511 - protein, 339 aa, Sorghum bicolor
  Clone ID: SORBI-28MAY03-C16397_1.pep
MPNLECRMYEQRFPEVDAAVMIQVKHIADMGAYVSLLEYNNIEGMILFSELSRRRIRSISSLIKVGRQEPAIVLRVDRDKGYIDLSKRRVSEEEAHACEDRYNKSKLVHSIMRHVAETLEVDLEPLYQRIGWPLYRKYGHAFEAFKLIVADPDAILDALTYEEKEVGPDCQEVTKVVPAVTPEDKDSLVKNIRRRMTPQPLKIRADIEMKCFQFDGVLHIKQAMKKAEAAGNDNCPVKIKLVAPPLYVLTTQTLDKEQGISVLTDAIKACTAEIEKYKGKLLVKEPPRAVSEREDKLFLDQIDSLMEQNAEVDGDADSEEEEDTGMGDVDITNSGVTAY

SEQ ID NO: 44512 - protein, 83 aa, Sorghum bicolor
  Clone ID: SORBI-28MAY03-C1653_1.pep
HQEDMSEILICNVSATSAMEGGAGTRCSSYIWGYSWYNYIAASTSRNGYELTAYGNLCYVCSLEQIYCVDWIEHAVAIHFDGS

SEQ ID NO: 44513 - protein, 361 aa, Sorghum bicolor
  unsure (1)..(361): unsure at all Xaa locations
  Clone ID: SORBI-28MAY03-C12444_1.pep
ARGSNVTEADFRRYFEQFGVITDVVVMYDHNTQRPRGFGFITYDSEDAVDKALHKSFHELNGKMVEVKRAVPKEQSPGPVVRSPVGVGQNYAMNRVHSFLNGFNQGYNPNPIGGYGMRVDGRYGLLSGARNGFSSFGPGYGMGMNVEGGMSGTFGASSGFISNSNGRQMGSYFNASSNRLGSPMGYLGLNDVPGSMLSSMSRNVWGNGSLNYPSNPTNMNAFASPGNGGQVGITGDSWGGLPSAHGMGSISSLGSGNLGRGAGDNTFGLPSGSYGRSNSTGTIGEPFSASVNTYEVNNPDTYGSSSIYGGTAWRFASSEVDMPSFGHDIGNVDPTIKXDMSASHMGNYPVNNNQPSRGITS

SEQ ID NO: 44514 - protein, 290 aa, Sorghum bicolor
  Clone ID: SORBI-28MAY03-C12609_1.pep
HEDSAVPGLNQGSASFDKKGMEIHLPEEDNLFTMSDSLPGQNSDIFASVGSSRVEGLLPEKAVDDLSYRFQSLVPGDAEHIQVLGPDALGSHPRDQRYQVDSQNLYHLLQGRPPMMAPRPMMDHIVNRKQPAPFDMPQSIHHDSHHSFPSNVNPMQHNLHGPGVPHLDPTAHIMLQHMSMPGRFPPEGLPRGVPPSQPVHHMAGYRPEMGNVNNFHMHPRQPNYGEFGLMMPGPSAPEVRGNHPEAFERLIQMEMSARSKQQQVHHPAMAAGRVPSGMYGHELDAKLRYR

SEQ ID NO: 44515 - protein, 206 aa, Sorghum bicolor
  Clone ID: SORBI-28MAY03-C12736_1.pep
MGAYYRRPSPLQRQLLPTAVLVLLAIAASSSGFSSAAAAAGRNVITHIKGFEGPLPFHLETGYVEVDEEHGARLFYYFIESERNPAEDPLILWITGGPGCSALSGLLFEIGPLKFDVAGYTEGFPRLVYFEDSWTKVSNVIFLDAPVGTGFSYSVEEAGLNVSLTESGRQHHAFLRKWLAEHPEFASNPLYIGGGAYSGYTVPVAA

SEQ ID NO: 44516 - protein, 246 aa, Sorghum bicolor
  Clone ID: SORBI-28MAY03-C13528_1.pep
RDGDGPREDGGGSNNWPEDTLFFRADNGGWSTQYGDFFLSWYSQMLLEHGDRILSGATSVFGASSPVEVSVKVAGIHWHYGTRSHAPELTAGYYNTRHHDGYRPIADLLARHGAVLNFTCVEMRDHEQPQEAQCMPEHLVRQVGAAARAAGVGLAGENALPRYDGTAHDQVVATAAQRAGEDRMVAFTYLRMGPDLFHPDNWQRFAAFVRRMNGAGSCREAAEREAHGVAQATGSLVHEAAVALRS

SEQ ID NO: 44517 - protein, 280 aa, Sorghum bicolor
  Clone ID: SORBI-28MAY03-C1365_1.pep
MAEMAVTVAAANGTLRTCSGVSPTAPGGRRAAVLGRWRALAPANLRLSSPAVRVPRATSAAAVEDWSNTDIVPIPKVIIDQDSDPDATIVEITLGDRLGELLDTMNALKNLGLNVVKASVCLDSTGKHNKFSITKASTGRKIDDPELLEAIRLTIINNMLVYHPESSSQLAMGATFGPEAPTEEVDVDIATHIDIYDGPERSLLVVETADRPGLLVDLVKIISDININVQSGEFDTEGLLAKAKFHVSYRGKPLMEALKQVLSNSLRYFLRRPTTEDASF

SEQ ID NO: 44518 - protein, 197 aa, Sorghum bicolor
  Clone ID: SORBI-28MAY03-C12787_1.pep
MSASRFIKCVTVGDGAVGKTCMLISYTSNTFPTDYVPTVFDNFSANVVVDGNTVNLGLWDTAGQEDYNRLRPLSYRGADVFLLAFSLISKASYENVSKKWIPELKHYAPGVPIILVGTKLDLRDDKQFFVDHPGAVPITTAQGEELRKQIGAPYYIECSSKTQLNVKGVFDAAIKVVLQPPKAKKKKKAQRGACSIL

SEQ ID NO: 44519 - protein, 124 aa, Sorghum bicolor
  unsure (1)..(124): unsure at all Xaa locations
  Clone ID: LIB3480-032-P1-K1-E6.pep
YVHLLLLPLLFCQDYVPTVFDNFSANVVVDGNTVNLGLWDTAGQEDYNRLRPLSYRGADXFLLAFSLISKASYENVSKKWIPELEHYAPGVPIILVGTKLDLRDDKQFFGDHPGAVPITTASGE

SEQ ID NO: 44520 - protein, 149 aa, Sorghum bicolor
  Clone ID: SORBI-28MAY03-C18903_1.pep
PAGPGLFSCPGRDVAVEVLERAYMQSPLVASVWVYGNSFESFLVAVVVPERQALEEWAAANNKAGDFAELCIDPKARSYIQDQLNQTGKKLGLRGFEMLKAVYLEPVPFSIEKDLITPTFKLKRPQLLKYYKDRIDQMYKDAKEGRTAP

SEQ ID NO: 44521 - protein, 288 aa, Sorghum bicolor
  Clone ID: SORBI-28MAY03-C1901_1.pep
MATAATASATAATRFTLLAGAGLRSRISRRPTAVRFQRQRGLTTTALLKTADLLPKAQGQPETLDYRVFLVDGGGRKVSPWHDVPLRAGDGVFHFVVEIPKESSAKMEVATDEAFTPIKQDTKKGNLRYYPYNINWNYGLLPQTWEDPTSANSDVEGAFGDNDPVDVVEIGERRANIGDVLKVKPLAALAMIDEGELDWKIVAISLDDPKASLVNDVDDVEKHFPGTLTAIRDWFRDYKIPDGKPANRFGLGNKPASKEYALKVIEETNESWEKLVKRNIPAGELSLA

SEQ ID NO: 44522 - protein, 299 aa, Sorghum bicolor
  Clone ID: SORBI-28MAY03-C19583_1.pep
MAASARHLFLAALSVAVLAVAAPRSADAWGGGRFFFSKTARPAEATVEPDKAASVPTHAAAADTDAAPAFSRPSTGGGSGRGYGLYGRPEENYPPDYFRRGVHRNAEKLTTTTTDVPATAGTVEAAGPVRGRGGDRERVRTTFPEDGSGRGRPPTDVPATTTRTEEAGGAGGDLDGVQPYPENGSGRGRPPWYYTGFHRQQEQEQRDYGMSDTRLYQNGRYYYDVEAGRYGYGRESNPMRTRPDVEEEEFGSGYGRPRGGSYHQQQQYGNGEEFGNAAMDRNTNGGFQEEAGQSGLYIP

SEQ ID NO: 44523 - protein, 85 aa, Sorghum bicolor
  unsure (1)..(85): unsure at all Xaa locations
  Clone ID: SORBI-28MAY03-C16377_1.pep
SKISLLTHSCLCCIVPFSRCLLDQVGRVYHGDWRPQRKCKVIWGMAQSMTKILFLSRNNLWITVVILLIKYNRLIKXCTTNFLNS

SEQ ID NO: 44524 - protein, 316 aa, Sorghum bicolor
  Clone ID: SORBI-28MAY03-C16379_1.pep
LHQTLETARRSTDEREKRSELQGLLCGCLQVIIQKLGGMESTKYSFLQYADQMMDLFLRVFACRNATVHEEAMLAIGALAYAAGPNFAKYMAQFYQYLEMGLQNFEEYQVCAITVGVVGDLCRALEDIILPFCDCIMTQLLKDLSSNQLHKSVKPPIFSCFGDIALALGENFEKYLIYAMPMLQSAADLSAHTTATDDEMLDYTNQLRNGILEAYSGILQGFKSSPKTQLLMPYAPHIIQFLDALYNGKDMDDTVMKTAIGVLGDLADTLGVHAGPLINQSTSSQAFLEECLASDDPLVKESADWARIAISRAVSG

SEQ ID NO: 44525 - protein, 299 aa, Sorghum bicolor
  Clone ID: SORBI-28MAY03-C15614_1.pep
MAAAVALTPASPARLPVPFRSHRDGRVRLSTRRPRYSAGRCRATAQTFQGGAAASYAREMERLSAKESLLLAFKDAGGFEALVSGKTSEMQRIDVNERIVGLERLNPTPRPTTSPFLEGRWNFEWFGDSSPGAFAARLLFERSPTAVAHFTGLDVLIKDGYSKLSSNLKFLNTIQSKFLLTTQLSIEGPIRMKEEYVEGLIEIPRINEESLPEQLKALLGQTAGALQQLPSPIRDAVSEGLKVPLGGAFQRLFMISYLDEEILIIRDAAGAPDVLTRLEGPQPNPGDGTADAVISEYES

SEQ ID NO: 44526 - protein, 159 aa, Sorghum bicolor
  Clone ID: SORBI-28MAY03-C17097_1.pep
MRPLPCQDPEAPQPHPCPLFLLPPFLRLLRGLPMPAIVGSVQLESARRRAGLEGAPWLAPEPRSRPNDQTLPLLLRAPAAAEAAAAAKMIIPVRCFTCGKVIGNKWDLYLDLLQADYSEGDALDALELFRYCCRRMLMTHVDLIEKLLNYNTLEKTETS

SEQ ID NO: 44527 - protein, 303 aa, Sorghum bicolor
  unsure (1)..(303): unsure at all Xaa locations
  Clone ID: SORBI-28MAY03-C1730_1.pep
HPMTQFTTGVMALQVESEFQKAYDNGLPKSKFWEPTYEDCLNLIARLPPVASYVYRRIFKGGKSIEADNSLDYAANFSHMLGFDDPKMLELMRLYVTIHTDHEGGNVSAHTGHLVGXALSDPYLSFAAALNGLAGPLHGLANQEVLLWIKSVIEETGSDVTTDQLKDYVWKTLKSGKVVPGFGHGVLRKTDPRYSCQREFALKHLPEDPLFQLVSKLYEVVPPILTELGKVKNPWPNVDAHSGVLLNHFGLSEARYYTVLFGVSRSMGIGSQLIWDRALGLPLERPKSVTMEWLENYCKNKAA

SEQ ID NO: 44528 - protein, 241 aa, Sorghum bicolor
  Clone ID: SORBI-28MAY03-C1705_1.pep
MSCTGAGQAGGGWLLDYGLVEEEIQGSEFMYMVDDPAVSSVILGFDAPRKDDGGVQDNSGAKKRSRPESSAPPGTKACREKLRRDRLNERFNELCAILEPGKPPKADKVAILSDAARLLNQLRTEAQKLKQSNESLQDSIKSLKAEKSELRDEKTRLKAERERLEQMLKGVSHAAVAAPAPFVPHPAAAAAAPSFHPAAAFAQAGKFVPYPSYPPPAAFWQWIPPTSLDTTKDPAHWPPVA

SEQ ID NO: 44529 - protein, 611 aa, Sorghum bicolor
  Clone ID: SORBI-28MAY03-C2319_1.pep
TRILLGLIGEGTGIAAKVLKSMGINLKDARVEVEKIIGRGSGFVAVEIPFTPRAKRVLELSLEEARQLGHNYIGSEHLLLGLLREGEGVAARVLESLGADPNNIRTQVIRMVGESTEAVGAGVGGGSSGQKMPTLEEYGTNLTKLAEEGKLDPVVGRRDPRGRVTQILGRRTKNNPCLIGEPGVGQTAIAEGLAQRIANGDVPETIEGKKVITLDMGLLVAGTKYRGEFEERLKKLMEEIKQNEDIILFIDEVHTLIGAGAAEGAIDAANILKPALARGELQCIGATTLDEYRKHIEKDPALERRFQPVKVPEPTVDETIQILRGLRERYELHHRLRYTDDALIAAAQLSYQYISDRFLPDKAIDLIDEAGSRVRLRHAQLPDEAKELDKELRQITKQKNEAVRSQDFEKAGELRDREMELKAQITAIIDKSKEMIKAETESGEVGPLVTEADIQHIVSSWTGIPVEKVSSDESDRLLKMEETLHTRIIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQI

SEQ ID NO: 44530 - protein, 295 aa, Sorghum bicolor
  Clone ID: SORBI-28MAY03-C2330_1.pep
ARGGTGRLEEQRDEPPLGGSQLRIARRAFQGDRGGGFTGGGSGSGSGASGGGDGNKMLDRGINTAIVLGASTYALTKLLTVDQDYWHGWTIFEILRYMPEHNWSAYEEALKANPVLAKMMISGVVYSLGDWIAQCYEGKPIFDFDRARMFRSGLVGFTLHGSLSHYYYHICEALFPFKDWWVVPAKVAFDQTIWSAIWNSIYFVVLGFLRLESPTTIYGELKSTFWPMLTAGWKLWPFAHLVTYGVVPVEQRLLWVDCVELVWVTILSTYSNEKSEARNSDSTSTPAASSKDNSR

SEQ ID NO: 44531 - protein, 339 aa, Sorghum bicolor
  Clone ID: SORBI-28MAY03-C2373_1.pep
MPSVEVGGAAGWRPKHLHQQYQQKHHHYTQQQQQQPPPHPHPHPPPQQQPLEIREVWADNVDREFKLIRAAIEHFPYVSMDTEFPGVIHHPPASVHHSTLTPSQRYALLIPNADALPLLLVRLGLVFAASPSSPPALAFQINLREFDPRVHRHAPDSVRLLASSGVDLAAHRARGVSARAFAALLMSSGLVCNPDVAWVTFCSAYDFAYLVKVLMGRKLPRALPEFLRYVRVYFGAAVYDVKHMARVAVDSYGEVALLGGLERVAGALRVRRAAGRGHQAASDSVLTWDTFREMARLYFPKECSLDVCAGVIYGLELRHGGGDTTTKPKPAKVRAALRC

SEQ ID NO: 44532 - protein, 270 aa, Sorghum bicolor
  unsure (1)..(270): unsure at all Xaa locations
  Clone ID: SORBI-28MAY03-C2655_1.pep
YXTDLLGTPSSETLSRIRNEKARRYLSCMRKKYPVPFTHKFRNADPLALRLLERLLAFDPKDRPTAEEALADPYFASLANVEREPSRHPISKLEFEFERRKLAKDDVRELIYREILEYHPQMLEEYMKGGEQISFLYPSGVDRFKRQFAHLEEHYSKGERGSPLQRKHASLPRERVVVSKDGNTEQHINDQERSADSVARTTVSPPRSEDADMNDVKSTSLSSRSYLKSASISASKCVVVKNKHPEDDEIPEEMEGVVDGLSEQVSRMHS

SEQ ID NO: 44533 - protein, 264 aa, Sorghum bicolor
  Clone ID: SORBI-28MAY03-C16944_1.pep
WPGPSARGQSRQTRTALSSPSSSPLSKAAKALGKAAHPSFGPDSTGKTPTSQIERGQTRHGDVGGLRLLLRRGAAGRARAARAGRLRALLQAAHPQQRHLHVQGRHPVLQRGLPLRADAPRRGLRAAGRQQQPAEAAAVAAEQGSLCGRQGGRVRGQLVDRQSTVRPRKKKKKEEVVLVHRAATAARDPAGGGAPGWPPAAGAAPRNEFCAGNRGKRGWIWRLKKAIMTASSAGLETQIDAMRALPLLGSVFPDGISWVVCARG

SEQ ID NO: 44534 - protein, 174 aa, Sorghum bicolor
  unsure (1)..(174): unsure at all Xaa locations
  Clone ID: SORBI-28MAY03-C17387_1.pep
MEAYFLFHSGRASACAEQEEDIGAPSDSESPSTSMSRESAGSSSSSELDDDATSTSSGSDPDRFEMSALMTQLPLKRGLSRFFDGKSQSFASLAAVGSLEDLPKPAARKRIKPSRSCGGALDAHNRXPLPLAAQALHQAQARRRQEAGGREERRAVGFRGRRRRAQDAAVGDEA

SEQ ID NO: 44535 - protein, 343 aa, Sorghum bicolor
  Clone ID: SORBI-28MAY03-C1786_1.pep
TRQGLNITDASLAVIGYYGKAIKDLTLARLPAVGERGFWVMANALGLQKLRCMTVISCPGLTDLALASVAKFSPSLKLVNLKKCSKVSDGCLKDFAESSKVLENLQIEECSKVTLMGILAFLPNCSPKFKALSLSKCIGIKDICSAPAQLPVCKSLRSLTIKDCPGFTDASLAVVGMICPQLENVNLSGLGAVTDNGFLPLLKSSESGLVNVDLNGCENLTDAAVSALVKAHGASLAHLSLEGCSKITDASLFAISESCSQLAELDLSNCMVSDYGVAVLAAAKQLKLRILSLSGCMKVTQKSVPFLGSMSSSLEGLNLQFNFIGNRNIASLEKQLWRCDILA

SEQ ID NO: 44536 - protein, 150 aa, Sorghum bicolor
  Clone ID: SORBI-28MAY03-C1727_1.pep
EPHTDTSVYNSHRTRGSMICNARNISWQLACTPTRTMMRIHPSMHRSAAALEDLAAAAGVSVDRLHRAFGLGALILVVAVAQRLAAEHLVIRQVLPLIGAGDLLRHRRQQQQAQHRRRRHGQPRRVVRRRHAGGLASLLSSPLAVERKYI

SEQ ID NO: 44537 - protein, 122 aa, Sorghum bicolor
  Clone ID: SORBI-28MAY03-C18067_1.pep
MAAKLAQLRAQAARAAEFASKHGGAYYKEVMEKNKQYVVQPPTVEKCQELSKQLFYTRLASLPGRYEAFWKELDSVKQVWKNRKDLKVEDLGIATLFGVELYAWFCVGEIVGRGFTLTGYKV

SEQ ID NO: 44538 - protein, 168 aa, Sorghum bicolor
  Clone ID: SORBI-28MAY03-C17574_1.pep
TPAHRRTHARPTAAAQLPHADPLNLLLSALAAVAAGGRRPGCPSTPPDARQAAAVQLRHADPPPRRPHPPPAGEAGRLRLGCGDSGGRIWLGLRRISGYFGVVAFQISRSLILAATTISPRAPGTSTPASPPLASRSHAAGKALGARVGGSRPPAVAAPIAAVGGGFA

SEQ ID NO: 44539 - protein, 266 aa, Sorghum bicolor
  Clone ID: SORBI-28MAY03-C1797_1.pep
MGSLANKIVAMAAVLAALVTGGSCAPKKFPPGPNITTNYNGQWLSARATWYGQPNGAGPDDNGGACGIKNVNLPPYNGFTACGNVPIFKDGKGCGSCYEVRCKEMPECSGNPITVFITDMNYEPIAPYHFDFSGKAFGSLAKPGLNDKLRHCGIMNVEFRRVRCKLGGKIMFHVEKGSNPNYLAVLVKNVADDGNIVLMELEDKASPGFKPMKQSWGAVWRFDTPKPVKGPFSIRLTSEFGKKLVAPNVIPATWKPDTLYNSNIQF

SEQ ID NO: 44540 - protein, 205 aa, Sorghum bicolor
  Clone ID: SORBI-28MAY03-C18110_1.pep
DIAMWVSGRFKGPATIKVSFASFALQKVGRHIGDWEHFTLRVSNFSGELSSIYFSQHSGGEWVEACDLEFISGNKAIVYSSRNGHASYPHPGCYLMGSEKLGVGVRNDVARSDLSVDSSTQYKIISAGHLGDAVVEPCWLQYMREWGPAVTYSSRSEIDTALSFLPFFLRYTVEAIFNSLPAELYEEEGPTGPKEKNNWEGDERC

SEQ ID NO: 44541 - protein, 134 aa, Sorghum bicolor
  Clone ID: SORBI-28MAY03-C25314_1.pep
KGRNIDVFAENSSLAINPHYIRSWLDLLSRTPRVAPFLQKNDPFISALKKELSEHTTDVHIQSDALDGMFTFYDATKATLNVYQVASVTFDLLFLLVLGSYLIVLFCFLVITTRGVDDLINIFRRPPSRKLKGA

SEQ ID NO: 44542 - protein, 313 aa, Sorghum bicolor
  Clone ID: SORBI-28MAY03-C25828_1.pep
MSQPAATVAAAAQPQGRGPAGRQGGGGGLGQNIAGIVRMAVFWYFAAKFFGPKRPPADPGMLMSNLFQKGEPMDMWMYLSENEKFNDFANEDALIWHESNIPYAVWGPTSTRTRSLTYYPSETLKHNGSLYAHVYFARSGYPVDPTDPEYEQKSAFGRTHPVVAFLPKSKAGKKKSLLGDSEELEEQAPPKENKEFEDKDEGPTEYISYWKPNVTINLVEDFTRYPNNNVPPNVAPYLNVDPATGDYYPTVFFNEFWLLRDKLIALNETVEELPLNLEVGPISMTKWQLFLQIEQSFQVHRSYGSMLEGEADE

SEQ ID NO: 44543 - protein, 179 aa, Sorghum bicolor
  Clone ID: SORBI-28MAY03-C25854_1.pep
TMIAMSMLTKEVLRRNPDFNPGKPTEYRNYLVISVGTGSAKLAEKYTAPQCAKWGLIQWLYEGGFTPIIDIFSHASADMVDIHAAVLFEALHCEKNYLRIQDDSLTGHASSVDIATKENMEALIGIGKKLLKKPVARVNIDTGMYEPVAGEGTNEDALARFAKMLSDERRLRQANLNSY

SEQ ID NO: 44544 - protein, 251 aa, Sorghum bicolor
  Clone ID: SORBI-28MAY03-C1998_1.pep
GAGKGQALAYSLKKLSSCGKPPNNTLVCGDSGNDAELFSIPGVRPVMVSNAQEELLQWYTENAKDNPKIIHANERCAAGIIQAIGHFKLGPNISPRDMEFPYAKEASFKPTDAVVKFYVLYEKWRRAEVPKSDSVIKYFKDITHANGVIIHPAGLELSLHASIDALGSCYGDKQGKKYRAWVDRLFITQTGSDSWVVRFDLWESEGDVRVCSLSSLALVLKAESPEGFVLTHIQKTWLNGYSSGVEQASKL

SEQ ID NO: 44545 - protein, 103 aa, Sorghum bicolor
  Clone ID: SORBI-28MAY03-C20529_1.pep
AGRGTFEACVGIFWPSIMKMRSQYIPEEARSTIMNFFRIPLNLFVCVVLYNVNAFPITVMFGMCSIFLFMAAILQRRLMVVSDLHKSSTKAQEMIEEDEPLNP

SEQ ID NO: 44546 - protein, 254 aa, Sorghum bicolor
  unsure (1)..(254): unsure at all Xaa locations
  Clone ID: SORBI-28MAY03-C2052_1.pep
ARGSRGNRPDVDAGIFVSWLDARPPSSVLYISFGSLAHLPAKQVVELGRGLEASERPFVWAIKEASSNADVQAWLAEGFEDRVKDRGLLVRGWAPQVTILSHPAVGGFLTRGAPRAAPAPTARRGPLRPSPPFSDPASGGPPRAAAPAVGVRSSVRPPAFLXAPGGVQVTSADVEKAVAELMDVGPDGTARRARAKELAAKAKAAMEEGGSSYADLDDMLRHVAELSMKKSHVEDTSVSTLPSAPELGSKSLRT

SEQ ID NO: 44547 - protein, 241 aa, Sorghum bicolor
  unsure (1)..(241): unsure at all Xaa locations
  Clone ID: SORBI-28MAY03-C2067_1.pep
MNSSKQALIYSFVAKGSVVLAEHTAFSGNFSTVAVQCLQKLPXNSTRSTYSCDGHTFNFLVDRGFVFLVVADEAAGRSVPFVFLERVREDFMQRYGSSIDEEGQHPLADDADEDDFLFEDRFSIAYNLDREFGPRLKDHMQYCVNHPEEINKLSKVKAHLSDVKGIMMDNIEKILDRGEKIELLVGKTETLQSQADSFHRHGRELRRKMWLQNLRFKLMVGGGILALILILWLMVCRGFKC

SEQ ID NO: 44548 - protein, 237 aa, Sorghum bicolor
  Clone ID: SORBI-28MAY03-C20877_1.pep
MQRVVPQPAAKVTHPVHPPLSVKAPVGRSDLPPKFSGSVASSPAGVMGRFDPPPVKMVSQGVQRPASMVSQKVDPQLAKVLQKETRSAVCLPDAPQPPVLQKPKDLTVLKQQDLITSLPKEEPCFSGRSAETVQVQDTKLSRSDRKKIRKAEKKEKKFRDLFVTWNPISLENEGSDLGDQDWLLSSTRNSDASMAQCKSTGGVGPIHPMVQQQPSLQPRATFLPDLHMYQLPYVVPF

SEQ ID NO: 44549 - protein, 624 aa, Sorghum bicolor
  unsure (1)..(624): unsure at all Xaa locations
  Clone ID: SORBI-28MAY03-C2181_1.pep
FKATAMELISVLEQKQKTVGRTKVLLDTVPVYRLADIFVASFEISFEEQLSMLDSVDLKVRLSSATELVDRHLQSILVAEKITQKVEGQLSKSQKEFLLRQQMRAIKEELGDNDDDEDDVAALERKMQNAGMPANIWKHAQREMRRLRKMQPQQPGYSSSRAYLELVADLPWQKVSEERELDLRAAKESLDQDHYGLTKVKQRIIEYLAVRKLKPDARGPVLCFVGPPGVGKTSLASSIAKALNRKFIRISLGGVKDEADIRGHRRTYIGSMPGRLIDGLKRVSVSNPVMLLDEIDKTGSDVRGDPASALLEVLDPEQNKAFNDHYLNVPFDLSKVIFVATANRMQPIPPPLLDRMEVIELPGYTPEEKLKIAMKHLIPRVLEQHGLSMTNLQIPEAMVKLIIERYTREAGVRNLERRPAALARAAAVKVAEQXKTLRLGKEIQPITTTLLDSRLADGGEVEMEVIPMEHDISNTYENPSPMIVDEAMLEKVLGPPRFDDREAADRVASPGVSVGLVWTSVGGEVQFVEATAMVGKGDLHLTGQLGDVIKESAQLALTWVRARAADLNLSPTSDINLLESRDIHIHFPAGAVPKDGPSAGVTLVTALVSLFSNRKVRADTAMTG

SEQ ID NO: 44550 - protein, 323 aa, Sorghum bicolor
  Clone ID: SORBI-28MAY03-C2266_1.pep
VQSSPHLGEVLPGRSVAALLLLSPGAARQSLHHFRLGALLALPRPLAARGITIYCSTQIPEVTQNVVAKCLGIPFHNVRLITRRVGGGFGGKAMKAIHVACACAVAAFKLQRPVRMYLDRKTDMIMAGGRHPMKVKYSVGFKSDGKITALHIDLGINAGISPDVSPMMPLAIIGSLKKYNWGNLAFDTKVCKTNVSSKSAMRGPGDVQGSFIAEAIIEHVASALSVDTNTIRRKNLHDFESLVVFYGDTAGEASTYSLVTMFDKLASSPEYQRRAEMVEHFNRSNKWKKRGISCVPITYEVRLRPTPGKVSIMNDGSIAVEVG

SEQ ID NO: 44551 - protein, 103 aa, Sorghum bicolor
  Clone ID: SORBI-28MAY03-C29215_1.pep
PTSRHISRDNKRFAIITISLLTVIYLAAILIPSIWDAFQFTGATAAVLIGFIFPAMVILRDSYGIATKRDKILAVTMIVLAVLSNSVALYSDAMNIFRKKEVA

SEQ ID NO: 44552 - protein, 189 aa, Sorghum bicolor
  Clone ID: SORBI-28MAY03-C29227_1.pep
MWGPGARGGWRFWRRLPATCIHGVRTQPEREYALRSFKSGATPILVATDVAARGLDIPHVAHVINFDLPNDIDDYVHRIGRTGRAGKSGLATAFFNEGNLSLARPLCDLMHEANQEVPTWLENYAARSSYGGGGGRNRRSGGARFGGRDFRRDRDFRGGGGGGGYSGGGYGGGGGYGGSYGGGATSSWD

SEQ ID NO: 44553 - protein, 273 aa, Sorghum bicolor
  Clone ID: SORBI-28MAY03-C30452_1.pep
MASQGNREAVPKGGLLDKLKTGPLFWIDTADKQPCIGTGGMIPWHLMATGKLFHSGLAHKAINAMEMNVEALKVIQKRFYTDFPPHEKEKLYKFATPSTMKPTKWSYPGGGLNQIPGACTISGDVRLTPFYSTSHVIEKLKEYVEDINQRFETILDTRGPVSKYILPDENLQGRLEITFDGDVMNGVACNLESRGYHALCKATKEIVGQVEPYSITGSLPLIRELQDEGFDVQTAGYGLLKTYHAKNEYCLFSDMAQGFEVFLSIISQLEEEV

SEQ ID NO: 44554 - protein, 115 aa, Sorghum bicolor
  Clone ID: SORBI-28MAY03-C34856_1.pep
RLSELRPRRRRRARPPARPPAFPPPWEEEQEEEQVLTNLVQFSPSGRPSYYYHHDDDDDDDATCAPFVRLSCGIYSSGFFIFINSSSVQIRIRNRQEATGRLRHLLLSPRRVQVD

SEQ ID NO: 44555 - protein, 281 aa, Sorghum bicolor
  Clone ID: SORBI-28MAY03-C21806_1.pep
SRLLPLRRFFLVLAVPGPSLTGVFDSSFRSLVSGFHIFVSSPVSRLVLFGTEAYFLRLCTVLVRYFSAVAFALCLQVTCHQTKTNMLQPGFIIVRNYLIGLRPWNPEHGSTAVSLQTVLTSSPLNIHLATNIPSSDPHQHLSTHITGLPPHLCCNSLIHKLFHKICIIHSVNFISATTEYEVSARGRLTMIPQIAHLGIRNLSGQSEVINIWQLSYQTFTDEMLGRQTPPGDRRSDLRGYSDIDTEQRLELVDSDGNNEATSRLQVASDTSSMDTYNSNEE

SEQ ID NO: 44556 - protein, 127 aa, Sorghum bicolor
  Clone ID: LIB5048-008-R1-XP1-H12.pep
LGFDLLLWLHFHSSILLSDVSIVEVSEATWSREVASLFPLLSTSSSRCSVSMSEYPGYVFYLDVYLELLLDCLREVIVVECVRDSIRDCCEDCVAGHSGIDVSELCIIDDSEVLEPVLRHLDVLKLV

SEQ ID NO: 44557 - protein, 174 aa, Sorghum bicolor
  Clone ID: LIB5121-008-A1-PF1-E12.pep
SAAELTRRFLAARARRASAGWLLRWSPLWALLPRLRLFFPVLAVLGLWKPGCLDSALRSLVFGFHILVSSPVYRLVLFGTEAYFLRLCTVLFRNLSGQSEVINIWQLSYQTFTDEMLGRQTPPGDRRSDLRGYSDIDTEQRLELVDSDGNNEATSRLQVASDTSSMDTYNSNEE

SEQ ID NO: 44558 - protein, 379 aa, Sorghum bicolor
  Clone ID: SORBI-28MAY03-C24576_1.pep
MAKLGPGQGLGCEAAEGSLVPSRKREYKPCGKHTEGKRPLYAIGFNFMDARYYDVFATVGGNRLTTYRCLENGSFALLQAYIDEDKDESFYTLSWARDHVDGSPLLVAAGSNGIIRVINCATEKLAKSFVGHGDSINEIRTQPLKPSLIISASKDESVRLWNVHTGICILIFAGAGGHRNEVLSVDFHPSDIERFASCGMDNTVKIWSMKEFWLYVDKSYSWTDLPSKFPTKYVQFPVLIAAVHSNYVDCTRWLGDFILSKSVDNEIVLWEPKTKEQSPGEGSIDILQKYPVPECDIWFIKFSCDFHFNQLAIGNREGKIYVWEVQSSPPVLIARLYNQQCKSPIRQTAVSFDGSTILGAGEDGTIWRWDEVDHPSTKN

SEQ ID NO: 44559 - protein, 206 aa, Sorghum bicolor
  Clone ID: SORBI-28MAY03-C24713_1.pep
TRLMQQVSKALYAEFLGAQKKKRPFKGLGLEHLNGSTPVIPDKLTSNILRSSKFQMDLFCLRERDLLKQFAEEVSLHLAQGESREKALMLSYQLAEDLARAFTERTILQIFLEDERNVPSGSLKEVLGLLRSLYVMVNIDESTSFLRYGYLSRDNVALVRKEVLKMCSELRPHALAVVSSFGIPDAFLSPLAFDWIEANTLSTGSH

SEQ ID NO: 44560 - protein, 237 aa, Sorghum bicolor
  Clone ID: SORBI-28MAY03-C24783_1.pep
MPVNPPPPPPPGSSSSAPAGPSYFPLPFHLQQHQPPPQMPPPMAANSYQQYQQQLHQAHQLFQRDAQTITPEALQSVKAAIATSDVLDPAAAANARPSDPSTSKKPIPRRAAGQSWEDPTLTDWPENDYRLFCGDLGNEVNDDVLSKAFSRFPSFNMARVVRDKRTGKTKGYGFVSFSNPTDLAAAIKEMNGKYVGNRPIKLRKSNWKERTDVEALERQKNHVHRKPKILKKSILHK

SEQ ID NO: 44561 - protein, 299 aa, Sorghum bicolor
  Clone ID: SORBI-28MAY03-C25111_1.pep
MPEDVQMNDSEPQPAAPVPVAAAAAAAAPALSTLHHLKEIATVIEAGSLSKEVRRISRAFRLTVALRRRLAARDVSAFLAFALPASSEAYGRLTALVPKEDDTEMDVDAAAPATQISIKHGLPEIEIFCYLLVLIFLIDQKKYDEAKACANVSIARLKNLNRRTVDVLASRLYFYYSYVYELTNSLAEIRGTLLALHRMATLHRDELGQETLLNLLLRNYLHYNLYDQAEKLRSKAPRFEAHSNQQFCRYLFYLGKIRTIQLEYTDAKESLLQAARKAPTTARGFRIQCNKWAIIVRLL

SEQ ID NO: 44562 - protein, 188 aa, Sorghum bicolor
  unsure (1)..(188): unsure at all Xaa locations
  Clone ID: SORBI-28MAY03-C2208_1.pep
RGGGGRSVPHAVRSHGALRRPPLVVAWGRDAPRLRLGRPRHLRVRLPPRAPPPLAPLRRXSGGGRRRRRDRAVVQSSHVQPRICTAHHLQQEPRLVQGQGIQQVAVHQVRAAAREAGRRRRTRRLAGPRGHGRLRPPPLLLSFFLTACKSKSIPSSALLLDLLQILPTIGSQAICNFTYGQQHVMNIL

SEQ ID NO: 44563 - protein, 218 aa, Sorghum bicolor
  Clone ID: SORBI-28MAY03-C2529_1.pep
RREAKRSEAKTPIPLPPRRLRCRRRTKAGSRSPNPSKQAAAEMVYYALLVGAELDGLTNLQPRRGCDDPNFPYYLKLKCENCGEVTAKSTYVTLSEQVDLPKGHGTAHLVQKCKLCGRDGTIVMIPGQGTPLTIEQSQKEEKTCLMVFDCRGYEPVEFSFGAGWKAESVHGTPFEIDCSEGEFSEYDEKGECPVELSKLQSTFKVVKKHDKGGKTRFV

SEQ ID NO: 44564 - protein, 333 aa, Sorghum bicolor
  Clone ID: SORBI-28MAY03-C33261_1.pep
ARGNSKPVALPDSTVPSLSTDKPVIVLDASVPTYLSSSQPPSANDASPVNVAEQVPLVTPARLLATTSSTIVSSHALQTSAVVPSSKAVPSSVPSSQATLSVASPTQVASSSVLSQQVEVTSESKPAKQREWKAKQPVVATPGNKKALLPAPKPVLQKPVGVSSYVQYNNRGRGRGRGHGRGNGQSHPITKFTEDFDFMAMNEKFNKDEVWGHLGKSIGQLNDEPNGYGDVLEDDEISPRKPEAMAVYVKDDFFDSLSCNTIDNGGRNGRVKFSEQRKIDTETFGDSARHRPTGIRGRAPRGGGGGPRGRGYYGRGYGYMGRGRGYSYPNHQS

SEQ ID NO: 44565 - protein, 349 aa, Sorghum bicolor
  Clone ID: SORBI-28MAY03-C3353_1.pep
MAPPAAPTALHHRTPLLLPRRATAAPGATATATARAARAASLAVVRAQPDTTAATSAPEPPTPEFKPPPGFKVPEPKRFEVKPGQQNSVLGASLAIPLRLGTGVFVLGYSPSLVSPSEIPSDQYALEFGAWKVKEESKIGQCKRPEKPIEIYEFEGCPFCRKVREMVSVLDLDVLFYPCPQKGPTFRPKVLEMGGKKQFPYMVDPNTGVAMYESDDIIKYLADTYGDGTVPIMLSLGLLTTITAGLATLGRFGKGNSYTASKVPPQPIEIWAYEGSPFCRLVRETLVELELPHLLHSCARGSPKRQEFLKKKGVFQAPYIEDPNTGVQMFESAEIIDYLKATYALYPSS

SEQ ID NO: 44566 - protein, 286 aa, Sorghum bicolor
  Clone ID: SORBI-28MAY03-C34142_1.pep
NGFAVPEAFLDCAAAPPCTPNPNGLGALIAVGLARTLVRVARPGRHVLVIATEVLSSMLYTGAKREMVVPNVLFRMGAAARIMTNSRACACRGGGPSGPPLAASWAGAGRWARPVGAGAGHRGLHRSADLPVVAASALKGHITAFGRAVVPVSELLRVAFSIVRNRLFSAGTTKEYRPAFGEVFQHFCIHPGGRRVLYEVQRGLGLSDRDMEASHMTLHRFGNMASSSLLYELGYVECKRWEEEGESLRRTSYMQVTGCRIVQWACLRPMAGNGEGDPTRALELKL

SEQ ID NO: 44567 - protein, 232 aa, Sorghum bicolor
  unsure (1)..(232): unsure at all Xaa locations
  Clone ID: SORBI-28MAY03-C27096_1.pep
MSMHYLAALSVTLLGAILLRWAFKWMNYGRTGGEEGMLLPPGSRGLPFLGETLEFFAASPTLELVPFFKRRLERFGPIFRTNIVGEDMIVSLDPELNARVLQQEERGFQIWYPSSFMRILGADNMVSMLGPLHRHIRNLVLRLFGPEALRLVLLRDVQRSARDELRSWLDRPEVEVRTATSRMIFGVTAKKLISHDDVASGGSLWKCFDAWTKGLMSFPICVPGTAFYRCMX

SEQ ID NO: 44568 - protein, 314 aa, Sorghum bicolor
  Clone ID: SORBI-28MAY03-C26894_1.pep
MATSSKPAAPVDPKFVLAHKFPEVSFDYDERDVALYALGVGACGDDAVDEKELHFVYHRDGQPNIKVLPTFVSLFPNKNSNGLGFVDVPGLNFDASLLLHGQQYIEIYRPIPSYASVVNRVKVAGLHDKGKATVLELETTTSLKESGEILCMNRSTIYLRGAGGFSDSSRPYSYATYPANQVSRISIPNSAPSAVYDDQAKQSQALLYRLSGDYNPLHSDPDIAQLAGFTRPILHGLCTLGFAARAVIKSFCNGEPTAVKSIFGRFLLHVYPGETLSTEMWLDGQKVHYQTKVKERNRAVLSGYVLLQHIPSSL

SEQ ID NO: 44569 - protein, 184 aa, Sorghum bicolor
  Clone ID: SORBI-28MAY03-C27202_1.pep
TREQTGKDDIDVGSIRMTLFNIFGDDASPKIKKFMKVMLGKFHQGESGEHGSGGGVLGMVGALAQEFLKAKLEGNEEEAFKPALDQEVHSVDEVYAGTKAWAPNNGILISGCQTNQTSADATTPQGVSFGALSNAIQTILEGKHGKVTNKDLVMKARELLSKQGYTQQPGLYCSDEHVHVAFIC

SEQ ID NO: 44570 - protein, 381 aa, Sorghum bicolor
  Clone ID: SORBI-28MAY03-C27774_1.pep
MAMMLLARNLRSGLRPPLAAAFSSAPAASASAAAAEAERAIRDGPRNDWSRPEIQAVYDSPLLDLLFHGAQVHRNTHKFREVQQCTLLSIKTGGCSEDCSYCPQSSRYDTGLKAQKLMNKDAVLEAAKKAKEAGSTRFCMGAAWRETIGRKTNFNQILEYVKEIRGMGMEVCCTLGMIEKQQAEELKKAGLTAYNHNLDTSREYYPNIITTRSYDDRLQTLQHVREAGISICSGGIIGLGEAEEDRVGLLHTLATLPTHPESVPINALVAVKGTPLENQKPLEIWEMIRMIATARIVMPKAMVRLSAGRVRFSMPEQALCFLAGANSIFAGEKLLTTANNDFDADQAMFKILGLIPKAPSFGEEEVAAHADTERSEQAASM

SEQ ID NO: 44571 - protein, 283 aa, Sorghum bicolor
  Clone ID: SORBI-28MAY03-C27804_1.pep
MEAEYARGAGPSSSSTTLWPCATRRRKRDEGEGDDDLSSEEDMDLDADAQRAADKLKAVSEELGHEIRVFSSENFALQPSKLPSADHEEDDDFYELQPADYYKLISNRIGEHSKMLKTRKMREAELAAQRAKRTKAVMRVRFPDGYILEADFLPSERIHSLVDLLMKVLARPDLPFYLYTVPPKKRIMDTSQDFCTAGFVPGANVHFSYDLPEGSLVNADDLKAGPFLREEIRSLDGLSLLLKPASQPDDSRMNSSTLQSGASQSDPVPTTNKKPGRPKWLKR

SEQ ID NO: 44572 - protein, 244 aa, Sorghum bicolor
  unsure (1)..(244): unsure at all Xaa locations
  Clone ID: SORBI-28MAY03-C28539_1.pep
MDGGGGGGGGGGGGVGAGVMVGGGVGPGGGVGVGGGGDVELVSKTLQFEHKLFYFDLKENPRGRYLKISEKTSATRSTIIVPVDGVAWFLXDLFDYYIRTDERDAFSKELPHQQHMEPPERLPGLSDDVGAGFIAGHGSQSASGPEVDVDRLVDLPPQEEISGMGMSKVIRADQKRFFFDLGSNNRGHYLRISEVAGPDRSSIILPLSGLKQFHEMVGHFVDIMKDRLEGMTGANVRTVEPSQR

SEQ ID NO: 44573 - protein, 210 aa, Sorghum bicolor
  Clone ID: SORBI-28MAY03-C28487_1.pep
MSYAYLFKYIIIGDTGVGKSCLLLQFTDKRFQPVHDLTIGVEFGARMITIDNKPIKLQIWDTAGQESFRSITRSYYRGAAGALLVYDITRRETFNHLASWLEDARQHANANMTVMLIGNKCDLSHRRAVSYEEGEQFAKEHGLVFMEASAKTAQNVEEAFIKTAGTIYKKIQDGIFDVSNESNGIKVGYVVPNSSGGGAGSSSQAGGCCS

SEQ ID NO: 44574 - protein, 165 aa, Sorghum bicolor
  Clone ID: SORBI-28MAY03-C37265_1.pep
KERVLVLAATNRPFDLDEAVVRRLPRRLMVNLPDAPNRKKILSVILAKEDLADDVDLEALANLTDGYSGSDLKNLCITAAHCPIREILEREKKERTLAEAENRPAPPQCCSGDVRSLKFSDFKHAHEQVCASISSDSNNMNELVQWNDLYGEGGSRQKTSLSYFM

SEQ ID NO: 44575 - protein, 174 aa, Sorghum bicolor
  Clone ID: SORBI-28MAY03-C3389_2.pep
MASPAASSVLSLLLLAAFVGTARAATFTITNNCGSTVWPAATPVGGGTQLDPGQTWTINVPAGTSSGRVWGRTGCSFNGGSGSCQTGDCGGALSCTLSGQPPMTLAEFTIGGSQDFYDISVIDGYNLATRFSCSTGVTLNCGGSSCPDAYLFPSDNTKTHACNGNSNYQVTFCP

SEQ ID NO: 44576 - protein, 173 aa, Sorghum bicolor
  Clone ID: SORBI-28MAY03-C3389_1.pep
MAASSSSILLLLLAATLMAGGTHAATFTITNNCGFTVWPAATPVGGGTQLNSGGTWTINVPAGTSSGRVWGRTGCSFNGNSGSCQTGDCGGALACTLSGKPPLTLAEFTIGGSQDFYDISVIDGFNIGMAFSCSTGVGLVCRDSSCPDAYHQPNDVKTHACNGNSNYQVTFCP

SEQ ID NO: 44577 - protein, 361 aa, Sorghum bicolor
  Clone ID: SORBI-28MAY03-C37364_1.pep
RGGMGGIPAHRIAAAAAAGPCLRHPAGLTSAVDVAAALPPGSASVCIKITALCPIALLEKTSDLLRWQKKHPSFNLPWKTHSFPILSDSSPLHLTPSEPPALTSEEETELQLAHERLLAVCARCAEHGIPLLVDAEYATVQPAIDYFTFVGALAFNDGAGAGDCEQRPIVHGTIQAYLRDARDRLEAMVRSAERERVRLGLKVVRGAYLARETRLAATLGVPSPIHGSIQETHDCYNGCAGFLLDRVRRGTASVMLATHNVESGKLAAARAQELGIPRGDRNLQFAQLMGMADGLSLSLRNAGFQVSKYLPYGPVEQIIPYLIRRAEENRGLLSASSFDRHLLRKELVRRVKTAVVGMGRE

SEQ ID NO: 44578 - protein, 313 aa, Sorghum bicolor
  Clone ID: SORBI-28MAY03-C3792_1.pep
MIAAHNAYVSFLHWHGIAVDRADTKYLITLFPFAGLSITIMKSDESVLKRLDAPTKAPAWPVGSEGKRPPAKFPVPLPPSPSMKDDEILAPSQELSKQRCILEAAIEASATAIINVKDSLNEWDSKVGDGDCGTTMYRGATAILEDMKKRYPMDDAAGTINEIGATIRRVMGGTSGILYDILCKAAYASLKQSSTVTANEWADALEASVAAVSKYGGASAGYRTMLDALIPASAVLKQRLEAGDDPVTAFVASSEAASAGAESTKQMQAKAGRSSYIAPDLLASIPDPGAMAAAAWYRAAALAVKNKLHGSKS

SEQ ID NO: 44579 - protein, 190 aa, Sorghum bicolor
  Clone ID: SORBI-28MAY03-C30468_1.pep
MDLLKRELEKKRKAATADFGGKSFVRRSELEQKQLQKRRDEHRQLLAKASASAPSPDSAAAATGSDTSNPDAAAQAAAANPNPSSSSSASSAPSVPPALAPKKTTQEEALLSEERRIDELDLPRHEVVRRLRVLREPVTLFGEDDDARLARFKLVLKSGVIDDIDDIDMTEGQTNDFLRDMIEMRKRQKA

SEQ ID NO: 44580 - protein, 596 aa, Sorghum bicolor
  Clone ID: SORBI-28MAY03-C30893_1.pep
TRSEVHPFDFPEENLQDTGPVGRNFKDVDIRRPSSDHESTDDYYGNFNSSHDTFAHGSSSTAWDKQNDKAQGNSSPVVFDQYDSAGEEENLLDTFSSKHTEQLPDPRDHMGFSTADWSEQHRSESPSNQKTSALFSRRETQLSDNLGTNRSDIPSPHSYDNLHPAFDSDGGNSDEEIATTMHAVSLRSHSGRSHPGGSVSSGLNKGGGPDGSLYDYSGAQAVRNLNRVQSRDSDLSEEETDLDKFKGSSSAGAREQQSLPFAISTSAASDDKEGDIGLNFGRLTPGLRNKTRQPPPYTKVSRESILPKQSLPTVSSSTEESVDSEENTSFKQNISSPKSSFSARTNSGKNHDSELYERNQNAGTHWEARSTIARNSFGLADTEKLSELPSNISLPTTKSSERANSSQVLYHEKPGIGARRGLRSTMARNYFDTDDSEEELEQQQTPQSKRSGVLIQSRRTREVTSDTKRESRIQIGAQYDDETESMPSKTQVHQGFNSSSTEQRTEMRDASVYPRVAVQRSSPKAQQIESPVARRKPQEAEMRRNFVGGNEGDAETSAGTPKESTPKTPPAHVHPKLPTDYDSFAAHFRSLRTNRP

SEQ ID NO: 44581 - protein, 128 aa, Sorghum bicolor
  Clone ID: SORBI-28MAY03-C31392_1.pep
AALPIVAFWSPAFVTALLLRVSRKSSLNKMDSRCLAVEFAPLIMWRQGDAGTDLRNHLKFTLKPPPKIVDTTSNTATWDLLDEDDEDASSQIPLDDASPPDYSSIEVIQCLIEHHNAIFTDANETVWR

SEQ ID NO: 44582 - protein, 285 aa, Sorghum bicolor
  unsure (1)..(285): unsure at all Xaa locations
  Clone ID: SORBI-28MAY03-C31164_1.pep
KSSFAYQNGGRVRHYIEPTFHHVSRMVSNSLAMAKKLPGASPSPSSAPTTTETAAVARQPFMGYGQMVKGFPRWVRPGDRRLLQAPATAITADAVVAKDGSGGYTTVSAAVAAAPXNSKKRYVIYIKAGAYMENVEVGKKHVNLMFVGDGIGKTVIKASRNVVDGYTTFRSATVAVVGNNFLARDLTIENSAGPSKHQAVALRVGADLSAFYRCSFVGYQDTLYVHSLRQFFRDCDIYGNKLNWQSGSNSFISSEPKRHRSSRVAVVDSFVSGDHANYIIIYEIV

SEQ ID NO: 44583 - protein, 131 aa, Sorghum bicolor
  Clone ID: SORBI-28MAY03-C32724_1.pep
FLNSLYNCQYKSFFVAFSGLTEQIKLDRYLQPHFRYYMREVRTVVYSQFLESYKSVTMEAMATAFGVSVDFIDQELSRFIAAGKLHCKIDKVAGVLETNRPDERNAFYQATIKQGDFLLNRIQKLSRVIDL

SEQ ID NO: 44584 - protein, 277 aa, Sorghum bicolor
  Clone ID: SORBI-28MAY03-C32949_1.pep
MDGGAGEEGKQERHLVLAHKLFLLSHPAVDDLSKVALRAEVLDTVKSDDMATLFESLVTAGVLEADAALLAEMRGRIDEEIRKLDEKIADAEENLGESEVREAHLAKSLYFIRVGEKEKALEQLKVTEGKTVAVGQKMDLVFHTLQIGFFYMDFDLISKSIEKAKNLFEEGGDWERKNRLKVYEGLYCMATRNFKKAASLFLDSISTFTTYELFPYDTFIFYTVLTSIITLDRVSLKQKVVDAPEILAVIGKVPHLSEFLNSLYNCQYKSFFVAFSG

SEQ ID NO: 44585 - protein, 243 aa, Sorghum bicolor
  Clone ID: SORBI-28MAY03-C33152_1.pep
MAITATTPDILGERQSGQDVRTQNVMACGAVANIVKSSLGPVGLDKMLVDDIGDVTITNDGATILKMLEVEHPAAKVLVELAELQDREVGDGTTSVVIIAAELLKRGNDLVKNKIHPTSIISGYRLAMREACKYVEEKLAVKVDKLGKDSLINSAKTSMSSKLINSDSDFFATLVVEAVQAVKTTNAKGEVKYPIKSINILKAHGKSAKDSYLLNGYALNTGRAAQGMPTRVTPARIACLDFN

SEQ ID NO: 44586 - protein, 166 aa, Sorghum bicolor
  Clone ID: SORBI-28MAY03-C43468_1.pep
MAGVGRNMVAPLMVLNLIMYIIVIGFASWNLNHFINGQTNYPGVAGNGATFYFLVFAILAGVVGAASKLAGVHHVRAWRHDSLATNAASSLIAWAITALAFGLACKEIHIGGHRGWRLRVLEAFVIILAFTQLLYVLMLHAGLFGGSGGYRDHDYAAGEPKGVPRV

SEQ ID NO: 44587 - protein, 158 aa, Sorghum bicolor
  Clone ID: SORBI-28MAY03-C44139_1.pep
MQAGKTAMEATKEAAANVGASANAGMQKTRAAVQGQVEKATAHNASDRAAAEANQRERVRAAELEKQDAMRANAAAKERATGAATYQHPSQGAPGIVDASRQGYGAGGAAPAGGHVEDGVGETRPVARATGTARPSAAHNPHVGSDFPQARGTGGQYQ

SEQ ID NO: 44588 - protein, 194 aa, Sorghum bicolor
  Clone ID: SORBI-28MAY03-C4410_1.pep
HEALVLLWFGISVPLVFVGSYLGFKKPAMEAPVKTNNIPRLIPEQAWYMNPLFTILIGGVLPFGAVFIELFFILTSIWLHQFYYIFGFLFLVFVILIITCAEITIVLCYFQLCSEDYMWWWRSYLTSGSSALYLFLYAAFYFFTKLQITKLVSGILYFGYMLLASYAFFVLTGTIGFCACFWFTRLIYSSVKID

SEQ ID NO: 44589 - protein, 217 aa, Sorghum bicolor
  Clone ID: SORBI-28MAY03-C35002_1.pep
RAASPGTRATYTNKGEICVAGTRIYVQEGIYDAFVEKAAELAKKSVVGDPFNPRVNQGPQVDKDQYQKVLKYIDMGKREGATLVTGGKPCGDKGYYIEPTIFTDVKDNMTIAQDEIFGPVMALMKFKTVEEVIQKANNTRYGLAAGIVTKNIDIANTVSRSIRAGAIWINCYFAFDPDAPFGGYKMSGFGKDMGMDALEKYLQTKTVVTPLYNTPWL

SEQ ID NO: 44590 - protein, 210 aa, Sorghum bicolor
  Clone ID: SORBI-28MAY03-C36145_1.pep
MAMASALPPFTVRRGEPVLVAPSSPTPRETKPLSDIDDSEGMRFYSSGIHLYRANPSKAGQDPATVIREALAQALVPYYPLAGRLREVEGRKLVVDCAAQGVLFAEADVDLTADDFGDVQSPPFPCFEQFILESTTVAGVEPVVDRPLLYVQVTRLACGGFIFGQRFCHCVVDAPGGMQFEKAVCEIARGAAAPSVAPAWGREMFMARNP

SEQ ID NO: 44591 - protein, 103 aa, Sorghum bicolor
  Clone ID: SORBI-28MAY03-C36161_1.pep
MQTAKVKAKDMASEAKEKAKEATAKMQGKTGEATAATHGEKEMAKEAARAKKDQASADKHQEKAEHRVDAAATTGRHGAGAGAAVDRAYPSAGTTYPASGKYI

SEQ ID NO: 44592 - protein, 525 aa, Sorghum bicolor
  Clone ID: SORBI-28MAY03-C3623_1.pep
MMPGSAPAAGGAGMFVPAATAGTVLCCMCGVSMQPNPANMCARCLRSRVDITEGVPRHAAVVYCPDCSSYLQPPRSWLRATPESPELMQILLRRINRPLARLRVSLSGAEFVFSEPHSKRLRLKLRLRREVLHGIVLEQTHPVEFVVHDRLCDSCSRAQANPDQWVAVVQLRQHVPHRRTFLYLEQLLLKHGQASLAIRVAAAPGGLDFFFGSRSHAARLVDFLATVAPIQTSTAKQLVSHDTKSSVYNYKYTFSVEICPICREDLIALSPQASRDMGGLGPLVLCVKVTNAIALLDPLTLRVHHLEEKKYRVYNFKAALTSKQLVEYIVLDIEQESPEISIDGSRYQLAYAQVARVSDFGKNDTIFTVRTHLGHLLNPGDHALGYDLYGANLNDDDMDTAMARYSLPEVVLVKKSYEKRPRTRRWKLKRLPVEEDAANKAKGEEERRLDEYEAFLRDLELDPEMRFKMDLYKNEDYRSEMASTVGDDIPTVPIDELLEDLTLGEDEEDEGEEAVEGNTSAGMVE

SEQ ID NO: 44593 - protein, 217 aa, Sorghum bicolor
  Clone ID: SORBI-28MAY03-C36521_1.pep
MVIKDGLQPLLILFFPVLPPGPLLPMRRMAALFAPRGVKCTILTTPVNAQVIRSAVDHANDASRGTDGALAIDIAVVPFPDVGLPPGVESGPALNSMEDREKFSHAAQLLRDPFDRFLVENRPDAVVSDSFFDWSVDAAAEHGVPRIAFLGISLFARSCSDTMLRNNPVEAAPDDPDAPVLLPGLPHRVELKRSHGAQPPRGGRPRRPRRARAASGA

SEQ ID NO: 44594 - protein, 158 aa, Sorghum bicolor
  Clone ID: SORBI-28MAY03-C37110_1.pep
QSYAKNMGLYGQRAGCLSILCEDEMQAVAVKSQLQQIARPMYSNPPVHGALVVSIILNDPELKSLWLKEVKGMADRIIGMRKALKENLIKLGSPLSWDHITNQIGMFCYSGMTPEQVDRLTNEYHIYMTRNGRISMAGVTTGNVAYLANAIHEVTKPN

SEQ ID NO: 44595 - protein, 221 aa, Sorghum bicolor
  Clone ID: SORBI-28MAY03-C45952_1.pep
MRALLRIHSPAVISTASFLHTYSTAASKILAPSPTFVPLRLIRRFAAMAATAADEFVKGRVFPNGVAVITLDRPKALNAMNVEMDVRYKALLDEWEANPSVKCILVESSSSRAFSAGMDIKGVAAEIQKDKNTPLVQKVFTAEYSLICKIHEYAKPYICLMDGVTMGFGIGLSGHGRYRIITERTLLAMPENAIGLFPDVGFAYIGAKAPGGGAVGAYLGI

SEQ ID NO: 44596 - protein, 388 aa, Sorghum bicolor
  Clone ID: SORBI-28MAY03-C4730_1.pep
MALALRCPPAATSSRSPFLPSPSPAPPGRLPRRPPASWRCHGYYGDDGFRKSYDHIPKQFREENLKDGLMDNYKNVPQFLYGLSSAQMEMFMNDDNPYNRQSQKVTEESVSAARSYDEFGMYTLSGMHEGPASYSMGMGMGGSMSMSMGRGGRGYTRMRSSAPDLPSLLLDSRIIFLGMPIVPAVTELIAAQFLWLDYDDRTKPIYLYINSTGTMDENNELVASETDAYAIADFINRSKSKVYTINLSMAYGQAAMLLSLGVKGKRGVLPNSITKLHLPKVHKSGGAAIDMWIKAKELDTNTDYYLELLSKGVGKPKEELAEFLKGPRYFRAQEAIDYGLADTILHSLDGSFKPKDLTAQLAKAQAMRQSGKRAAAGAGRWSTPTAPR

SEQ ID NO: 44597 - protein, 153 aa, Sorghum bicolor
  Clone ID: SORBI-28MAY03-C4796_1.pep
MANSNLPRRIIKETQRLLSEPAPGISASPSEENMRYFNVMILGPAQSPYEGGVFKLELFLPEEYPMAAPKVRFLTKIYHPNIDKLGRICLDILKDKWSPALQIRTVLLSIQALLSAPNPDDPLSDNIAKHWKANEVEAVETAKEWTRLYASGA

SEQ ID NO: 44598 - protein, 199 aa, Sorghum bicolor
  Clone ID: SORBI-28MAY03-C4591_1.pep
PSVECTSSVLQALIMFRDLDHGYRKEEIGNCIESATKFIEKEQRKDGSWFGSWGVCFTYGSFFAIKGLAASGRTYKNSDTIRKACNFLLSKQLHTGGWGESYLSSETEEYVDASRPHAVNTAWAMLALVYGGQVERDPTPLYKAAKVLINMQLESGDFPQQEHVGCFNSSLYFNYGNYRNLYPIWALGEFRQRLLARKK

SEQ ID NO: 44599 - protein, 131 aa, Sorghum bicolor
  unsure (1)..(131): unsure at all Xaa locations
  Clone ID: LIB3481-046-Q6-K1-B11.pep
TTKGSWFGSWGVCFTYGSFFAIXGLAASGRTYKNSDTIRKACNFLLSKQLHTXWMGEERGLSSETEEYVDASRPHAVNTAWAMLALVYGGQVERDPTPLYKAAKVLINMQLESGDFPQQVSKGSELDYYLS

SEQ ID NO: 44600 - protein, 210 aa, Sorghum bicolor
  Clone ID: SORBI-28MAY03-C3776_1.pep
MSAGLVTDEATVGRLYRIRRTVMQMLRDRGYLVVEHELATSRRDFLRKFGESFHREDLQINKSKKNDPSDQIYVFFPNDDKVGMKHIKKYVEMMTHENVSRAMVVLQQNLTPFAKSFLIELEPKIHLEVFQEAELLINIKEHVLVPEHQVLTNEEKKTLLERYTLKETQLPRIQISDPIARYYGLRRGQVVKIIRPSETAGRYVTYRYVV

SEQ ID NO: 44601 - protein, 317 aa, Sorghum bicolor
  Clone ID: SORBI-28MAY03-C38989_1.pep
MGKASKDKRDIYYRKAKEEGWRARSAFKLLQIDQEFNIFHGVKRVVDLCAAPGSWSQVLSRNLYVPAKQSPDCKEGDLPLIVAIDLQPMAPIEGVIQVQGDITNARTAEVVIRHFDGCKADLVVCDGAPDVTGLHDMDEFVQSQLILAALTIVTHVLKVGGKFVAKIFRGKDTSLLYCQLKLFFSQVTFAKPKSSRNSSIEAFAVCENYSPPEGFKEEDLYHLLEKVGTPSGVDDLDCRSGWLEGPNKVYIPFLACGDLSGYDSDRSYPLPITDGGSYRSLDPVQPPIAPPYKTALQMKKASSHSASRDAMKPSTDS

SEQ ID NO: 44602 - protein, 305 aa, Sorghum bicolor
  Clone ID: SORBI-28MAY03-C40115_1.pep
TRVFFKPGEQFRDLVGSAYYVAPEVLKRRYGAEADIWSAKQILYILLSGVPPFWAEKKDGIFDAVLRGHIDFASDPWPSISNSAKDLVKKMLRQDPKERLTAAEILNHPWIREDGEAPDKPIDITVISRMKQFRAMNKLKKVALKVVAENLSEEEIVGLKEMFKSLDTDNSGTITLEELRAGLPKLGTKISESEIRQLMEAADVDGNGTIDYVEFISATMHMNRLEKEDHIFKAFEYFDKDHSGHITVDELEEALKKYDMGDEATIKEIIAEVDTDHDGRINYQEFVAMMKNNSSDIVPNRRRMF

SEQ ID NO: 44603 - protein, 175 aa, Sorghum bicolor
  unsure (1)..(175): unsure at all Xaa locations
  Clone ID: SORBI-28MAY03-C4065_1.pep
MGQKINPLGFRLGTTQNHHSFWFAQPKNYSEGLQEDKKIRNCIKNYIQKNRKKGSNRKMESDSSSEVITHIEIQKEIDTIHVIIHIGFPNLXLKKKGAIEELEKDLQKEVNSVNQRLNIAIEKVKEPYRQPNILAEYIAFQLKNRVSFRXAMXKAIELTXKADIKGIKIQIAGRL

SEQ ID NO: 44604 - protein, 119 aa, Sorghum bicolor
  Clone ID: SORBI-28MAY03-C4120_1.pep
VGRAVDLTRLDGYDDLHVRPGVLFDIHGELSANLRKWKVVYTDDEDDMMLVGDDPWNEFCRMVKRIYIYSYEEAKSLTPKAKLPVIGDTIKPDPNKLSPESDMPQSDTNSNAPVAADKD

SEQ ID NO: 44605 - protein, 488 aa, Sorghum bicolor
  Clone ID: SORBI-28MAY03-C40750_1.pep
LRSLVGTPASSALHSFEPHPIVGDAWEALRRSLVFFRGQPLGTVAAVDHASEEVLNYDQVFVRDFVPSALAFLMNGEPDIVKNFLLKTLLLQGWEKKVDRFKLGEGAMPASFKVMHDAKKGVETLHADFGESAIGRVAPVDSGFWWIILLRAYTKTTGDMTLAETPECQKGMRLILSLCLSEGFDTFPTLLCADGCCMIDRRMGVYGYPIEIQARGFMALRCALQMLKHDNEGKEFVEKIATRLHALSYHMRSYFWLDFQQLNDIYRYKTEEYSHTAVNKFNVIPDSIPDWLFDFMPCQGGFFIGNVSPARMDFRWFALGNMIAILSSLATPEQSVAIMDLIEERWEELIGDMPLKICYPAIENHEWRIVTGCDPKNTRWSYHNGGSWPVLLWLLTAACIKTGRPQIARRAIDLAERRLLKDGWPEYYDGKLGRYVGKQARKFQTWSIAGYLVAKMMLEDPSHLGMISLEEDKAMLKPVLKRSASWTN

SEQ ID NO: 44606 - protein, 257 aa, Sorghum bicolor
  Clone ID: SORBI-28MAY03-C4254_1.pep
MAPRTSEKTMTPAAAAAATGLALSVSGGAGASGPHFRGVRKRPWGRYAAEIRDPAKKSRVWLGTFDTAEEAARAYDAAARDYRGPKAKTNFPFPSSCMPLAAGAGAGSLPAAKAVTGGGGSRSSNSSTVESFSSGSDVQAAPMQAMPLPPSLELDLFHRAAAAGTGTGGAAVRFPFNSYPVTHPYYFFGQAAAAAAAGCHMLKLAPTVTVAAVAQSDSDSSSVVDLSPSPPAAVSTQKAAAAFDLDLNCPPPAEMEA

SEQ ID NO: 44607 - protein, 629 aa, Sorghum bicolor
  unsure (1)..(629): unsure at all Xaa locations
  Clone ID: SORBI-28MAY03-C52_1.pep
MATPSAVGAACLVLARAAAGLGLGPGRGGDRARPRRLQRVVRRRCVAELSREGPAPTPRPLPPALLAPPLVPAFLAPPSEPEGEPASTPPPLPDAGLGDLGLQPEGIAEGSIDETVVVASEQDSEIVVGKEQARAKVTQSIVFVTGEASPYAKSGGLGDVCGSLPVALAARGHRVMVVMPRYLNGTSDKNYANAFYTEKHIRIPCFGGEHEVTFFHEYRDSVDWVFVDHPSYHRPGNLYGDKFGAFGDNQFRYTLLCYAACEAPLVLELGGYIYGQNCMFVVNDWHASLVPVLLAAKYRPYGVYKDSRSILVIHNLAHQGVEPASTYPDLGLPPEWYGALEWVFPEWARRHALDKGEAVNFLKGAVVTADRIVTVSKGYSWEVTTAEGGQGLNELLSSRKSVLNGIVNGIDINDWNPATDKCIPCHYSVDDLSGKAKCKSALQKELGLPIRPEVPLIGFIGRLDYQKGIDLIQLIIPHLMRDDVQFVMLGSGDPELEDWMRSTESDFKDKFRGWVGFSVPVSHRITAGCDILLMPSRFEPCGLNQLYAMQYGTVPVVHATGGLRDTVENFNPFGENGEQGTGWAFAPLTTENMXVDIANCNFDIQGAQIFLGRAHEEGHVKRLHVGPCR

SEQ ID NO: 44608 - protein, 89 aa, Sorghum bicolor
  Clone ID: SORBI-28MAY03-C4971_2.pep
LYIICLGLCDRVLHCECPKQKKRWRLIPKPHTALCRTYYSQPFACIHVLNLIISLQTGQNSQCDDSATENIKKLSHQKVTDPPQAPLYI

SEQ ID NO: 44609 - protein, 104 aa, Sorghum bicolor
  Clone ID: SORBI-28MAY03-C4971_1.pep
SRLDAWYSDGSGSVESTAAYIIRGLCRRCCLPETILRSMQACIALSAAGDSLDNCDKLIELVGSAESGMMHLFSQQQLQEFLIFQRECFICTMELEEDQLPSDG

SEQ ID NO: 44610 - protein, 165 aa, Sorghum bicolor
  Clone ID: SORBI-28MAY03-C531_1.pep
MASEHAAAGEGKHEKQSLMDKAKEFVADKIAHIPKPEATLDAVTFKGLSRECITLHSSVNVSNPYDHRLPICEVTYTLRCAGREVASGTMPDPGWIAASGTTSLEIPAKVPYDFIVSIVRDVGRDWDLDYELQVGLTVDLPIVGNFTIPLSTSGEFKLPTLKDLF

SEQ ID NO: 44611 - protein, 237 aa, Sorghum bicolor
  unsure (1)..(237): unsure at all Xaa locations
  Clone ID: SORBI-28MAY03-C5679_1.pep
MARKKIREYDSKRLLREHLKRLAGIDLTILSAQITQSTDFAELVSQQPWLSTMKLVVKPDMLFGKRGKSGLVALNLDFDQVKEFVKERLGVEIEMGGCKAPITTFIVEPFVPHDQEYYLSIVSERLGSTISFSECGGIEIEENWDKVKTIFLPTEKPMTPDSCAPLIATLPLEARGKIGDFIKGVFAVFQDXDLSFLEMNPFTMVNGEPYALDMTGELDDTAXFKNLKKWGDIEVPL

SEQ ID NO: 44612 - protein, 144 aa, Sorghum bicolor
  Clone ID: SORBI-28MAY03-C5888_1.pep
IPTERAYVYKVAPQAECNIPFRIDSSAEGGEENSCLKGGVYLADGDETVPVLSAGYMCAKGWRGKTRFNPAGSKTYVREYSHSPPSTLLEGRGTQSGAHVDIMGNFALIEDIIRIAAGATGEEIGGDQVYSDIFKWSEKIKLKL

SEQ ID NO: 44613 - protein, 249 aa, Sorghum bicolor
  Clone ID: SORBI-28MAY03-C555_1.pep
MAASTASPTFTPFLHRHQQRRTNAVVVVAAASNPGAEPTPATAADGAGPAGKKKTVDTRIHWSNPDEGWVGGNAKKEGGGSGGGGGGSKNEPLGGRFADLINNASESHYQFLGIAPEADIEEIKAAYRRLSKEYHPDTTTLPLKVASQKFIRLREVYNVLSKEETRRFYDWTLAQEAESRRLQQLRSRLEDPYEQDIINYKSVPDMVDRLGGKNMELSDQAMTALTFDIVIIIISICSIIYAVYFKEQY

SEQ ID NO: 44614 - protein, 235 aa, Sorghum bicolor
  unsure (1)..(235): unsure at all Xaa locations
  Clone ID: SORBI-28MAY03-C56626_1.pep
MHDDLGVLRXHIGGGAAAGAAVAGEREVXGVNFVAPPAAAAAAPAPPPRAAGGAGPAATGDGAXDARRVHRXDGRSRPPGGGHERRVLILVPPEPRAARRRRLRRRLAGRFSHRLLERLRVVHGLHVHQDHARARVRLPEEVGVLVPHEAVVIPYSGVGTVAASAGELLGGVGKAGRAVAGGDVAAALREAVDDVVALAGGGRGVAASGGGRGDEVGEDGVDAGHGLVAARVAAS

SEQ ID NO: 44615 - protein, 315 aa, Sorghum bicolor
  unsure (1)..(315): unsure at all Xaa locations
  Clone ID: SORBI-28MAY03-C56139_1.pep
QKQECSYREIKQSIGAMAASASCLAFLVAAAVASVASAQLSSTFYDTSCPNALSTIKSGVDAAVMQEARTGASLLRMHFHDCFVHGCDGSVLLNDTSGEQSSPPNKGSLRRFDVIDSIKAQVEAVCPGVVSCADILAVAARDSVVALGGPSWTVLLGRRDSTASFPSETTDLPAPTSSLQQLLSLFSNKNLDATDMVALSGAHTIGQAQCSNFNDHIYNDTNIDAAFATSLQANCPASGSTSLAPLDTMTPTTFDNDYYTNLMSQKGLLHSDQELFNNGSTDSTVSNFAXQRIGLHQRLHGGDGEDGKPQPTHRN

SEQ ID NO: 44616 - protein, 145 aa, Sorghum bicolor
  Clone ID: SORBI-28MAY03-C56736_1.pep
ARGPQVEESYGSGYGSRPQGGEEYGSGGYGRNTQEESSGYGYGRKNEEQSYGGSGYGYEKKASEEDEGAYGSGGYRKPKPYGEETQGSYGYGEEQSKYQSGGYERPSYGGGEGYYGRKKDDDDSDDEKKQRHQKHHHHRRHDYDD

SEQ ID NO: 44617 - protein, 159 aa, Sorghum bicolor
  Clone ID: SORBI-28MAY03-C5723_1.pep
NRKYLILGSIYGIVVCGPYDLEQISLLVLDNLFSICIGITRNGNMLQVVVVNWYPFQVYAQSIFYKAVDLRTSVGALWEHVGGWEVIIFGQASFFLAACVLDFLGTSFVIYRLDEGSIGNVGVWKLPSVLWRWLTMPREIVVNVCECVSHYGSRITLQF

SEQ ID NO: 44618 - protein, 324 aa, Sorghum bicolor
  unsure (1)..(324): unsure at all Xaa locations
  Clone ID: SORBI-28MAY03-C58108_1.pep
VRCCCSGHCAGLPASPGYFPLRPMARGLLPSRSWAHCPAALRLVLLVFLPPSRPSSCASFQHEAHVCLITDYYAGGELFMLLDRQPMKVLKEDAVRFYAAEVVTALEYLHCQGIIYRDLKPENILLQRDGHISLTDFDLSCLTSCQPQVFLPEDDKKKRRRKSRSNPIFFAEPMRASNSFVGTEEYIAPVXEIITGAGHTSAVDWWALGILLYEMLYGYTPFRGKTRQRTFANILHKDIRFPASIQVSLAARQLIYRLLHRDPANRLGSYEGAIEIKQHPFFRGINWALVRAATPPELEAPLQDTLEATGETLPPPDSAHTDMF

SEQ ID NO: 44619 - protein, 178 aa, Sorghum bicolor
  Clone ID: SORBI-28MAY03-C5801_1.pep
MSRHPITKWAQRSDRVFLTIELPDAKDVKLNLKPEGHFNFSAKGSDDLPYEFDLELFDAVNVEESKAAVAPRTICYLIKKAESKWWPRLLKKEGKAPVFLKVDWDKWQDEDDEDVGFNDFSDMDFSKLDMGGADDDDFEDDEDDVVESANKDEGGKTEKSNGEEEAAAAAAAAEEVKP

SEQ ID NO: 44620 - protein, 177 aa, Sorghum bicolor
  Clone ID: SORBI-28MAY03-C6453_1.pep
RLQEPPRNSSRVAPTPTEQGEIFDPERNSWEQMPTGMGEGWPARQAGTKLSVVIDGNLYALEPATSSGSAKIKMYDAQEDTWKVAVSQVPVGAFAESDSPYLLVGFLGKLHLIIKDVGSKINVMQTDSLEPLDSPALSAGTTCQVPDVSLEQADVWKAIASKSITAAELVSCQVLSI

SEQ ID NO: 44621 - protein, 190 aa, Sorghum bicolor
  Clone ID: SORBI-28MAY03-C6445_1.pep
MARVYVGNLDPRVTAREIEDEFRTFGVLRSVWVARKPPGFAFIDFDDRRDAQDAIRELDGKNGWKVELSTKAGGGRGRDRNGSDMKCYECGESGHFARECRLRIGSGGLGSGRRRSRSPRYRSRSRSRSRSPRYRRSPSYGRRSYSPRDRSPRRRNVSRSPPPPPDARRSYSRSPGQQPQRDESPYANDA

SEQ ID NO: 44622 - protein, 114 aa, Sorghum bicolor
  unsure (1)..(114): unsure at all Xaa locations
  Clone ID: LIB3476-020-P1-K1-C9.pep
HASDRRSPSYGRRSYSPRDRSPRRRSYSRSPPGSRAPGSRDLAKVQRAVCMISNSTSVVEVFSRIDHKFDLMYAKRAFVHWYVGEGMEEGEFFDGREDLXALEKDYEEVGAEFD

SEQ ID NO: 44623 - protein, 128 aa, Sorghum bicolor
  Clone ID: SORBI-28MAY03-C7089_1.pep
VTANEHLEALRQGRPHQKVGIPQGGGIGQNQGQLQENMIPLDIEKNMIDLGPGLPTRGIITGDLQEGIRQGADHPQLVIAIVHQEDIGHHLPTGRLDWVSLERISLLQDLAMPPLSEIWRRNLASLDV

SEQ ID NO: 44624 - protein, 163 aa, Sorghum bicolor
  Clone ID: SORBI-28MAY03-C48207_1.pep
SSSSTYNGWDVPGTSSGQSSSKPHKTETNPPVLIPQEALQALPTPTAPPFAEETFYSGPVHYPSIDSTPVDVTMPATTEGGTTGSTTAAAPTKQEENEADASDSGKTPSGTCVICLDAPVEGACIPCGHMAGCMSCLKDIESKKWGCPICRATINQVVRLYAV

SEQ ID NO: 44625 - protein, 471 aa, Sorghum bicolor
  unsure (1)..(471): unsure at all Xaa locations
  Clone ID: SORBI-28MAY03-C4862_1.pep
MLDKVGALSETNATNIFMVKKGIVLTPHADYCLPGSPRAPLGAPAARGHLAPQARPVSPAVFHAAAAPRSPGTSRVFSPALRVDGRVLGEPLFAPVPRPTRVACPVRPARLAVPVPGGAEVVLAVMLPPAGXEQPPCEPVATHRPPHLSSDLLLSRLLFGSMRSPLIILPSSPLVVPPSFRDLGIGVLPPRRGRSRGLGSPPPVIDADDLQQDPEAVLSGLCEDLGIPFQPQMLKWEAGPKEFDGIWAPWWYGSVHKSSGFSKPRQYPLTFPFAFYDLLEQSLPFYNMLKRQIRKTRGLQQPPLPDPPLPVPANKNILVWVGDELLPRDSAKVSVFDSVVQGGDAVWEGLRIYDGKVFKLDEHLDRLFDSAKAMAFINVPTRDWIKDAIFKTLIANGMFDNAHIRLTLTRGKKVTSGMSPGFNLYGCALIVLAEWKPPVYDNSHGIKLVTATTRRNSPNSVDSKIHHNNLI

SEQ ID NO: 44626 - protein, 322 aa, Sorghum bicolor
  Clone ID: SORBI-28MAY03-C48914_1.pep
MMAPAVAGAASVAMSQALRDRQILDAVGTGAAALSLAGSSFIVLCYLLFRELRKFSFKLVFYLAVSDMFCSLFTILGGPSNAFYCFAHDYSAHFFCVASFLWTTTIAFTLHRTVVKHKTDVEEFGSIFHLYVWGTSLATTVLRSIGSDYGRPGSWCWIQQGSMAKVLHLVTFYLPLWGAILYNGFTYYEVNRMLNNATRMAAGISDRSNQSDIRADRKAFNRWGYYPLILIGSWAFATINRLYDFANPGHKIFWLSFLDVGFAGLMGLFNSIAYGLNSSVRRAISERIDMFLPERIKRSLPTFSRLRSQQENELTSLIVEGN

SEQ ID NO: 44627 - protein, 154 aa, Sorghum bicolor
  Clone ID: SORBI-28MAY03-C48987_1.pep
GLDGVKLMTFGQPRIGNAAFASYFKTYLPQAIRVTHAHDIVPHLPPYFAFFPQKTYHHFPREVWVHNVGLGTLVYSIEKICDDSGEDPTCCRSVIGNSVRDHIYYLGVSMHAEDWSSCRIVMDYSKLRYQMDLNGNLVLSKQPALSNDRGFSAQ

SEQ ID NO: 44628 - protein, 437 aa, Sorghum bicolor
  Clone ID: SORBI-28MAY03-C4800_1.pep
FENVAKTETVVPSVVPVKSISNPTPQMTLEVHKDVIEPTQSRKLDKEREIIENGSPVVETPIVAAPVEEAVTSLNKKPSQNMPLLPHGLRNTGNICFLNATLQALLSCSPFVHLLQDLRNRSIPKVGYPTLNAFVELISQFDVADESVIKKNEKAITVAAKPLNPAMFDAVLRNFTPDVPAGVTARPRQEDAQEFLSFAMDRMHDELLKLNGNGSDSKEGMVVSSVDDDAWETVGRKNKSAIVRTQSFVPSELSAIFGGQLQSVVKATGNKASATVQPFLLLHLDIFPDAVQTLNDALHLFSTPESLEGYRTAAGKAGLVTARKSFKIHALSKIMIMHLKRFSYGNHGSTKVYKPLHFPKELVLSRELLSSPSTEGRKYELVATITHHGRDPYRGHYTAHAKHANGQWLRFDDDAVVPVAENDVLHDQAYVLFYKQV

SEQ ID NO: 44629 - protein, 56 aa, Sorghum bicolor
  Clone ID: LIB3476-061-P1-K1-D11.pep
IHLSGNKASATVQPFLLLHLDIFPDAVQTLNDALHLFSTPESLEGYRTAAGKAGLV

SEQ ID NO: 44630 - protein, 197 aa, Sorghum bicolor
  Clone ID: SORBI-28MAY03-C49367_1.pep
MAGFKSLGIVLVVVAALLAATARAVDDEHMYHWKCFKSCTGNCHDEDAAAAAVDDDVVAANDGNHSGASNISGGKCKNRCLSECFEDLPAQCYHQCVVTNCLSFPPFSNEKTMCLKSCCEKCFHHGPPAPGPGPKPPAPTMPKPPPRPPAPKPPAPTKPKPPKPSPPAPTKPKPPTPKAPPPPKKPCPPGSDEVNNN

SEQ ID NO: 44631 - protein, 310 aa, Sorghum bicolor
  Clone ID: SORBI-28MAY03-C51265_1.pep
MGYSKLIALLVLVPALVAVHVHVPMASAANSNLFRDYIGAIFNGVKFTDVPINPRVRFDFIMAFVIDYTTATEPPTPTNGQFNIFWQNSVLTASAVAGIKQSNPNVRVAISLGGATVNDRPVYFNITSVESWVENAVSSLTSIIHEYNLDGIDIDYEQFQADPATFAECIGRLVTTLKSNGVIKFASIAPYGNADVQRHYQALWASYGSVIDYVNYQFYAYGASTTEAQYVDYFDQQLVNYPGGNILASFTTAATTTSVSINTSLSACQTLQSQGKLYGIFIWAADHSRSQGFKYDTQAQALLANAPAGY

SEQ ID NO: 44632 - protein, 144 aa, Sorghum bicolor
  Clone ID: SORBI-28MAY03-C7633_1.pep
LGVGPLAPVAGCSPAGGVGAGAGILRSALLLTHPSGVPATTILAPRRSPAPLQEVMHVFYVALLCTEGPRVQRPTMREVVQILSELPKPANKQGEDVPNSGDGSASSPLHPAPVETNEAPTVEARDQQQQTSSPSSPPPDLISI

SEQ ID NO: 44633 - protein, 206 aa, Sorghum bicolor
  unsure (1)..(206): unsure at all Xaa locations
  Clone ID: LIB3476-037-P1-K1-B7.pep
LTAFQRLDFTSDDVLDCLKEENIIGKGGAGIVYKGAMPNGELVAVKRLPAMGRGSSHDHGFSAEIQTLGRIRHRHIVRLLGFCSNNETNLLVYEYMPNGSLGEMLHGKKGGHLHWDTRYSIAIEAAKGLCYLHHDCSPLILHRDVKSNNILLDSNFEAHVADXGLAKFLQDSXASECMSAIAGSYGYIAPEYAYTXKVDEKSDVYS

SEQ ID NO: 44634 - protein, 341 aa, Sorghum bicolor
  Clone ID: SORBI-28MAY03-C7853_1.pep
MGAPLLRRRLLLSLALLAACCAAVGTAAAAKAKAPRLSPNYYRHSCPRVERIVSDVIAAKQRANPSTAAGTLRLFFHDCFVNGCDASVLVSPLSSTAAPERAAEINLSLPGDAFDAVARAKAALESACPGVVSCADVLALAARDLVGILGGPRFPVALGRRDSARSDARDVEGNLPRTNMSARAMVRLFAGKGLSAREMVALAGAHTVGFSHCAEFAHRIYGYRGAGAAGHDPRLNPEFARALQRSCAGYRTDPTVSIFNDIVTPSEFDEAYYKNLPHGLGLLASDAAIWEYPPTRVFAQRYSANRTAFFEDFAAAMQRLGAVGVKTGRQGVVRRRCDALD

SEQ ID NO: 44635 - protein, 417 aa, Sorghum bicolor
  Clone ID: SORBI-28MAY03-C7924_1.pep
MCLGSWPCLLVDRVRLLQPPPPPPPLRSVSSSSLEIDSIDQSINHCRLHHLQSPTLLDSLVRPPAACLKRIDGTGGRKKTTIGVLEMEGGNGQIDRSDEREEMKLIIDTDPGIDDSVAIMMAFQLPGVQVLGLTTIFGNCTTEHATRNALILCEKAGHPEVPVAEGSHEPLKGGKPHVADFVHGSDGLGNIVLPDPTIKKVEESAADFLVDKVSQFPGEVSVLALGPLTNIALAIKKDPSFVKNVKKIVVLGGAFFAAGNATPSAEANIHSDPEAADIVFTSGADIYVVGLNITTQVSFTDKDLLELRNSKGKHAQFLCDVCKFYLDWHIKSYGAPVIFLHDPVSFAALVCPEMFTFKKGVVRVETQGICVGHTSMDMLLKKWNSENPWTGYSPISVAWTVDVPKVVAFVKELVIKQ

SEQ ID NO: 44636 - protein, 228 aa, Sorghum bicolor
  Clone ID: SORBI-28MAY03-C795_1.pep
MAPAKSGEKATSFAMACSLLSRYVRQNGAAAGDLGLAIRAEADGKRASADTEKGDTTKETMDLFPQNAGFGSEAAMKEAPDVREPEKRQLTIFYGGKVLVFDDFPAEKAKDLMQMASKGSSVAQNPGMLPSPTVATVTDSTKITAVPAAPIAVVNAQKSPADIPQAPKASLRRFLEKRKDRLTAKAPYQGSPSDATPVKKEMAEGQPWLGLGPQIANPDLSLCKEGSQ

SEQ ID NO: 44637 - protein, 143 aa, Sorghum bicolor
  Clone ID: SORBI-28MAY03-C5242_1.pep
TACFYSTDAGDGSFLMNIQELAMIRIENLPVKVFELNNQHLGMVVQWEDRFYKANRAHTYLGNPENESEIYPDFVTIAKGFNIPAVRVTKKSEVHAAIKKMLETPGPYLLDIIVPHQEHVLPMIPSGGAFKDMILDGDGRTVY

SEQ ID NO: 44638 - protein, 82 aa, Sorghum bicolor
  Clone ID: LIB3480-042-P1-K1-C7.pep
MLPFQFCSSVGMVVQWEDRFYKANRAHTYLGNPENESEIYPDFVTIAKGFNIPAVRVTKKSEVHAAIKKMLETPGPYLLDII

SEQ ID NO: 44639 - protein, 664 aa, Sorghum bicolor
  Clone ID: SORBI-28MAY03-C5904_1.pep
HEDQLVTAMSTRKIRARGDSITKKLTLTQAIDARDALAKSIYANLFDWIVEQINHSLGTGRQFTWRSISILDIYGFECFNKNGFEQFCINYANERLQQHFNRHLFKLQQEEYLEDGIDWTPVEFVDNTNCLSLFEKKPLGLLSLLDEESTFPKATDFSFANKLKQQLSGNSCFKGEKEGTFEICHYAGEVTYDTAGFLEKNRDPLHSESIQLLSSCKCELPKHFASVMVAGSRNKSSLSWHSVMDTQKQSVVTKFKAQLFKLMQQLESTTPHFIRCIQPNSKQHPRLFEHDLVLHQLKCCGVLEVVRISRTCYPTRITHQQFAERYGFLLLRSVASQDPLSVSIAVLQQLNIPPEMYQVGYTKLFFRTGQVAALENAKRQMLHGTLRIQKHFRGLHSRQGYQQLKKGAMNLQSFIRGERARIHFDNLVKRWRAAVLIQKYTRRRLAANMFNDELSHIIILQSVMRGCLARRKYKCLQNEKESKASHNIVQGDTRKTNSESRVCHEMNGHYLHEPVITELQDRITKAEAALLDKEEENVMLKRQLEQYERKWSEYEAKMKSMEEAWKRQLSSLQLSLVAAKKSLAADDAATRAARTDFTPTHAQYDSEDTLSTGTHTPEVIESRHHNHNPEAKVSAGNSDRRVNAVNHLTKEFEDRTQVFEDDAG

SEQ ID NO: 44640 - protein, 441 aa, Sorghum bicolor
  Clone ID: SORBI-28MAY03-C5492_1.pep
MDNHEPFFIFENMVGCPSPVPGAPHPLSFAPAGSNPSSSWSDLPKDLVLSILQRLQLPEAIAFASVCTSWLSAATAAGVPRSCTPMIMSWRDILESRESRGAKGSSSVNCKFLHLLDVHKAYDVRFPQGLCFMACCGSSHGWLILVNELANLVLYNPFTSEMIPLPPITDFTCVEAVCGSKGNIEAYNFENHRVQDAKYLATWFYQKAVLSCSPSKSANYVVMIIHRDNNWLSSVRAGDSNWQVAATLVAQKADRYADCAYHNGMFYTVTFEGIVEKWDVDGPNGPAKEVIVAKRSSRRILSRHLVSTPWGDLLEVRAFVANSRRMYRDGVAFRIFKVHLDGYEKVSPVPKIDLMEHAILIGLNHSACLSTKNFPWLRPCCIYFSVPWMTPICHLLRRCPEWGGVRTYDIKQRTFDHVFRLCPHTNRLNLAPSEVWITPNL

SEQ ID NO: 44641 - protein, 133 aa, Sorghum bicolor
  Clone ID: LIB3476-007-P1-K1-A11.pep
ARHRASERRIPSERRLLLPHPPHRPDPGAAEVDAQLQIQAAAAELPPPALQKLIHPNIVKLKDVTMENHEPFFIFENMVCKPRPVHDASHTKTNEPTGSNPSSSWSDLPKDLVLSILQRLQLPEAMAFAIVCT

SEQ ID NO: 44642 - protein, 132 aa, Sorghum bicolor
  Clone ID: SORBI-28MAY03-C5997_1.pep
MEVFGKSVIAEPSNVIFLSAILNTEGSNPSHKCDKRCQNEHIFGNMYRCKLTGTTHICDKNCNQRILYDNHNSLCRVSGQFFPLSPLEQQAVRGIRRKHEVDSNEIPPFTPFSIWQMQEQPFELPYTWQAAV

SEQ ID NO: 44643 - protein, 156 aa, Sorghum bicolor
  Clone ID: SORBI-28MAY03-C6_1.pep
MRIWLRGATTIRRCKCYSCSFPLAVVPVVSPPPPLPPGSRRRTASSAMAEAHSGRRVGMVGDVRDAPEGHENDLEAIELARFAVDEHNSKTNAMLEFERLVKVRHQVVAGTMHHFTVQVKEAGGGKKLYEAKVWEKVWENFKQLQSFQPVGDAAVA

SEQ ID NO: 44644 - protein, 233 aa, Sorghum bicolor
  Clone ID: SORBI-28MAY03-C6219_1.pep
MASIKPQQSLIQSKTKKAPSRISYSTIITWNLILILIVLSLYATYSHWHQRSAQDFEMELHEAELAVRPVDPKMISRPRYAVMNTAKGPITIEIYKDASAGVVDRFIDLCKSNHFKGMPFRHIIKNFVIQGGDFDFDGAAQEWITKAKASGKNDLSPKHEAFMIGTAKNPNNKGFDLFITTAPIPDLNDKLVVFGRVIKGEDIVQEIEEVDTDEHYQPKAAIGIINIMLKQEP

SEQ ID NO: 44645 - protein, 294 aa, Sorghum bicolor
  Clone ID: SORBI-28MAY03-C6422_1.pep
HEADREHAQVDTLYSDRLQDVPSDLQRSTDANVSSQDVALDNSGQACAHAGDDMTGEFNDFVHSNANIFESNEVPASEITGVEYNQDVSGFPRPTEDENAVGYNQDASGYPRPTENENAVEFNQDSSGFPRPTEDENAVSAMGDNSGFQENNMGSLMDLDMVNDYELKECNDFGSAIHGVDTDFLNYDDDGDFDDANDDEPNPSEFQSLDNSGWSSRTRGVARYLKTLFDEDSGLGRKSVAIDHLVRGKTRKEASRMFFETLVLTTKDYISVDQPNPYDFVSIKPGPKLLMSEF

SEQ ID NO: 44646 - protein, 197 aa, Sorghum bicolor
  Clone ID: SORBI-28MAY03-C9367_1.pep
MVGLVGGSTARAEHVVANAGGETEYVRRLHRHAPAEHQCTSTLVKHIKAPVHLVWELVRSFDQPQRYKPFVRNCVVRGDQLEVGSVRDVNVKTGLPATTSTERLEQLDDDLHILGVKFVGGDHRLQNYSSIITVRPESIDGRPGTLVIESFVVDVPDGNTKDETCYFVEAVIKCNLKSLAEVSEQLAVEPPTSPIDQ

SEQ ID NO: 44647 - protein, 303 aa, Sorghum bicolor
  Clone ID: SORBI-28MAY03-C9471_1.pep
ARGRYDYYTIGSYDKRKDRYYPDNPNGDYHRLRYDYGNFYASKTFYDPAKRRRVLLGWANESDSVPDDKAKGWAGIHAIPRKIWLDPSGKQLLQWPIEEVEKLRGKAVTVGGKVVKPGEHFEVTGLATYQADVEVSFEISSLDKAEPFDPAYDNDAQKLCGVKGADVKGGVGPFGLWVLASADLQEKTAVFFRVFKDGYGKPKVLMCTDPTKSSLSPDLYKPTFAGFVDTDISSGKIALRSLIDRSVVESFGEKGRTCILSRVYPSIAIGKEAHLYVFNNGDVDVKVSSLTAWEMKKPLMNGA

SEQ ID NO: 44648 - protein, 192 aa, Sorghum bicolor
  Clone ID: SORBI-28MAY03-C70212_1.pep
MNALAATSRNFRRASKLLGLDSKLEQSLLIPFREIKVECTIPKDDGTLASFVGFRVQHDNARGPMKGGIRYHPEVDPDEVNALAQLMTWKTAVAAVPYGGAKGGIGCSPGELSRSELERLTRVFTQKIHDLIGTHTDVPAPDMGTNAQTMAWMLDEYSKFHGHSPAVVTGKPIDLGGSLGRDAATGRGVMYA

SEQ ID NO: 44649 - protein, 238 aa, Sorghum bicolor
  unsure (1)..(238): unsure at all Xaa locations
  Clone ID: SORBI-28MAY03-C71406_1.pep
EDLPSMDLEAPAADEVFSSSDELQTVWPLRQGNPKRPLLPCCSVRIPSPGRCGLAPYXTHGGSAPLDGSVVVLAGSILVSVADLAYGSVAGCLQLDRAKRGFPASLAAHVCAVSHPHSGAGTALSAAAPLRSAARRFEHKCYNLFTCNSHSFVADCLNRLAYGGSVGWNVLNLGALVWLRGRWLDPMAAVRSFLPFAVVSCVGVLMAGWSFLLGMAAFTLLLLGWFVIAVYCMKGLVG

SEQ ID NO: 44650 - protein, 140 aa, Sorghum bicolor
  Clone ID: SORBI-28MAY03-C740_1.pep
SGRVREIQLQNYTRKMEQKMQREEDLRMGLRLYKDGKYEVALEKFESVLGSKPESSEASIASYNVACSYSKLGRIEAGLSALEEALKAGYEDFKRVRTDPDLANLRKSEEFEPLLKNYDESFINENAINAIKSLFGLGKN

SEQ ID NO: 44651 - protein, 287 aa, Sorghum bicolor
  unsure (1)..(287): unsure at all Xaa locations
  Clone ID: SORBI-28MAY03-C7123_1.pep
ARGYGPGEERHIPRILSLAKLGLAFFKIGGPDVKTDWVYIDNLVLALILASMGLLDDIPDRKGTPVAAGQAYFICDGSPCNTFEFIIKPLFQSLGYSAPQVRLDTSVALAISRMFLFISTLFYPWLDSKWMPEPLILPAEVYKVGVTHYFSFLKAREELGYVPMVSPHEGLAATISYWQERKRRELDGPTIFTWLAVIIGMLAVFSSAYLPPVGPLKWVLDIHLFVFRSCXVIRLVFVTAVAAHLGEAVYAWFLAKKVDPRNATGWFWQTFVLGIFSLRYLLKRARG

SEQ ID NO: 44652 - protein, 216 aa, Sorghum bicolor
  Clone ID: SORBI-28MAY03-C7231_2.pep
MATSSHCFENPPALEPASGGGEVVDDFGGQKAYITGSAGSKAAVVLISDAFGFEAPNLRKIADQVASSGYFVVVPDFLHGDPYDLSSSNPGMWIQAHNPQNAFEEAKPVIAAIKEKGVSRIGAAGYCWGAKVVVELAKVHEIQAAVLLHPSLLTDDDIKEVKCPISILGAEIDRSSPPELLKQFGQILSANSEIDHFVKIFPGVAHGWAVRYSDDD

SEQ ID NO: 44653 - protein, 239 aa, Sorghum bicolor
  Clone ID: SORBI-28MAY03-C7231_1.pep
MASSHCWESPPALNPAGGVGEVVDDFGGLKAYVAGLAEAKAAVILVSDIFGFEAPKLRKIADNVALSGYLVVVPDFLHGDPFDPSNPNNRAMWLQAHSPKKAFEEAKPVIAALKEKGVAIIGAAGYCWGAKVVVELAKVHEIQAAVLLHPSLLTVDDIKEIKCPISILGAEIDKASPPELLEEFEQILSANSGIEHSVKIFPGVAHGWAVRYSDDDVAAVSSAAEALHDMTHWFNKYLK

SEQ ID NO: 44654 - protein, 145 aa, Sorghum bicolor
  Clone ID: SORBI-28MAY03-C7272_1.pep
EEERVTGTMAADSGARRQPTFTKVDQLRPGTHGHNLIVKVVDSKMVVQRGRDGGPQGRQMRIAECLVGDETGIIVFTARNDQVDVMKPGTTVELRNAKIDMFKGSMRLAVDKWGIVKAAESSAEFTVKEDNNLSLIEFELVTVVE

SEQ ID NO: 44655 - protein, 276 aa, Sorghum bicolor
  Clone ID: SORBI-28MAY03-C7814_1.pep
MAVEKTLPGANAGRTVLVTGGAGYIGSHAVLQLLLAGFRAVVVDNLNNSSELAVRRVAALAGDHSRNLSFHKIDLRDKGTLEMVFASTRFDAVVHFAGLKAVGESVQKPLLYYDNNVIGTINLLEVMSAHGCKKLVFSSSAAVYGSPRNSPCTEEFPLTPNNPYGKTKLVVEDICRDIYRSDPEWKIILLRYFNPVGAHPSGYLGEDPRGIPNNLMPYVQQVAVGRRPALTVLGNDYATRDGTGVRDYIHVVDLADGHIAALQKLFENSSIRWKHT

SEQ ID NO: 44656 - protein, 96 aa, Sorghum bicolor
  Clone ID: SORBI-28MAY03-C10763_1.pep
MATALNRGLRSGIRLLAAGAEASRPASRGFHATGVKRMGGHGHDEPYYIHAKHMYNLHRMKHQGLKVTLSVLGAVSIGVGVPVYAVIFQQKKTASG

SEQ ID NO: 44657 - protein, 167 aa, Sorghum bicolor
  unsure (1)..(167): unsure at all Xaa locations
  Clone ID: SORBI-28MAY03-C10786_1.pep
AGHGRRDCTARGPLASGAAAQPVEKFINDATSKGANIMLGGXRHSLGMTFYEPTVVGNVSNDMLLFREEVFGPVAPLIPFKTEEEAVHMANDTNAGLAAYIFTKSIPRSWRVSESLEYGLVGVNEGIISTEVAPFGGVKQSGLGREGSKYGIDEYLELKYICMGNLG

SEQ ID NO: 44658 - protein, 151 aa, Sorghum bicolor
  Clone ID: SORBI-28MAY03-C11006_1.pep
MSTSTFATSCTLLGNVRTQASQTAVKSPSSLSFFSHVMKVPSLKTSKKLDVSAMAVYKVKLVTPEGQEHEFDAPDDTYILDAAETAGVELPYSCRAGACSTCAGKIESGAVDQSDGSFLDDGQQEEGYVLTCVSYPKSDCVIHTHKEGDLY

SEQ ID NO: 44659 - protein, 159 aa, Sorghum bicolor
  Clone ID: SORBI-28MAY03-C11187_1.pep
RDIYRDLAEKYGVTGFPTLKFFPKGNKAGEDYDGGRDLGDFVKFINEKSGTSRDTKGQLTSEAGRIASLDVLAKEFLGASSDKRKEVLSSMEEEAAKLSGPSARHGKVYVNIAKKILEKGNEYTKKETERLDRMLEKSINPSKADEFIIKKNVLSTFSS

SEQ ID NO: 44660 - protein, 481 aa, Sorghum bicolor
  Clone ID: SORBI-28MAY03-C8196_1.pep
MMDHRDVMLPLSLRTLATRTLLLLVIASAVSCSSLPPEDGIRVVSAEKRIDLTGPIVKVFLTLKVENAPTASEASGVLLAFTPTEAQHLSIAKATRVEGKRKKKAFIPLSITASELTTTASDAPRLYSVLLSTPLKPGDATTLEVLYMLTHSLEPFPAEISQSESQLVYYRDSAVLLSPYHVLEQVTYIKMPSNRIESFTRVDPTTRAGSEVKYGTYNNQMPNSYLPILVHYENNRPFAVVEELVRKVEISHWGNIQITEQYKLKHGGARHKGVFSRLEYQPRPSVSGASSFKNLLARLPPRVHSVYYRDEIGNISSSHLRTDSHKSELEIEPRYPLFGGWHCTFTIGYGLPLQDFVFESVDGRRYINLTFGCPLLDTVVDDLTVKVVLPEGSKNPQPVVPFVTEKHLETSYSYLDVVGRTTVVLKKKNVVGEHNVPFQVYYEFNPIFMLAEPLMLISAVLLFFVAFIAYLHMDLSIRKSS

SEQ ID NO: 44661 - protein, 222 aa, Sorghum bicolor
  Clone ID: SORBI-28MAY03-C8093_1.pep
TRWLFYRGGIGVKGEESWEAWWEEELQHIYSIRGRILETILSLRFFIFQYGVVYHMHASRESTALSVYWISWAVLGGLFILLLVFGLNPKAMVHFQLFLRLVKSIALLMVLAGLVLAILFTELSIGDVFASILAFVPTGWGIISIAMAWKPVVKKLGLWKTVRALARLYDAGTGMIIFIPIAICSWFPFISTFQTRLLFNQAFSRGLEISLILAGNNPNAGI

SEQ ID NO: 44662 - protein, 338 aa, Sorghum bicolor
  Clone ID: SORBI-28MAY03-C8551_1.pep
MALRTLHLNAPPLLHILRSLCLLVLAASAAVSVSGRHHAPTPAHGTGQSMYLAPACRAHTASLADFGGVGDGTTSNTAAFRSAVDHLSQYSGEDAGGAMLYVPAGKWLTGPFNLTSHFTLFLHSDAVILASQDINEWPIIDPLPSYGRGRDKIGGRFASLVGGSNLTDVVITGNNGTIDGQGAMWWSKFHKNQLKYTRGYLIELMHSDTIYISNLTLLNSPAWNIHPVYSSNIVVQGITILAPTNSPNTDGINPDSCSHVRIEDCYIVSGDDCVAIKSGWDEYGISYGMPSQHIVIRRLTCVSPTSAVIALGSEMSGGIQDVRAEDITAINSDPGAHR

SEQ ID NO: 44663 - protein, 172 aa, Sorghum bicolor
  Clone ID: SORBI-28MAY03-C835_1.pep
MAQESWKQESEETGVHAPEAPILCINNCGFFGSSMTNNMCSKCYRDFIKLMETPVVEKKVIAGASSSAVLPLEAAKRDALPTAAAAAAAEAAAAVDDKQAAQEEPPKPPSNRCLTCRKKVGLTGFQCRCGGTFCSMHRYTDSHQCTFDYKTAAREQIAKQNPVVMAEKINKI

SEQ ID NO: 44664 - protein, 182 aa, Sorghum bicolor
  Clone ID: SORBI-28MAY03-C8318_1.pep
TRLFTYWTSDAYQATGCYNMLCSGFIQINSEIAMGASIFPISNYAGSQYDISILIWKDPKEGNWWMQFGKEYVLGYWPSFLFSYLADSASMIEWGGEVVNSQPDGVHTSTQMGSGHFPEEGFSKASYFKNIQVVDSTNNLKAPKGLGTFTEQSNCYDVQNGNNGDWGTYFYYGGPGRSSNCQ

SEQ ID NO: 44665 - protein, 345 aa, Sorghum bicolor
  Clone ID: SORBI-28MAY03-C8759_1.pep
TGKRSAKDEKSSAKKAGEGESSKKTQKNNSKQQKDETLSEDDPAKDLIIKEMISPKSSTKGPGRIKGQSTENNTPKMKQEQETEEPPRSRKSKGLDRSLVGARIKVWWPDDKMFYNGVVESFDSVSKRHKVAYDDGDVEVLLLRDEKWEFISEEKGASVASEKPRGRKRKVDAVKEENTETPRSDAVDTPKKRGRPTGVRSSNGTPSNSATPSTKGKTAGKGAKETPKTGPNLKKELEKSSKGKASVSTETNDELPKDDDKSATKPKEAISKGKDSKDEGKSTEGKARPGRKPRNAGTPLKSDADKEKRKEKEVKAAEIEQEASGNASTGKSGNASTGKKRRRKA

SEQ ID NO: 44666 - protein, 273 aa, Sorghum bicolor
  Clone ID: SORBI-28MAY03-C90128_1.pep
MRKRERENPCGICGHYHKYEEGEVCGVCGHRPPAASPAGARQQDSAFPSEILKEFLFLGSYDNASRSELLKTIGVSHILNTVPLCQNLYRNSFTYHCLQEDKTLQFDDANQFLEQCEREKARVLVHCMSGKSRSAAFVVAFLMKSRGWRLTQSFQWVKERRPQVQLSDAAQQQLIDYEMKLFGSNNVSIPAQPFAPVDSFPSLGFGFPKPAGDIQVPTFNQQAPASIFERVTPNSFPSNFTFGAERTSEAKLPDSNNFGVINSSGSDSMMDSS

SEQ ID NO: 44667 - protein, 168 aa, Sorghum bicolor
  Clone ID: SORBI-28MAY03-C12619_1.pep
LNSVWYQPEEIFPISGTPEERQHAFWVPVSKRYYRLAAKLEGMELPACVNETTCLPRAPRVTRVPRGCSANIYTDNASYRQFIRAHFGCTPVEMESAAVALVAHQHGVPFITIRSLSDLAGGGSSLSNEAATFLDIAAKNAVDVMLKFVPLLGRGGEQEQADGLAQDM

SEQ ID NO: 44668 - protein, 225 aa, Sorghum bicolor
  Clone ID: SORBI-28MAY03-C13496_1.pep
RPGWDHLQTTEVVDTSKMMMRSTNAICLVAFIVVAAAATLTTTTTEAAAASPAAAEFLQGRCSPSVMPKVIARHCYDSLLPEAGSFNGSSIRVIGAATELMVANFRSLLAELRKLNGTKQYKLGKCAEQAAEFEPGPGKKEPEKLAKIRALAAMGDDNKVEYVYDISSWMDEMDMKFSRDCQPEMKAVPDADKLLPTKAVMYPSILVVQGLVSGYTPPRSEMTYP

SEQ ID NO: 44669 - protein, 247 aa, Sorghum bicolor
  Clone ID: SORBI-28MAY03-C13540_1.pep
MEEREKLVCLAKLAEQAERYDDMVEFMKNLARMDVDMSAEERHLFSVGFKNTIGAKRASWRIICSHEQKVTTDRQTGVMIDAYKKIVEDELRKVCNEVLSVIAIHCLPLANTSENVVFFYKMKGDYYRYLAEFSSGTEKKAASDQSLMAYQHAMVVASSELSPAHQIRLGLALNLSVFFYEIMNSHERACQVAKQAFNEALTEINSGEGVYKDSTLMMQLLKDNLALWTSELTGGEASKDNDVDMEG

SEQ ID NO: 44670 - protein, 251 aa, Sorghum bicolor
  Clone ID: SORBI-28MAY03-C15977_1.pep
TRARVALGCGHDNEGLFVAAAGLLGLGRGSLSFPTQISRRYGKSFSYCLVDRTSSSSSGAASRSRSSTVTFGPPSASAASFTPMVRNPRMETFYYVQLVGISVGGARVPGVAESDLRLDPSTGRGGVIVDSGTSVTRLARPSYSALRDAFRAAAAGLRLSPGGFSLFDTCYDLGGRKVVKVPTVSMHFAGGAEAALPPENYLIPVDSRGTFCFAFAGTDGGVSIIGNIQQQGFRVVFDGDGQRVGFAPKGC

SEQ ID NO: 44671 - protein, 203 aa, Sorghum bicolor
  Clone ID: SORBI-28MAY03-C9792_1.pep
MDFHTLSRPELQVLCKRNNVRANMTNAAMAEALESLDFVDGINYEMAPIPILVPASTVTTRLTARRSASRKTEMVMLNPVPAILQRSQRTATQKALDQKPKDDITEVKERAASKIPQAKLTDETCEDDGLDEDDSAEEIGSTDEENDTVFTSGLLQEFDKEMDTRPDQAFIKELLQDLKTINLNMLRATYNEFKDKTNHLSTA

SEQ ID NO: 44672 - protein, 305 aa, Sorghum bicolor
  Clone ID: SORBI-28MAY03-C1015_1.pep
KIALLSVACGLPNVGVHYETWNTGVGGPVGLHGLNEGSRDLTWQTWSYQVGLKGEQMNLNSLEGSTSVEWMQGSLIAQNQQPLSWYRAYFETPSGDEPLALDMGSMGKGQIWINGQSIGRYWTAYADGDCKECSYTGTFRAPKCQAGCGQPTQRWYHVPRSWLQPTRNLLVVFEELGGDSSKIALVERSVSSVCADVSEDHPNIKNWQIESYGEREYHRAKVHLRCSPGQSISAIKFASFGTPMGTCGNFQQGDCHSANSHTVLEKKCIGLQRCAVAISPESFGGDPCPRVTKRVAVEAVCSPTA

SEQ ID NO: 44673 - protein, 290 aa, Sorghum bicolor
  Clone ID: SORBI-28MAY03-C9554_1.pep
MSSGKRSFFAPKKKATNPFDSGSDDDKPQRRPARASSVPPPESDEQQRGGSSLSGSAGGDRAGLFSSSSTNHHYRNDFRDAGGLESQSVQELEGYAAYKAEETTRRAQGCVRIAEEMRDTASKTLVTVHQQGQQIHRTHMMAVDIDQDLSRSEKLLGDLGGLFSKKWKPKKNGAIRGPMLTRDDSFIRKGSHLEQRQKLGLADHPPRSNARQFSSEPSSALEKVEMEKGKQDDALSDLSNILIELKGMAVDMGSEIERQTKAMGDAEKDYDELNIRVKGANTRARRLLGR

SEQ ID NO: 44674 - protein, 64 aa, Sorghum bicolor
  unsure (1)..(64): unsure at all Xaa locations
  Clone ID: LIB3478-003-P1-K1-E2.pep
QWHACYYELADMLVTGAEQMLCPSLHNFQSEKLLXDLGGLFSKKWKPKKNGAIRGPMLTRGKLP

SEQ ID NO: 44675 - protein, 151 aa, Sorghum bicolor
  Clone ID: SORBI-28MAY03-C10164_1.pep
LLLLLFLQDSIGTVCRAYPCWSWMKQAALLLPSSSCPGWCGIGTPYLRRFIPIFAGEVLCQYSSLCHPRLSCSICFGFLFLPCVGRVRALYFRWCSWILLWTHAASRTASSFTSPWPHRQLLHCRFASRFLGAPLIRAPAGDGELARRRRQ

SEQ ID NO: 44676 - protein, 177 aa, Sorghum bicolor
  unsure (1)..(177): unsure at all Xaa locations
  Clone ID: SORBI-28MAY03-C996_1.pep
ANARGYRVPRGTQQHSRYLTRTSRDPPQLPPARPGRVVGPVMPYQNGDTKDPYDTRRLAMNSGYPPQQQIPQTFGYYQTHGKPACSEPSQXAERYTLHQQAYACANRTAASDVALDMRAPPFHHLSAGQKGDSSDRLTAETNLYTRSLNGIAATAAGVAATTHRKVGVVPFGMSSMY

SEQ ID NO: 44677 - protein, 153 aa, Sorghum bicolor
  unsure (1)..(153): unsure at all Xaa locations
  Clone ID: LIB3476-014-P1-K1-G8.pep
PVFCRSTIVHSAPIPVKEQPRIGPSRERPSSDESYRNPRETEKYSGNLPRTSQAPQRVPTARPGRVVGPVMPYQNGDTKDPYDTRRLAMNSGYPPQQQIPQTFGYYQTHGKPACSEPSXGXRYTLHQQAYACANRTAAFYVALDMRAPXFHHL

SEQ ID NO: 44678 - protein, 235 aa, Sorghum bicolor
  Clone ID: SORBI-28MAY03-C10260_1.pep
MGDSQYSFSLTTFSPSGKLVQIEHALTAVGSGQTSLGIKAANGVVIATEKKLPSILVDETSVQKIQALTPNIGVVYSGMGPDFRVLVRKSRKQAQQYYRLYKEHIPVTQLVRETAAVMQEFTQSGGVRPFGVSLLIAGYDDNGPQLYQVDPSGSYFSWKASAMGKNVSNAKTFLEKRYTEDMELDDAIHTAILTLKEGYEGQISSNNIEIGIIRADREFKVLSPAEIKDFLEEVE

SEQ ID NO: 44679 - protein, 414 aa, Sorghum bicolor
  Clone ID: SORBI-28MAY03-C10278_1.pep
ARGSPGCPAPPSSATRLHGVILVLALDAGFEDRARLLLRAWVEGREEAARCPAPGPPCAGVALRALHFAVPSLCGCARRWNCTEEAHRPVNCETVSKWILKNSAESENMNWILANSKPCPKCNRPIRSDRGCGPLTCTPPCKFEFCWLCLGAWSDHGEGTGGFYACNRYESAKKEGVYDETEARRERAKNSLERYMHYYERWASNQTSRQKAQADLLKAEKDQLANLTDIFGIPETQLKFIIEAWSQIIECRRVLKWTYAYGYYLDDKVKSEFFEYLQGEAESGLERLHQCAEKDLQKFLPSVKSDSTETTAPTPDEFSEFRVKLAGLTSVTRNYFENLVQALEAGLEDVRATAQAAGTSSAATSSKKGGTKSKKKQPTKPSSDHTDDGWPCERCTFLNPPSVDACSVCEKSRY

SEQ ID NO: 44680 - protein, 95 aa, Sorghum bicolor
  Clone ID: SORBI-28MAY03-C8884_1.pep
ESREERATCLPPDSQPPGIALKFIAWFIRASELIVVRQCCKHLTHTQGNRKPGTTQLYIEPKYRSRQHKTKVNSMGLRDLTQFPLIWNLMSDSFH

SEQ ID NO: 44681 - protein, 156 aa, Sorghum bicolor
  Clone ID: LIB3476-055-P1-K1-B7.pep
KVLAEFKEGIEVKGKMVRVSACQDNNTIYLGNICKGWTRDQVLNTLKSIGIQECKITFPTYKGGSRGFAFLKFASHYYAREAFCRLMKSDAVFGTDRRAKVSFSETPTKSSKSLLEAKKVYLEHVPVSWDENKIKEYCEEYGEILNSDLFQILKNL

SEQ ID NO: 44682 - protein, 189 aa, Sorghum bicolor
  Clone ID: SORBI-28MAY03-C1553_1.pep
MASVAFALAGAFKGLSLAPTTTSFLRGDRVSLSVGGGSGAVGVSVPARRLTIQMAHKKGAGSTKNGRDSKGQRLGVKIYGDQVAKPGAIIIRQRGTRVYPGNNVGMGKDHTLFSLIDGLVKFEKYGPDKKKVSVYPYEKEPENPNSYRARKREYFRMRRERKKARAEGATEPQLVLAAVDKNSEASADC

SEQ ID NO: 44683 - protein, 195 aa, Sorghum bicolor
  Clone ID: SORBI-28MAY03-C14417_1.pep
AGRVGETTSRLLTWTMFLLSVYPEWQERLREEVLRECGKENPTADMLNKLKEMTMVLLETLRLYSPVLLMLRKPISDIRLGSLSIPKGNGIVIPIPFLHRDKEVWGDNANDFDPLRFENGITNAAKTPQALLSFSIGPRSCIGQNFAMLEAKSVMAMILKKFSFTLSSSYVHAPADHITLQPKFGLPIVLRPLDV

SEQ ID NO: 44684 - protein, 413 aa, Sorghum bicolor
  Clone ID: SORBI-28MAY03-C1560_1.pep
MASPRPTSLSSPAALIHLRLQPLPSIPPLHPARGPFPRSLPLHLPSLRLNGPHLPPLPLASSGSGSAITGTGGEADLPPLPLDSSDSGSGITGTGGEDGLPPSGGGGGGGGGDGEGEGEGDGEGSDDASVNRREALFVLAQLGRKLESLPADLAAAVEGGRIPAEIVRRFVDLEASPVLGGLLQFGGFKERLLADDLFLTKVAIECGVGIFTKTAAEYEKRRENFVKELDFVIADVVMAIVADFMLVWLPAPTVSLQPPLAVNSGAIAKFFYNCPDNAFQVALSGTSYSLLQRAGAILRNGAKLFAVGTSASLVGTGVTNALIKARQAASKDFDGEVENLPIVSTSVAYGVYMAVSSNLRYQVLAGVIEQRMLEPLLHQHKLVLSAASFAVRTGNTFLGSLLWIDYARWVGVQ

SEQ ID NO: 44685 - protein, 360 aa, Sorghum bicolor
  unsure (1)..(360): unsure at all Xaa locations
  Clone ID: SORBI-28MAY03-C11074_1.pep
MLSIAMAARPVAVSRSRRPRLPTQAASAAAADSDPSSSPAVAVRGVNKQEATARRSCSRPMVLASVAVGSLVAAGAANATELWDPLALHGSSGLILADLGIGDWFGGLLFSAGQQANEAVQDQLSALSFSSLAVIFGAGLVTSLSPCTLSVLPLTLGYIGPSAXHVGAFGSGKGRSEVVGNSIAFSLGLATTLAILGVAASFAGKAYGQVGQGLPVAASGLAIIMGLNLLEVLELQLPSFFSDFDPRAAAANLPSGVQAYLAGLTFALAASPCSTPVLATLLGYVATSRDPIIGGSLLLTYTTGYVAPLLVAASFAGALQSLLSFRRYSAWINPISGAFLLGGGVYTLLDRVFPATSMAM

SEQ ID NO: 44686 - protein, 276 aa, Sorghum bicolor
  Clone ID: SORBI-28MAY03-C11413_1.pep
MAAAAHGGDYLRRFVAETEWYNAVVLSAVAPGDWWRGLPHPVQSWMRNCVGGYLLYFISGFLWCFVIYYWKRHAYIPKDAIPTNEAMKKQIVVASKAMPFYCALPTLSEYMIESGWTQCYFNISEVGFSMYLCYMAMYLIFVEFGIYWMHRELHDIKPLYKYLHATHHIYNKENTLSPFAGLAFHPLDGILQAIPHVFALFLFPTHFRTHIALLFLEAVWTTNIHDCIHGKIWPVMGAGYHTIHHTTYRHNYGHYTIWMDWMFSTLREPEDILKKD

SEQ ID NO: 44687 - protein, 496 aa, Sorghum bicolor
  unsure (1)..(496): unsure at all Xaa locations
  Clone ID: SORBI-28MAY03-C1147_1.pep
MAPFRRWXADLAAQDLLCRIGDRLDLKWYASARGACTAWRCALAPPSPALLVVADDARWCPYAASLPTRRSFELTAIVSGSRCVGSSNGWLALSVVLFSGQNVFVLLNPIAAVEIVLPPLIYESRWVSKVVFTPSPAKDDFAAAAICDIDRIAYVTAGARRWAVMEPVRLTSGDQLTDVVYTDKGKVYCLTKCGDVHVLRLPERRRRKPANADAAGRSEPEFSVLQPPQPTERINFRPLRWQHQRNFRMLRYEQARPREDPTIPLRVTFCAETFIPSYKKVPPESQGPHLNAPATVEPLLSEANLPFNPATVFAPPYDTVSSFTSAKNLVFCEGNLYQVWRNASCTVTLQLPAGGQRRVAENEILVLRYYPRRQPCWDVVKDLGGHSLFVGRNNAVSMYAEGVAGLRGNCVYWIGGRGRDQGMVFDMESGRSTPCRAPPVGFLPGHPHSTICWYFLSDVMSINNSYNTSVSSSSSGGRKVYQTRARARADLADMEE

SEQ ID NO: 44688 - protein, 209 aa, Sorghum bicolor
  Clone ID: SORBI-28MAY03-C1165_1.pep
HEDHLVETAEVLSTIDAGQRTHRACARASLLSLQIRIPDLMWIGLSETNARRIFVEQSRFQEALIVAEAYNINQPIEWAPVFWNQMLKPDLIEQFVAEFVSVLPLQPPMLLELARFYRAEVAARGEQSHFSVWLSPGGLPAEWVKHLGRSFRSLLRRTRDMRLRLQLATLATGFIDVLDICNRVLDKVPDNAGPLILRKGHGGAYLPLM

SEQ ID NO: 44689 - protein, 519 aa, Sorghum bicolor
  Clone ID: SORBI-28MAY03-C11908_1.pep
MNCQTNGSENNAASNHISANVANGSKTGENSDEESDAQSFGSKRETEIQSVEKLPDIRRDEDEVAGSSKKTESQNKSYEHEVNTKVDASKDSDGAPSGSEKNVHSKCLNGITSAKVAEQIMDNALRITDASSRRPSNLGKDLAMTEPEADRKCQSSVMENNAVTENNLGVKSKGAAICPADSCPSQFLETNLGKQHHLNGYKNQEFREKDIFNHSNSSAFSRYGNKRIEPSGEIQFFPSLCITGQEHVHGKDPVFQPIGVLLPPNEHNTGESTRQTRITLDSSPEGAAIMCSSSAREDAGVSSSSHRKDSMSHPSYGFIPVPIPVGPGMPYHYGAILQPVYYPQGPLMHCDSAGINKAAIQHGSGQSNYHEAPGKPSQDDEHKQSEENHQLHHSRQILRESGEPIEMARAHMDRANQSASCSQDICKGSGCTGSGEADINANTMVALESGNESGIQNGDRSRREAALMKFRMKRKDRCFEKKVRYHSRKKLAEQRPRVKGQFVSQKQKSATTTEAETDL

SEQ ID NO: 44690 - protein, 223 aa, Sorghum bicolor
  unsure (1)..(223): unsure at all Xaa locations
  Clone ID: SORBI-28MAY03-C1176_1.pep
LHTGKGSLYIRPLLMGSGTVLGLAPXPKYTFIIFGSPGRIFVLERAAPFCFMVGDKFHRATPGGTGGVKTIGNYASVLMAQKIAKEKGYSDVLYLDAVHKKYLEEVSSCNIFVVKGNVISTPAVKGTILPGITRKSIIDVALSKGFQVEERLVSVDELLDADEVFCTGTAVVVSPVGSITYQGKRVEYGHQGVGVVSQQLYTSLTSLQMGQTEDWMGWTVQLN

SEQ ID NO: 44691 - protein, 94 aa, Sorghum bicolor
  Clone ID: SORBI-28MAY03-C1731_1.pep
MASRLVAAAAAAASSSSSASPLARLISRRGLAGAADGHGPAKVPLWKDPLSPSKWKEEHFVLASLSMWGALIYGGFKLFGGKKEDKTEVAPAKA

SEQ ID NO: 44692 - protein, 67 aa, Sorghum bicolor
  Clone ID: SORBI-28MAY03-C17354_1.pep
SSPPSAPRCAYLDLCLIFRRFLLSLLILFFFHLALIASAGAERAHARAPSVPACGGWGKLASWGRTR

SEQ ID NO: 44693 - protein, 349 aa, Sorghum bicolor
  Clone ID: SORBI-28MAY03-C17585_1.pep
MAGKMKELDGASPAKIFIGGLSKDTSMSTFKEHFGKYGDIIDAVIMKDRYTQKPRGFGFITFADPAVVDRVIEDEHVINGKLVEIKRTIPKGAAPLKDFKTKKIFVGGLPSALKEDEFKEFFSKFGKVVEHEIIRDHTTNRSRGFGFIVFDAEKTVDDLLAKKGNMIDLNGSQVEIKKAEPKKPSNQPPRSLDSEPRGRPYADSYDGFGSSYNYGGSFGPYRSPGSFGARPGGYNSASGPGDYGSGYATYGGALVGYRGEPSLYSSRYGSTYGSSFGGGYGGGSYAGGLAGAYGREAGGYGGSSYGPSYDSSGANTGAGFGTGGLYGARTGYGSTGGSGAAGRYHPYGR

SEQ ID NO: 44694 - protein, 185 aa, Sorghum bicolor
  Clone ID: SORBI-28MAY03-C1762_1.pep
WDLKTNTEKIEAAAKKKDEGNVWFKMGKYAKASKRYEKAAKYIEYDNSFSEDEKKQSKSLKISSKLNNAACKLKLKEYREAEKLCTKVLDLESTSVKALYRRAQAYIELVDLELAELDVKKALEIDPDNRDVKLVYKTLKERMREYNRRDAKFYGNMFAKWRKLEQLQKVPGKQELQPMAIDSAA

SEQ ID NO: 44695 - protein, 373 aa, Sorghum bicolor
  Clone ID: SORBI-28MAY03-C13599_1.pep
NNATTQPISPTRPGNDQARPNPAGAARERSAGPGRRRPGRPGPSGGGSARGGERRLPAASDPVGEGRGSCLPDVPRRRGVGRRRRGGTTSAVVCGAGARRIFVDDSLWQEVLLPLRRRPPPAVPKVPPLLPSPPAGGGGRTRGRRREALVHHLLALFPDMDPQLLEKALEASGDDLDSAIKSLNLLRLESTSTGFKPENGQHTTIQPSVEGIPNGGVDTVTVTEHPPTVDNYQTSNNGSEWVELFVREMTNASDIDDARARASRALEALEKSIVERAGAEATQNVHKENMMLKEQLTVVLRENAVLKRAVAIQHERQKEFDERSHEVQSLKQLVLQYQEQVRTLEMNNYALTMHLKQAQQNSSIPGRFNPDVF

SEQ ID NO: 44696 - protein, 577 aa, Sorghum bicolor
  unsure (1)..(577): unsure at all Xaa locations
  Clone ID: SORBI-28MAY03-C13601_1.pep
MELLNIILVIASLLPFSASDRQGDALYDMKLKLNATGSQLSDWNQNQVNPCTWNSVVCDNNNDVVQVTLASMGFTGVLSPRIGDLEYLNVLSLPGNNITGGIPEQFGNLSRLTSLDLENNLLVGPIPASLGRLSKLQLLILSQNNLNGSIPDTIASISSLTDIRLAYNKLTGQIPSQLFQVARYNFSGNNLTCGANFLHQCASNMSYQGSSHGSTIGIVLGTVGGLMGLLIIGAIFIICKGRWACRLRQLATGCFSEKNVLGQGGFGKVYKGALPDGTKIAVKRLTDYESPGGEAAFLREVELISVAVHRNLLRLIGFCTTQTERLLVYPFMQNLSVAYRLREFXTWEPILDWSARKRVAIGTARGLEYLHEHCNPKIIHRDVKAANVLLDEGFEPVVGDFGLAKLVDVQKTSVTTQVRGTMGHIAPEYLSTGKSSERTDVFGYGIMLLELVTGQRAIDFSRLEEEDDVLLDHVNNVQREGHLDAIVDRNLNNNYNGQEVEMMIQIALLCTQASPEDRPSMSEVVRMLEGEGLAERWEEWQQVEVTRRQDYERMQQRFDWGEDSVYNQDAIELSAGR

SEQ ID NO: 44697 - protein, 117 aa, Sorghum bicolor
  Clone ID: SORBI-28MAY03-C13864_1.pep
HDLHTSDCLHELRPGDHIEIQWRRNKEFPYGWWYGVVGHLESCDGNEHFCRCHLSDTVVLEFNQYTPGSRWRQALVNRKEHREEGNEGDGFYGGVRKLRSKDDISKWRQLWPTDILE

SEQ ID NO: 44698 - protein, 166 aa, Sorghum bicolor
  Clone ID: SORBI-28MAY03-C14035_1.pep
MAAAAAAADGERRIGVAMDYSESAKKALDWAIDNLLHHGDTLVVLHVLHHSGEETKHALWAKSGSPLIPLSEFREPEVMQGYGVRTDAEVLDMIDTAARQKQLKVVAKLYWGDAREKLCDAVGDLKIDSLVMGSRGLGPIQRILLGSVTNYVLSNASCPVTVVKGK

SEQ ID NO: 44699 - protein, 246 aa, Sorghum bicolor
  Clone ID: SORBI-28MAY03-C14098_1.pep
NLGIYVEDGNKELSVLVDRSIGGSSIKDGQIELMLHRRLLHDDGRGVAEALNETVCLDKQCEGLIIQGKYYVKIDPQGEGARWRRTFGQEIYSPLLLAFTEQDGGNWANSHVAKFSAMDSTYSLPDNVAMLTLEELEDGSVLLRFAHLYEAGEDKDLSALASIDLKRVFPDNKIGKIIETSLSANQERTAMEKKRLKWKVQGSAADEKVVRGGPVDPSKLVVELGPMEIRTFIVSFDHNIRDKQLL

SEQ ID NO: 44700 - protein, 141 aa, Sorghum bicolor
  Clone ID: SORBI-28MAY03-C14125_1.pep
MGIGEHFEGLKQHWASNLAFLDYFKKVYGRAEPLPKWTDADVDEFIASDPVYGPQLKALRESRKFALAGGFIGAAHLGGVALKFSKAPHGVLLATGFGAITGAVLGSEVAEHWYQLYKMDRQGANLRFIYWWEDKVSGQKS

SEQ ID NO: 44701 - protein, 254 aa, Sorghum bicolor
  Clone ID: SORBI-28MAY03-C14264_1.pep
MGRDERFPVWEAALGAGVAAAFAAGLVGVYLSMPDSDYSFLKLPRNLEELQILTGHLENYTSDYTLQVLVGYCAVYIFMQTFMIPGTIFMSLLAGALFGQLRGLALVVFAATAGASSCYFLSKMIGKPLVFTLWPDKLSFFQRQVAKRREKLLNYILFLRVTPTLPNTFINLASPIVDVPYHTFLLGTLIGLIPAAYVTVRAGIALGELTSLSDLYDTQSIALLFLIGVVSVTPALLGKDEAQEKPSEMVVGAS

SEQ ID NO: 44702 - protein, 285 aa, Sorghum bicolor
  unsure (1)..(285): unsure at all Xaa locations
  Clone ID: SORBI-28MAY03-C12168_1.pep
FEGILQAGSTIVENLRTYNQPAFVYIPMAGELRGGAWVVVDSKINPDRIECYAERTAKGNVLEPQGLIEIKFRSEELQDCMGRLDPELINLKAKLQDVKHGNGSLPDIESLQTSITSRXRDPEPGGQALVAQAALHGLPHARRGAHAPQAQGGQVMCCEFIDTKERRVNNFVGWLLRFDLLYVNKHVFRLRSLIDRVPFFCTFLHPRRFALFISAHALRAHYCTSLVAHASSHVLVAXNCTHSISELHDSSSDLQAFSQGLSTLLDKMDPSQRAKFVQEVKKVLG

SEQ ID NO: 44703 - protein, 330 aa, Sorghum bicolor
  Clone ID: SORBI-28MAY03-C20754_1.pep
MVKSKAIRVHELGGPEVLRWEEVEVGEPGEGEIRIRTTAVGVNFIDIYFRKGVYAAPTLPFTPGMEAVGVVTAVGPGLTGRKVGDVVAYAGNPMGSYAQEQILPAAVAVPIPPSVDHKQAASVMLKGMTAHVLLRRVFKVENGHTVLVHAAAGGVGSLLCQWANALGATVIGTVSNQDKAAQAAQDGCHHPIIYTSEDVVARVKEITSGKGVNVVYDSVGKDTYKASLECLAPCGFLVSFGQSSGKPDPIPMSDLASKSLFLTRPSLMHYTATRDELLESAGEVFANVANGVLRVRVNHTYPLSEAAQAHADLEGRKTSGSIVLIPDTVS

SEQ ID NO: 44704 - protein, 123 aa, Sorghum bicolor
  Clone ID: SORBI-28MAY03-C19829_1.pep
NWGTHYFFFFLAHIHFINCSPPEISAHHTQSNHQTSRLTIGETAARTQQATNTTHTSQKSAHTSHNIISKSPVLQFKNLHYMAIIKSSLTVFGSTKYSFQLPNSFQLRKFKVNVVTAAQTLAA

SEQ ID NO: 44705 - protein, 612 aa, Sorghum bicolor
  Clone ID: SORBI-28MAY03-C2228_1.pep
MSPPAMLLPVCSAAPSCSPLCPVTASHVVARVPRRVDVGAALRSYADPLVAQVPDRPPLADSSILSPYTAAPDDIARAFGAPASELPPLPSADPSAGLCCTGTDQPLTAVADLAATAVVNSAPTDAAERALSDAPFPSTFPSDASEVEDSVARFIDKVGKQVFQAEDALTEAYDKLRLSAYDALGAWRKTVRDTIGGLKASVDAGKEQAAGGVTDASGALQAKVAGAGAVAVDVLRKAIVSAEDSLGSAATFVVYSYGSAKESLPPNVRDLLSSSEEKAGLVLRPIGNALQQVYVIVEGVEKNVGFDPSDPIVQLAVVLGGSVTIGTTYWLFIYGGYSGDLSPESALELLKNDGKAVLVDVRPENLREKDGVPDLRLGARSKYASVDSPEIKGPVKSMLKGGREVDDALLAAVIRNLKLVKGDSKVIVMDYNGARSKAIARLLKKLGVQRPYLVKGGFQAWSKNLRVKELKPETALTSINEDVEEILEQIKPTPTLVFGSLLGLSALSYALLEWEMTLQYIAVLSVGLTIYLRFSTYERSEDLEQDLKLLLSPVRVGADAVSWAAKKIEPNKVGLPTSPSTTAVKDRVLQAAAKHESQPADAEESSAQTAEA

SEQ ID NO: 44706 - protein, 469 aa, Sorghum bicolor
  Clone ID: SORBI-28MAY03-C22445_1.pep
MPTEEQQPPPAPAPAPPGLRYLSGLGNSFSSEAVPGSLPVGQNSPLVCPLGLYAEQLSGTSFTTPRARNLRTWLYRIKPSVTHEPFYPRNPTNERLVGEFHRATTVATPTQLRWRPADVPLHPDLDFIDGLYTVCGAGSSCLRHGYAIHMYAANKSMDGCAFCNADGDFLIVPQQGRLLITTECGKLLVSPGEIVVIPQGFRFAVDLPDGPSRGYVSEIFGTHFQLPDLGPIGANGLASPRDFLSPTAWFEQDHHPGYTIVQKYGGELFTATQDFSPFNVVAWHGNYVPYKYDLSKFCPFNTVLFDHGDPSVNTVLTAPTDKPGVALLDFVIFPPRWLVAENTFRPPYYHRNCMSEFMGLIYGIYEAKADGFLPGGASLHSCMTPHGPDTKTYEATISRAGANEPFRLSGTLAFMFESSLIPRVCRWALDSPCRDLDYYQCWIGLKSHFSHDNGGVATIEPAAGTDEKE

SEQ ID NO: 44707 - protein, 267 aa, Sorghum bicolor
  Clone ID: SORBI-28MAY03-C6153_1.pep
ETSCHPRERSRGAAARFRFRCRGEEFFPRPRLPELRAKITEKENLILSVPGAPLRAVVYSSRIERGARRDQENPNHVVNPIYSLFDSTGLFSSRQEGRRTNKIRSLSGKSIMAAAGAALLRSVATKMARAPPRLPSALERHRRLSTSSRFSTSTGSTPQPANQGPQTHNQEVPSSLWYRAIVAFNEAASVVTFFLLGGIAFMHFSVSPALDRMEADLDAQRKSWATIREEIKKSHERTRAILVSNKESQIEATDVFEGKRITGIGTK

SEQ ID NO: 44708 - protein, 187 aa, Sorghum bicolor
  Clone ID: SORBI-28MAY03-C2385_1.pep
MAASTASRTNSRVNYSNDHDIGTVQNSTMMPPTYYDRSLADIFPPHLLKKVVSEVVSTFLLVFVTCGAAGIYGSDKDRISQLGQSVAGGLIVTVMIYAVGHISGAHMNPAVTLAFAVFRHFPWIQVPFYWAGAATGAICASFVLVPVLHPISVLGCTTPTGPHWHSLIIVIVVAFNMMFVTLAVATD

SEQ ID NO: 44709 - protein, 143 aa, Sorghum bicolor
  unsure (1)..(143): unsure at all Xaa locations
  Clone ID: LIB3478-021-P1-K1-A12.pep
IHDLSTVQSGSAVPTLFYPDKSIADIFPPHLGKKVISEVVATFLLVFVTCXAASIYGEDNKRISQLGQSVAGGLIVTVMIYATGHIXGAHMNPAVTLSFACFRHFPWIQVPFYWAAQFTVAMCAAFVLKAVLHPIXVIGTTTP

SEQ ID NO: 44710 - protein, 190 aa, Sorghum bicolor
  Clone ID: SORBI-28MAY03-C2432_1.pep
CKQEGARLHAVASNDVLWKKKVRFIHALGFQSEDSKLKILGGIVQASANRAKVIGPAPVLYSAPSYCCFSAVEAVFDADTDSDSPQALITASFCQSRLRRFLALFLRVVVSLMRFHSRPGESFRLTTSSARVAQNAPPSRPPPAIAAGSASLFFLLFLARRRWRWWRRRSETGVSRTGEGFRKVGPARPA

SEQ ID NO: 44711 - protein, 200 aa, Sorghum bicolor
  Clone ID: SORBI-28MAY03-C24420_1.pep
NTKIGSFSVPAASMNSAEVIFMLIWVVFQDSIVIPIARRYTGNPMGLTLLQRMGVGRLLAIPSLAAAALVETWRLRSVRAGHNLSIGWQLPQFVILACSDVFCGIAQLEFFYAEAPASMRSLCSAFQFLAMSLAYYVNTLVVSLVAAVTTAWGGQGWLPADLNDGHLDYYFWLWTGISVVNYVVYTAFARRYTVKKVVLQ

SEQ ID NO: 44712 - protein, 199 aa, Sorghum bicolor
  Clone ID: SORBI-28MAY03-C24602_1.pep
MGGFEDDEPPSKRARASSVESASLPDYFSFSKSVNPLGSTMARPLPSQGKEVMVGSKGVIKKEEFVRIITKTLYSLGYEKSGAVLEEESGIILHKPMVNLFREQVIDGNWDNAVVTLNKIGLQDENIVKSASFLILEQKFFELLRNDDVMGAMKTLRCEITPLGVNRKRVHELSTCMISCSPQQLVLGFSKLGIDSSSS

SEQ ID NO: 44713 - protein, 158 aa, Sorghum bicolor
  Clone ID: SORBI-28MAY03-C25410_1.pep
MATLNMFELLGADDNDDPSQLIAAAEAAAQKAEAKKSAAAPAGKAAQPAAAAKFPTKPAPPSQTVRDARGGGASARGGFGRGERGRGRGGRGYGQNRDFSGDNANGFQGGYGGGGYGGGGYGDGAVTGGAEGERERGPRPPYRGGGRRGGYRNGEFGD

SEQ ID NO: 44714 - protein, 168 aa, Sorghum bicolor
  Clone ID: SORBI-28MAY03-C25278_1.pep
RPFNCKLLYHDRLRIDPALEAETGAQFEADLDAMLPKCDVVVLNMPLTEKTRGMFDKERIARMKKGVIIVNNARGAIMDTQAVADACATGHIAGYGGDVWHPQPAPKDHPWRYMPNNAMTPHISGTTIDGQLRYAAGVKDMLERYFKGQDFPVQNYIVKEGNLAGQYQ

SEQ ID NO: 44715 - protein, 258 aa, Sorghum bicolor
  Clone ID: SORBI-28MAY03-C2525_1.pep
MATRVWLTALLLAFLLAASPFTARVARADSEEDAAAAEVVEGADLGIVGDDTQVSSDGPLSPAPGVETVVVFPKNAGKIVPAGEETELLVGLQNDGESTLNVVAVHSTLHLPFDHRMYGQNLTVQNFFNASVPVSVQATFPYKFVVSKFLQPGAYDLVGYIVYEIDQHPYQNVFYNGTVEVVEAGGLLSVESVFLITLGIALLGLFGLWAYGQVQQFSKKTKKAPKVELGTGTTDANIDEWLEGTSFVQRSKSKKKQT

SEQ ID NO: 44716 - protein, 299 aa, Sorghum bicolor
  Clone ID: SORBI-28MAY03-C25472_1.pep
MADDAFDLPISGEGEEEVMGGLEEEEEAIKDLDAGVDADEDYFPPTMKAGEEREIGKEGLKKKLVKEGQGWDPPPTGAAAPARCSAPPADGPPFDSSRDRGTPFKFKLGQGQVIKGSAPAGGPASSGPPATPPTPPPRPPPPPPSPSASPPPATPPCARPPPSWASVKDICKDGGIFKKILVEGEKWENPKDLDEVFVKYEARLEDGTVVSKSDGVEFAVKDGYFCPALAKAVKTMKKGEKVLLTVKPQYGFGEQGKQASGDEAAVPPNAMLHIDLELVTWKTVTLIGDRKRILKKVLK

SEQ ID NO: 44717 - protein, 349 aa, Sorghum bicolor
  Clone ID: SORBI-28MAY03-C25484_1.pep
TRAAAAARGGGGGGTEDGMYTELWSLCAGPLVTVPRVGDKVYYFPQGHIEQVEASTNQVAEQHMQLYNLPWKILCEVMNVELKAEPDNDEVYAQLTLLPESKQPEENGSSQEEMPAAPPAALARPRVHSFCKTLTASDTSTHGGFSVLRRHADECLPPLDMSRQPPTQELVAKDLHGVEWRFRHIFRGQPRRHLLQSGWSVFVSAKRLVAGDAFIFLRGDNGELRVGVRRAMRQQANVPSSVISSHSMHLGVLATAWHAVNTGTMFTVYYKPRTSPAEFVVPCDRYTESLKRNYPIGMRFKMRFEGEEAPEQRFTGTIVGNVDPEQAGWAESKWRYLKVRWDEASSIPR

SEQ ID NO: 44718 - protein, 201 aa, Sorghum bicolor
  Clone ID: SORBI-28MAY03-C25598_1.pep
ARGRDITPPIGIKQAMEMQAEAERRKRAQILESEGKKQAQILESEGKKTAQILESEGAMLDLANRAKGAAEAILAKSEATARGMRLVSDAMTTEGSAKAASLKLAEQYIEAFSNLAQKTNTMLLPGDSASPASFVAQAMKTYEHIHSHNQALKSHPQIQELEESGETSPAAPSSEASTMPPLIEDADSNQTFTLQRPKNKK

SEQ ID NO: 44719 - protein, 150 aa, Sorghum bicolor
  Clone ID: SORBI-28MAY03-C3100_1.pep
MGSDTETEKKKTPVALMPIAKPLAGKKLCKRTLKLVRRASEAKCLKRGVKEVVKSIRRGNKGLCVIAGNVSPIDVITHVPILCEEANVPYIYVPSKEDLATAGTTKRPTCCVLVLTKPTKGELSEEVKDKLKSDYDQVVTEVAEATSAMF

SEQ ID NO: 44720 - protein, 110 aa, Sorghum bicolor
  Clone ID: SORBI-28MAY03-C17942_1.pep
MATATRRLLPALLKTLAPAGARGLSTEKAVGAAAVVGSHTAKWMQDTSKKSPMELINEVPPIKVDGRIAVCEGASEGVGLGHPIEYICLDLEAPNVCKYCGLRYVQVHHH

SEQ ID NO: 44721 - protein, 99 aa, Sorghum bicolor
  Clone ID: SORBI-28MAY03-C17489_1.pep
MLEGKARVEDTDMPARMQAAATTAASRALDLFDVADFRGIAGHIKTEFDKRYGVGWQCVVGASFGCFFTHTSGTFIYFSLERLSFLLFKAAAAVAVAAS

SEQ ID NO: 44722 - protein, 163 aa, Sorghum bicolor
  Clone ID: SORBI-28MAY03-C18324_1.pep
HEGRLSLEHLTSSYKKANRRMIFLDYDGTLVPQASHDKSPSAELISILNSLCNDMKNTVFIVSGRGRDSLSEWFVSCENLGIAAEHGYFIRWNKAAEATSLSEPAISEVFACSVGPKASKANYYVDGCSEVIRLLKGVTAISPQKDTVSHSHAVFKDTLEVIS

SEQ ID NO: 44723 - protein, 328 aa, Sorghum bicolor
  Clone ID: SORBI-28MAY03-C180_1.pep
MRTPAMLRWAAALAVLLAVAAPAAGFYLPGVAPSDFAKGDLLPVKVNKLTSIKTQLPYTYYSLPFCKPDTIIDSAENLGEVLRGDRIENSPYVFKMGEPKMCQIVCKAKIGEKEAKELKEKIEDEYRVNMILDNLPLVVPVKRQDKNSIAYQGGYHVGLKGLYSGTKDEKYFIHNHLSFAVKYHRDENSGLSRIVGFEVNPHSVKHQVDDKWNGVDTRLSTCDPHASKFVTNSDNPQEVETDKEIIFTYDVHFEESEIKWASRWDTYLLMTDDQIHWFSIVNSLMIVLFLSGMVAMIMLRTLYRDISRYNQLETQEEAQEETGWKLVH

SEQ ID NO: 44724 - protein, 212 aa, Sorghum bicolor
  unsure (1)..(212): unsure at all Xaa locations
  Clone ID: LIB3481-049-Q6-K1-H1.pep
ASDLGYSSNGRAQECQIVCKAKIGEKEAKELRKXEDEYRVNMILDNLPLVVPVKRQDKNSIAYQGGYHVGLKGLYSGTKDEKYFIHNHLSFAVKYHRDENSGLSRIVGFEVNPHRFTSNSVWQDFILLVIYEMDLRYFVTYVDSVKHQVDDKWNGVDTRLSTCDPHASKFVTNSDNPQEVETDKEIIFTYDVHFEESEIKWASRWDTYLLMT

SEQ ID NO: 44725 - protein, 207 aa, Sorghum bicolor
  Clone ID: SORBI-28MAY03-C18745_1.pep
MCGGAILDDLREPELRRVTDRDIWQKKKPKRGGGGGRRSFAAEDHEDFEADFADFEADSGDSDLELGEGADDDVVEIKPFAAKGTFSGDGLSTMTTADYDAPVARSAKRKRKNQYRGIRKRPWGKWAAEIRDPQKGVRVWLGTFNSPEEAARAYDAEARRIRGKKAKVNFPDAPAVGQKRRSGSASAKAPKSSVEQKPVVKAPMTNL

SEQ ID NO: 44726 - protein, 465 aa, Sorghum bicolor
  Clone ID: SORBI-28MAY03-C1985_1.pep
YSEAKEQLDLAKRIGKEELMVEDYGDVEIEYELAPVSAQLAYVQQLQGQSQEALQTYLNMINGQSADPSSLAVATTNLISLKGTKDTADSLKKLDRLIGTTTAPNQLHLVENLDFKLSPRQKEALYSARVLLLLHANKTDQAHELVSGLLGMFPDSVFPVLLQAAVHVKEKKVQKAEDVLSQYAEKNPENSKGLLLALAQIAANANHFQLAADSLCRIPDIQHMPATVATLVALKERLGDSNAAASVLDSAIHWWKNSMTEDNKLDMLTREAASFKLSHGHDEEACLLYEELVKSHGSIEALAGLVMTSARTNLEKAEQYEKKLKPLPGLKGVNVESLEKTSGARHVEGPQDMKVDVPEEVKKQKAKKRKRKPRYPKGFDPANPGPPPDPERWLPRRERSSYRPKRKDKRAQVRGAQGAVSRETAATNAGGSSKGSQTTSSSKTPAANTDQPKTSNKSRKKKSRS

SEQ ID NO: 44727 - protein, 279 aa, Sorghum bicolor
  Clone ID: SORBI-28MAY03-C2034_1.pep
MEFLHGQRLETTVAIAVAVVAVAAGAAYLFLRSRKTRGCLDPENFKEFKLVEKRQLSHNVAKFKFALPTPTSALGLPIGQHISCRGQDAAGEEVIKPYTPTTLDSDLGSFELVIKMYPQGRMSHHFREMKVGDYMSVKGPKGRFKYLPGQVRAFGMIAGGSGITPMFQVTRAILENPKDNTKVHLIYANVTYDDILLKEELDSMAKNYPDRFKIYYVLNQPPEVWDGGVGFVSKEMIQTHCPVPAADIQVLRCGPPPMNKAMAAHLDDLGYTKEMQFQF

SEQ ID NO: 44728 - protein, 382 aa, Sorghum bicolor
  Clone ID: SORBI-28MAY03-C28492_1.pep
MDPAREPLAGGGGLQRRAAAAARSGGGPQEPPPRGQRATIHADVDPPPRPWPWMQKLAIVAIVVLGCLHVLPATHFRDPNDPQRNWIPIDGSGNPTGSLNYVGSVDVFSWISCLDLRTLAVMTNSTLSSSSDPQNISFHFLIPEGGNDKSSYHKLKALLPDSDLTVTSQKQIKDKLNVATPEGNFLWLFHMELSPFLIAKSQLSKKRYVYIAADSIIKGKVEDLGRMDLGSYAIGAVLDCSKRLNDYISMDVLSAIQRAGAAQSWVSKEPYNKDACLLDFDVLLIEPRKLDKNLVASIMWWINAINLANQRDQIRLAVTLAFNDKYMKLPSNWKRKDGDTDILNFDGPKIVCSEDGRQHEQSGYGATWQQYLNQKSEAILNI

SEQ ID NO: 44729 - protein, 175 aa, Sorghum bicolor
  Clone ID: SORBI-28MAY03-C29031_1.pep
HEADAELRLLEVFYHKIYKIFPPHEKIENINDQYWTLRAEEIPEEEKNLGPHDRLIHVYHFMKDPNQNQQIQSFGDPFLMVIREGETSAEVMERIQRKLRVPDEEFSKWKLAFISMNRPEYLQDTDVVSARFQRRDVYGAWEQYLGLEHTDTTSKRSYTANQNRHTYEKPVKIYN

SEQ ID NO: 44730 - protein, 166 aa, Sorghum bicolor
  Clone ID: SORBI-28MAY03-C29259_1.pep
ARGKLATAMVADKEVPTKFQPPDMLDKQIGLLPGVVFDSTPHGVKFGDVSSDVPASSTFSKGSIVNATFYSACPRNDLLTDGTFALVEKLEGTDNWVPAYDDDDWSLRFKWSRPSKLSSRSFATLEWTIPEDAPSGVYRLRHFGASKPLIGSINHFTGTSRAFAVR

SEQ ID NO: 44731 - protein, 262 aa, Sorghum bicolor
  Clone ID: SORBI-28MAY03-C29588_1.pep
TRVDTYDVMRSGVPNFCAVALALNDMGYKAVGIRLDSGDLAYLSIETRKFFRAIEKEFGVVGFEKTRITASNDLNEETIDALNKQGHEVDAFGIGTNLVTCYAQAALGCVFKLVEINKQPRIKLSEDVSKVSIPCKKKCYRLYGKEGYPLVDIMTGEDEPGPKIGERLLCRHPFNESKRAYVVPQHVEELLRCYWPGTSSNPREVLPSIHEIRTRCIHHLDRMRPDHMRRLNPTPYKVSVSTKLYDFIHFLWLNEAPVGELQ

SEQ ID NO: 44732 - protein, 135 aa, Sorghum bicolor
  Clone ID: SORBI-28MAY03-C23368_1.pep
MASSLASTPVFPSCGARRGARCVARASASAVAVASPSAARTHYEVLGVGAGASRCEIKAAYRRLAREVHPDAGGRGDEGFIRLHDAYATLADPDERARYDRAVAVAAPVRSGSWAAPSGSGSGFRPRRWETDQCW

SEQ ID NO: 44733 - protein, 60 aa, Sorghum bicolor
  Clone ID: SORBI-28MAY03-C2242_2.pep
MAKSKNHTAHNQSYKAHKNGIKKPKRHRQTSTKGMDPKFLRNLRYSRKGNKKSGEAEAEE

SEQ ID NO: 44734 - protein, 60 aa, Sorghum bicolor; identical to SEQ ID NO: 44733
  Clone ID: SORBI-28MAY03-C2242_1.pep

SEQ ID NO: 44735 - protein, 380 aa, Sorghum bicolor
  Clone ID: SORBI-28MAY03-C24_1.pep
MASVAELKEKHAAATASVNSLRERLRQRRETLLDTDVARYSKSQGRLPVSFNPTDLVCCRTLQGHSGKVYSLDWTPEKNWIVSASQDGRLIVWNALTSQKTHAIKLHCPWVMTCAFAPNGQSVACGGLDSACSIFNLNSQADRDGNMPVSRILTGHKGYVSSCQYVPDQETRLITSSGDQTCVLWDVTTGQRISIFGGEFPSGHTADVQSVSINSSNTNMFVSGSCDTTVRLWDIRIASRAVRTYHGHEGDVNSVKFFPDGHRFGTGSDDGTCRLFDMRTGHQLQVYSRVPDRNDDELPTVTSIAFSISGRLLFAGYSNGDCYVWDTLLAEVVLNLGNLQNSHDGRISCLGMSSDGSALCTGSWDKNLKIWAFSGHRKIV

SEQ ID NO: 44736 - protein, 173 aa, Sorghum bicolor
  Clone ID: SORBI-28MAY03-C24542_1.pep
LTNAVRVGDLELFRAVADKFASTFSADRTRNLIVRLRHNVIRTGLRNISISYSRISLADIAKKLRLDSENPIADAESIVAKAIRDGAIDATIDHANGWMVSKETGDVYSTNEPQIAFNSRIAFCLNMHNEAVKAMRFPPNSHKEKESAEKRRERLQQEEELAKHMAEEDDDDF

SEQ ID NO: 44737 - protein, 501 aa, Sorghum bicolor
  Clone ID: SORBI-28MAY03-C24554_1.pep
HEGDATAGAGGAAEGAASGRPRYKMEELVPGGRVGREAFQAFLGYMYTGKLRPSPVDVVSCADPVCPHDSCPPAIRSAVELMYAACTFKIPHLASLFQRRLLNFVDKTLVEDVIPILKVASHSGLTQVIDKCIQRIARSDLDDISLDKELPPEAVEERKNLRKKSQTADGDGDAFISDPVHEKRVRRIHRALDSDDVELVKLLLNESDSTLDDANALHYAASYCDNKVVSELLDLALANLNLKNSRGYTALHLAAMRREPAIIMCLLNKGANVSQLTADGRSAIGICRRLTRLKDYNTKMEQGQESNKDRLCIDILEREMMRNPMAVEDAVTSPLLADDLHMKLLYLENRVAFARLFFPAEAKVAMQIAQADTTEEFGGIVAASTSGKLREVDLNETPVTQNKRLRSRVDALMKTVELGRRYFPNCSQVLDKFLEDDLPDGLDQFYLQRGTADEQKVKRMRFCELKEDVLKAFSKDKADSSMLSGLSSSSSCSPPQKSAKR

SEQ ID NO: 44738 - protein, 193 aa, Sorghum bicolor
  Clone ID: SORBI-28MAY03-C24778_1.pep
MDKYELLKDIGSGNFGVARLTRNKDTKELVAMKYIPRGLKIDENVAREIINHRSLRHPNIIRFKEVVLTPTHLAIVMEYAAGGELFDRICSAGRFSEDEARYFFQQLICGVSYCHFMQICHRDLKLENTLLDGSPAPRLKICDFGYSKSSLLHSKPKSTVGTPAYIAPEVLSRREYDGKMADVWSCGVTLYVM

SEQ ID NO: 44739 - protein, 377 aa, Sorghum bicolor
  Clone ID: SORBI-28MAY03-C2376_1.pep
MAGKGAKATAAKSSDKDKGKKAGGPVSRSSRAAPQEKEKSAPKKDVYQLFAEKVRDNKQLESRWAIMQETRVEYFRGKDFNTFIKNHPEVREILGPDKDLEVEDIVNTLLTKNLVIRCDRVMKTVRPGKKKLSSWPAHLEIHNEQVFTENDGFFAWMFLKRRTLWQTILSFVWPLFALAVCLFPVYPYQCKIVVLYSCAGALLFIVSILLLRAAIFGILWVLLGKRVWFFPNINAEETTFRELVRFWPEKDEGERPKWTSRLFYALVALLVILLLRHHAPDEAARARYQKKVSNIIDDVLEWSPKLAISGMIEKHTGANITEESNYTSRAASSHVPPSTEGKASEGGPDMDVDGDNGANLDETQDNEYADDTRSSEA

SEQ ID NO: 44740 - protein, 273 aa, Sorghum bicolor
  unsure (1)..(273): unsure at all Xaa locations
  Clone ID: SORBI-28MAY03-C33179_1.pep
MAASARDSADAAERVVDDHDGWVSDGEMDVEMDVEGEFQDLDADRRDGGADGDDEYLLLTRIRDTSAAEARAGKDIQGIPWERIHIARQDYRKARLEQYKNYENFPQSGELMDKLCKQVEKSSKYYEFQHNTRSVKPSILHFQLXLWATSKHDVYFMSNSTVSHWSALSHKLSEVLDFSGHVAPAEKHPGSLLEGFSGVQVSTLAVNEGLLVAGGFQGELIGKDLEGRNVKFCARTTLSDNAITNAIDIHRSTSGSLRITVSNNDCGVREYDM

SEQ ID NO: 44741 - protein, 279 aa, Sorghum bicolor
  unsure (1)..(279): unsure at all Xaa locations
  Clone ID: SORBI-28MAY03-C33315_1.pep
MAAAAVTSNGGAVAANGGPAPGRLASVYSEVQTNRLLHALPLPSVLRSNFSVVDGPASSAAGNPDEIAKLFPNLFGQPSASLVPAAEPAATRPLKVGVVLSGGQAPGGHNVICGIFDYLQERAKGSTMYGFKGGPAGVMKCKYVELTADFVYPYRNQGGFDMICSGRDKIETPEQFKQAEDTANKLDLDGLVVIGGDDSNTNACLLGEYFRSRNLKTRVIGCPKTIDGDLKCKEVPTSFGFDTACKIYSDMIGNVMTDARSTGXYYHFVRLMGRAASHI

SEQ ID NO: 44742 - protein, 277 aa, Sorghum bicolor
  unsure (1)..(277): unsure at all Xaa locations
  Clone ID: SORBI-28MAY03-C33509_1.pep
MASVLLVASATALLALAAAWLWDYAVVRLLWRPRAVAGMFGAQRGRGPPGSFRRRPRREVGRVKAPADAARLPRRHLSHLRRALLHYLAATQRCARPFLDWFTPQPRPPLLGVGSAGSVLXSGQSFKIDAHPTILALLGKGLVLVEGTDWVRHRRVVNPAFAMDKLKTMKTTMVSCAEPLIKEWERLASSNESREVEVEFSKLFQDLTADIISHTGFGSSYKQGKEVFHTQRQLLALAVATLLNVQLPGLKYLPTKNNRLKWMLDKKIKTMLMAIIQ

SEQ ID NO: 44743 - protein, 262 aa, Sorghum bicolor
  Clone ID: SORBI-28MAY03-C25758_1.pep
MAAANLLSRSLLPTPNPTQTSHPNRRSPAVVSFPRRHGRLSVRASVSTASPSPPPQPAAAAAAGVPKHCFRRGADGYLYCEGVRVEDAMAAAERSPFYLYSKPQILRNFAAYRDALQGLRSIVGYAVKANNNLPVLRVLRELGCGAVLVSGNELRLALQAGFDPARCIFNGNGKTFEDLKLAAESGVFVNVDSEFDLENIVRAARATGKKVPVLLRINPDVDPQVHPYVATGNKTSKFGIRNEKLQWFLDSIKSYPDEIKLV

SEQ ID NO: 44744 - protein, 140 aa, Sorghum bicolor
  Clone ID: SORBI-28MAY03-C26550_1.pep
SFTAKEQTGTKQADDGKKPQEAGASSSAHAEDEKKADRGLSLMGSAIRPGIAPNVKFGGSGSYPDLPWVSTNGAGPNGRTISGVTYKFGRNEVKIVCACHGTHMSPEEFMRHASADAPAQENSATLPAFPVGNQATSAEN

SEQ ID NO: 44745 - protein, 250 aa, Sorghum bicolor
  Clone ID: SORBI-28MAY03-C2687_1.pep
SGNGFREYQPKGLNPPNGNQFGFTVGPLQDQMLHQQKVHAPPYSSPFMGFHNHPLAVPTNGYLPYPQPGHFYPGPMAPVGYGVTGNQCVDFPMQYSNNIHPYTGPEFGFLPSQPVHKTPVSFHAVPVPPLTPLCRSGVPVVINQERQQSPALFPKLKQAVSVPETSCAEDNTVKHKGDDTDSTPFSLFQFNLPIAAPSLATSKEEQSGAMPSTAPAPAQIARAQPCSREETNVKEYNIFSGCNGVMFQLN

SEQ ID NO: 44746 - protein, 281 aa, Sorghum bicolor
  Clone ID: SORBI-28MAY03-C2697_1.pep
MQALLLPARAAPPAMLRQRAVSGSACASQVCRTLLSASGCLSCGVHGSARRHLTVAVAAASSSSSPSSGPLYPTPPPTEQEVERVKLEQVMKRLEKTARYFKNLGSFGFWSQLVCTIVSAGILAFSTVVTGKVTAPFTFYATAAGIAAAFISVFWSFGYIRLSERLRRTSKEPAKAPPRADVVKSLKNGIVLNILGMGAAVLGMQATVGALVAKALTTSAVPYYAAAPGQSPVLALDVFLVQASANTILSHFLGLASTLELLRSVSLPPAEAAPAPTPARA

SEQ ID NO: 44747 - protein, 173 aa, Sorghum bicolor
  Clone ID: SORBI-28MAY03-C2706_1.pep
MAPSQLPELELSPTAIFTRCKVCGGCEEKDKRFLVCSHSECFYKYYHVRCLTKEQIASDVQMGSQLWYCPSCLCRVCLCDTDDDKIILCDCCDQAYHLYCLSPPKTKVPTKYWDCDPCKKRKEKEKRILMLHRKDYDGDILKSTEIDGLDLLLNAAENSTGDKETEVATTTGK

SEQ ID NO: 44748 - protein, 231 aa, Sorghum bicolor
  unsure (1)..(231): unsure at all Xaa locations
  Clone ID: SORBI-28MAY03-C283_1.pep
VEVGGVEPGPLFSERIMTGSTRLTSGISASPSAAASTARHRHDGAPQQLRVKAAVRPQQQQQLLHGGRRHTRGSAVVVRAGPGPLSEIEPDLEEDAIDVYRTNGIAPEDFTRRASGRMSPSGTKKLSLLRAFKHSSPGHFLLQSSLAWLSMCXGEYLYIGAAVFIVVFCIFEMRKPDKPHNFEPEIYMMERTARDKLIADYNSMDIWDFNEKYGELWDFTVNPRDDIVKST

SEQ ID NO: 44749 - protein, 212 aa, Sorghum bicolor
  Clone ID: SORBI-28MAY03-C39594_1.pep
MASRGDADGVTSSMGELSVEAAPSSIEAEVPQHANGGDVAAAELDDVWEDVSDSPRHANTLDREWIHRQNQFQKMGYRDGITEGQKDSAQEGFNVGFRQSVNVGYKWGLVRGVASALASLPDSLKEKLVPDVQHRGKLQDLHNSVHEISADDALQMFHESLCQSNRPSEGSGSHVTSTSNGATESNRMESLSKDLVLLLHECSDIKVSEELA

SEQ ID NO: 44750 - protein, 81 aa, Sorghum bicolor
  Clone ID: SORBI-28MAY03-C3981_1.pep
MVCVACLLPLFLIPLVNALPYLVDLIISKVYRLFGWEYRRPERAPPACPYKPAAQKNDEGASESKPLVNPHGAAAEDKKEE

SEQ ID NO: 44751 - protein, 279 aa, Sorghum bicolor
  unsure (1)..(279): unsure at all Xaa locations
  Clone ID: SORBI-28MAY03-C40595_1.pep
MDANTLLLPCSDGAVAGAVDFRGRPASRSGTGRWSAAMFVLGVEIAERFAYHGVSANLISYLTGPLGESTAGAAAAINAWSGVATMLPLLMACVADAWLGRYRTIVLASLLFVVSMGMLTVSALPAFHHDGCSSYASSSLACSPSPAQVGVFYVSLYLVALAEAGHKPCAQAFGADQFDQNDPKESVSRSSFFNWWYFGMCSGTAVATMVCSYVQDNDGWGLGFGXRPCLDMVFALLMFLLGTRNYRYYTSTESSPFARLTRAFIALIKGSKSSQSDGT

SEQ ID NO: 44752 - protein, 302 aa, Sorghum bicolor
  Clone ID: SORBI-28MAY03-C3864_1.pep
MFWTSWLCWNVGVCTCKCTSFKCCSALCEGSITRPPTRPPTRPWLYFSFSNDWKSVREITDVLDAVGNTTKATTKGFAIGSAALASFLLFSAYMDEVASFAQLPFKEVDIAVPEIFVGGLLGSMLIFLFSAWACSAVGKTAQEVVNEVRRQFIERPGIMDYKEKPDYGRCVAIVASASLREMIKPGALAIISPMAVGVVFRILGHYTAQPLLGAKVVASMLMFATVAGILMALFLNTAGGAWDNAKKYIETGALGGKGSESHKAAVTGDTVGDPFKDTAGPSLHVLIKMLATITLVMAPIFL

SEQ ID NO: 44753 - protein, 173 aa, Sorghum bicolor
  Clone ID: LIB3480-052-P1-K1-G1.pep
SHDKEASFLLFSAYMDEVASFAQLPFKEVDIAVPEIFVGGLLGSMLIFLFSAWACSAVGKTAQEVVNEVRRQFIERPGIMDYKEKPDYGRCVAIVASASLREMIKPGALAIISPMAVGVVFRILGHYTAQPFLGAKVVASMLMFATVAGILMALFLNTAGGAWDNAKKYIETG

SEQ ID NO: 44754 - protein, 315 aa, Sorghum bicolor
  Clone ID: SORBI-28MAY03-C31325_1.pep
ARGEGFLDVFDPNASGTPSGIFSSRPEVSDFECVPVSVMERVIEFLNDVRADLRQAVAKDTVTIKNEDLAVGEHRNLEKSDKSGSEVVKTGQDVLDFQKKITPHRDSEQALNLNARGHSGIGDESISRIVSEMEEDDQVFNLALEARLHAAETIKQSRQELIVVASLVDRIPNLAGLTRTCEVFRAAGLVVADKSVLQDKQFRLISVTAEKWLPVTEVPVDSVKAYLERKRGEGYSVIGLEQTAHSRPLDGFVFPDRTVLVLGREKEGIPVDIIHILDACVEIPQLGVVRSLNVHVSGAIAVWEYTRQLRNQRYS

SEQ ID NO: 44755 - protein, 255 aa, Sorghum bicolor
  Clone ID: SORBI-28MAY03-C3137_1.pep
MPPLLTSPASASSPLLLASRVGALHHRAAASVHFLAPRRKTRPSPTPGPAMSWLGKLGLSGLGGSPRASEASAALAQGPDEDQPAPGNEFAQSSAGCFWGVELAFQRVPGVTRTEVGYSQGNLHEPTYEDVCTGATNHNEVVRVQYDPAACKFDDLLDTFWARHDPTTPNRQGNDVGTQYRSGIYFYTPEQEKAARESLEKQQKLLNRTIVTEILPAKRFYRAEEYHQQYLEKGGRFGFRQSASKGCNDPIRCYG

SEQ ID NO: 44756 - protein, 171 aa, Sorghum bicolor
  Clone ID: SORBI-28MAY03-C32864_1.pep
MASASKEEVIGKLNVRVVRGNNLAIADPLTHTSDPYVVLQYGAQKVKTSVQKKNPNPVWNEVLQLSVTNPTKPIHLEVFDEDKFTADDTMGVAEINITDIYDAAKLDLKHATDGTRIKTIYPVGVNYLGGGTRVQWKDGKVIQDLILKLKKVESGLIVVQLEWVHVPGVKL

SEQ ID NO: 44757 - protein, 146 aa, Sorghum bicolor
  Clone ID: SORBI-28MAY03-C33226_1.pep
MAAYMRVTHRDEEGKKVTEKMPVPETRRPDTAKHFERKLEEQGLHRFERHPANAPRGVGIGTPPPKSGRGGKFTWEGPGGVVDGQLDPAPPAIDANDPNYVAPEEEEEEVAREVVVGEVEVAKVAESRVGVARVDVAPALLQDQNQ

SEQ ID NO: 44758 - protein, 181 aa, Sorghum bicolor
  Clone ID: SORBI-28MAY03-C33251_1.pep
MPSRAMNRLFVESASGSGGCRDAEPVLCAPRPRRVQVHPCSADLILGPPPFLLNKSSKEGGRTKPAEVREEEDAGCWAVFGGSPPARADNPLVHDPHFLLNQQRHPAADPTPLELGFFDHRSRTSYVHRPTYSSSSSSNNSNNSSFAPSSFAPAVRIQGFDVAACRSSHSNGGSRVLSARA

SEQ ID NO: 44759 - protein, 188 aa, Sorghum bicolor
  Clone ID: SORBI-28MAY03-C3331_1.pep
MTMPLLLTPGARAAPSPSTLSRLLLPLHLQITNGRHNHRHGHVSASPLLYPRLRNRRGRFFASSSSSSQMAAPADAPGGSSDAFEVIRVHQAKAARLSPVEEIRTILDRSVRGVLATHSQDHAGYPSSSMVDFACDQDGSPILAVSSLAVHSKNLSGNPKCSLLVAKDPEDRTDTVITVYGDAVPVSD

SEQ ID NO: 44760 - protein, 305 aa, Sorghum bicolor
  Clone ID: SORBI-28MAY03-C46113_1.pep
MTITIEQPQLDAVAERKVPAGGDPAELVLDAGFVVPDANAFGDTFRNYDAESERKQTVEEFYRVNHTRQTHEFVSRMRAEYGRLDKTEMGIWDCIELLNEFIDDSDPDLDMPQIEHLLQTAEAIRKDYPDQDWLHLTGLIHDLGKVLLHPSFGELPQWAVVGDTFPVGCAYDESNVHFKYFKENPDYHNPKLNTKFGVYSEGCGLDNVLMSWGHDDYMYLVAKENKSTLPSAGLFIIRYHSFYPLHKHGAYMHLMNEEDKENLKWLHVFNKYDLYSKSNVRIDVEKVKPYYMSLIDKYFPGKLRW

SEQ ID NO: 44761 - protein, 440 aa, Sorghum bicolor
  unsure (1)..(440): unsure at all Xaa locations
  Clone ID: SORBI-28MAY03-C46427_1.pep
MATATHHADAPGLNGAEGVEMAETNNELRRRGKPSGDDRAARDGPGAEEEDAAAAPSSVERAFADQPVPSWREQLTVRAFVVSAVLPVLFSFIVMTLHLTTGIIPSLNISAGLLGFFFVRLWTRAIESLGLLMQPFTRQENTVIQTCVVASYGLAFSGGFGSYLFAMSDKIAAMVTEANNAQNIKDPQLGWIIGFLFLVSFIGLFGLVPLRKIMIVDYKLTYPSGTATAYLINGFHTPQGARLARKQVKKLGTFFVLSFVWGFFQWFYTANSDECGFQQFPSLGLQAYNNKFYFDFSPTYVGVGMICSHIVNVSILLGAILSWGIMWPLIAKKKGIWFSADLDDTSLHGMQGYRVFIAIALILGDGLYNFLKIFILTVVSLRSQIKKANVSTLPISDDGTVTNSTPISYDEERRNELFLXDXIPWYAALGGYVAIAAISI

SEQ ID NO: 44762 - protein, 312 aa, Sorghum bicolor
  Clone ID: SORBI-28MAY03-C46642_1.pep
MASRDFLRVFGEGSGSGSPKAANAGAGGQSDDVELSLGLSLGGRFGTDAAAKRPRLARSSSIASVCSVSSLHGEGDADADPSPAAPLPLLRTTSLPTETEEERWRRREMQSRRRLEARRKRVERRNSSMASLVPAGPKPAAAAADANANAAVGSGRRSNASQGSNSVSTTEQGIGGSAINQSTDARSPSTSDNTNQNSMLPPTKAAEKPLNGTPTEQPRLRTLGSLTTRTSSTSDIRKLMMEDMPMVSSKVEGPNTRRIDGFLYRYKKGEDVRIVCVCHGSFLTPAEFVKHAGGGDVSNPLRHIVVNPAPFS

SEQ ID NO: 44763 - protein, 169 aa, Sorghum bicolor
  Clone ID: SORBI-28MAY03-C341_1.pep
MSGNGAKKVVDVAVKAAKAIDWDGMAKMLVSDEARKEFATLRRTFEDVNHQLQTKFSQEPQPIDWEYYRKGIGSKVVDMYKEAYESIEIPKYVDTVTPEYKPKFDALVVELKEAEKASLKESERIEKEIAELKEMKKKISTMTADEYFEKHPELKKKFDDEIRNDYWGY

SEQ ID NO: 44764 - protein, 275 aa, Sorghum bicolor
  Clone ID: SORBI-28MAY03-C3433_1.pep
MYKQGGAGGGAGLDRKRISDALDKHLEKAVASPSTSRGSAGGGGGRDHHRLVVPSSVSTILKGHCSEGESDSDSEASDVSGSDGEDTSWISWYCNLRGNEFFCEVDDDYIQDDFNLCGLSSQVPYYDYALDLILDIESSHGDMFTEEQNELVESAAEMLYGLIHARYILTSKGLAAMLEKYKNYDFGRCPRVYCCGQPCLPVGQSDIHRSSTVKIYCPKCEDIYYPRSKYQGNIDGAYFGTTFPHLFLMTYEHLKPQKPSQRYVPRVFGFKLHKP

SEQ ID NO: 44765 - protein, 235 aa, Sorghum bicolor
  Clone ID: SORBI-28MAY03-C33670_1.pep
MSLSTLSHPAAAAAAATGSGKSHFRTAPAAQSVRFPKARPPVPAAVSAASAAVHADPAEDRVSSLSQVSGVLGSQWGDEGKGKLVDVLAPRFDIVARCQGGANAGHTIYNAEGKKFALHLVPSGILHEGTLCVVGNGAVIHVPGFFGEIDGLESNGVRCDGRILVSDRAHLLFDLHQVVDGLREAELENSFIGTTKRGIGPCYSSKVTRNGLRVCDLRHMDTFGDKLDVLFKDAA

SEQ ID NO: 44766 - protein, 50 aa, Sorghum bicolor
  Clone ID: SORBI-28MAY03-C34687_1.pep
ARGKVTQKSVPFLGNLGQSLEGLNLQFCNMIGNHNIASLEKQLWWCDILA

SEQ ID NO: 44767 - protein, 202 aa, Sorghum bicolor
  Clone ID: SORBI-28MAY03-C36279_1.pep
MVEASPEPVAAAGGGASGTAAPRKGKSCKGCLYYSSVLKSRGYNPICVGIPRSIPQVPNYVVDEPKEEATAQGHDLRRFRYGCAGYSMFVDNRDGQGGESEGKTLLPYCRGLELLVDSRLVERKPSTAEQAPAHVAKDAATTRSHQQGQQRPANLSRQEFLERFKRSAGLVASGVAKNLNKTAHYIKENIQDILYPDRRPPK

SEQ ID NO: 44768 - protein, 204 aa, Sorghum bicolor
  Clone ID: SORBI-28MAY03-C38299_1.pep
MARKPLDYEELNENVKKVQYAVRGELYLRASELQKEGKKIIFTNVGNPHALGQKPLTFGRQVVALCQAPFLLDDPHVGLMFPADAIARAKHYLAMAKGGLGAYSDSRGIPGIRKEVADFIYKRDGYPTDPELIYLTDGASKGVMQILNTIIRNERDGILVPVPQYPLYSASIALYGGALVPYYLEEEANWSLDFVNIRKTVAEA

SEQ ID NO: 44769 - protein, 112 aa, Sorghum bicolor
  unsure (1)..(112): unsure at all Xaa locations
  Clone ID: SORBI-28MAY03-C3470_1.pep
MSHFGRSGPPDIRDTFSLLVLNISFRTTADDLYPLFERYGKVVDVFIPRDRRTGDSRGFAFVRYKYADEAQKAIDRLDGRNVDGRNIMLQFAKXRPNAELIKKGRVDEGQWK

SEQ ID NO: 44770 - protein, 121 aa, Sorghum bicolor
  Clone ID: LIB3480-030-P1-K1-F3.pep
DRDYRRRSRSRSRSPSSSPDRKSHRRARDDGKRKSRSKSRSKSRSRSRSRSKSMSRSRSRSRSYHSASPARRSASPHKSPPPRRSPTPEKHTNGKDSPLSRSVSPSPKRASSHSPGSDGKE

SEQ ID NO: 44771 - protein, 320 aa, Sorghum bicolor
  Clone ID: SORBI-28MAY03-C5226_1.pep
MGCDQRQGPAPDASYQGGGDYYKQGSQPYDSQPPSYPPGPGNYNSYGQSQGPNYGQPQYPQQAPQQNYSHGYGDPRYNAPPPNQQYYGQPPMGPQQGYPQQPDPYARPPYSGPGQWPPRGAPATDGSYQAPPASYGPPSQQPPAYGQTYSAATGPDGYAQQGYPQQGGPAPAPYGQSAPAAPGYPQQGTQQGSYAQYPQTQPAYGDQSAQANANYGYQGAPADPNYGSAYSQPGYGPPGQATGQAGYATSAPAAGQPAYGQAGYTQPPTNPPSYDQSAAPAATQSSYAAPPANPQQPAAAKGVSPQPAAAGYGAGGQWTA

SEQ ID NO: 44772 - protein, 164 aa, Sorghum bicolor
  Clone ID: SORBI-28MAY03-C54639_1.pep
MLAGIQQLSTFYLHVVQPSSPVDQALELLVQHKISGLPVVDDDGKLVGVVSDYDLLALDSISGNELPDTNTNMFPDVDSTWKTFHEIQRLLSKTNGKVIGDVMTSSPLAVRQNTNLDAATRLLLETKYRRLPVVDSMGKLVGMITRGNVVSAALKIKKKTEEGA

SEQ ID NO: 44773 - protein, 207 aa, Sorghum bicolor
  Clone ID: SORBI-28MAY03-C55349_1.pep
MATSASGVSLLLAQPLPPNGTSLRRVGVAARAPAPAPARLAATAVRSAHPLAANADAKTRTLRFVSVSVRCVGVGGTEALRSDAAEPPVPSSVPRSVPVRVAYELQQAGHRYLDVRTEGEFSAGHPEGAVNIPYMNKTGSGMTKNTHFLEQVSRIFGKDDEIIVGCQSGKRSLMAATELCSAGFTAVTDIAGGFSTWRENELPTTIH

SEQ ID NO: 44774 - protein, 211 aa, Sorghum bicolor
  Clone ID: SORBI-28MAY03-C412_1.pep
MVEMDGGVGVVGGGQQTPAPRRWRLADELRCDLRAMETDYVRRFHRHEPRDHQCSSAVAKHIKAPVHARGSLVRRFDQPQLFKPFVSRCEMKGNIEIGSVREVNVKSGLPATRSTERLELLDDNEHILSVKFVGGDHRLQNYSSILTVHPEVIDGRPGTLVIESFVVDVPDGNTKDETCYFVEALLKCNLKSLAEVSERQVIKDQTEPLDR

SEQ ID NO: 44775 - protein, 265 aa, Sorghum bicolor
  Clone ID: SORBI-28MAY03-C4250_1.pep
MALHAVSPAAVSSPLRALSRSLPQRPGCGCLPKQSLAVYSSINFARLRAGPVDFGGRPLVLRHSDKRAVLMHATIEEIEAEKSLIEDQAKEKMEKAIETVQTNFNTVRTGRANPAMLDRIEVEYYGTPVNLKSIAQISTPDATSLLIQPYDKSSLKLIEKTIVAANLGVTPSNDGEVIRVTVPPLTSDRRKELAKTVAKLSEDGKVAIRNIRRDAIKAYDKLQKEKKLSEDNVKDLSADLQKVTDEYMKKIDSIQKQKEQELMKI

SEQ ID NO: 44776 - protein, 148 aa, Sorghum bicolor
  Clone ID: SORBI-28MAY03-C4324_1.pep
KKKKCSIHPSYKVTTTPVVKQPRLPTNNHQIDGGANARAQPTSRLLGAWPVRLCRRHAADVLQQVLDLGQHHHLRGFATRAPTPHPNTTTATAAARDLRRRALVVLLQLDLLEDELLLSLGLLEFFFFFFTCIKQRFIHHSSHLVQQR

SEQ ID NO: 44777 - protein, 187 aa, Sorghum bicolor
  Clone ID: SORBI-28MAY03-C43540_1.pep
ARGNMSSPHPRISHLSSAHSLVGSHLSPPISIRYSLPQLAQSGHGSLSPHVSSSYISNSGYGSSSYYYLGGSSQHGSYLRRCGESGPSLSTMAPQSPQQFQSEANVVAGTSSAQSFRQSYLRHCGDSDASLSDMMSAQSLPQQFQSDANVAAGASSAQSLRQSYLRRCGDSDASLSDMTSAQSLPGC

SEQ ID NO: 44778 - protein, 274 aa, Sorghum bicolor
  Clone ID: SORBI-28MAY03-C3912_1.pep
MPCLLLLAPPPPPPPRPCLIDSVSRPPLPKYRFFLPRTRRRPSPWLGVRMAEMTRVGSGGEPPEVGVSMESDPLVGGDAPSRPRWEASRWASVEAALNRMSKWLVSGSFAFAAIWKHDAEIMWVLLGAVGNSLLSLVLKKMLNHERPAPALRSDPGMPSSHAQSIFYATTILALSLYYWLGTNYLTMILGPATLLVAAYLSWLRVSQRLHTLNQVTVGAVVGSAFGALWFVLWHWLVQEAFASSLLVRIAVILGSTTFCVSFVIYIIHHWLKDE

SEQ ID NO: 44779 - protein, 96 aa, Sorghum bicolor
  Clone ID: LIB3481-031-P1-K1-F11.pep
PACGRGRAVPPEVGSEPVGVRGGCAESDAIWKHDAEIMWVLLGAVGNSLLSLVLKKMANHERPAPALRADPGMPSAHAQSIFYATTILALSLYYWL

SEQ ID NO: 44780 - protein, 248 aa, Sorghum bicolor
  Clone ID: SORBI-28MAY03-C44204_1.pep
SPAPLFSRLRFRLRTCAAVSISTRPSSAAPLRYRRTRLSIPFPLSPPCPRILRAAAAAAVSSSLDLRAIAGGFALFSMAAASSATSVHDFTVKDASGKDVDLSTYKGKVLLIVNVASQCGLTNSNYTELSQLYEKYKDQGFEILAFPCNQFGGQEPGTNEEIVQFACTRFKAEYPIFDKVDVNGDNTAPIYKFLKSSKGSLFGENIKWNFSKFLVDKEGRVVERYAPTTSPLSIEKDIKKLLGSPSTL

SEQ ID NO: 44781 - protein, 433 aa, Sorghum bicolor
  Clone ID: SORBI-28MAY03-C4538_1.pep
HEGRLHDEKGFAVAVMMDTEGSEIHMGDLGGASSVKAEDGEVWTFSVRSFELPLPERTINVNYDGFAEDVRVGDELLVDGGMARFEVIEKIGPDVKCRCTDPGLLLPRANLTFWRDGSIVRERNAMLPTISSKDWLDIDFGIAEGVDFIAVSFVKSAQVIKHLKSYIAARGRGSDLAVIAKIESIDSLKNLEEIIRASDGAMVARGDMGAQVPLEQVPSIQQKIVQLCRQLNKPVIVASQLLESMIEYPTPTRAEVADVSEAVRQRADALMLSGESAMGRYPDKALSVLRSVSLRIEKWWREEKRHEALELQTVSSSFSDKISEEICNSAAKMANGLGVDAVFVFTKTGHMASLLSRCRPDCPVFAFTTSTSVRRRLNLQWGLIPFRLSFSDDMESNLNRTFSLLKARGMIQSGDLVIALSDMLQSIQVMNVP

SEQ ID NO: 44782 - protein, 393 aa, Sorghum bicolor
  Clone ID: SORBI-28MAY03-C5914_1.pep
MQSAAAVGLVRPCAARPLPTYPSPRRGAGACSPPLLTTPRGLRLSARAGLVPASPLEEENRRCRHVAAAAGKVAAADTARGEAGGGLAKTLQLGALFGLWYLFNIYFNIYNKQVLKVLPYPINITTVQFAVGSAIALFMWITGILKRPKISGAQLFAILPLAIVHTMGNLFTNMSLGKVAVSFTHTIKAMEPFFSVLLSAIFLGELPTPWVVLSLLPIVGGVALASLTEASFNWAGFWSAMASNVTFQSRNVLSKKLMVKKEESLDNINLFSIITVMSFFLLAPVTLLTEGVKVSPAVLQSAGLNLKQVYTRSLIAAFCFHAYQQVSYMILARVSPVTHSVGNCVKRVVVIVTSVLFFRTPVSPINSLGTGIALAGVFLYSQLKRLKPKPKAA

SEQ ID NO: 44783 - protein, 335 aa, Sorghum bicolor
  Clone ID: SORBI-28MAY03-C59142_1.pep
AHPVIHSTRRRPSNPSPAMELRELGGTGLRVSAVGFGASPLGNVFGDVPRDTARAAVRRALDLGINFFDTSPYYGGTVSESVLGDCLRHAAVPRDRVVVATKCGRYKDEGFDFSADRVTRSIDESLARLGLDYVDILHAHDIEFTHLDQIVNETIPALQKIKESGKARFIGITGLPLSIYPYVLDRVAPGSVDLILSYCHYGINDTSLVDLLPYLKSKGVGVISASPLSMGLLTDNGPPEWHPAPEQLKSACRAAADHCRKKGRSITKLAMQYSLMNNEISTILVGMNSSEQVEENVAAALELSTSGIDEELLREVEAILEPVKNLTWPSGIQQV

SEQ ID NO: 44784 - protein, 425 aa, Sorghum bicolor
  Clone ID: SORBI-28MAY03-C5983_1.pep
MGNCCRSPAAVAREDVSSSHFPASNAKKKPHQARNGAGGGGGGGGGGGGGQKRLSVLGDEGCEVVGIDDKYVLDRELGRGEFGVTYLCMDRDTKELLACKSISKRKLRTAVDVEDVRREVAIMRHLPKSPSIVSLREACEDEGAVHLVMELCEGGELFDRIVARGHYTERAAANVTRTIVEVVQLCHRHGVIHRDLKPENFLFANKKENSPLKAIDFGLSIFFKPGEKFSEIVGSPYYMAPEVLKRNYGPEIDIWSAGVILYILLCGVPPFWAETEQGVAQAILRGNIDFKREPWPNVSENAKDLVRRMLEPDPKLRLTAKQVLEHHWLQNAKKAPNVPLGDIVKSRLKQFSRMNRFKRRALRVIADHLSAEEVEDIKEMFKTMDTDNDGIVSYEELKTGIAKLGSHLAESEVQMLIEAVDTNGR

SEQ ID NO: 44785 - protein, 237 aa, Sorghum bicolor
  Clone ID: SORBI-28MAY03-C46993_1.pep
QPVQQPQSNAQQYPPPVQPQQSSPQLPQAMQPQHPPVQTQMRPQTPPNYTHYPPHQPLNPSTETLPANVAMQGPYNTAAPSGASRSEPPYSYGGPGIPPSQPPPQHNMQRHQLPPSSQSSFGPPPSKGSYASPTQYAPQGNPQGYNTGYAYPPSGPPAVQPQQMPPGGVGMSHPGSHMMRGHPYGEMMEKAITMGYPRDQVLNVTQRMAESGQPMDFNTLLDRLNEAGSGAPPPRAW

SEQ ID NO: 44786 - protein, 337 aa, Sorghum bicolor
  unsure (1)..(337): unsure at all Xaa locations
  Clone ID: SORBI-28MAY03-C47_1.pep
KPAAAGQLATRSWRRRATTTRPPSSAPPAAGRSRWSLRGMTGLVTGGTRGIGYXTTHNQQVAHAGLLCNXTELHVLRRAVVEELAALGAAVHTCSRNEAELRDRLAEWEAAAKTNGGGGVVTGSVCDVSARDQRERLLRDVAERFGGKLNILVNNVGTNFGKPTAEYTAEDYAFLMSTNLESAYHLCQLAYPLLKAPAAAAGNGNGGSVVLVSSVCGGVAVCTGSVYAMAKAGMNQLARNLACEWAGDGIRANSVAPWYTRTPLVEGDLSRGQYVEEILRRTPQRRVGEPEEISSLVAFLCMPCASYITGQTIAVDGGMTVNGLYPSSSPSGLSYSN

SEQ ID NO: 44787 - protein, 130 aa, Sorghum bicolor
  unsure (1)..(130): unsure at all Xaa locations
  Clone ID: SORBI-28MAY03-C4966_1.pep
MDKYEPVRDIGSGNFGVERLMRDRETRGLVGVKLIDRDHRIDENVYREIVNHRSLRHPKIIQFIEVILTPTQFAIXTEYAAGGELFDRIDDRGRFSEDEAMYLFQXSVAGVSDCHHMHISHGDFLPACVL

SEQ ID NO: 44788 - protein, 257 aa, Sorghum bicolor
  unsure (1)..(257): unsure at all Xaa locations
  Clone ID: SORBI-28MAY03-C512_1.pep
MFDCKILPYSLVXDYVNNGEESGITLLNAKFFHMIAFRXEDMLIKDVTVTAPGDSPNTDGIHMGDSSGVTIENTVIGVGDDCISIGPGTTKVNITGVTCGPGHGISIGSLGRYKDEKDVTDINVKDCTLKKTSNGLRIKAYEDAASVLTASKIHYENIKMEDSSNPIIIDMKYCPNKICTASGASKVTVKDVSFKNVTGTSASPEAVSLLCSDKIPCTGVTMDNVKVEYSGKNNKTMAVCQNAKGSATGCLKELACF

SEQ ID NO: 44789 - protein, 81 aa, Sorghum bicolor
  Clone ID: SORBI-28MAY03-C4674_1.pep
TLCIIRTYLRGCTSLATRFTCLGSTNNAATNSLFPSQNPFVLLCRRLYQITELNMGNFPLAPYRRAYKVQIVVALCSVVLQ

SEQ ID NO: 44790 - protein, 63 aa, Sorghum bicolor
  Clone ID: LIB3476-052-P1-K1-H8.pep
HTANDLRNFRTRVAYSLSTTTNCRVPVVNVRYLGPTKCLPHHFCDMHTHLLHMKKINDMSCAC

SEQ ID NO: 44791 - protein, 55 aa, Sorghum bicolor
  unsure (1)..(55): unsure at all Xaa locations
  Clone ID: LIB3480-029-P1-K1-G3.pep
RQQVSWTDKMSTSSFCDMHGHXLHMKKINDMSCACQTXCIIRISXPCAXVASLVS

SEQ ID NO: 44792 - protein, 151 aa, Sorghum bicolor
  Clone ID: SORBI-28MAY03-C4753_2.pep
MGRMHSRGKGISSSALPYKRTPPTWLKTAASDVEEMITKAAKKGQMPSQIGVLLRDQHGIPLVKSVTGSKILRILKAHGLAPEIPEDLYFLIKKAVAIRKHLERNRKDKDSKFRLILVESRIHRLARYYKRTKKLPPTWKYESTTASTLVA

SEQ ID NO: 44793 - protein, 151 aa, Sorghum bicolor
  Clone ID: SORBI-28MAY03-C4753_1.pep
MGRMHSRGKGISSSALPYKRTPPTWLKTAATEVEEMITKAAKKGQMPSQIGVLLRDQHGIPLVKSVTGSKILRILKAHGLAPEIPEDLYFLIKKAVAIRKHLERNRKDKDSKFRLILVESRIHRLARYYKRTKKLPPTWKYESTTASTLVA

SEQ ID NO: 44794 - protein, 86 aa, Sorghum bicolor
  Clone ID: LIB3478-043-P1-K1-E6.pep
VEEMITNAAKKGQMPSQIGVLLRDQHGIPLVKSVTGSKILRILKAHGLAPEIPEDLYFLIKKAVAIRKHLERNRKDIDFKSSSFLL

SEQ ID NO: 44795 - protein, 127 aa, Sorghum bicolor
  Clone ID: SORBI-28MAY03-C4945_2.pep
MTATEAALRLGLSATAGQSQARRRHQRLLLPPLSSSLTTSPPSSAHRPATLRFKSVSHGVSSQHAERIHCRSSLRQNTIVASENENPPLMPAIMTPGGALDLATVLLGNRVIFIGQYINSQVAQCQL

SEQ ID NO: 44796 - protein, 105 aa, Sorghum bicolor
  Clone ID: SORBI-28MAY03-C4945_1.pep
RKYFLYLSEHTANILEGGEKGMLYTMPNVRVMIHQPQGGSEGNVEEVRRQVGETVYARDKVDKMFAAFTGQPLDMVQQWTERDRFVSSSEAMDFGLVDALLETRY

SEQ ID NO: 44797 - protein, 135 aa, Sorghum bicolor
  Clone ID: SORBI-28MAY03-C5206_1.pep
SEVQMLIEAVDTNGRGALDYGEFLAVSLHLQRMANDEHLRRAFLFFDKDGNGFIEPEELREALVDDGAADSMEVVNDILQEVDTDKDGKISYDEFVAMMKTGTDWRKASRHYSRGRFNSLSMKLIKDGSVKLGVE

SEQ ID NO: 44798 - protein, 309 aa, Sorghum bicolor
  Clone ID: SORBI-28MAY03-C6869_1.pep
MEVFYYVVFGALAAVVAGLELGKSGKDRVATTSAFNSFKNNYVLVYSLMMSGDWLQGPYVYYLYSQYGFDKGDIGRLFIAGFGSSMLFGTIVGSLADKQGRKRACITYCISYILSCITKHSPEYRVLMIGRILGGIATSLLFSAFESWLVAEHNKRGFDPQWLSITFSKAIFLGNGLIAIVSGLFANLLAENLGFGPVAPFDAAACFLAIGMAIIMSSWSENYGDPSESKDLMAQFKVAAKAIASDEKIALLGAIQSLFEGSMYTFVFLWTPALSPNEEDIPHGFIFATFMLSSMLGSSIASRLLARKL

SEQ ID NO: 44799 - protein, 415 aa, Sorghum bicolor
  Clone ID: SORBI-28MAY03-C696_1.pep
MWCASCLASACAGCTCNLCASAASAVSRRSARLAYCGLFAASLILSFLLRQFAAPLLKHIPWINAFDQTPPEEWFQMNAVLRVSLGNFLFFATFALMMIGVKDQNDRRDAWHHGGWIAKVAVWAVLIVLMFCVPNIVITIYEVLSKFGSGFFLLVQVVMLLDFTNNWNDSWIEKEERKWEIALLVVTVVCYLSTFAFSGVLFMWFNPSGHDCGLNVFFIVMTFILAFAFAIVALHPQVNGSVMPASVISVYCAYLCYTSLSSEPDDYECNGLHRHSKQVSLGALILGMLTTVLSVVYSAVRAGSSTTFLSPPSSPRSGAKNPLLGDEEDGKGDGKESEPRPVSYSYTFFHLIFALASMYSAMLLTGWTSAASERSELMDVGWTTVWVRICTEWVTAALYIWTLIAPLLFPDRDFS

SEQ ID NO: 44800 - protein, 389 aa, Sorghum bicolor
  unsure (1)..(389): unsure at all Xaa locations
  Clone ID: SORBI-28MAY03-C13230_1.pep
MGYIGHHGVATLRRYKYSGVDHSLVAKYILQPFWSRFVNIFPLWFPPNMITLTGFMFLLTSAFLGFLYSPHLDTAPPRWVHLAHGLLLFLYQTFDAVDGKQARRTNSSSPLGELFDHGCDALACAFESLAFGSTAMCGKATFWFWFISAVPFYFATXEHFFTNTLILPIVNGPTEGLMLIYLCHFFTFFTGAKWWAQDFQKSMPLLGWVPFISEIPVYDIVLCLMIAFAVIPTIASNIHNVYKVVEARKGSMVLALAMLFPFGLLLAGVLVWSYFSPSDIMRNQPHLLIIGTGFAFGFLVGRMILAHLCDEPKGLKTGMCMSLAYFPFAIANALTARLDDGNPLVDEQLVLLMYCLFTVALYMHFATSVIHEITNALGIHCFRITTKKA

SEQ ID NO: 44801 - protein, 53 aa, Sorghum bicolor
  Clone ID: SORBI-28MAY03-C12036_1.pep
MAASSSVEKLKALWDSQVNDEEQWALNYKLLKAAGLFAGSIFLMRNFGDLMAI

SEQ ID NO: 44802 - protein, 137 aa, Sorghum bicolor
  unsure (1)..(137): unsure at all Xaa locations
  Clone ID: LIB3478-037-P1-K1-G4.pep
MASTATAAVSLRLAFPLVSTPACSASSSNTLRFPLRRRRASRSLAVAAFKKLSEASPVAIPEEPTQPLVDEDALPPKPGVYGVYDPAGELQFVWISRNVRASVXGHRRKVPANLCASCKVAVSDEETPDRAALKHAW

SEQ ID NO: 44803 - protein, 325 aa, Sorghum bicolor
  Clone ID: SORBI-28MAY03-C1325_1.pep
FTDYADFCFKTYGDRVKHWFTFNEPRIAALLGYDVGSNPPQRCTKCAAGGNSATEPYIVAHNFLLAHAAAVARYRTKYQAAQKGKVGIVLDFNWYEALTNSPDDQAAAQRARDFHIGWFVDPLINGHYPQIMQDLVKERLPRFTPEQAKLVKGSADYIGINEYTSSYMKGQKLLQQTPSSYSADWQVQYVFARNGKPIGPKANSNWLYIVPTGMYGCVNYLKEKYGNPTVYITENGMDQPGNLTRDQYLRDATRVRFYRSYIGQLKKAIDQGANVAGYFAWSLLDNFEWLSGYSSKFGIVYVDFNTLERHPKASAYWFRDMLQKH

SEQ ID NO: 44804 - protein, 323 aa, Sorghum bicolor
  Clone ID: SORBI-28MAY03-C13515_1.pep
ARGTRTSSYNLSPSSNCLPFLPTAKHTSPARLAMAYRVLEVTLVSANDLKKLSVFSRPRIYAVASISGLDLRMPSHSTQADQTNGCNPAWNAVAHFPIPAAIDTRGLALHVRLCAQRVYLGDRDIGEVFVPIDDLLAGADKGGDPRPVSYQVRRPHSGRAHGVLYFCYKFTDVPAVACVPEPEGKQGQYAKYVLDSVNTTDKTMVPPTAYPPSAMPSTYPPPAMSPAYPPPQYGSPYPAYPPQPYAYAAPPPYGYNAATPQPAMYGYAAQPVAAPASHGGGMGMGLGLGLLGGAVGGMMLGEAIGDYEADAAYDAGFNDALAF

SEQ ID NO: 44805 - protein, 87 aa, Sorghum bicolor
  Clone ID: LIB3480-005-P1-K1-A9.pep
QPACVPAASTAPCWASPSPAPWPRAMAYRVLEVTLVSANDLKKLSVFSRPRIYAVASISGLDLRMPSHSTQADQTNGCNPAWNAVAH

SEQ ID NO: 44806 - protein, 273 aa, Sorghum bicolor
  Clone ID: SORBI-28MAY03-C14725_1.pep
MDDGDLDFSNPDTYLCPALGTDPPSSCSMDSYFDEILKDTEHHACTHTHTCNPPVHDLSHTHTCVHVHTKIVAASPGDDAAESPSENNTNTTGNSNAASKKRPSGNRAAVRKYREKKKAHTASLEEEVVHLRALNQQLMKKLQSHATLEAEVARLRCLLVDIRGRIEGEIGAFPYQRPPVKNVDLVSSVDQGSFLGGAGTAQVTNACDFRCKDQMYCNPGMQGAISGQVLGQGACDVASIQCIGSNKSGSTKLPVCGGMDTVPAVCLPNVENK

SEQ ID NO: 44807 - protein, 199 aa, Sorghum bicolor
  Clone ID: SORBI-28MAY03-C14811_1.pep
MATLTMQPIGPTPAPAAQEDQRNGENLPTVDATDLSDIDSGWVILKNSDIVSADLAAAAVSGGQRLGSSTIPSWARWVLGGVVYTVVPFYNRVRHLEDETVGFVENAVEVVEHIAEVTEKLAANVAKQLPEDGSLQKAAEDVEHIAEVVDDDAEKFEAVAEKIDKVCDEIDAAVEPVIEELEKELDQSTTSEKGVDTKN

SEQ ID NO: 44808 - protein, 405 aa, Sorghum bicolor
  Clone ID: SORBI-28MAY03-C14852_1.pep
MDMAIDTPSPAPPPTPPAPSAAAGRQTRAAEAVRLEHQLVRVPLESLRATVRSNHRLAEKEIAAVLSSASAAPAESSAAAVDHLTSLVSRLHGLKRKMEEGARVEELQVQRCRARLDRLATASTGDDAEWEDIRLKRILVDYMLRSSCYDSATKLAETSGIQELVDIDVFLDAKRVIDSLQNNEVAPALAWCAENKSRLKKSKSKLEFLLRLQEFVEFVKAKNCIQAIAYARKHLAPWGNMHMKELQRVTATLVFRSNTNCTPYKILFEQERWDYLVDIFKQDFCKLYGMTLEPLLNIYLQAGLTALKTPFCTEGSCPREDPLSLEGFRKLAEPLPFSKQHHSKLVCYITKELMDTENPPRVLPNGYVYSEKALQEMSKKNDGKITCPRTGDVCDFSECVRAFIS

SEQ ID NO: 44809 - protein, 111 aa, Sorghum bicolor
  Clone ID: SORBI-28MAY03-C7470_1.pep
MGVAGEKFHWGTGGALSLSVVSSVSLVICNKALMSSLGFNFATTLTSSLLLVTFCSLHVALCMKLFEHTPCAPRAALGLGVLERMPFGPRTVRRGGVPVGFYQVYIPFLFL

SEQ ID NO: 44810 - protein, 137 aa, Sorghum bicolor
  unsure (1)..(137): unsure at all Xaa locations
  Clone ID: LIB3476-034-P1-K1-G8.pep
TYCSLHVALCMKLXEHKPFDARTVMGFGVLNGISIGLLNLSLGFNSVGFYQMTKLAIIPCTVILETLFFKKKFSRNIKLSLSVLLVGVGVATVTDLQLNTVGSVLSLLAIITTCIAQIMTNTIQKKFKVSSTQLLYQ

SEQ ID NO: 44811 - protein, 203 aa, Sorghum bicolor
  Clone ID: SORBI-28MAY03-C8132_1.pep
MNPEYDYLFKLLLIGDSGVGKSCLLLRFADDSYLESYISTIGVDFKIRTVEHEGKTIKLQIWDTAGQERFRTITSSYYRGAHGIIVVYDVTDQESFNNVKQWLNEIDRYASENVNKLLVGNKCDLAENRVVSYEAGKALADEIGIPFLETSAKDATNVEKAFMTMAGEIKNRMASQPAASGASRPATVQMRGQPVSQQSSCCS

SEQ ID NO: 44812 - protein, 183 aa, Sorghum bicolor
  Clone ID: SORBI-28MAY03-C9035_1.pep
MINLFKIKGQKKEEAASAAGKAPVKKQSAGELRLHKDISELNLPKTTSISFPNGKDDLMNFEIIIRPDEGYYMGGTFVFTFQVSPSYPHDPPKVKCKTKVYHPNIDLEGNVCLNILREDWKPVLNINTVIYGLNLLFTQPNDEDPLNHEAAVVLRDNPKMFEANVKRAMAGGYVGQHYFQRCA

SEQ ID NO: 44813 - protein, 540 aa, Sorghum bicolor
  Clone ID: SORBI-28MAY03-C8942_1.pep
MYKNQLQELAQRSCFNLPAYTCLREGPDHAPRFKAAVNFARGQFESPGFFTTLRQAEHAAAEVALAALARRGPSYSLAARILDETGVYKNLLQEVAQRVGAPLPLYTTERSGLGHLPVFTCTVELAGITFTGDPAKNKKQAEKNAASAAWSALKQLVREEVNSSNEPENNDEQEQIRIARALLNYRLKEKMAMANYPHVSPFPKKFPMQPERKPSFGQSSQSSYSKILPLFRPKSNSRSRPESLASTDGVSQIPSRAMDSLTPSPRSRFPAAEAAPYVPVGHYRMPCHSMAPSVTIRTAVPVFSAPPLPSPSARPQQLPPLMSHPPPIRMASPVRMRPSSPMFASSAAVQGPKPVMPIQLKNVQDQSRKETAPSAIPVQVKDVQYQPRKSSMSPVIPVSVKDAQRQPLVGSLSTAIPVQMKDMQTQTPKESLSTAIPVQMKDVQTQAPKESLSAPIPAIRPSLVKIDLPAQGKEASASATSEVPSSATGNNAAVECTASSDALLARQSRAADGDKDKAEAKHEAEAQAVAEAAIRQLEIN

SEQ ID NO: 44814 - protein, 251 aa, Sorghum bicolor
  Clone ID: SORBI-28MAY03-C6217_1.pep
MDDDNGLELSLGLSLGGSSGKAKARDAPLEPKAEPQVEESSSKGGSQTPDAPFGKFYQKSAENQEQNSKQRHSPVAQQFGNFWGQPGSSSGPVVDGSIEPVSHQPQLSSYQDGRMPNNSGNNSEEQKPVSSNRKLSEEMNFQKKHQTASDQPDAFSKSSDGGAKNAPISISTDDGSTGENEDVAESEAEGSNSWLVAQREDSAKGSVVNKGSDRKRSADDAAVGFQGKRQPSFSGSESSSGKLTPGNPLSM

SEQ ID NO: 44815 - protein, 117 aa, Sorghum bicolor
  Clone ID: SORBI-28MAY03-C6380_1.pep
MRGLLVLALLVAAAACLVAVRGADGAGECGATPPDRMALKLAPCASAAQNPSSAPSSSCCSAVHSIGKQSPKCLCAVMLSKTAKSAGIKAEVAITIPKRCNLVDRPIGYKCGDYTLP

SEQ ID NO: 44816 - protein, 206 aa, Sorghum bicolor
  unsure (1)..(206): unsure at all Xaa locations
  Clone ID: SORBI-28MAY03-C6526_1.pep
MAENPQLFGNGMPVPFYGEMFVLARDGVEFHVDKIPSAPGGHVKTKGTIYLSNIRMVXFVANKPVGNFFAFDMPLLFVHGEKFNQPIFHCNNISGFVEPVVPDNQNRALYSTHTFKILFKDGGCGTFVPLFLNLVASVRRYNQFEAQSAANMAPRVDPLQAAQTPVDDMMRHAYVDPNDPTKIFLQQPAPESQLRRRNYSGPADAN

SEQ ID NO: 44817 - protein, 217 aa, Sorghum bicolor
  unsure (1)..(217): unsure at all Xaa locations
  Clone ID: SORBI-28MAY03-C6549_1.pep
ARGSRTVYCSNQGRRVTGDDVKGFFKQSCVKVSRYVLDIDHDVTACKLAVVFSELSKVVACAVCGDPHSDFSXSSIEYIIRGPRSESYVNQGNQDIYYPVRVLPSKTAILPVNPKFLPRTEDEKEMVSRTVYCTNIDKKVTEDDVKGFFQQSCGKVSRLRLLGDYVHSTCIAFVEFAEAESAIMALNFSGVVLGLLPIRVSPSKTPVRPRSPRVMSN

SEQ ID NO: 44818 - protein, 464 aa, Sorghum bicolor
  Clone ID: SORBI-28MAY03-C6631_1.pep
MDASSSLVLVMLTLHSAMTAADLPAAQPSHRRLLLQQDTTNLAALPLPANVHGVPVDAHVPSHGTGSFPAASPSRHGGQNDPSEAAPTTPAAYLSRSMRWLYMVVLPALALLLLAGLACWLLCRKSAVATIGPWKTGLSGQLPRAFATGVPKLQRSELERACEDFSNIVASYPHYTVYKGTLSTGVEIAVVSTMITSSKEWSEHSETCFRRKIDTLSRINHKNFINLLGFCEEEEPFTRMMVLEYAPNGTLHESLHAEDFEHIAWRGRMRIIMGLAYCIQHMHELSPPVVHPDLQSSSILLSEDGAAKIADMSVWHEVISEAKTATNGELDHHQEQVSAGLAGNVHSFGVLLLEIISGKLPFPYPGHERSLVSSALECIANDDRSIASLLDPTLCDHIHREDELAVIGEVIRACIQSDPRNRPSMREVAARLREAIGISPVAATPRLSPLWWAELEVLSTAEGS

SEQ ID NO: 44819 - protein, 158 aa, Sorghum bicolor
  Clone ID: SORBI-28MAY03-C66942_1.pep
RGSKVPAEALAAIDRSEMSDVLAAPLRFRSPLSLATASIARGNVCVAGDALHPMTPDLGQGGCSALEDGVVLARCLGDALLLPDGKGKEEERIEAALREYAWIRRWRSVELVATAYAVGFIQQSDSAVVSFLRDRFLSGVLARRLVRMADYDCGTLAN

SEQ ID NO: 44820 - protein, 164 aa, Sorghum bicolor
  Clone ID: SORBI-28MAY03-C6885_1.pep
MSRPNRSDAHLSAEDEATLEAEVRGYYDDAAPKRHTKPSRSEHSAVYADALVPDAGGNTPPELDKFQELEAHTERLVYDGGNVGEEFVETEYYKDLGGVGKQHHTTGTGFIKIDKAKGASFKLSEDPSAEERHASCKGNPATNEWIPSADTVYPASDKPSRSDS

SEQ ID NO: 44821 - protein, 435 aa, Sorghum bicolor
  Clone ID: SORBI-28MAY03-C6890_1.pep
ARGEFMNKMQQERASWLSRIQQEREDLKKDIDIQRIELLNSAKARQMEIDSYLREKEEEFEQKKSKELEYINSEKEAINSKLEHARLELQKLEEERKGAMLERERREQELSEIKNTINALNEQREKLQEQRKLLHSDRESITLQSPRLNELEELKIESENKQLSLRQCGKSKNGGVENLKENGVHLSPDEDQNASPKQTSVKKLEVSPSVSTPISWVRKCAQVFIFKRSPEKSADPHNDRLVPANPRVPIDSSLAAAYSDGLFAHQLENGAGKVPQTVDGLKVGKKRLNNALSHGDSEISQPKRKQQRSTTQTLRVIGGEIDSNCSLSILEEKCSKNEHDTVPVGLCGKGPHNTQAGELPSSDDVPLVNGKSDASEVPEDDEHSEDISVSAADPSNRHGVVDSVDKHEPDEDSDDEGEEEEKTSSAKKIWRFLIT

SEQ ID NO: 44822 - protein, 196 aa, Sorghum bicolor
  Clone ID: SORBI-28MAY03-C9723_1.pep
MAAGRELVVSFGEMLIDFVPTVAGVSLAEAPAFLKAPGGAPANVAIAVSRLGGGAAFVGKLGDDEFGRMLAAILRDNGVDDGGVVFDAGARTALAFVTLRADGEREFMFYRNPSADMLLTADELNVELIKRAAVFHYGSISLIAEPCRTAHLRAMEIAKEAGALLSYDPNLREALWPSREEARTQILSICDQADIV

SEQ ID NO: 44823 - protein, 203 aa, Sorghum bicolor
  Clone ID: SORBI-28MAY03-C9086_1.pep
PQFCGTAEVEQSQHYMPKKRLRNHVSESNPLRVGGQRAGPYHAGGTHLHLEGINVKHKQQQAQHPSRVQAQAPSRCARTYSGDVDEGGEIVDEAGDVGVRLLQQRLLLLHRGRGRRGRRARGRAGAAACFAHRVWLAAVAELAQGAGRGPRGPGPAGAGGRAWADGGGSRPRRSGSRPSAQGGDGGGPAAGNGWRCLRNLGLV

SEQ ID NO: 44824 - protein, 127 aa, Sorghum bicolor
  unsure (1)..(127): unsure at all Xaa locations
  Clone ID: LIB3476-057-P1-K1-H7.pep
MSKAGGGPGSAPGPTAAAAAAAVQKQKSLLQKADADVSSLVDNFSSLINIARVNDPPVRNSQEVFQMEMRAARMVHAADSLLKLVSELKRTAIFSGLASLNENVDRRNXSAGQQAEGTERMLERMGR

SEQ ID NO: 44825 - protein, 423 aa, Sorghum bicolor
  unsure (1)..(423): unsure at all Xaa locations
  Clone ID: SORBI-28MAY03-C1004_1.pep
MASAFGTGTASTCGIKPAPTGVALAAPKMHLSLVSPSLVSLPRKMRPQRKCNFRVNAAKELHFNKDGSAIRKLQNGVNKLADLVGVTLGPKGRNVVLESKYGSPKIVNDGVTVAKEVELEDPVENIGAKLVRQAAAKTNDLAGDGTTTSVVLAQGMITEGVKVVAAGANPVQITRGIEKTAKALVSELQKMSKEVEDSELADVAAVSAGNNYEIGNMIAEAMKKVGRQGVVTLEEGKSAENNLYVVEGMQFDRGYISPYFVTDSEKMTVEYENCKLLLVDKKINNARDLITILEDAIRSGYPILIVAEDIEQEALATLVVNRLRGALKIAAIKAPGFGERKSQYLDDIATLTGGTVIREEVGLSLDKADNQVLGTAAKVVVTKDSTTIVGDGTTXGGVNKRVTQIKNQXEATEQEYEKEKLNE

SEQ ID NO: 44826 - protein, 176 aa, Sorghum bicolor
  Clone ID: SORBI-28MAY03-C7132_1.pep
MLRVAGRRLSSSLSWRPAAAAARGPLAGAGAPDRDDDSARGRSQPRFSIDSPFFVASRGFSSTETLVPRNQDAGFPATVAAVKNPNPKVVYDEYNHERYPPGDPSKRAFAYFVLSGGRFIYASLLRLLVLKFVLSMSASKDVLALASLEVDLSSIEPGTTVTVKWRGKPVFIRRAF

SEQ ID NO: 44827 - protein, 61 aa, Sorghum bicolor
  Clone ID: SORBI-28MAY03-C6922_2.pep
MSMFNRIFGKPKEQANSNALATLDKLNETLDMLEKKEKVLEKKAAAELERAKEFSKAKNKR

SEQ ID NO: 44828 - protein, 246 aa, Sorghum bicolor
  unsure (1)..(246): unsure at all Xaa locations
  Clone ID: SORBI-28MAY03-C6922_1.pep
MSMFNRIFGKPKEFSKAKNKRVPIQSLKRKKLYEQQIEQLGNFQLRIHDQMIRLEAAKATTETVDALXTGTDAMNAMQKATNIDDGEKTMEEINXKTQNMKQIQFALSAPLGAASKFGEDELEPLLLQLGRAVRGALLLQPGAPPPMHPVHVPANKQPARPAPQKATAEDDELAALQAEMALRSGSRVDGKRVLECRHTTKIKAESASLLLPRRCILGGSLPTRSRLARLLRPLLLSVMCVPLGER

SEQ ID NO: 44829 - protein, 438 aa, Sorghum bicolor
  Clone ID: SORBI-28MAY03-C7243_1.pep
MATRRHVLLLAFATLLALAAAAEGAEEGPRGRRLLVLLDDLAVRSSHSAFFGSLQARGFDLDFRLADDPKLSLHRYGQYLYDGLVLFAPSTPRFGGSVDQNAVLEFIDAGHDMILAADSSASDLIRGIATECGVDFDEDPEAMVIDHINYAVTDVEGDHTLIAGDDLIQSDVILGSKKIEAPVLFRGIGHTANPSNSLVLKVLSASPSAYSANPKTKLSSPPSLTGSAISLVSVMQARNNARVLISGSLDLFSNRFLKSGVQKAGSKTRYERAGNEQFVTETSKWVFHERGHLKAVNVKHHKVGEANEPGMYRINDDLEYSVEIYEWSGTSWKPYVADDVQLQFFMMSPYVLKTMSTDNKGLYSTSFKVPDVYGVFQFKVEYQRLGYTGLSFTKQIPVRPYRHNEYERFITSAYPYYTASFSTMGAFFIFSLVYLYHK

SEQ ID NO: 44830 - protein, 286 aa, Sorghum bicolor
  Clone ID: SORBI-28MAY03-C7296_1.pep
MGAPKQKWTSEEEDALRAGVRKHGAGKWRTIQKDPEFSPVLSSRSNIDLKDKWRNLSFSASGLGSSKVRVPRITGPTSSPSPSAQALLLPAPNKVTEATLPADAEKKPQDGKTPPKYGVMIMEALSELNEPNGSDMAAILRFIEERHVVQPTFRRFLTSKLRRLADSNKIVKIDKSYRLPDSFATRTPAPIKTSAPKQKDPSKPSKVSKTIGLFTASSPALEAAMAAAVKVADAEAKAHDAHDQMMEAERILKMAEDTESLLTIAVEIYDRCLRGEITTIVAQRDV

SEQ ID NO: 44831 - protein, 103 aa, Sorghum bicolor
  Clone ID: SORBI-28MAY03-C73480_1.pep
MKGSTLFVILVLQAALVMGIFAVVAKENAAVGESKGNTETNGGKLGCCTKCNFSFSGLYTCDDIVSKCDPVCKVCTVVKKYPVKQFQCTDTFLGMCGPPCKKN

SEQ ID NO: 44832 - protein, 388 aa, Sorghum bicolor
  Clone ID: SORBI-28MAY03-C7685_1.pep
MSPAAPAPRRHRGVSGRATLPVHHGESRVPPGACFMGTSPMLGPMRVSLVCGASPNHHRPRNSDTSRQQKGGSSRGKGKSYQDKDDSENIDEFDSDIMFSKNGPPISLASNSRPQATSAPGEREKEIVELFKRVQAQLRARGKGREDKKPEPAKVQGERGSVDSLLKLLRKHSVDQRRKSSDDKEQNFDVMRRNNDSGNRQSSTIFGTKSDIQEEQRKPPPAPFKRPASNFRRRSPVPGVKFQPAINTDVDRDADRKSIGSNVADAVQKAKTVLDERTVTDEPDSMSPYEPDSVIEPENISLEDLDDILDDDEESDTDEPDDEYPEPSLEITDVTDTDELHENNSTESSDLTSLKVAELRELAKSRGIKGYSKMKKNELIEVVSSSMA

SEQ ID NO: 44833 - protein, 310 aa, Sorghum bicolor
  unsure (1)..(310): unsure at all Xaa locations
  Clone ID: SORBI-28MAY03-C7754_1.pep
MVVLAASIVSKSGKALVSRQFVDMSRIRIEGLLAAFPKLVGTGKQHTYVETENVRYVYQPIEGLYLLLITNKQSNILEDLDTLRLLSKLVPEYSPSLDEEGVCKTAFEIIFAFDEAISLGNKENVTVQQVKQYCEMESHEEKAHKLMMQTKINETKDLMKKRANELDKMRMERGKLDKGGYSSISGPRMIEKTFSDMSISGSGFGSGSGLGGLSTDMDSFASKPKGRPSTAATAPGKGFGMKLGKTQKTNQFLESLKAEGEVILEDVQPSAVSTRSAXSTSDPVTVTIEEKLNVVVXKRDGGINNFDVQG

SEQ ID NO: 44834 - protein, 155 aa, Sorghum bicolor
  Clone ID: SORBI-28MAY03-C7864_1.pep
RKIGFDLDYDEKDTSYNRIKSLVTEELKQYFRPEFLNRLDEMIVFRQLTKLEVKEIADIMLKEVFDRLKAKDINLQVTEKFRDRVVDEGYNPSYGARPLRRAIMRLLEDSLAEKMLAGEVKEGDSAIVDVDSDGKVIVLNGGSGVAEPLEPALST

SEQ ID NO: 44835 - protein, 259 aa, Sorghum bicolor
  Clone ID: SORBI-28MAY03-C1135_1.pep
MDGGAAFPGTPPVPRSPEDVFRDYRARQAGLIRALTTDVEKFYVMCDPEKENLCLYGLPNETWEVNLPAEEVPPELPEPALGINFARDGMNEKDWLSLVAVHSDSWLMSVAFYFGARFGFDKEARKRLFTMINNLPSIYEVVTGTAKKEPKEKTHKSNNKTNKSGSKPSRQAEPNNSRVPKMPPPKDEEESEGEEGEPQEDHETALCGACGLGYDDFWICCDLCETWFHGKCVKITPAKAEHIKQYKCPSCTGSKRAKA

SEQ ID NO: 44836 - protein, 621 aa, Sorghum bicolor
  unsure (1)..(621): unsure at all Xaa locations
  Clone ID: SORBI-28MAY03-C1157_1.pep
MGAEQGYDDMEVTLRDSDVFNYIVEVLQNVRMDPFLIDLRYKSQYDFLLDLVDPTKKRTSDEEAMFATTLEALSEAVSTIDTMYHHALLHNIFTMCVWYLNSYTRVVLLDLITRLAAVADQYLRECLQMLVNNFTPPGPLIRYIEEPRWLAKKEEIYSQLQESLKKISDTVPLAPRMLKDIIDRSMPKLFDSKAKMVSFVECMLGLDADTWDIIGPSLLEKVVYLLTELDVNITWEDILQDEHNKGIFDMELEDLDEDEDNLGQEGTKVLFGGNVCAEKLDGLMVVVCKHLKSRAEEPDRLNKEFDTLKAIFKSHVIRVHKSKFAQFIMFYACSLYPKICGEGFAFFLVDIFIDKDKKEDAITRMSAVSYVGSYLSRARFISVNTVVAVLQRLVEWCGDYCGSQLDKGVTANPIKHQLFYASCQAVMYVLCFRLRSIMDYPNLKLQLFXMRIQNILAHPLEPLKVCLPSIVNEFLRQARSASLFHASVNSTHEDAVESDLSKAFGGLNRLDMFFPFDPYLLKESDRYIRPNFEFWSLVKTTYSNNNSDEDNDELADIDAPGMNVGSLDDHFEIDFNNDDDIEYSMNKMSITPHRTFYHPLATNSEFSSMPARIRPSVSPPS

SEQ ID NO: 44837 - protein, 406 aa, Sorghum bicolor
  Clone ID: SORBI-28MAY03-C12118_1.pep
MELTGAALRRYALPSASPVSARVGRRRRLPRVACVGGGGGFAGAGHLRYYEGAPRRKAVEAVARDLGKLRAMGLVAGDAAKEKVLSEATDLLLQELSQMKDEEYKIKKVEKEEKAAMKALKKQEDATKTAIAMMKCEEDESSSESSESDCEDEATMNVDQRTMISTADPEVVASSILAVSAMECDKAAMKAMKQMEKEQMKAMKKMEKAAKKAMKMEKEAKKMAMATLNGCRDEDDSSCSSESSESECEGQLVRMSRCATITTPEMPSPTTGLPIIVPQIPAPLAPEPSQPLEPVTAVQATRVSSVAVAETSTTSRIEVCMGGKCKKAGALALLQEFEKTVGTEGAVVGCKCLGKCGLGPNVRLRSDISAEGSAKGSPLCIGVGFEDVSTIVAGLFGDADLGMTPT

SEQ ID NO: 44838 - protein, 69 aa, Sorghum bicolor
  Clone ID: SORBI-28MAY03-C12272_1.pep
MSATTAAVPFWRAAGMTYIGYSNICAALVRNCLKEPFKSEAASREKVHFSISKWADGKQEKPTVRTEDE

SEQ ID NO: 44839 - protein, 205 aa, Sorghum bicolor
  Clone ID: SORBI-28MAY03-C9053_1.pep
SEPPSVASPKSSATTAALADFAFSSSPDRSVVGASFASSLGGSLDDSTIASADTGVSCFPVSASLDSVFSPLGASSVFSRPCKAAAVFSVSEFSSFPKLSLLGASFTSWQLGGSLDISTTASPDGGNCIPGSAPTSFEVSPPGECLVFSRSISVFSSVPEGPELATSCTSWLSCSLDMSTSASPDEGGGNCSSVPASPSFTFSLP

SEQ ID NO: 44840 - protein, 681 aa, Sorghum bicolor
  Clone ID: SORBI-28MAY03-C9197_1.pep
MKRVEHVLSQENDKIVDEEDTLSDQECEVDPVDWNDDEKSIFIEAMNNYGKDFARARGCVKSKSYEQCKVFFSKARKSLGLDLIHQGAADVSMPASDTNGGRSDTDEACAVEMDSAICSTQSCSKIVIDVCPTEGAIGGPNSVIISKQAGEISNGCDVDAKIEEDEEEADKNCSIVDDKRSSDGTHQAVPIDARGPESTDKLQGTDDVVDQVNVHSSSAISSTTKHTMAMHSEVRSSLHSIEVLQTDKAEGTGTDPSQVEECSHHALDNTPMKTGNSGASDSGIKDNVHILNMTGTSTVSPAFTSSYQHSVPGDMPLLKPKPLVTPLTPKDLMPVQFSSVLPDPTAFRFEGIASITTPNFEDSGNRVSSALGAKDMSKYPAFKDPSGNQHDTLFRSTGGYVNHRLTTELPIFSERTASGNVSTSQTDRFNQTKFQNGRSSSLCLPNSSDGIQWSRKHEEIQEGSLRPCSRNTSSEGDEQQKRPGDVKLFGQILSQPSTLQSSGSLCNGSKSKPPSPKIDTSSVRLMNNPRDRVVCSSRPGITPHLGLEERSARSYGHLDGSTTQPEPLLVMAKCQRSLAGVPFYSAKNGTLGVFPDYQQPLVPPHQSDPKRQERFSDPQKRNGLELISGFQQPGRVARFGGAGILVSNVSDPVAAAIKAQYGPGSKIMGSDADPWKDIGSR

SEQ ID NO: 44841 - protein, 369 aa, Sorghum bicolor
  unsure (1)..(369): unsure at all Xaa locations
  Clone ID: SORBI-28MAY03-C9638_1.pep
MATAMSPSPSAAIARPSHPRSCAAASVALRSGFLGRGLAAVVPVAVDDPRCRLRRRVSFSVRMAWDGPLSSVRLIMQGRNVKLSDKLKEHIEDKVGRAVSKHCHLVREVDVRLSARGGELGRGPKTSRCEITLFSKRHGVLRAEEDAESTYASIDLAAAIIKRKLRKIKEKETEVRRDGDGGAGGAWEEELPLLDDDLVEADELAAAVGAEDEQTVVAKVVRTKVFEMPPLTVEEALEQLDNVGHNFYCFRDEATGQVNILYRRKEGGYGLIIPKEDGNFDNKDTVGXRNHHHPPLRSRPWPCTPPPTTTDDPFLFFFACLLAATVKQTPPRTRRHLISISCMHWHIAVSVSVSVSLCHTHYSHSIAQV

SEQ ID NO: 44842 - protein, 455 aa, Sorghum bicolor
  Clone ID: SORBI-28MAY03-C9652_1.pep
MASPDAEQPAPTEPERWRDLDMLLSRPGNLVEASFDPSPGLRDLLGSLVEVLVVGAGGLGCELLKDLALSGFKKLHVIDMDTIDVSNLNRQFLFRVQDVGKSKAEVAAKRVMERVNGVNIVPHFCRIEDKEIEFYSQFHIIVLGLDSIEARSYINSVACGFLEYDSNDNPLEETVKPMVDGGTEGFKGHARVIIPGKTPCFECNIWLFPPQVKFPLCTLAETPRTAAHCIEYAHLIKWDEVHPGKPFDADDAEHMQWIYSEALKRAELFGISGVTYSLTQGVVKNIIPAIASTNAIISAACALEAFKLISGCSKSVSNYLTYNGLEGTHIKVTEFIRDKDCLVCGPGTLIELDTTSTLSDFIKMLEEHPTLRMSKASVTHEGNNLYMQSPEVLEQMTRPNLSVPMFELLKEVPYTTVHATGMAENNGKKVSSLRKLRVAFKGIEEASKMDTTVSS

SEQ ID NO: 44843 - protein, 161 aa, Sorghum bicolor
  Clone ID: SORBI-28MAY03-C9714_1.pep
MAATTAYSTALLGGARLPSARGAAAPPSSLGLLPLRSPLPLRLQVQDSAPPRLSLLRVKASSDDSSAASGDELIADLKAKWDAVENKSTVLTYAGGAVVALWLTSVIVGAINSVPLLPKIMELVGLGYTGWFVYRYLLFKESRKELADDIESLKKKIAGSE

SEQ ID NO: 44844 - protein, 172 aa, Sorghum bicolor
  Clone ID: SORBI-28MAY03-C9237_1.pep
MAAMNSDLGGLGGRPANPQANPFGTALHGAGSGLIRTGLEAYGGRIIDSSSEFMQSNITQYLSNPQYYFQVNSQYVRNKLKVILFPFLHRGHWTRITEPVGGRLSYKPPVQDINAPDLYIPLMAFGTYIIVAGYALGVLGRFTPEALTLQFSKGILGWFLQVMLIKCLLYSG

SEQ ID NO: 44845 - protein, 142 aa, Sorghum bicolor
  Clone ID: LIB3476-060-P1-K1-A10.pep
SNITQYLSDPQYYFQVNSQYVRNKLKVILFPFLHRGHWTRITEPVGGRLSYKPPVQDINAPDLYIPLMAFGTYIVVAGYALGVLGRFTSEALTLQFSKGILGWFLQVILIKGLLYSLGSSEAPLLDIVAYAGYGFAGTSLAM

SEQ ID NO: 44846 - protein, 128 aa, Sorghum bicolor
  unsure (1)..(128): unsure at all Xaa locations
  Clone ID: LIB3476-061-P1-K1-B6.pep
MAAMKTDMGGLGGRPTNQQANPFGTALHGAGPGLIRTGLEAYGXRFLDSSSEFMQSNITQYLSDPQYYFQVNSQYVRNKLKVILFPFLHRSHNICLTFTVFLKGHWTRITEPVXGRLFYKPXVQDINA

SEQ ID NO: 44847 - protein, 81 aa, Sorghum bicolor
  Clone ID: SORBI-28MAY03-C12605_2.pep
EKPNILKFLILVCKNVNYHLFEHATKNTEWLLMLCLVYRRKIVALLLVIFYNAAIFRSCFRRLCLLLIKTIFVLSIDMSII

SEQ ID NO: 44848 - protein, 121 aa, Sorghum bicolor
  Clone ID: LIB5052-012-A1-XP1-H1.pep
RPGWGSRRRHHYCHPHRDPGLHPSHRRPSHGDSRPLPQPPMPSTGTWPPPLRISGAGESYIDPNTPPASAASRSRRQHPLASTARSTSKRHRSGGTLWLDLRQVLERVTRRSRTVWIFRSR

SEQ ID NO: 44849 - protein, 72 aa, Sorghum bicolor
  Clone ID: LIB3478-046-P1-K1-C6.pep
ICFELVLNASIMNSWRSGRTGASSSGLLLPAGGKAEATDLAELGTYIAGDKTWRRARTPQRRHVAARRGVVR

SEQ ID NO: 44850 - protein, 99 aa, Sorghum bicolor
  Clone ID: LIB3480-007-P1-K1-D3.pep
VCERADPAAASLPFSLSAQIRRRYGELPPSLSLGSMCGLRSSARMVSSLPLPRQRAWAATSGSNPLLRPALRWWTRSSAVDSPKCGLLSLPICLGCLIA

SEQ ID NO: 44851 - protein, 46 aa, Sorghum bicolor
  unsure (1)..(46): unsure at all Xaa locations
  Clone ID: LIB3478-052-P1-K1-D6.pep
FASRRLMRLCVNCGKRIKVLMVAIFISHDRXCVRANHMSCCCISQH

SEQ ID NO: 44852 - protein, 326 aa, Sorghum bicolor
  Clone ID: SORBI-28MAY03-C14328_1.pep
MASPIPREWAGLQQFPAATQTKLHELLGKLKEEDVSTLTILVMGKGGVGKSSTVNSIVGERVTTVSAFQSEGLRPTMCSRTRAGFTLNIIDTPGLIEGGYINEQAVDIIKRFLLGKTIDVLLYVDRLDAYRMDTLDEQVIRAITNSFGKDIWRRSLVVLTHAQLSPPDGIDYNDFFTRRSEALLRYIRSGAGINKREYGDFPLPIALVENSGRCKANEHGEKILPDGTPWVPNLMKEITVVISNGSKSIHVDQKLIDGPNPNNRWKMFIPLILAVEYFLVVKGIRRAIHADIANGKVDDWEQRYRDLVGSRDPVEQKGSTSRNRKA

SEQ ID NO: 44853 - protein, 309 aa, Sorghum bicolor
  Clone ID: SORBI-28MAY03-C14530_1.pep
MADQLGFYTIRSHGMILARLHMYDWIILLLLAVIDGLLNLIEPFHRFVGKDMMTDLRYPMKGNTVPFWAVPLIGIILPWAIFVGIYFKKKNFYDLHHGILGILYSVLITAVITDAIKDGVGRPRPDFFWRCFPDGNDVYDNITTGVICNGVKSVIKEGHKSFPSGHSSWSFAGLGFLAWYLAGKIAAFDRKGHVAKLCIVFLPLLTAALVAVSRVDDYWHHWQDVFAGALIGLTVASFCYLQFFPYPFDGDAWWPHAYTVQVAEERNSRHANSYSVRPTEIETVNIPGHGGMTLRDTLNDVESGSGRRL

SEQ ID NO: 44854 - protein, 197 aa, Sorghum bicolor
  Clone ID: SORBI-28MAY03-C148_1.pep
MAVAEVAIEVPPQQQPAAAAAATREPAVVPRVLQYLYLASAWVACAGVAAATVARRALGDSSPVVWALLKVSIGALVFPALLILIFAVRVLRAMLAAGFRRSLRTHAREIQIQARKMFGALTWKALQDPIVLAWLASFLFILLLGASVLVFVGLLPMEESRRERIGYVLSDVGVLGAMSMYCFIIIPSFALKLWRGM

SEQ ID NO: 44855 - protein, 244 aa, Sorghum bicolor
  Clone ID: SORBI-28MAY03-C1063_1.pep
MAAGSTAKTLLLGFLLALTATSTPAAATTLTLHNLCPYPVWPLVTPNTGFPAISENTGRLDGGGRGLVSFRFPDSFWAGRVVARTGCSSRSGSPPSSSSSGCETGSTPPATVVQLVVHAEGQDLAAYSVSLVDGFNVPAVVSPQAVGGGQCPALGCAADLNGGCPRSQRVVGAGGGVVACKGPAAYFKERCPLTRTTATDVEPVPQRCFAPGELKVVFCQSAMVNNNDAAGEPGRIRTVVVADN

SEQ ID NO: 44856 - protein, 413 aa, Sorghum bicolor
  Clone ID: SORBI-28MAY03-C10736_1.pep
MVGPGGALAAAPRLLVLVLLSFLAGGARASPATDALRRVSPLAAAGGLCQQLLLPQGYPCTEHTVQTDDGFLLSLQHIPHGKNGIPDNAGPPVFLQHGLFQGGDTWFINSNEQSLGYILADNGFDVWIGNVRGTRWSKGHSTLSVHDKLFWEWSWQDLAEYDVLAMLSYVYTITQSKISYVGHSQGTIMGLAAFTMPEIVKMISSAVLLCPISYLDHISASFVLRAVAMHLDQMLVAMGIHQLNFRSDMGVQILDSLCDDEHLDCNDLLSSITGQNCCFNSSRIDYYLEYEPHPSSTKNLRHLFQMIRKGSFAKYDYGWWGNIRHYGQRHPPSFDLSSIPESLPIWMGYGGLDALADVTDVERTIKELRSTPELLYIGDYGHIDFIMSVKAKDDVYVDLMRFLRAQQGMHSSY

SEQ ID NO: 44857 - protein, 247 aa, Sorghum bicolor
  Clone ID: SORBI-28MAY03-C99_1.pep
MAALRLASFTLRPAAAAAASASSGATPAAPRSASFARAARGLPSLRLAPPRRRGDLVRPRAEAAADSYASALSEVAVENGTLEQTVSDLEKLQKIFADETVAEFFDNPTVPREEKTALIDEIAKSYELQPHVVNFINVVVDNFRATILPEIVVEFENIFNSLTGTEVATVTSVVQLESQDLAQIAQHVQKMTGAKNVRLKTQLDPELIAGFTVQYGRDGSSLIDMSVRKQIEEITSEFELPDVPLEV

SEQ ID NO: 44858 - protein, 144 aa, Sorghum bicolor
  unsure (1)..(144): unsure at all Xaa locations
  Clone ID: LIB3481-057-Q6-K1-E3.pep
FFDNPTVPREXXTALIDEIAKSYELQPHVVNFINVVVDNFRATILPEIVVEFENIFNSLTGTEVATVTSVVQLESQDLAQIAQHVQKMTGAKNVRLKTQLDPELIAGFTVQYGRDGSSLIDMSVRKQIEEITSEFELPDVPLEV

SEQ ID NO: 44859 - protein, 207 aa, Sorghum bicolor
  Clone ID: SORBI-28MAY03-C108265_1.pep
MADALVSSKKASASAAVVLAVAVATMACLSAPVAALVPYGRAGGGLFDLMLLDDPFRVLEQSPPVPLPRASLDSASVALARCDWKETPDAHVITVDVPGVRREDVKVEVEENSRVLRVSGERRADEEKEGERWHRAERAAGRFWRRFRMPAGADVDRVSARLEDGVLTVTMPKVAGHRGREPRVISIDGGDVGGAEAAEVKASKAEM

SEQ ID NO: 44860 - protein, 222 aa, Sorghum bicolor
  Clone ID: SORBI-28MAY03-C108644_1.pep
MGMSRAPRRRASPSAAAAVPWLLLFAVLFVGRATAQGPGATPLSKHASFFDRNGDGVVSFEETYGAFRALGFGFGMSGVSAAFINGALGSKCRPQNATSSKLDIYIEDIYKGKHGSDSGSYDTEGRFVPDKFEAIFANHAKTVPDALTSDEIDQLLQANREPGDYTGWAGAEAEWKILYSLGKNQNGLLHKDVARSVYDGTLFHRLAPNWKPLDKESVIREN

SEQ ID NO: 44861 - protein, 401 aa, Sorghum bicolor
  Clone ID: SORBI-28MAY03-C11057_1.pep
MDSDWKYNDEVSHKSGNVMDKAKVWPEFQYSEMCFSDRIIIELSEVGVSIEPVPDLAQSEDEDINAEICKLEGQLHKEVVEKKNLLLKLDGIVTTAKESQQREFSRLAMDRLLLRAYEKYMAFYGPNVSSSKNVSRAGRHAALSFVKRVLVRCQNYEEAGTSCFDEPTFKDMFLSATSHRSSPDAASQDNNTAVKPVHRASASDASRGSSHLTDLSFAKEDPWTNNVKQRELLLDEVVGSITGGTLKTSGLGTSLVSNTKGKRSERDREGKGHNRDSLRSGRPSSSNAKGERKNKTKPKQKTANISAPSSSNPRDLQLPAKITPPSSGKDNTTASAAARHDDPANASNDAEMPDLSNLELPGMDVDFGGWLNLDDDDGLQDLDLMGLEIPMDDINEINLMI

SEQ ID NO: 44862 - protein, 321 aa, Sorghum bicolor
  Clone ID: SORBI-28MAY03-C11327_1.pep
MAVDPSAAAQAEAAARRIEEAEAFFRAAPPLRDRDRLAASLADFVARHAAGSGGVVCITSGGTTVPLEQRCVRFIDNFSSGQRGAASTEYFLKAGYPVIFIHRRGSKQPYCRFLPEDSFLDLFELGEDSEIQVPQSHSSVVKAAISNYRKAIDEGLLLKLPFTTIFEYLQLLQMVAISMNCLGHRGMFYLAAAVSDFYVPWETMAKHKIQSASGPLNMQLNQAPKMLFILRKKWAPAAFCVSFKLETDPNILLQKAEMALEKYGMNVVVANELANYKDVVVMVTSSRRTTVSRSSKEEDLELQLTDLLVKMHSEHIAQPNL

SEQ ID NO: 44863 - protein, 212 aa, Sorghum bicolor
  unsure (1)..(212): unsure at all Xaa locations
  Clone ID: SORBI-28MAY03-C1683_1.pep
MITGKISRSAIAALVADVFSNVAVAENXVSEVSTSSSATTKTITXAFISIPVDASRAEYQDAPAKAQVKEETLASKQANEAEAAASKYEADTKKAPLEDAAATASPVNDERASLENLLSIPKVISTDFFWEKFSTQLAEVTTPRTSLQKEPKAQIATVRGQEKAKKLTPRIATVKPAAQKVKQQLKQPDPKPEVRPVFGGLFKQETVYVDDD

SEQ ID NO: 44864 - protein, 409 aa, Sorghum bicolor
  unsure (1)..(409): unsure at all Xaa locations
  Clone ID: SORBI-28MAY03-C17004_1.pep
MGLRVRASSLLLSLALELVVALVSVSAQQKFGINYGQIANNLPEPTQVASLLQSMNVNKVKLYDADPRVLTAFANTGVEFIIAVGNENLQTMAASPAAARQWVATNVQPYLPAXTRITCVTVGNEVFSSNDTSMMASLLPAMKAVYAALGGLGLGSQVTVSSAHSVNVLATSFPPSSGAFREDLAEYIKPILVFLGRPAPPVPSFAFPLAACKASPGSVSLPYVLFEPNPGVRDPNTGLTYDNMLYAQIDAVYAAMKAMGHTDVGVRISETGWPSKGDEDETGATVQNAAAYNGNLMQRIAMNQGTPLKPNVPVDVYVFALFNEDMKPGPASERNYGLFYPNGSPVYALNSAGSGGGSSPGGSLNPYYTSMFSSSSRSAVSATFLTERVILLLLLQAIVILRQSYSLYC

SEQ ID NO: 44865 - protein, 135 aa, Sorghum bicolor
  Clone ID: SORBI-28MAY03-C17180_1.pep
MSESKVYTLEEVAKHNTKDDCWLVIGGKVYNVTKFLDDHPGGDDVLLSSTAKDATDDFEDVGHSTTARAMMDEYLVGEIDAATIPTKVKYTPPKQPHYNQDKTPEFVIKILQFLVPLAILGLAVAVRIYTKSESA

SEQ ID NO: 44866 - protein, 311 aa, Sorghum bicolor
  unsure (1)..(311): unsure at all Xaa locations
  Clone ID: SORBI-28MAY03-C12497_1.pep
MAALLLRRLAGTHRGRVPLGAAAAAACGGAALFYASSSPTVAYLEEKGEAAEKVALNPDKWLEFKLQDKATVSHNSQLFRFSFDPSTKLGLDVASCLITRAPIGEEVEGRRKFVIRPYTPISDPDSKGYFDLLIKVYPDGKMSQYFASLKPGDVLEVKGPIEKLRYSPNMXKQIGMIAGGTGITPMLQVVRAILKNPDDNTQVSLIYANVSPDDILLKRELDRLANSYPNFKVFYTVDKPSTDWRGGVGFVSKDMVLKGLPGPAEDSLILVCGPPGMMNHISGDKAKDRSQGEVSGILKDLGYTAEMVYKF

SEQ ID NO: 44867 - protein, 374 aa, Sorghum bicolor
  Clone ID: SORBI-28MAY03-C12890_1.pep
KSKIYFAMEYVRGGELFARVARGRLKEDVARRYFHQLIGAVDFCHSRGVYHRDLKPENLLVDEHGNLKVSDFGLSALKECQKQDGLLHTTCGTPAYVAPEIISKKGYDGAKADIWSCGVILFVLLAGYLPFHDSNLMEMYRRISRGDVKYPQWFSSDLRRFMSKLLDPNPNTRITIEKLVEHPWFKKGYKPAVMLAQPHGSNSLKDVQVAFSTADNEGGSKVEQPAGSSVKPSSLNAFDIISHSKGFDLSGLFAVDQEQKASNSRFMTQKPASAIVSKLEQIAETESFMVKKQDGLVKLQGSKEGRKGQLAIDAEIFEVTPAFYVVEVKKSAGDTLEYERFCNKGLRPSLSDICWSSQSEAPSGVQSSPLKPSS

SEQ ID NO: 44868 - protein, 349 aa, Sorghum bicolor
  Clone ID: SORBI-28MAY03-C12979_1.pep
MATPRKPIKLTLPSQETTIGKFLTHSGTFKDGDLRVNKDGLRIVSQSEGGEAPPIEPLDSQLSLDDLDVIKVIGKGNSGNVQLVRHKFTGQFFALKVIQLNIDESIRKQIAKELKINLSTQCQYVVVFYQCFYVNGAISIVLEYMDGGSLADFLKTVKTIPEDHLAAICKQVLKGLIHLHHESHIIHRDLKPSNILINHRGEVKISDFAARPLGPPPPRRAARAGPGSSLAPAGFSAELRGSRRDIWGRGRVLRECATGLSPIPPPQSFYELLEAVVEHPPPSAPSEEFSPQFCSFISSCIQKDANDRKSAQVLLDHPFLSMYDDLHVDLASYFTTAGSPLATFNSRQL

SEQ ID NO: 44869 - protein, 281 aa, Sorghum bicolor
  Clone ID: SORBI-28MAY03-C13129_1.pep
ARGDGNSSMVFRERPYYSAPQRTNINAPPVPTPPGSSDSLHFVHGGYAPRAAPPNTISTYPAPAFATSNNTVTVTHEPDIPSYRPAVPSYPPATSAAASSIHAEAATSPRHLGHVALGSGGSARSRRLRDSYHAFRPLIIEENNLRGPAAERFMMLDELVIHESREDSDPHWDMRLDIDDMSYEELLALGERIGNVNTGLADEKLSSCVMEITCCSSARTHGDTESARCVICLEDYKFKDSIGKLKCGHDYHADCIKKWLQVKNACPVCKASAADDSGGTE

SEQ ID NO: 44870 - protein, 223 aa, Sorghum bicolor
  Clone ID: SORBI-28MAY03-C14132_1.pep
RPGRVSVPLGVLKANVIKFEPELPSWKSSAIADLGVGVENKIAMHFDRVFWPNVEVLGMVGPTPKACGYFLNLHKATGNPVLVYMAAGRFAQEVEKLSDKEAVSLVVSHLKKMLPDASEPTQYLVSRWGSDPNSLGSYSCDLVGKPADVCARFSAPVDNLYFAGEAASAEHSGSVHGAYSSGIAAAEECRKRLLTLKGIPDLVQVAAWEEMAGAVAPLQICRT

SEQ ID NO: 44871 - protein, 226 aa, Sorghum bicolor
  Clone ID: SORBI-28MAY03-C14288_1.pep
HEEDIEIVYRPLSEMYEAAAEADVVFTSTASETPLFTKEHADALPTISDAMGGVRLFIDISVPRNVSACVSEIGSARVYNVDDLKEVVEANKEDRLRKAMEAQTIITEELKRFEAWRDSLETVPTIKKLRSYADRIRASELEKCLQKIGDDVLTKKMRRAIEELSTGIVNKLLHGPLQHLRCDGSNSRTLDETLENMHALNRMFSLDTEKAIIEQKIKAKVEKTQN

SEQ ID NO: 44872 - protein, 327 aa, Sorghum bicolor
  Clone ID: SORBI-28MAY03-C9283_1.pep
MVSAPTLSFLQIHRSSPSRPQSQPRPAPPMMQQHQQEDDPAPPPAVADPDPPPPPDRGDAAASASRNASSKYDFVKVKVWLGENADHYYVLSRFLLSRMLTVTKIPNHVAIKIALELKKLLVDNSLLDVSQSDLEANLFKLMEKRGYGEDYINRYKMMTRFHHQRVPLVILVCGTACTGKSTIATQLAQRLNLPNVLQTDMVYELLRTSTDAPLTSVPVWARDFNSPEELITEFCRECRVVRKGLAGDLKKAMKDGKPIIIEGIHLDPSIYLMDEEKRDGNSRTEKTVMDSENPGISVERKTEHQSKNGLAENRMNPTEDNKLVKIK

SEQ ID NO: 44873 - protein, 224 aa, Sorghum bicolor
  unsure (1)..(224): unsure at all Xaa locations
  Clone ID: LIB5048-008-R1-XP1-G11.pep
MSCGRRDFTPRLSSLRTSLVLDSEAGMRGGDCFPRGANRLASTVKDCCMNLAGLEPFVDEAERLAKEAERMRYLREKARRKEQRDRERMAEDRIRDFDPKQGGEYFTRLQFVDLTKFDLDEESPYGPMRFTDAVYKSKDDYELCEGMNIFSVRIATSDVGFPIHVYGTVIARDSLDKKCVYVFRCDRDHCQLINSKDESLVLTGPKRGLAXIDENYVEIDLKIR

SEQ ID NO: 44874 - protein, 150 aa, Sorghum bicolor
  Clone ID: LIB3476-060-P1-K1-F3.pep
MVSAPTLSFLQIHRSSPSRPQSQPRPAPPMMQQHQQEEDRIRDFDPKQGGEYFTRLQFVDLTKFDLDEESPYGPMRFTDAVYKSKDDYELCEGINIFSVRIATSDVGFPIHVYGTVIARDSLDKKCVYVFRCDRDHCQLINSKDESLVLT

SEQ ID NO: 44875 - protein, 136 aa, Sorghum bicolor
  Clone ID: SORBI-28MAY03-C2139_1.pep
MGKDTIADLLTSIRNADMNKKGTVRVVSTNITENIVKILLREGFIESVRKHQESNRYFLVLTLRHQRRKTRKGIYRTRTFLKRISRPGLRIYANYQGIPKVLGGMGIAILSTSRGIMTDREARLNRIGGEVLCYIW

SEQ ID NO: 44876 - protein, 190 aa, Sorghum bicolor
  Clone ID: SORBI-28MAY03-C21544_1.pep
MGGGGAAAVAAALVVVVLWAGVASAAVYEVGDKTGWTIMGNPDYAAWANSKKFHLGDTVVFTYNKQFHNVLAVSKADYKNCDATKPTATWSTGNDSVVLNTTGHHYFLCGFTGHCAAGQKVDIRVAASSAAPSASPTAAPSPTPSGSKPSGGATAAPSPHPNAAPKALSASSLAATVAASLLSLAAAVLA

SEQ ID NO: 44877 - protein, 162 aa, Sorghum bicolor
  Clone ID: SORBI-28MAY03-C22679_1.pep
MGRRGEPYYVEAAPPVDVNKNTEWFMYPGVWTTYILLLFFAWLLVLSVSGCSPGAAWTVVNLAHFAITYHFFHWKKGTPFAADDQGIYSRLTWWEQMDNGQQLTRNRKFLTVVPVVLYLIASHLTDYKQPMFFLNTIAVFVLVVAKLPNMHKVRIFGINADI

SEQ ID NO: 44878 - protein, 125 aa, Sorghum bicolor
  Clone ID: SORBI-28MAY03-C2077_2.pep
MPLDITYFISHLQSYWEITSDDYLAYIGKYVVGLGPWKDTIVPASGNYLMPPSDLVARAHAHNLQVHPYTYRNENQFLHFNFHQDPYTEYDFWINTVGVDGLFTDFTGTLHRYPELTSPHPKDET

SEQ ID NO: 44879 - protein, 391 aa, Sorghum bicolor
  Clone ID: SORBI-28MAY03-C2077_1.pep
MRPSLYCAPLFLLLLLHLAFARPLFPLPSKTKYEEKKPIQTFRPYNIAHRGSNGEIPEETAAAYLRAIEEGADFIESDILASKDGTLICFHDVTLDDTTDVARRKEFANRRRTYEVEWFNVSGWFVVDFTLEELKTLKVKQRYSFRDQKYNGMFSIITFEEFISIALDADRTVGIYPEIKDPVFINKHVKWADGKKFEDKFVDTLLKYGYKGQYMSENWLKQPLFIQSFAPTSIVHVSDLIDSPKVFLIDDITVRTQDTNQSYWEITSDDYLAYIGKYVVGLGPWKDTIVPASGNYLMPPSDLVARAHAHNLQVHPYTYRNENQFLHFNFHQDPYTEYDFWINTVGVDGLFTDFTGTLHRYQELTSPHPKDETANSLLVKISQMISAYEGL

SEQ ID NO: 44880 - protein, 195 aa, Sorghum bicolor
  Clone ID: SORBI-28MAY03-C15384_1.pep
MARGGGAAALVVVAAFVVVLSVSAGVARADFAKDRAMCADKLMGLATCLTFVQDKATARAPTPDCCAGLKQVVAASKMCMCVLVKDRDEPALGFKINVTRAMDLPSLCSNPATFSDCPKILGMSPDAPEAEIFKEYAKKHEGQNGTTIPAAATGAAATGKSTSAAPTADGAGRQPCAVFFYLVSALFASVAVLLG

SEQ ID NO: 44881 - protein, 143 aa, Sorghum bicolor
  Clone ID: SORBI-28MAY03-C15359_1.pep
MADDDYNEMDMGYEDEPPEAEIEEGAEEELENNNEDTPDDVVGAEAEDKEQEKIARARKTTKYMTKYERARILGTRALQISMNAPVMVELEGETDPLEIAMKELRARKIPFTIRRYLPDGSYEDWSVDELIVEDSWKRQVGGE

SEQ ID NO: 44882 - protein, 105 aa, Sorghum bicolor
  Clone ID: SORBI-28MAY03-C13790_2.pep
MVNVPKTKKTYCKNKECRKHTLHKVTQYKKGKDSLAAQGKRRYDRKQSGYGGQTKPVFHKKAKTTKKIVLKLQCQSCKHYSQHPIKRCKHFEIGGDKKGKGTSLF

SEQ ID NO: 44883 - protein, 121 aa, Sorghum bicolor
  Clone ID: SORBI-28MAY03-C13790_1.pep
GARRTSPSGLLSAAAKMVNVPKTKKTYCKNKECKKHTLHKVTQYKKGKDSLSAQGKRRYDRKQSGYGGQTKPVFHKKAKTTKKIVLKLQCQSCKHYSQHAIKRCKHFEIGGDKKGKGTSLF

SEQ ID NO: 44884 - protein, 106 aa, Sorghum bicolor
  Clone ID: LIB5051-008-A1-XP1-B11.pep
MVNIPKTRRTYCKGKDCKKHTQHKVTQYKAGKASLFAQGKRRYDRKQSGYGGQTKPVFHKKAKTTKKVVLRLECTQCKTKAQLALKRCKHFELGGDKKTKGAALVF

SEQ ID NO: 44885 - protein, 184 aa, Sorghum bicolor
  Clone ID: SORBI-28MAY03-C15601_1.pep
IPMTDMNMRADPSRGYPGRTYRFYTGDVVYGFGYGLSYSKYSYSILSAPKKITMSRSSVLDIISRKPSYIRRDGLDFVKTEDIASCEALAFSVHVAVSNHGSMDGSHAVLLFARSKSSVPGFPIKQLVGFERVHTAAGSASNVEISVDPCKHMSAANPEGKRVLLLGDHVLTVGDEEFELFIEL

SEQ ID NO: 44886 - protein, 145 aa, Sorghum bicolor
  unsure (1)..(145): unsure at all Xaa locations
  Clone ID: SORBI-28MAY03-C1237_2.pep
MNILKRVWKCKNISPVIKTFIWRLIRRAIATGEHANALTDIEKDCALCGFPENDVHLFFHYEFARAVWFSAKTPLLSSALPQEQDGVQHCLAXIITPQIPVDILVQITTYLWFIWKARNDLRFHKRSWSVLQVHLAVRTHIHSFA

SEQ ID NO: 44887 - protein, 80 aa, Sorghum bicolor
  Clone ID: SORBI-28MAY03-C1237_1.pep
FSKGLQMNINDMENSVVTDPYLATVGTEFGRWAVLHLSASVNKSQASSIAYRTFTASMAKKFWDLLDCNTEATFCSLKSI

SEQ ID NO: 44888 - protein, 94 aa, Sorghum bicolor
  Clone ID: LIB3476-033-P1-K1-E1.pep
VLIHCINPPCRFPEPPDVAQCFIDASIDPEVSQSAPKPAGLGISFLDPRTNTKSYIKLQINNISSVVMAEAAALAFAAAVASELLVQGARPRAR

SEQ ID NO: 44889 - protein, 48 aa, Sorghum bicolor
  unsure (1)..(48): unsure at all Xaa locations
  Clone ID: LIB3476-008-P1-K1-C10.pep
NRWFYATLKIFCLPMLCCQVNIDERINTXAASFHSQLCKVVDTMLVNY

SEQ ID NO: 44890 - protein, 250 aa, Sorghum bicolor
  unsure (1)..(250): unsure at all Xaa locations
  Clone ID: SORBI-28MAY03-C16011_1.pep
MDRAQLLLVGLPAFLFFSDLTHIFAPPPXPPPPPPSPPSSPPPSPASAAPSPPAPAASSPPASPPPATAAPPPAPRXSAAIIQEPRVDGAGFGSTVELQFCASCSYKGTAVTMMRMLETSFPGIHVILHNYPPPFPKRVLSKVVPIVQVGAIATIMAGDHIFPRLGMVPPPWYYSLRANRFGTMATIWLFGNFAQSFLQSSGAFEVYCNGDLVFSKLAEQRFPSEFELRELIGSRLPESPFGRNLGKTLT

SEQ ID NO: 44891 - protein, 244 aa, Sorghum bicolor
  Clone ID: SORBI-28MAY03-C1606_1.pep
MASHPHPQEDKSDRHSAGAGASREQERRPSKAWGILIFGLIGVTTASFAITQVRRSVDWFYTQLNKVQTTSSWRYTSNSSSRGSFSEETKKRYYQRMQQEYEEEQERVQRIRHMQSVFNRERNKFRRGYESWRENGPPGGYNYIPRDDWYWQTDTSHSEHKNRRTYTPAGPRVYPMSHHYAVLGLDRSRATPYTDAEVKTAFRTKAMEVHPDQNQDDREGAEEKFKEVVKSYEAIKLERKNGVS

SEQ ID NO: 44892 - protein, 133 aa, Sorghum bicolor
  Clone ID: SORBI-28MAY03-C2386_3.pep
PRVRRTFIEVVFENPEKSIDTFHIDGYAFFAVGMGPAKWTPACRSTYNLLDTASRHTVQVYPRSWTAVMMTFDNAGMWSIRSNIWERNYLGEQLYISVTSPERSLRDEYNMPETSLRCGKVVGLPLPSSYLFV

SEQ ID NO: 44893 - protein, 113 aa, Sorghum bicolor
  unsure (1)..(113): unsure at all Xaa locations
  Clone ID: SORBI-28MAY03-C2386_2.pep
RQRYRSAGSTHAYGPGQRSPEARVTYNLLDAVSRHTIQVYPRSWTAIMLTFDNAGMWSVRSNIWERYYLXEQFYISVISPEHSLRDEYNMPDNDLRCGKVVGLPLPPSYSAAR

SEQ ID NO: 44894 - protein, 168 aa, Sorghum bicolor
  Clone ID: SORBI-28MAY03-C2386_1.pep
MAAAGKLLLLAAAVLAASLVADARPCGHAQTLLVSFSSVSRPNPDPSNPTPLTTTVVTVLRVRRLGPHQIRRPVALPAVEPDVAASSVQDRAKDILVVVSGLLFGFGCGALTAASMYLVWSLLASTCASGYDDDVYSDDEDQLSDSESPKKAGYVIIHDADEYGAGKN

SEQ ID NO: 44895 - protein, 321 aa, Sorghum bicolor
  Clone ID: SORBI-28MAY03-C256_1.pep
MLCSGRMLACNGLLPGRLRLPRADAYRLRPPALARRWSVAASAAASGGSSDLPSSSSSPPTPPFGVGDDQAAASPGFCIIEGPETVQDFAKLDLQEIQDNIRSRRNKIFLHMEEIRRLRIQQRIKNVELGISDEESDRELPDFPSFIPFLPPLSAANLKVYYATCFALIASIMVFGGLLAPILELKLGLGGTSYEDFIRSVHLPMQLSEVDPIVASFSGGAVGVISALMVVEINNVKQQEHKRCKYCLGTGYLACARCSSTGALVLTEPVSTFSDGNQPLSAPKTERCPNCSGSGKVMCPTCLCTGMAMASEHDPRIDPFI

SEQ ID NO: 44896 - protein, 195 aa, Sorghum bicolor
  Clone ID: SORBI-28MAY03-C25694_1.pep
MALVGQVATVAQLVGVDAFSLITMIAEAAQTVRRNRAVCRQLARRVEMIGGLLRRLHDQDTQLMQLPETRTPVEALEETLRRAYLLVRSCQRRGYAYRCFMGARHADELREVQGEIGFYLQLFPLVSYVDATLNWVRHLNNKQASHDTSFQEALMVRPCIVPFLFASWDGCCLAIVQGVCMPWYMVQHTHGLQLL

SEQ ID NO: 44897 - protein, 376 aa, Sorghum bicolor
  Clone ID: SORBI-28MAY03-C2586_1.pep
RSLLLPSPTSVFSGAAVPISVSAQKRRSSWQPRGARVQVSAAAAADSKNILVMGGTRFIGVFLSRILVKEGHQVTLFTRGKAPITQQLPGESDAEYAEFSSKVQHLKGDRQDFEFVKTSLAAKGYDVVYDINGREAVQVEPIIDALPNLEQYIYCSSAGVYLKSDILPHCEVDAVDPKSRHKGKLETESLLTSRGVNWTSIRPVYIYGPLNYNPVEEWFFHRLKAGRPIPLPGAGNQITQLGHVKDLARAFNLVLGNPKASQQIFNISGAKYVTFDGLARACAKAGGFPEPELVHYNPKDFDFGKKKAFPFRDQHFFASVEKAISELGWTPEFDLVDGLTDSYNLDFGRGTFRKAADFTTDDIILGKKLATTRALI

SEQ ID NO: 44898 - protein, 255 aa, Sorghum bicolor
  Clone ID: SORBI-28MAY03-C26673_1.pep
KVQKVIGHGINCFVNRQLIYNFPEELFADAGILAIEHADFEGIERLALVTGGEIASTFDNPESVKLGHCKVIEEIMIGEDRLIHFSGVAMGQACTIVLRGASEHVLDEAERSLHDALCVLSQTVNDTRVLFGGGWPEMVMAKEVDELARKTPGKKSHAIDAFSRALQAIPTIIADNAGLDSAELISQLRAEHHKENCTAGIDVITGSVGDMQKLGIQESFKVKQAILLSATEAAEMILRVDEIITCAPRRREDRM

SEQ ID NO: 44899 - protein, 111 aa, Sorghum bicolor
  Clone ID: SORBI-28MAY03-C17399_1.pep
MAKLPSLFLVLSSIVAISVVGSQADGGCDNDLQSLITECKRYVMFPTNPKVPPSDGCCGVIKKVNVPCLCAKVTKEIEKVVCMEKVVYVAEQCKRPFEHGFQCGSYKVPRK

SEQ ID NO: 44900 - protein, 210 aa, Sorghum bicolor
  Clone ID: SORBI-28MAY03-C18120_1.pep
MAMATRRSWAVAALLVALAAASLLLPSPAIAQQPSPSPSPTAGGGMDSACMNSLLNMSDCLTYVTKGSTARRPDTPCCPELAGLVDSNPICLCELLSGAADSYGIAVDYARALALPGICRVATPPVSTCTALGYDVRVGPAAAPMSGSPSPMSGISPSGEGPQFPGTSPVASPPSSTSTAARRSSAVSSHLVTLAMLPLAAAAAVSGILL

SEQ ID NO: 44901 - protein, 312 aa, Sorghum bicolor
  Clone ID: SORBI-28MAY03-C2055_1.pep
ARGLALEIYRRAGQQAGSLSDFYENCRGLELARNFQFPTLREPPQTFLATMEEYVKEAPRMVPVREPLELPERLLLTYKPEESEEIPEPAPVEEEKAPVEEPVPVPPVTEVVSSPPKTEVADTGDLLGLDDPNPAVSAIEESNALALAIVPTDGASTTSNTAFQDKGFDATGWELALVTAPSNTTSSSSVGQLGGGFDKLILDSLYDDGAYRQRQQQQLYGSAAPNPFMTNDPFAMSNQVAPPPSVQMAAMSQQHPQIPTMMQPNPFGPPMQPQMSMGPATNNPFLDSGFGAFPVANNGHQQHNPFGSAQLL

SEQ ID NO: 44902 - protein, 228 aa, Sorghum bicolor
  Clone ID: SORBI-28MAY03-C2046_1.pep
MITMLAASSVVNSNLACSSRISSCSDFTSGHSWRPIEAVKLHRRAVSSIRISCAATKPAKTPAEEEWKVKRQLLAEKRVRSVDVKEALRLQKENNFVILDVRPEAEFKEAHPPGAINVQIYRLIKEWTAWDIARRAAFAFFGIFAGTEENPEFIQSVDVKVGKNAKIIVACSTGGTLKPTQNFPDGKQSRSLIAAYLLVLNGYSNVYHLEGGLYTWFKEGLPAVEGEE

SEQ ID NO: 44903 - protein, 95 aa, Sorghum bicolor
  Clone ID: SORBI-28MAY03-C1888_1.pep
MATPDKGQGRPLPKFGEWDVKNPATSEGFTVIFQKARDGKKTTGGPGNVRAGIPPAFRNGDGADDGGYRPDFKYGDSSQHTPPKRIKKKWAFCGC

SEQ ID NO: 44904 - protein, 111 aa, Sorghum bicolor
  Clone ID: LIB5121-003-A1-PF1-A5.pep
MATPDKGQGRPLPKFGEWDVKNPATSEGFTVIFQKARDGKKTTGGPGNVRAGIPPAFRNGDGADDGGYRPDFKYGDSSQHTPPKRIKVLTRGRGPLVDRRRSGPSVAADSS

SEQ ID NO: 44905 - protein, 67 aa, Sorghum bicolor
  unsure (1)..(67): unsure at all Xaa locations
  Clone ID: LIB5047-002-R1-XP1-G4.pep
MHACRCVALQDKGQGRPLPKFGEWDVKNPATSEGFTVIFQKARDGKRTTGXPGNVRAGIPTAFRNGD

SEQ ID NO: 44906 - protein, 173 aa, Sorghum bicolor
  Clone ID: SORBI-28MAY03-C1945_1.pep
MGSLLTRTGAWLQAKIFDPVLQVIRRGAEPKELAFSAALGVTIGIFPICGTTVILGAVAVAMLGSRCNAVTVMVLNLAATPIELSLIIPFLRLGETITGSGHFALTADALKNVLTGHASKDVLLSIVRAMLGWLVAAPFVLAVLYVISFPCFKVLVNRFGGIPSSPRTPIKAV

SEQ ID NO: 44907 - protein, 94 aa, Sorghum bicolor
  Clone ID: LIB3478-006-P1-K1-G3.pep
MGSLLTRTGAWLQAKIFDPVLQVIRRGAEPKELAFSAALGVTIGIFPICGTTVILGAVAVAMLGSRCNAVTVMVLNLAATPIELSLIIPFLRLG

SEQ ID NO: 44908 - protein, 131 aa, Sorghum bicolor
  Clone ID: SORBI-28MAY03-C1720_2.pep
TACTSTSPSPTPDSWKLDEIFATGIVLGTYMAIVTAIFFYLAHDTDFFTAVFGVQSIKENDRELMAALYLQVSIISQALIFVTRSRSWSFVERSGHTPRASTSSPPSTTFHLRAHRAGQPKSLDLWSCLHS

SEQ ID NO: 44909 - protein, 484 aa, Sorghum bicolor
  unsure (1)..(484): unsure at all Xaa locations
  Clone ID: SORBI-28MAY03-C1720_1.pep
HEGKESAGEPWQFIGLLPLFDPPRHDSAETIRRALHLGVNVKMITGDQLAIGKETARRLGMGSNMYPSTTLLGDNKGGEMGGLNIDELIEKADGFAGVFPEHKYEIVKRLQDRKHICGMTGDGVNDAPALKKADIGIAVDDATDAARSASDIVLNASGLSVIVSAVLTSRAIFQRMKNYTIYAVSITIRIVLGFLLVALVWEFDFAPFMVLIIAILNDGTIMTISKDRVKPSPTPDSWKLKEIFATGIVLGTYMALATALFFYLAHDTEFFSETFGVRSIKENDKELMAALYLQVSIISQALIFVTRSRSWSFVERPGALLVIAFLAAQLVATCIAVYANWEFCKMQGIGWGWGGAIWAFSVVTYFPLDVLKFAIRYALSGKAWNNINNKTAFTNRTDYGKGEREAQWATAQRTLHGLNQATGTFDLXFGDNQGYRELSELADQAAKRAEVARLRELHTLKGHVESVVKLKGLDIDTINQSYTV

SEQ ID NO: 44910 - protein, 311 aa, Sorghum bicolor
  Clone ID: SORBI-28MAY03-C14874_1.pep
MAARCPYFAVEESSRGIRSGESPAAALRRILATPGAHQAPCCYDALGARLVERAGFQIGFMGGFCVSAARLGLPDVGLISYGEMIDQGRLINEAVSIPVIGDGDNGYGNSMNIKRTIKGYINAGFAGIMLEDQVAPKACGHTEGRKVISREEAIMHIKAAVDARKESGSDIVIVARSDARQAISLDEALWRVKAFADAGADVLFIDALASVEEMKAFCAVAPEVPKMANMLEGGGKTPILSPAELAEIGFRLAVYPLSLVGVSMRAMQDALVAIKDGGVPPPSILPSFQEIKDTLGFNRYYKEEKQYQVDK

SEQ ID NO: 44911 - protein, 164 aa, Sorghum bicolor
  Clone ID: SORBI-28MAY03-C29638_1.pep
DSVEAAEMAQTLRDCEAPAAKGEKKACATSLESMVDFATTSLGTSHVRAVSTVVAKEGSPKQEYTVTGVKPAAGTGHDGRLVACHAEPYAYAVFACHLTQQTRAYSVSMLGRDGTAVDAVAVCHADTSGWNPKHIAFQVLKVKPGTVPVCHFLPQDHVVWTRSG

SEQ ID NO: 44912 - protein, 253 aa, Sorghum bicolor
  Clone ID: SORBI-28MAY03-C2990_1.pep
MALLQSQSRLPGIGCSSSIVLARARVQQCLAAASHSRAPLLRANGGRRSTTGLPTSSSSSFKAGNAISLSRRRIRDLRVVAEAATAGAAKVVTPASSGGVSVSDVLWPSAGAFLAMAVLGKMDQMVAFKGVSLTIAPLGAVCCVLFSAPGSPAAKKYNMFVAQIGCAVFQMVAFKGVSLTIAPLGAVCCVLLAFMTITGASHPPAASLPLLFIDGPKFHNLQLWYALFPGAAGCIVLCLIQEVVLYLKKNFKF

SEQ ID NO: 44913 - protein, 511 aa, Sorghum bicolor
  unsure (1)..(511): unsure at all Xaa locations
  Clone ID: SORBI-28MAY03-C30252_1.pep
MSAAIRGAEFPGFRGAAAQLPRSRMLGRPIRVAPPAAAQPGGGGASAGSIRAVSAPAKKDASEVKRSKVEIIKEKSNFLRYPLNEELVSEAPNINESAVQLIKFHGSYQQTDRDVRGQKNYSFMLRTKNPCGKVPNQLYLAMDTLADEFGIGTLRLTTRQTFQLHGVLKKNLKTVLSTVIKNMGSTLGACGDLNRNVLAPAAPYVKKDILFAQQTAENIATLLTPQSGAYYDLWVDGEKIMSAEEPPEVTKARNDNSHGTNFPDSPEPIYGTQYLPRKFKVAVTAAGDNSVDILTNDIGVVVVSDDAGEPIGFNIYVGGGMGRTHRVETTFPRLADPLGYVPKEDILYAIKAIVVTQRENGRRDDRKYSRMKYLIDRWGIDKFRAEVEKYYGKKFESFRPLPEWQFNSYLGWQEQGDGKLFYGVHVDNGRVGGQAKKTLREIIEKYNLDVSITPNQNLILCGIDQAWREPITTALAQAGLLEPQDVDPLNXTSMACPALPLCPLAQTEAER

SEQ ID NO: 44914 - protein, 470 aa, Sorghum bicolor
  Clone ID: SORBI-28MAY03-C70299_1.pep
YCEAATSTSPPNNKFHRRRPFSPSPRSQTQEHHQSREHRRRRRRRRRSGRQASMAGFKVTRISEGPVKPASSTPEETLPLAWVDRYPTHRGLVESMHIFRSGADAAPAVIRAALGKALAFFYPLAGRIVEGDQPGCPAIRCTADGVYFAEAVADCSLEDVRFLERPLLLPKEDLVPYPGDDRWTVEPHNTIMMMQITKFTCGGFVMGLRFNHASADGMGAAQFINAVGDMARGLTEPKVLPVWHREKFPNPNIKPGPLPELPVLALDYVVLDFPTPYIDDLKRQYKAHSGKFCSGFDVLTAKLWQCRTRALALDPATEVKLCFFASVRHLLKLDRGYYGNSIFPVKMSAPAEKVLASSILEVVDMIREAKDRMAVEFFRFAKEETDQDPFQMTFNYESIYVSDWSKLGFSDVDYGFGPPMFAGPLVNNDFIASVVILKAPLPLDGTRMLASCVTKEHSDEFARGMKEDLP

SEQ ID NO: 44915 - protein, 148 aa, Sorghum bicolor
  Clone ID: SORBI-28MAY03-C67555_1.pep
QSGGWIRALLEEAENERMHLMTFMEVAKPRWYERALVITVQGVFFNAYFLGYLLSPKFAHRVVGYLEEEAIHSYTEYLKDLEAGKIENVPAPSIAIDYWRLPANATLKDVVTVVRADEAHHRDVNHFASDIHCQGMQLKQSPAPIGYH

SEQ ID NO: 44916 - protein, 365 aa, Sorghum bicolor
  Clone ID: SORBI-28MAY03-C7432_1.pep
MALRRLLQGSVLPRVTGRALAPAVAPFSTESGETIRATLFPGDGIGPEIAESVKQVFNVAGVPIEWEEHYVGTEVDPRTESFLTWESLESVRRNKVGLKGPMATPIGKGHRSLNLTLRKELGLYANVRPCNSLPGYKTRYDDVNLVTIRENTEGEYSGLEHQVVRGVVESLKIITRQASLRVAEYAFHYAKANGRERVSAIHKANIMRKTDGLFLKCCREVAAKYPEIQYEEVIIDNCCMTLVKNPGLFDVLVMPNLYGDIISDLCAGLIGGLGLTPSCNIGEGGICLAEAVHGSAPDIAGKNLANPTALMLSAVMMLRHLQFNDKADRIHNAILQTIAEGKYRTADLGGKASTSEFTNAVCEHI

SEQ ID NO: 44917 - protein, 324 aa, Sorghum bicolor
  Clone ID: SORBI-28MAY03-C8065_1.pep
ELSAQLGELFEEHQLYRILVNLGKELVQNLLVLRFANRLFLPLWNRDNIDNIQIVFREDFGTEGRGGYFDQYGIIRDIIQNHLLQVFCLVAMEKPVSLTREHIRDEKVKVLQSVNPIKPEEVVLGQYDGYNDYPTGPPDSNAPPFASPVPRVHTALCEGFPLILKAGKALSSRKAEVRVQFKDVPGDIFRNKRQGRNEFVIRLQPSEAMYMKLTVKKPGLEMATEQSELDLSYGMRYQNIKIPEAYERLILDTIRGDQQHFVRRDELKAAWQIFTPLLHDIDDGKLKALPYEPGSRGPKEADELSARVGYVQTHGYIWIPPTLA

SEQ ID NO: 44918 - protein, 273 aa, Sorghum bicolor
  Clone ID: SORBI-28MAY03-C8933_1.pep
HEGIFEGLMPEDLNIYVTTASNPVENSWGTYCPGMEPSPPPEYITCLGDLYSVSWMEDSQTHNLKKETIKDQYEVVKTRTSNSNKYKEGSHVMEYGDKTFKDEKLFLYQGFDPANANIANMLLWPGPKGAVNQRDADLLFMWKRYEQLNGESVEKLRALIEIKETVQHRKHLDSSIDFIGRLLFGFEKGPSMLEAVRASGLPLVDDWDCLKRMVRIFESQCGSLTQYGMKYMRAFANICNSGISEMKMRESSISACSSYNSARWSPMAQGHSA

SEQ ID NO: 44919 - protein, 343 aa, Sorghum bicolor
  Clone ID: SORBI-28MAY03-C9159_1.pep
ILVIPRLIHGLPDEIALICLARVPRRYHNILRHVSKRWRALLCSEEWHLCRKRNNLDESWIYVICREAGIKCYVLAPDPSSRCFRIMHIIEPPCSGRKGVTIEAIAQGLFLLGGCNCVHDATDEVYCYDASSNRWSAAAPMPTARCYFVSASLNEKLYVTGGYGLTDKSPNSWDIYDPATDSWCAHKNPMLTPDIVKFVALDEELVTIHRAAWNRMYFAGIYDPLDRTWRGTENEIALCCSSPTVVVDGTLYMLEQSMGTKLMRWQKDTKEWAMLGRLSDKVTRPPCALVAIGRKIHVIGRGLSIVTVDVDTAARVDGFLVTTSIGPLVEEDLTPERCMVITI

SEQ ID NO: 44920 - protein, 361 aa, Sorghum bicolor
  unsure (1)..(361): unsure at all Xaa locations
  Clone ID: SORBI-28MAY03-C9137_1.pep
MSAPMPISRLVSHVILDLDGTLLNTDSVVSKVVKPFLVKNGKTWDSKKAYKXWCNIKALPGATRLLKHLRSNGVPTALASNSPRSNIEAKISCHQGWKESFSAIVGGDEVEKGKPSPDIFLEAAVKSEDITFNIVSNEDARPGITAGKAAGMHVIAVPSIPKKTAEFSSADVVINSLLDVRPEKWGLPPFNDWIEDTLPIEPWFISGPVIKGFGRGSKVLGIPTANLPAENFSDVVSEYTSGVYFGWAGLSTRGTYKMVMSVGWNPYFDNTEKTVEPWLLHNFGEDFYGEELRLAIVGYIRPEANFPSLESLIERIQEDGRIAEKALDLPMYAKYKDSPYLRNTLQLGSTNDDSQAELNSK

SEQ ID NO: 44921 - protein, 141 aa, Sorghum bicolor
  Clone ID: LIB3476-058-P1-K1-F1.pep
AAAIVLEDYGLPYSTEEFLSMITPVFSEQWCNIKALPGATRLLKHLRSNGVPTALASNSPRSNIEAKISCHQGWKESFSAIVGGDEVEKGKPSPDIFLEAAKRMNATPSNCLVIEDSLPGITAGKAAGMHVIAVPSIPKKT

SEQ ID NO: 44922 - protein, 187 aa, Sorghum bicolor
  Clone ID: SORBI-28MAY03-C3513_1.pep
MALAPAPLQCFLTGSSRPVCTATPPKHARRPSRISCKASGDDKDKVPSGGNDLGVKLGKLAMVALAAGVLALGPVDGALAAKSGGRVGGQAFRSAPRSSGPRINNSRTNIYINPPVAPPLGGYGYGSPFFGGYGYGWSPFSFFAPGPSVAVGVGGGFDTLVLFLVLGAVVGAVRRFLNRNNDDYDDY

SEQ ID NO: 44923 - protein, 229 aa, Sorghum bicolor
  Clone ID: SORBI-28MAY03-C335_1.pep
SRRNSRTIYVGNLPGDIREREVEDLFYKYGRILDIDLKIPPRPPGYAFVEFEDPRDADDAIYGRDARGFDGYRLRVELAHGGRGQSYSYDRSSSYSSARRGGVSRRSDFRVMVTGLPSSASWQDLKDHMRRAGDVCFSDVYREAGETIGIVDYTNYDDMKYAIRKLDDSQFRNAFSRAYIRVREYDARSRSRSRSRSYSRSPSYSRSRSPKSLSRSPSPVDERYVNLCQ

SEQ ID NO: 44924 - protein, 115 aa, Sorghum bicolor
  unsure (1)..(115): unsure at all Xaa locations
  Clone ID: LIB3481-052-Q6-K1-D8.pep
AFAWQESEDHMRRAGDVCFSDVYREAGETXGIVDYTNYDDMKYAIRKLDDSQFRNAFSRAYIRVREYDARSRSRSRSRSYSRSPSYSRSRSPKSLSRSPSPVDERFGHAVIWGLH

SEQ ID NO: 44925 - protein, 273 aa, Sorghum bicolor
  Clone ID: SORBI-28MAY03-C35563_1.pep
MKRPRGGSPSSLAAMTNPDGDGYGVVGMEAADADADADEEMMACGGGGGEKKRRLSAEQVRALERSFEVENKLEPERKARLARDLGLQPRQVAVWFQNRRARWKTKQLERDYAARRHSYDALRHDHDALRRDKDALLAEIKELKAKLGDEEAAASFTSVKAEPAASDGPPPVGVGSSESDSSAVLNDAGPPVPEAQPVPEVQGTLLDDAPCAVVAGASAAAANHGGVFFHGSFLKVEEDETGLLDDDEPCGGFFAVEQPPPMAWWTEPTEHWN

SEQ ID NO: 44926 - protein, 95 aa, Sorghum bicolor
  Clone ID: SORBI-28MAY03-C26813_1.pep
LHHPPGRPAAMAIYLKLLYTVSTAFIRPQQSPPPYASSEELKKKKTQKLKRRRRSLLMYPSETTTTSEMGELARSSDTYVSSILNNPRMYRTSVI

SEQ ID NO: 44927 - protein, 373 aa, Sorghum bicolor
  Clone ID: SORBI-28MAY03-C27156_1.pep
TRSGRSIFQNEVLPLIEASGVLYTMQETKHRLHAQEIAHSLDLRKYDGIICVSGDGVMVEVVNGLLQREDWETAIKVPPGIIPAGTGNGMARSLLHAAGEPFSISNAVFAIIRGHKRALDVTSVVQGKTRFFSVLMLTWGLVADVDIESEKYRWMGSARLDFYLLLRVLNLRRYNGRILFVPAPGYEEVGDPVDQTTGSETNGFSTGIQEDVATDSNGETRGYVGPSVKESDLRWRSLNGPFVSVWLGNVPFASEDAMAAPKAEFADGYLDAAIIKDCPRRDVVGLLFQMKDGAYVNSPCVEYFKVKAIRIEPGLRVGSSTKGGIIDSDGEVLARGDDGSHSRAGDEPGHLMAYGPPIQLTVDQGLATIFSPR

SEQ ID NO: 44928 - protein, 356 aa, Sorghum bicolor
  Clone ID: SORBI-28MAY03-C27267_1.pep
MAKYGEGDKRWIVEERADGTNVHNWHWAERDCLEWSRARLSSLLAGLTVLDGEGGLTLRTVALDKLDGEAYVNIRKGKVIPGYELSLTLSWEAEAAAAASESGAVKVAGAAEVPYLADENADEDPELRVTVRGDETPLARRAKDAFLARGKPMVLEKIREFVAAMAKGGPAKDELESKKTPAKVAPAAPGAAPAKKEEVVAPAPAAEKKKAKGKDKEGFKTIEMTEKFYCRSKDIYEILMDENRWKGFTQSNARISREVGGEFSLFDGSITGINEELQEGKLIAQKWRFGSWPDGLYSSVRLTFDEPESGVTIIKLKQTDVPEEDKYGNSTVVENTERGWRELIFQRIRGVFGFGI

SEQ ID NO: 44929 - protein, 363 aa, Sorghum bicolor
  Clone ID: SORBI-28MAY03-C27438_1.pep
MEDDDDCPPLAVELPPQVPSPPAQAPSDASPVGVTVITGYLGAGKSTLVNYILNEQHGKRIAVILNEFGEEIGVERAMINEGQGGALVEEWVELANGCVCCSVKHSLVQALEQLVQRKDRMDHILLETTGLADPAPLVSVLWLDDQLESSIRLDSIITVIDAKNFRVQIDEHKNSSSFPEAFHQIAFADVVILNKIDLVEDNLEDLEKHIHDVNALVTVVRSVRCQVDLNEVFNRQAYGVKDSSLLQELLDYSKSVPPSRRHDNNISTLCIYEQESVHLAKVESWLEDLLWEKGPSMDIYRCKEFLYVPNWASVLSMLLVGSACAVFPYRISLHTDTRPCFCVVPRRKWVLNGRRVSCCLGLR

SEQ ID NO: 44930 - protein, 461 aa, Sorghum bicolor
  Clone ID: SORBI-28MAY03-C2813_1.pep
HEAQLNFAAAQSMQSTQHKPQHGETKSVAGDSSSTPIAGDRHGEKSTSTKYPGDSQQHSLSFTRSESKNYVPPFLSGSTNESSSRTLSLIGTESSNAFMGSKPTNSNTPASTPAAASPSISQQQQQHQHFLQMQVQQKHQQHQQLIQHHHLNRPRSAAPSTQNSAGRYPDGLNMASFQNLMYPSSAAQGGVQSPQLKASSGRGAPSSTATTPPAAPPSNLIVMKNSGLHQQQAKVPMQALSTPGHQPQSSLSMSSSKMGPSVTNLSTGGDLSRSSNAPVASGSPSNSVSKSTGGSPPATGNAKGVQQPGQLPSPQQQSAKNSASTSGSKSTATNHFSMAMPSILGQQPNASPGSNPGSKQQSHMPPSSMKQPPFLQGHFFISNNYAPQAPGAGGAAALGLYPKRPGDKTQQQAPHTQNALAAATQSAGGMPHTHMSAAQLTFGTMPMPLKPSSDQKPAAGK

SEQ ID NO: 44931 - protein, 214 aa, Sorghum bicolor
  Clone ID: SORBI-28MAY03-C2866_1.pep
MEGMSWRTACCLSVLCAVLLLLRPAEGIRFVIDREECFSHNVEYEGDTVHVSFVVIKADTPWHYSEEGVDLVVKDPNGGQVRDSRDKTSDKFEFIVQKRGVHRFCFTNKSPYHETIDFDVHVGHFSYFEQHAKDEHFAPLFEQIAKLDEALYNIQFEQHWLEAQTDRQAILNENMSRRAVHKALFESAALIAASVIQVYLLRRLFERKLGTSRV

SEQ ID NO: 44932 - protein, 95 aa, Sorghum bicolor
  Clone ID: SORBI-28MAY03-C29602_1.pep
MASGQESRKELDRKAREGETVVPGGTGGKSVEAQEHLAEGRSRGGQTRREQLGHEGYSEMGKKGGLSSTEESGGERAAREGVDIDESKFRTNKQS

SEQ ID NO: 44933 - protein, 167 aa, Sorghum bicolor
  Clone ID: SORBI-28MAY03-C41780_1.pep
VKEKIPSENAPTNAAPVLAMRRKKNVHEDVKPLAVTNLNAFEIISFSTGFDLSGLFIKKECKKETRFTSDKPAAAIISKLEDVAKILNLRIRKMDNGVVKIQGRKEGRNGVLQFDAEIFEITASYHLIEMKQTGGDSLEYQKLLEENIRPALKDIVWAWHGDDQQQK

SEQ ID NO: 44934 - protein, 135 aa, Sorghum bicolor
  Clone ID: SORBI-28MAY03-C4074_1.pep
TTQTSSHGGVRAADGQMRIAPIHFSPEAKPEPGGGGAEEEGDLEQAGGGEDEDVRPVACLLPPGVEAQLALPHGVRHHRLPHHQDDGQLHRGGPQELQVRPGAQEALTNQVKELCQNSEMPVWPANSVMLLNEKK

SEQ ID NO: 44935 - protein, 159 aa, Sorghum bicolor
  Clone ID: LIB5047-003-R1-XP1-B7.pep
GPFFFFFLDFMYLNQKLIAVESIQLPLITLQMEHRVHAFLDLKNEKEGANFSFKRHNITGCPQEIRTTPSPGRSVPLVLLDELGVLEVLLGEVGRHLGDEESGDGEPREEGPVAPPLPAEEDRPRVERLHLLGLRLRLRLRLLAISFLPPPPPASLLVR

SEQ ID NO: 44936 - protein, 202 aa, Sorghum bicolor
  Clone ID: SORBI-28MAY03-C42255_1.pep
TRVDAAGSSRAGFTPHVITVQAGEDVSSKIMSFSQHGTRAICVLSANGAISNVTLRHTATSGGTVTYEGRFEILSLSGSFLLVENGGQRSRTGGLSVSLAGPDGRLLGGGVAGLLIAASPVQIVLGSFNSGGKKESKKHAPSEPTSVPLKVAPTTGMGPNSPPSRGTLSESSGGAGSPPPLHQGMAASNNNQPPFLSSMPWK

SEQ ID NO: 44937 - protein, 68 aa, Sorghum bicolor
  Clone ID: SORBI-28MAY03-C30755_1.pep
SRLILIQSSTLNQLLTVLYQSIQWVNKILRNEMDLRAAEFQSRDGGWHMMMDVQEALGTGRTIIVQTV

SEQ ID NO: 44938 - protein, 200 aa, Sorghum bicolor
  Clone ID: SORBI-28MAY03-C30380_1.pep
MKHSSSLCLLFLVALCISLACGLVQAQVLFQGFNWESCKQPGGWYNRLKAQVDDIANAGVTHVWLPPPSHSVSPQGYMPGRLYDLDASKYGTAAELRSLIAAFHGRRIQCVADIVINHRCAEKKDARGIYCIFEGGTGDGRLDWGPGMICSDDTEYSDGTGHRDTGEAFAAAPDVDHLNERVRRELSAWLNWLKSDDVGF

SEQ ID NO: 44939 - protein, 319 aa, Sorghum bicolor
  Clone ID: SORBI-28MAY03-C33223_1.pep
MASAQAMGQGEQDHFVLKSGHTIPAVGLGTWRAGSDTAHSVQTAITEAGYRHVDTAAQYGVEKEVGKGLKAAMEGGINRKDLFVTSKLWCTELAPDKVRPALQKTLKDLQLDYLDLYLIHWPFRLKDGAHMPPEAGEVLEFDMERVWREMESLVKDGLVKDIGVCNYTVTKLNRLMRSANVPPAVCQMEMHPGWKNDKIFEACKKHGIHVTAYSPLGSSEKNLAHDPVVEKVANKLNKTPGQVLIKWALQRGTSVIPKSTKDERIKENIQVFGWEIPEEDFTVLCSIKDEKRVLTGEELFVNKTHGPYKSASEVWDHED

SEQ ID NO: 44940 - protein, 182 aa, Sorghum bicolor
  Clone ID: SORBI-28MAY03-C33337_1.pep
MAQPQPRRGDEGLQAQGGNGKAPAAQQDPIKYGDAFPVKGELAGQPIAPRDAAAMRSAEDSVPGVQVPQESGGGFSAGAFMESAAAYNQAVGAVGPGQASAAVAKHGVNVTQDAVPGGRIVTEFVAGQVVGQYAVAEAAPPSPQQQEQDGAGHKAAGNEGGAGHGDGGAPGGRAGATAARRD

SEQ ID NO: 44941 - protein, 458 aa, Sorghum bicolor
  Clone ID: SORBI-28MAY03-C33649_1.pep
MAGLLNLQSTLLPSASALRRRAGAPGPSSSRRRCRVEAKIREIFMPALSSTMTEGKIVSWTAAEGDRLAKGDPVVVVESDKADMDVETFHDGFLAAVLVPAGESAPVGSAIALLAESEEEIPVAQSQAASFSSSSPSPPPPQETAAQEESLPPPPPPTPPPVAVSAPAPPSPAAQGGGRVVASPYAKKLAKDLGVDLFSVTGSGPGGRIVAKDVESALAAPKKAVPATAARPDVPLGAPGPFTTMQGAVSKNMVESLAVPTFRVGYTITTDALDQLYKKIKSKGVTMSALLAKATAMALVQHPVVNSSCRDGKSFTYNSSINIAVAVAIDGGLITPVLQDADKLDIYSLSRKWKELVDKARAKQLQPHEYNSGTFTLSNLGMFGVDRFDAILPPGTGAIMAVGASEPTIVGTKDGRIGIKNQMQVNVTADHRIIYGADLAAFLQTLAKIIEDPKDLTF

SEQ ID NO: 44942 - protein, 592 aa, Sorghum bicolor
  Clone ID: SORBI-28MAY03-C34293_1.pep
HEGEINTENPLGLQGELAIAFGELLRKLWSSGRTSVAPRAFKSKLSRFAPQFSGYNQHDSQELLAFLLDGLHEDLNRVKKKPYIEAKDADGRPDDEFAEECWNYHKARNDSIIVDRFQGQYKSTLVCPVCNKISVTFDPFMYLSLPLPSTVTRMITVTVFSGTGDVLPMPYTVTVQKNGNCRDLTKALADVCCLKDSETLLLAEVYERRIYRYLTNPIEGLHSIKDEDILVAYRLPVGYEKLLRLEILHRRADRFLVEPQFNINRKLIGCPIVTCIPNGSTGKSDIYAAVSAVLVPFVRAKAHSPDVSAVKLNGNGPSLDGIVLTDNGTTSEEGLSISRSSEDDNAAVDELLPFQLSLTDEKGSIRNAIDTDSNRGLGLVIRVLMDWSEKEHGMYNIDYMDGLPEVFKPGFMSKKTRQEAVNLFSCLDAFLKEEPLGPDDMWYCPGCKEHRQASKKLDLWRLPEILVVHLKRFSYSRYMKNKLDTFVNFPIHDLNMSKYVKLTSRGDQHPMYELYAVINHYGGLGGGHYSAYAKLVEENNWYHFDDSHVSSVNEDEIRTSAAYVLFYRRVGGSSTVANGGAVDIEMVDSIEM

SEQ ID NO: 44943 - protein, 307 aa, Sorghum bicolor
  Clone ID: SORBI-28MAY03-C35042_1.pep
APRRRRTSGTLPPTQMPSIRRPPHTQGAPNDGVVRELLHDIDLDASPPLPRAELHALIIGINFEEVEFDRTDAVDKVMADFDTSRNDIVEEEEFVQGMKKWLNEFKRNMPAGGAFSSKFNEYHERTRQEHDQLIDRSDEAVESVENPGWCITKAVALLLLGAAIAAAFADPLVDAVHNFSNATHIPSFFISFIALPLATNSSEAVSAIIFASRKKQRTCSLTFSEVYGGVTMNNTLCLGVFLALIYFRNLTWDFSSEVLIILLVCVVMALFTSFRTTFPLWTCLVAYMLYPFSLVIVYILDYVFGWS

SEQ ID NO: 44944 - protein, 460 aa, Sorghum bicolor
  Clone ID: SORBI-28MAY03-C4611_1.pep
MPEKAVDDVMEAAVGAHFSGLRLEALRLSTSAPSSPSSSPAAAAHAHSNGAVYANGTAELPSPAAARQPFVIGVSGGTASGKTTVCDMIIQQLHDHPVAFVNQELLVCMGTVKEGQSVNIPIYDFKNHRRCSEKFRKVNESDVIILEGILVFHDQRVRDLMDMKIFVDTDADIRLARRIRRDTVERGRDVTSVLEQYVRFVKPAFDAFVLPSKKYADVIIPKGGDNHVAIDLIVQHIHTKLGQHNLCKVYPNVFVVHTTFQIRGMHTLIRDKNITTPDFVFYSDRLIRLVVEHGLGHLPFTEKQVVTPTGSVYMGVDFCKKLCGVSIVRSGESMENALRACCKGIKIGKILFHRIGDNGQQLIYHKLPVDIAERHVLLLDPVLGTGNSANQAIELLMRKGVPEQRIIFLTLISAPEGIHCVCKRFPDLKIVTSEIDSGLNDEYRVIPGLGEYGDRYFGTD

SEQ ID NO: 44945 - protein, 181 aa, Sorghum bicolor
  Clone ID: SORBI-28MAY03-C4789_1.pep
MFKKFSSEDISGQNQVKASVQRKIRQSIADEYPSLEPLLDDLLPKKSPMIVVKCQNHLNLVVVNNVPLFFNIRDGPYMPTLRLLHQYPNIMKKFQVDRGAIKFVLSGANIMCPGLTSPGGALDDEVEEETPVAIMAEGKQHALAIGYTKMSAKDIRTINKGIGVDNMHYLNDGLWKMERLE

SEQ ID NO: 44946 - protein, 331 aa, Sorghum bicolor
  Clone ID: SORBI-28MAY03-C36802_1.pep
MATADIRRSIAGQTRFALRLTAALSSTAAAAPARNTAFSPLSLHVVLSLLAAGAGHATRDQLLTALGGGDGPVAAEILHALSEQVVQLVLADGSGVGGPRVAFADAVFVDASLKLKSAFEEVAVGKYKAETHSVDFQEKAAQVAGEVNSWVEKVTSGLIKELLPPGSVDQTTRLVLGNALYFKGAWTEKFNVAEKLSSEPEFMEEHIPTRKVPVGQFKVPKFKVSFGFEASDLLKGLGLELPFSSQADLSELVHLPAGQNLCVSSIFHKSFVEVNEEGTEAAAASAAVVMLCSFRMPTDFVADHPFLFLIREDTTGVLLFVGHVVNPLLAP

SEQ ID NO: 44947 - protein, 276 aa, Sorghum bicolor
  Clone ID: SORBI-28MAY03-C37138_1.pep
PARPHPLRISLAPLLLTAAVASSAEGGSSAEAEMASVAAAEGAAAALRSVLSRAQQAAARAGRAPGSVRVVAVSKTKPVPVIRGVYDAGHRCFGENYVQELIDKAPQLPEDIEWHFIGNLQSNKARALLAGVPNLDMVESVDRGKIASRLDRVVADLGRKPLKVLVQVNTSGEESKFGVDPSGCVELAKHVKLNCPNLVFSGLMTIGMLDYSSTPENFKTLANCREGVCKELGIPEEQCELSMGMSADFEQAIEMGSTNVRVGSTIFGAREYPKKN

SEQ ID NO: 44948 - protein, 139 aa, Sorghum bicolor
  Clone ID: SORBI-28MAY03-C39035_1.pep
ARGHHLSTPSTPKQKAALAKQLNLKPRQVEVWFQNRRARTKLKQTEVDCEFLKRCCETLTEENRRLQREVAELRALKLVAPHHYARMPPPTTLTMCPSCERLASAPADEAVAGRTAAPTGPWGPLPVRPVFVDGPARRS

SEQ ID NO: 44949 - protein, 109 aa, Sorghum bicolor
  unsure (1)..(109): unsure at all Xaa locations
  Clone ID: SORBI-28MAY03-C3635_1.pep
QAGGEHTAAAVKIAEQHPDFVIGFISVNPASWSPAPSSPAFIHATPGVQMAAGGDGLGQQYNTPFSVINDRGSDIIIVGRGIIKASNPAETARQYRIXQGWQAYQSSLS

SEQ ID NO: 44950 - protein, 179 aa, Sorghum bicolor
  Clone ID: SORBI-28MAY03-C39064_1.pep
RPWGLRPPVIGCFPLLASQLGVGFFDDKLGALCMQWLEDKVYSIRDAAANNLKRLAEEFGPEWAMQHIIPQVLEKINNPHYLYRMTILQAISLLAPVMGAEITCQKLLPVVINSSKDRVPNIKFNVAKVLQSLVPILDQSVVEKTVKPCLVELSEDPDVDVRYYANQALQACDQMMVSS

SEQ ID NO: 44951 - protein, 147 aa, Sorghum bicolor
  Clone ID: SORBI-28MAY03-C3883_2.pep
MASTTRSSYIILLSAAAVLLSVVGGAMAARTNWCEPGLVIPLNPLPSCRTYLVRRTCGLGRGPFVPLPVLKGRCCTELEKIVPYCRCGALRIMMDGMPGGGEDTPPCSWGGQLELAPTLVSEAECNLMTIHGRPFCYALGAEGTTTN

SEQ ID NO: 44952 - protein, 145 aa, Sorghum bicolor
  Clone ID: SORBI-28MAY03-C3883_1.pep
MASTRSSSYILLSAAVLLSVLAATAAAANWCEPGLVIPLNPLPSCRTYMVRRACGVSIGPVVPLPVLKERCCSELEKIVPYCRCSALRTALDSMMTGYEMRPTCSWGGLLEFAPTLVSEAECNLRTIHGRPFCYALGAEGTTTSD

SEQ ID NO: 44953 - protein, 331 aa, Sorghum bicolor
  Clone ID: SORBI-28MAY03-C3991_1.pep
MVGTAAGAAEGAVRRWVDAAGGRLVLDGGLATELEANGADLNDPLWSAKCLLSSPHLIRKVHMDYLEAGANILITASYQATIQGFESKGFSKEQSENLLTKSVEIALEAREMFLKEHLEKSIPIQHPILVAASIGSYGAYLADGSEYSGDYGEAGTKEFLKDFHRRRLQVLAEAGPDLIAFETIPNKLEAQAYVELLEECNINIPAWLSFNSKDGVHIVSGDSVIECTTIADKCAKVGAVGINCTPPRFIHGLILSIRKVTDKPILIYPNSGERYDGEKKEWVESTGVSDGDFVSYVNEWCKDGAALIGGCCRTTPNTIRAIQRTLNQGFN

SEQ ID NO: 44954 - protein, 414 aa, Sorghum bicolor
  Clone ID: SORBI-28MAY03-C40350_1.pep
GVLSLCDHPALLDKSETHALYSSDAIERAWQILEKIPGRATGAYSHSQGVKGLRDEIAAGIAARDGFHASGDNIFLTDGASPAVHMMMQLLISSEKDGILCPIPQYPLYSASIALHGGSLVPYYLDEETGWGLEVDELKKQLEEARSKGITVRALVVINPGNPTGQVLAEENQKKIVEFCKNEGLVLLADEVYQENVYVEDKKFHSFKKIARSLGYTDDDLPLVSFQSVSKGFYGECGKRGGYMEITGFSPEVREQIYKVASVNLCSNVSGQILASLVMNPPKAGDESFESFMLERDGILSSLARRAKALEEAFNSLEGITCNKAEGAMYLFPRLHLPQKAIGAAQAAGTAPDAYYAKRLLEATGIVVVPGSGFGQVPGTWHFRCTILPQEDKIPAIISRFKEFHEKFMDEFRD

SEQ ID NO: 44955 - protein, 255 aa, Sorghum bicolor
  Clone ID: SORBI-28MAY03-C55851_1.pep
MATTAAAAAAASAFSHGHGRSRRCPPRSRSRATVARCGLLLPVPRRNVLSTMLSTSTILLLGPRQITLAETSGGAFREYIDIFDGYTFLYPKSWIQVRGAGADIFFRDPFVLDENMSVEISSPSSSKYMSVEDLGPPEKAAEKVLKQYLTEFMSTRLGVRRESNVLSAVSKVADDGKLYYEVEVNIKSYASNNELAVMPQDRVQSLEWDRRYLSVLGVENKRLYELRLQTPEQVFMQEEEDIRRVMDSFRVIKTA

SEQ ID NO: 44956 - protein, 227 aa, Sorghum bicolor
  Clone ID: SORBI-28MAY03-C59005_1.pep
LRTAKEEFEQTKAAAAAAETRLSAVVKEAEASAASERLAREAVQALQESKEARDTTDSPRRVVLPLSEYYELSKRAHEAEEQASEKVAEALAQVVLAKESEARSLERLKETSEEMDEKKEELEIALERAGRANEGKLGAEQELRKWRADHEQRRRAHESTKRAVNPLNGPSRVFVEQKDPHHKEQESKVHMSGSSYEGFVPNQKLQRKKSLFPLMGSVLSRKTRAQT

SEQ ID NO: 44957 - protein, 124 aa, Sorghum bicolor
  Clone ID: SORBI-28MAY03-C6048_1.pep
MGGKCPHRKVKKRRLSHKTARRGKFLLKADDAVYDELVKLADQGKDAEGKELPVDEDLPGMGQFYCLHCDRYFASESVKDDHYRSKRHKKRVKVMSGPAPHTQLDAELAAGMGKPDNGLKLMSM

SEQ ID NO: 44958 - protein, 326 aa, Sorghum bicolor
  Clone ID: SORBI-28MAY03-C5448_1.pep
QVISGKQYAGPEVDVWSCGVILYALLCGTLPFDDENIPNLFKKIKGGIYTLPSHLSALARDLIPRMLVVEPMKRITIREIRDHQWFQTRLPRYLAVPPPDTTQQAKMIDEDTLRDVVNMGFNKNHVCESLCSRLQNEATVAYYLLLDNRFRATSGYLGADYQESMDRNLNQMASSESSSSGTRNYVPGSSDPHSSGLRPHYPVERKWALGLQSRAHPREIMIEVLKALQELNVSWKKNGHYNMKCRWLPGFPEVHDMLDASNSFLGDSTIMDNDDANGRLPAVIKFEFQLYKTKEDKYLLDMQRVTGPQLLFLDFCAAFLTKLRVL

SEQ ID NO: 44959 - protein, 104 aa, Sorghum bicolor
  Clone ID: LIB3476-006-Q6-K1-C9.pep
ATVAYYLLLDNRFRATSGYLGADYQESMDRNLNQMASSESSSSGTRNYVPGSSDPHSSGLRPHYPVERKWALGLQSRAHPREIMIEVLKALQELNVSWKKNGHY

SEQ ID NO: 44960 - protein, 152 aa, Sorghum bicolor
  Clone ID: SORBI-28MAY03-C4371_1.pep
MSTPARKRLMRDFKRLMQDPPAGISGAPQDNNIMLWNAVIFGPDDTPWDGGTFKLTLQFNEEYPNKPPTVRFVSRMFHPNIYADGSICLDILQNQWSPIYDVAAILTSIQSLLCDPNPNSPANSEAARMFSENKREYNRKVREVVEQSWTAD

SEQ ID NO: 44961 - protein, 321 aa, Sorghum bicolor
  unsure (1)..(321): unsure at all Xaa locations
  Clone ID: SORBI-28MAY03-C3919_1.pep
MKPVVGKARKLKDLMIKSDNRICADCGAPDPKWASANIGVFLCLKCGDVHRALGPDISKVLSITLDDWSDSDIDSMLEVGGNSYANSIYEAFLPKDHPKPKPDSTMEYRTKFIRAKYETQDFLKPSLRISSRSSFKSTTSVKSVDNNFSSTSKKDVSEDTREFCGELNITVVKGTNLAVRDMLTSDPYVILTLGGQTAQSTVKKSDLNPVWNEVLKISVPRNYGPLKLEIYDPDIFXSADDIMGEAEIDLQPMITAAMAFGDTSRLGDMQIGRWFMTKDNALMKDSTVNVVAGKVKQEVHLKLQNVESGEMELELEWVPIL

SEQ ID NO: 44962 - protein, 72 aa, Sorghum bicolor
  unsure (1)..(72): unsure at all Xaa locations
  Clone ID: LIB3480-021-P1-K1-B3.pep
RHEINTHNLYVQEIYDHDIFSADDIMGEAEIDLQPMITAAMAFGDTSRXGDMQXXRXFMTKDNALMKDSTVN

SEQ ID NO: 44963 - protein, 157 aa, Sorghum bicolor
  Clone ID: SORBI-28MAY03-C44053_1.pep
PWFKRSLSVDSQLGGLLGGQAERELAFQAPPALNAFDIISMSPGLDLSGLFGESRRSREKRFMTTASPEQTVERLGHAGAKLGYFMVGKKGVERLPLGGLSGLVAMSMEMSEVSHELMLVELRLEGGDGDEADAFGWEELRVELGDVVTAWHVCEEG

SEQ ID NO: 44964 - protein, 306 aa, Sorghum bicolor
  Clone ID: SORBI-28MAY03-C4450_1.pep
MAPSPLLVRPPAMANSPLPPPRCAAAVAAAPAVRTAPAAPLSRLRTKCRFAASDVREDYSSTPIDIVADVKTEKIVVLGGSGFVGSAICKAAVATGIEVVSFSRSGRPAYSDPWVDQVNWLAGDVFYARWDEVLVGSTAVVSTLGGFGNEEQMKRINGEANVIAVNAAKEYGVPKFILISVHDYNLPSFLLTSGYFTGKRKAESEVLSKYPASGVVLRPGFIYGKRKVNGFEVPLDAVGQPLERLLSSVENFTKPLNSLPASDLILAPPVSVDDVAYAVINGVVDDSFFGVFTIEQIKEAAAKVRV

SEQ ID NO: 44965 - protein, 133 aa, Sorghum bicolor
  Clone ID: SORBI-28MAY03-C44398_1.pep
PAMNFTASVEDPIMNLHSDQGSNSFGCSDLAWENDTKTPDITSIAPISTIAEGDESAFVNSNSNSSMLPPVLENSAVDFTDGLTDLESYMRFLLDGGASDSVDSLLNLDGSQDVGSNMDLWSFDDMPIAGDFF

SEQ ID NO: 44966 - protein, 106 aa, Sorghum bicolor
  Clone ID: SORBI-28MAY03-C45126_1.pep
DHFHKKPVVPPKPEPQPKPQPESQPPTPTYGSATPTNGSPTPVSNHAPHMFHHFYKGHHDHHFFDYFHKKPVPPEPKPEPKPQPDNHPPVPTFGSPPPLYHAPAKH

SEQ ID NO: 44967 - protein, 250 aa, Sorghum bicolor
  Clone ID: SORBI-28MAY03-C4586_1.pep
MSRRYDSRTTIFSPEGRLYQVEYAMEAIGNAGSALGILAADGVVLVGEKKVTSKLLQTSRSAEKMYKIDSHLACAVAGIMSDANILINTARLHAQRYALSYQEPIPVEQLVQSLCDTKQGYTQFGGLRPFGVSFLFAGWDKHHGFQLYMSDPSGNYGGWKAAAVGANSQAAQSMLKQDYKDGLTREEAVALALKVLSKTMDSTSLTAEKLELAEVFLQPGTGDVQYQVCSPEALGKLLAKSGLTQPTPDA

SEQ ID NO: 44968 - protein, 254 aa, Sorghum bicolor
  Clone ID: SORBI-28MAY03-C45375_1.pep
MALRRALLRSAEISPDRKAAIEYFHSLSRAQPARSLNGAGRSFSTQAATTSSTPQPPPPPPPPEKTHFGGLKDEDRIFTNLYGLHDPFLKGAMKRGDWYRTKDLVIKGADWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLEKARQEAYAAGLLGKNACGSGYDFDVHIHFGAGAYICGEETALLESLEG

SEQ ID NO: 44969 - protein, 172 aa, Sorghum bicolor
  Clone ID: SORBI-28MAY03-C7638_1.pep
MAVAVPSSLPMKLWRTEPRGKSAAAGPDEPVRVLVTVTVLGSAGPLRFIVLEGDTVAALIRAALRCYAREGRMPLLGTDPAGFVLSTANGGSGALKEDEKITFNGCRSFLLWQKTAVQGAAKGAGHDALTATPSPGRKGSSGFKATPSPGRKGSGGWKAGLNKFLLSFSIKV

SEQ ID NO: 44970 - protein, 216 aa, Sorghum bicolor
  Clone ID: SORBI-28MAY03-C636_1.pep
PAAMAAASSYLPPVVTAVLFLWVFFSCGHVEASIHFGNMTALQKHVEFFDRNKDGIITPSELFRGYVALGCDAVFARKKAASMSAGVGPKTSPVGAPLPHLSIYVQYIHKAMHGSDTGAYDAEGRFVPAKFEEIFTKHAKVRPDALTYEEIEEMILANRDPLDPQSWSAPEKEWGLIYKLASDKQGFLHKDSTRGIYDGSVFYKLEKLRMSARCDM

SEQ ID NO: 44971 - protein, 86 aa, Sorghum bicolor
  unsure (1)..(86): unsure at all Xaa locations
  Clone ID: LIB3481-029-P1-K1-C10.pep
KDSLQDDAPLPHSSIYVEYIHKAMHGSDTGAYDAKGRFVPAKFEEIFTKHAKVRPDALTVXEMEEMILANRDPLDPQSWSAPEGEW

SEQ ID NO: 44972 - protein, 302 aa, Sorghum bicolor
  Clone ID: SORBI-28MAY03-C8378_1.pep
MAPPLAAVSSTSPLFSPSSSRPLRRRHAPPPSVSFQTRGRSPAAAPAESSGSPLLEVRGLTASVKETGQQILAGVDLTIREGEIHAIMGKNGSGKSTLTKVLVGHPHYEVTGGTILFKGQDLVDMEPEDRSLAGLFMSFQAPIEIPGVSNFDFLLMAVNARREKSGLPALGPLEFYSVVSPKVDALKMDPKFLDRNVNEGFSGGERKRNEILQLSVIGADLALLDEIDSGLDVDALEDVANAVNGLLTPQNSVMMITHYQRLLDLIKPSYVHIMENGKIIKTGDSSIATQINEGGFKSIALV

SEQ ID NO: 44973 - protein, 362 aa, Sorghum bicolor
  unsure (1)..(362): unsure at all Xaa locations
  Clone ID: SORBI-28MAY03-C46_1.pep
MEAAIPNPSALKTRIAVVTGGNKGIGLEVCRQLAGDGATVVLTARDETRGAAAAEKLREAGLSNVIFHQVEITDDPIIAGFFQLLASRGGKLDIIVSNATRGAADEVKHTEAGPSNEILHKVENPGQRLVARLTGVRKTCFGKLDIVKTNSYSVXHVIEAFPADSQASXEEISVMVSSEFGLLMLIDNEELWQELNEVEKLTEERLDEVLATLLRLFQAGEVEASVKVSSFLGXMRLINNEELRQELNDVEKLTEERLDEVLATFLRDFKAGKVEARGWPMAFSAYKVAKVAMNGYSRILARRHPELRINCAHPGYVSTDMTIHTGPLTPEEGAANLVKVALLPEGGPTGAYFAWGVEASFV

SEQ ID NO: 44974 - protein, 112 aa, Sorghum bicolor
  unsure (1)..(112): unsure at all Xaa locations
  Clone ID: LIB3481-001-Q6-K1-G12.pep
RVVTGGNKGIGLEVCRQLAGDGATVVLTARDETRGAAAAEKLREAGLSGXGFHXLEITDAPSIARLAEFLKTRFGKLDILINNAALGADEYIQNTYTCKNEKFMRICYTNIL

SEQ ID NO: 44975 - protein, 208 aa, Sorghum bicolor
  Clone ID: SORBI-28MAY03-C4793_1.pep
PPERKTELARKLGLQPRQVAVWFQNRRARWKTKQLERDFDRFKASFDALRADHDVILQDNHRLRAQVVSLTEKLQEKEATEGGASAATDAAAALPAVDDVKASLADDVEEPTEAAAEEEEAAFEVQQVKSEDRLSTGSGGSAVVDTDALLYGAGCRFAAAVDSSVESYFSGAEDHHYHDCGMGNVNQGKGGGMNSYELLCCMEKRCSY

SEQ ID NO: 44976 - protein, 342 aa, Sorghum bicolor
  Clone ID: SORBI-28MAY03-C4798_1.pep
MEKMLHAAPVHATLPECFIFPSDKLPQAKSTSGAVSLPIIDLSLGRDEVRRAILHAGKEIGFFQVVNHGVSLEAMRDMEAVCQEFFALPAEDKAGLYSEDTGKATRIYSSTMFDTGAEKYWRDCLRLACSFPDVGDSPRGWPDKPARLREVVERFTAQTRGLGMHILRLLCEGLGLRPDYLDGDISGGDVVLHVNHYPPCPDPTATLGLPPHCDRNLLTLLLPSMVRGLEVSYNGDWIKVDPVAGAFVVNFGCQLEVVTNGTLKSIEHRVMTNLGVARTTVATFIMPTTDCLIGPAAEFLSDDNPPAYRTMTFGEFKRIYSVVKLGLSLNLTTNLKDVQKQV

SEQ ID NO: 44977 - protein, 123 aa, Sorghum bicolor
  Clone ID: SORBI-28MAY03-C4956_1.pep
MSDMKDSNAPAALDGNPQPMDQTEDNSMPSAQQQEEAIKKKFGGLMPKKPPLISKDHERAYFDSADWALGKQGVAKPKGPLEALRPKLQPTRQQQQQRARRSIYTSSENEDGDGAGAEEMSIN

SEQ ID NO: 44978 - protein, 251 aa, Sorghum bicolor
  Clone ID: SORBI-28MAY03-C5126_1.pep
MAEELVLDTAIRDWVLIPLSVVMVLIGVLRYFVSKLMRSPPTSPSPDPKLVKEGQVVIRARNLRTNAQFIPGKAFKARKVYYTNEENGLLHVPKEEAQKAQAAMFSDPNMAMDMMKKNLSMIVPQTLTFAWVNFFFSGFVAAKIPFPLTQRFRGMLQNGIDLSTVDVSYVSSRSWYFLNLFGLRGLFSLILGEENATDDAQKMMQMGGGFGFNPTMSLGAEKDSLDIIQHDWALPKMEKHAEDVLKKLLKK

SEQ ID NO: 44979 - protein, 264 aa, Sorghum bicolor
  Clone ID: SORBI-28MAY03-C50400_1.pep
MLDWGCVLTVRGLRGLWARASRQSLAVIRGSCRAIRLWLGTAPAAEEAARAFDEAARAMYGDLARTNFPRPHAATYAQAALVSTSSKAAPMAVGALWPGTSCESTTTSNHSDIASTSHKPEASDSSSSLKAEWPEALEAGSSCIQAGTPSVADKVFGTLEPITKLPDGGVTNLPDGGVINLPDGGDDCFDIGEMLSMMEADPHNEGGADVGMGQPWCLDGLDSSVLESMLQSEPEPFLMSEEQEMFLAGFESPSSFFEDLERLK

SEQ ID NO: 44980 - protein, 172 aa, Sorghum bicolor
  Clone ID: SORBI-28MAY03-C5379_1.pep
MALWNGGGGAFPAAAVLVAAAVAALLGAGVGATKFDDVVQPSWANDHMVYDGDLLKLRLDANSGGGFVSRSKFLYGKASADLKLVPGDSAGVVTAFYLSSAGDKHNEFDFEFLGNVTGEPYLVQTNLYIDGVGNREQRIDLWFDPTADFHTYAVLWNPSQVVFMVDDTPIRV

SEQ ID NO: 44981 - protein, 313 aa, Sorghum bicolor
  Clone ID: SORBI-28MAY03-C5388_1.pep
VLLIFAPLAIPLKMTLFPKKKRPSDSHSPTNDNDARGALLPSSSESNLGNLEEDDSFDIDILLAEGEGAIKPKRRRPRRGEDFRFREAILKADFWLLFAICFVGIGSGITVVNNLAQIGIAAGAVDTTISLSVFSFCNFFGRLGGGAVSEYLVRSRTLPRSVLIICTQVVMIITYLLFALGQLATLYVSVALLGICYGALLSVIISTSSELFGLKHWGKIFNFIILANPVGAYLFNTLAGYVYDLEVAKQHATTSGSDIACHGPNCFRLTFCVLSGAACLGTLLSVVLTVRVRPVYQMLYAGGSFSQPRNSGH

SEQ ID NO: 44982 - protein, 240 aa, Sorghum bicolor
  Clone ID: SORBI-28MAY03-C1117_1.pep
MALAARLVSRSRQLYSVQAAFGNGGATQVRSFAAPADRPPVSGDDLLKGIFFEVKKKFETALGVLKKEKITIDPEDPAAVSRYAQVMKTVREKADLLSDSQRIKYTIETFTKGIPDARTYLNTLQQIRIKSGLIDHLGIEPLMMEALEKIEKDIKKPLLRSDKKNMATLLAEFDKINKKLGIRKEDLPKIEEELELEIAKSELSELKKECVEAMETQLKREEFQDEEMPDVRKLDIRNFL

SEQ ID NO: 44983 - protein, 263 aa, Sorghum bicolor
  Clone ID: SORBI-28MAY03-C1137_1.pep
ARGKVLTYSAQDSTYKVFDLKNYTLLYSVSDKNVQEIKISPGIMLLIYTRTSSSVPLKILSIEDGTVLKSFSHLLHRNKKVDFIEQFNEKLLVKQEGENLQILDVRNFQLTEVSRTEFMTPSAFIFLYELQLFLTFRNRSVAVWNFRGELVTSFEDHLLWHPDCNTNNIYITSDQDLIISYCKADSTDSSSEENAGSINISSILTGKCLAKINPGNSSKQKKAWRFQNTVSEALEDITALYYDEDRDEIYTGNRHGLVHVWSN

SEQ ID NO: 44984 - protein, 330 aa, Sorghum bicolor
  Clone ID: SORBI-28MAY03-C10471_1.pep
MEAGLALQTRAAGFGSGRRRGGLQSPIGSLRVADPAGAAVAAGFGSGRRRGGLQSPIGSLRVADPAGAAVAVRARGSKPVAPLRAKKSFGGHENLHNSVDEALLLKRKSEEVLFYLNGRCIYLVGMMGSGKSTVGKIMSEVLGYSFFDSDKLVEQAVGMPSVAQIFKVHSEAFFRDNESSVLRDLSSMQRLVVATGGGAVIRPVNWKYMKKGLSVWLDVPLDALARRIAKVGTASRPLLDQPSGDPYTMAFSKLSMLAEQRGDAYANADVRVSLEEIASKQGHHDVSKLTPTDIAIESLHKIESFVSEHTPDNPASDSQAESQIQRIQTL

SEQ ID NO: 44985 - protein, 166 aa, Sorghum bicolor
  Clone ID: SORBI-28MAY03-C5878_1.pep
MNVDKLKKMAGAVRTGGKGSMRRKKKAVHKTTTTDDKRLQSTLKRIGVNTIPGIEEVNIFKDDVVIQFVNPKVQASIGANTWVVSGTPQTKKLQDLLPSIINQLGPDNLDNLRRLAEQFQKQAPGASGAEAGASAGAAQDDDDDVPELVPGETFEEAVEEKKEEAS

SEQ ID NO: 44986 - protein, 215 aa, Sorghum bicolor
  Clone ID: SORBI-28MAY03-C66869_1.pep
MNYPPSSCSSSRISLVLLLVITVLTRSSIVLATSDRYYANSAEYYGDGGDHELLMMERFHAWMAAHGRSYPTAEEKLRRFQIYRDNVKFIEAINRDTTKTFTCGENQFTDLTHQEFLARYTMASHDSVPLDLSSSVITTRAGDITESDSGTTMQVEDTDLPEHVDWREQDAVTPVQNQLQGCHACWVFASVATIESANKIKNGDLLKLSEQQIVD

SEQ ID NO: 44987 - protein, 327 aa, Sorghum bicolor
  Clone ID: SORBI-28MAY03-C67447_1.pep
MAAIRHRTVEANGISMHVAESGAEGDPAVVFLHGFPELWYSWRHQMAHLAARGYRCVAPDLRGYGGTAAPTDVASYTAFHVVGDVVALLDALGIQKVFVVGHDWGAIIAWYLCLFRPDRVTALVNTSVAFMRHVFIRAGASAVKPTDYFCRNYGPTYYICRFQEPGVAEKEFSPATARYLMKPILCNRFTSSAAGGEKPADTAAPAAPVEEPLPPWLTEEDVGHFVSEFERTGFTGPINYYRNMDRNWELAAPWADAKVQVPTRFIVGDGDLTYHYPGIQDYIHKGGFQADVPGLDSVVVIPGAGHFVQQEKADEVSQHIYDFISKF

SEQ ID NO: 44988 - protein, 335 aa, Sorghum bicolor
  unsure (1)..(335): unsure at all Xaa locations
  Clone ID: SORBI-28MAY03-C6825_1.pep
MDGGGAGAGVGGSEGELSAQETALYDRQIRVWGADAQKRLSKSPVLVCGMNGTTIEFCKNIVLAGVGGXSLMDDHVVTEDDLNANFLIPPDESIYGGRSRAEVCCESLVDFNPMVRVSVEKGDPSLIDGEFLDKFDIVVLSRASLKTKLFINENCRKRSKHIAFYTIDCKDSCGEIFVDLQKHSYVQKKPGGSTEQQELTYPSLQEAISVPWSNLPKKTSKLYFAMRVLEDYELSEGRSPGETTLSDIHAVLARRKDMCDKMSLNESRIPTTLVERLLAAGKKEHPPVCAILGGILGQEVIKSISCKGDPVKNFFYFDVADGKGVIEDIPPPPAN

SEQ ID NO: 44989 - protein, 299 aa, Sorghum bicolor
  Clone ID: SORBI-28MAY03-C6942_1.pep
MEFWGLEVKPGSTVKCEPGHGFILHLSQAALGESKKSDNALMYVKVDDQKLAIGTLSIDKFPQVQFDLVFDKEFELSHTSKTTSVFFSGYKVEQPMEEDEMDLDSEDEEELDVPVIKENGKADGKEQKSQEKAVAAASKSSLVSKKSKDDDDSDEDETDDSDSDDTDDSDEGEGLSPEEGDDDDSSDEDDTSDDEEEETPTPKKKPEAGKKRPAENSLTPLSDKKAKVATPSAQKTGGKKGAVHVATPHPAKGKTPANNDKSKEKSPKSGGSVPCKSCTKTFNSEMALQAHSKAKHGAK

SEQ ID NO: 44990 - protein, 289 aa, Sorghum bicolor
  Clone ID: SORBI-28MAY03-C6980_1.pep
MNVKGGGRIPVPPPGASALVKVAVFGGAAVYAAMNSLYNVEGGHRAIVFNRIQGIKDKVYPEGTHFMIPWFERPIIYDVRARPNLVESTSGSRDLQMVKIGLRVLTRPMPERLPHIYRTLGENFNERVLPSIIHETLKAVVAQYNASQLITQRETVSREIRKILTERARFFNIALDDVSITSLSFGKEFTHAIEAKQVAAQEAERAKFIVEKAEQDKRSAIIRAQGEAKSAELIGQAIANNPAFLALRQIEAAREISHTISSSANKVFLDSNDLLLNLQQLNVSSKQKK

SEQ ID NO: 44991 - protein, 113 aa, Sorghum bicolor
  Clone ID: SORBI-28MAY03-C6939_1.pep
MVSRGARRPSARLLLLSLGLVLLYFTSVSSVGVAAAQKTWCVAKPSASNDILSLNLDYACSQVSCAVIQKGGPCYYPDSLVSRAAVAMNLYYASIGRHPWNCYFNNWNRYFNN

SEQ ID NO: 44992 - protein, 470 aa, Sorghum bicolor
  Clone ID: SORBI-28MAY03-C1506_1.pep
LVEVKKELDDLRDKLQPLTMKYRKEKERIDEIRKLKQRREELQFSLQEAERRMDLARVADLKYGALQEIDAARGKLESETGENLMLTETVGPEQIAEVVSRWTGIPVTRLGQNDKERLVGLADRLHQRVVGQTEAVNAVAEAVLRSRAGLGRPQQPTGSFLFLGPTGVGKTELAKALAEQLFDDENLLVRIDMSEYMEQHSVARLIGAPPGYVGHEEGGQLTEQVRRRPYSVILFDEVEKAHVAVFNTLLQVLDDGRLTDGQGRTVDFRNTVIIMTSNLGAEHLLAGMVGKNSMKVARDLVMQEVRRHFRPELLNRLDEIVIFDPLSHEQLRKVARLQMKDVAVRLAERGIALAVTDAALDIILSLSYDPVYGARPIRRWIEKRVVTQLSKMLIQEEIDENCTVYIDAAPAKDELAYRVDRSGGLVNAETGLKSDILIQVPNDAVRSDAAQAVKKMRIMEEEDEDGMDEE

SEQ ID NO: 44993 - protein, 250 aa, Sorghum bicolor
  Clone ID: SORBI-28MAY03-C15402_1.pep
MALSISTPTSSSLVPASRQVVRLTSRSAKPATFSLRRPPLAAAAAAGNAPTSPVSEVVTELDAVAGFSEIVPDTVVFDDFERFAPTAATVSSSLLLGIAGLPDTKFKSAIDTALADGECNALEKPEDRMSCYLTKALANVGAELAHQVPGRVSTEIDARLAYDTQGIIHRVHELLNLYNQHDVSTDRLLFKIPATWQGIEASRLLESEGVQTHLTFVYSFAQAAAAAQAGASVVQIFVGRLRDWARNHSG

SEQ ID NO: 44994 - protein, 205 aa, Sorghum bicolor
  Clone ID: SORBI-28MAY03-C16028_1.pep
MAKLPRLPCPIPVLALVCILSLAALRPALSSRAAPRDGVSFAGAGNTIHQLLKDHGLPGGLLPRGVESYTLDESTGLLEARLSAPCYATYDNGDLAYFDNVVRGNLSKGALRGVEGLSQEELFVWLPVKGILVQDQEPGVILFDIGLAHKSLSRSLFEDPPDCKPSAAAGMSATAAARWKGRQGVTGLRLRREVAADSDQHQEQR

SEQ ID NO: 44995 - protein, 140 aa, Sorghum bicolor
  Clone ID: SORBI-28MAY03-C81582_1.pep
DRLFPRPDPTLNATFAGQLRRTCPAKGTDRRTPLDVRTPNAFDNKYYVNLVNREGLFTSDQDLFSNARTRALVDKFARSQRDFFDQFAFSVVKMGQIKVLTGTQGQIRTNCSARNAAGTTMLPWSVSVVEEAADESLGVF

SEQ ID NO: 44996 - protein, 255 aa, Sorghum bicolor
  Clone ID: SORBI-28MAY03-C86008_1.pep
MAEQHREESGGSVLDKISDKLHGRGSGSSSSSSDSDDEHSSATAAVKAKIYRLFGREKPVHSVLGGGKPADLFLWRNKRISGGVLAGATAIWLLFEVMDYHLLTLLCHCLILTLAILFLWSNATTFINKSPPNIPEVKIPEDLAVNVARSLRYEINRGFATLREIGQGHDLKKFLIVIAGLWILSVLGSCCNFLTLSYIVFMVLYTVPVLYEKHEDKVDAFGEKAMVELKKYYAIFDEKCLSKIPKGPLKDKKQH

SEQ ID NO: 44997 - protein, 325 aa, Sorghum bicolor
  Clone ID: SORBI-28MAY03-C8901_1.pep
MAATVEGVRHRTVEANGVRLHVAEAGPEEAGAPVVLLVHGFPDLWYGWRHQMAALAARGYRAVAPDLRGYGDSDSPPDASSYTTFHVVGDLVALISDLGQPRVFVVGHDWGAIVAWQLCLLRPDLVRALVNLSVVYHPRRPEMSPLQTIRAACGEDHYMCRFQEPGVAEAEFALYDTKYVFKKTFGMRKPAPLVLPKDKSFFDSLDSDGTCPPWLSEEDISYYAEKFAKTGFTGGLNYYRCMDRSWELSAPWTGAQIKVPSKFIVGDLDITYNAPGVPDYIHKGGFKASVPNLEDVVIMEGVSHFLNQEKPNEVSDHICEFFSKF

SEQ ID NO: 44998 - protein, 232 aa, Sorghum bicolor
  Clone ID: SORBI-28MAY03-C92261_1.pep
MAVHHVLSLTQGLLLLLSFYVAAVVSDTFRHELSHKTNQHHIPYNLQPEYFPNERLYQAYLVIQRFKSTITSDPKNVTATWTGHDICGEKTYLGFYCATPSGLAEKQTVTTVLLNGFSLRAPKLQGFIDQLPDIAVFHAASNNFGGDIPQLDRLPYLYQLSTANYDIQPLLPSGSRGEVMTGASAGSGKQQYPVLCIKTFFNFTFHIVAGNATSGGLIPGIPNPKIPGIPSF

SEQ ID NO: 44999 - protein, 216 aa, Sorghum bicolor
  Clone ID: SORBI-28MAY03-C9776_1.pep
HDAPLPGGGPLGRHRHPPRRAGLVRGSPRPPPAVRDQAPGPVREGGAPRPPAGRGGPLPLPLRREGGGPLMFTMSSERFVKIQREAPPEFQQYLVQVTKYQAAQNCKTWIVGKALSPREQRWAPSGTHFHQFVVPPIIGFRRDCTYGKLAAMRLPKDVQGLGSCEYTMERGVVHACHAGGVVHFLEGWDHHEVGAIDVDRIDVVWNAALKHGLAPV

SEQ ID NO: 45000 - protein, 96 aa, Sorghum bicolor
  Clone ID: SORBI-28MAY03-C9868_1.pep
LVSLFSNRKVRADTAMTGEMTLRGLVLPVGGVKDKVLAAHRYGIKRVILPERNLKDLSEVPSPILSGMEILLVKRIEEVLDHAFEGGCPLRSRSKL

SEQ ID NO: 45001 - protein, 319 aa, Sorghum bicolor
  Clone ID: SORBI-28MAY03-C10152_1.pep
MGTEAEHQDSSVQHDGVVVVPAPRPRKGLASWALDLLESLVVRLGHDKTKPLHWLSGNFAPVVEETPPAPNLTVRGHLPECLNGEFVRVGPNPKFVPVAGYHWFDGDGMIHAMRIKDGKATYVSRYVKTARLKQEEYFGGAKFMKIGDLKGFFGLFMVQMQQLRKKFKVLDFTYGFGTANTALIYHHGKLMALSEADKPYVVKVLEDGDLQTLGLLDYDKRLKHSFTAHPKVDPFTDEMFTFGYSHEPPYCTYRVITKEGAMLDPVPITIPESVMMHDFAITENYSIFMDLPLLFRPKEMVKNSEFIYKFDPTKKARFG

SEQ ID NO: 45002 - protein, 210 aa, Sorghum bicolor
  Clone ID: SORBI-28MAY03-C17969_1.pep
RPHVIFMDSANIYYAINKSVVEVIVYARGELITQCGTIVACKDRSAYVVTDARLVSEHLGRRRIEVKFPDGQISIPTPNQFNLHNGILGIYCSPNSQFDRTKVDVIEVCEEGLNSLDTVYVYDGVKGMMTPGTVTQIDAHSFSITNIASDMTEYGAPVLNRNGILVGMCYSFEYHLSAKSILAIANAIERSQNRPFTSVQAALDHIYNTI

SEQ ID NO: 45003 - protein, 328 aa, Sorghum bicolor
  Clone ID: SORBI-28MAY03-C1838_1.pep
THNRSVATQGPRSEHQTTSRFCFAIIVAFSHHRSLHDVAPPSCIYLDGHHYANLTVINDSEIQSISAHIEERAVIARLPQSARDIIGHKDLKDVIQEELQINIKVEDISQYNSDYIIMLDSSSTKTILLDRGFLKVGSFILPLIPWDRSYGSTILPLQTHLTDAHNLNPHSLIASNSQHLTIYIYGLPPHLCCEFIVRQLLKKICIVHKIAFTPANLTYSVDAYGSDMSIPEITHIGVKKETHNGSIISIWPLWYEVITEDMHPNQHDLYYLENTDNFRGDSDLDSEHHKEVQKQYYDLQDGNKETTSQLNEYIAGYSDDSDWEPYVP

SEQ ID NO: 45004 - protein, 108 aa, Sorghum bicolor
  Clone ID: SORBI-28MAY03-C4836_1.pep
GGGGGGGGCGGGGGGGGGGTRGRCPVDTLKLGVCANVLNGLINVNLGTPPRTPCCTLIQGLADLEAAVCLCTALRANILGINLNLPINLSLLVNYCGRRVPSGFQCSS

SEQ ID NO: 45005 - protein, 180 aa, Sorghum bicolor
  Clone ID: SORBI-28MAY03-C5429_1.pep
MGFVGDTMESIRSMQIRQVLTQIISLGMIVTSALIIWKGLIVFTGSESPVVVVLSGSMEPGFKRGDILFLHMSKDPIRTGEIVVFNVDGREIPIVHRVIKVHERQDTAEVDILTKGDNNFGDDRLLYAHGQLWLQQHHIMGRAVGYLPYVGWVTIIMTEKPFIKYLLIGALGLLVITSKD

SEQ ID NO: 45006 - protein, 106 aa, Sorghum bicolor
  Clone ID: LIB5047-007-R1-XP1-H10.pep
PAGSRRRIVVFNIDGREIPIVHRVIKVHERQGTAEVNILTKGDNNFGDDRLLYAHGQLWLQQHHIMGRAVGFLPYVGWVTIIMTEKPFIKYLLIGALGLLVITTKE

SEQ ID NO: 45007 - protein, 210 aa, Sorghum bicolor
  unsure (1)..(210): unsure at all Xaa locations
  Clone ID: SORBI-28MAY03-C56862_1.pep
GSSCWFRRVLPFSSGRFSAYFRGFGPWDGRAGPSLLSIGPHFLGAYFRTQQTRRVQTENYVLCEFISPRPTCRIPLEGKISSVNKGTAKNWHRTTAKFVEKCXYPQDGSSPKSLRYIGSMVADVHRTLLYGGIFLYPADQKSPNGKLRVLYEVFPMSFLMEQAGGQSFTGKQRALELAPAKLHDRSPIFLGSYDDVEEIKALYASESNNA

SEQ ID NO: 45008 - protein, 218 aa, Sorghum bicolor
  Clone ID: SORBI-28MAY03-C5447_1.pep
MVKLTMIARVTDGLPLSEGLDDGRDLKDADFYKQQAKLLFKNLSKGQHEASRMSIETGPYLFHYIIEGRVCYLTLCDRSYPKKLAFQYLEDLKNEFEKVNGSQIETAARPYAFIKFDAFIQKTKKLYLDSRTQRNLAKLNDELYEVHQIMTRNVQEVLGVGEKLDQVSEMSSRLTSDTRIYADKAKDLNRQALIRKYAPVAIVIGIVLMLFWLKNKIW

SEQ ID NO: 45009 - protein, 116 aa, Sorghum bicolor
  unsure (1)..(116): unsure at all Xaa locations
  Clone ID: SORBI-28MAY03-C4878_3.pep
QYEPEAALLSSIGSCPTGKMKKERSRSRTIDDEDPLRQSLRRGDDVAPAPATAAPLVDMTAMAPTTALKKMNHAAAGLSHGDSSGHRDSSSVRSAIRPSSARVLCLLQLSXAAGPA

SEQ ID NO: 45010 - protein, 159 aa, Sorghum bicolor
  Clone ID: SORBI-28MAY03-C4878_1.pep
RRRAPRRPLRLRAGRGPRARPRQAGLLAGVRTPPCGSCCTKKYASLVQIPWRVFCKKGCNADGDTWDECIGKCTEICYKDPVLEDRQWSAYIDRSPGQDSYSLECFNACVSGCGYRFDVPTEKVEEIKPNRPSKPPAPEPDVKRTKGPDCTEDVPCTSA

SEQ ID NO: 45011 - protein, 69 aa, Sorghum bicolor
  Clone ID: LIB3476-001-Q6-K2-C4.pep
HFMKKKAKLKKQIEASKLRGEELKAREKNFDPKLVRMMNGDFEGIGLEELKNYHDKLVEIQSMIRDQLN

SEQ ID NO: 45012 - protein, 196 aa, Sorghum bicolor
  Clone ID: SORBI-28MAY03-C6197_1.pep
MAGTKSKSSTKAGSPLLGKYELGHLLGRGNFAKVYHARCLAGGDPVAVKVLDKPELSATGMAARLLREVSAMRRLSHPNVLRLHEVLATRSKVYLVMELAPGGDLLSRLASLPSRRLPEHAARRVFLQLASALIYSHARGVFHRDVKPQNVLLDADGNLKVSDFGLAALPDSLRDDGHLHTACGTPAFAAPEVLRR

SEQ ID NO: 45013 - protein, 337 aa, Sorghum bicolor
  Clone ID: SORBI-28MAY03-C629_1.pep
TSHCLASGDIMISCLGDKEGTAAGNGFLLLDSEFNVKGRWEKPGHSPLFGYDFWYQPRHKTMISSSWGAPAAFRTGFNLQHVQDGLYGRHLHVYDWPGGELKQTLDLGDTGLLPLEVRFLHDPSKDTGYVGCALTSNMVRFFKTADGSWSHEVAISVKPLKVRNWILPEMPGLITDFVLSLDDRYLYLVNWLHGDIRQYNIEDPAKPFLAGQVWVGGLLQKGSDVVYVTDDGQEEQYNVPQVKGHRLRGGPQMIQLSLDGKRIYVTNSLFSRWDEQFFGDDFVKKGSHMLQIDVDTEKGGLAINPNFFVDFGTEPDGPALAHEMRYPGGDCTSDIWI

SEQ ID NO: 45014 - protein, 286 aa, Sorghum bicolor
  Clone ID: SORBI-28MAY03-C24598_1.pep
MTNGYLFREYIGAQSTGVQFSDVPINALLSFHFILSFAIDYTPVGQQPKPVPTNGVFSPFWDTGNLTPAAVAAIKAAHPNVAVMAGLGGDSVQDIVKAVFTPTSVDSWVGNAVASLTGIINTYGLDGVDVDYEHFADGADVDTFVECIGRLLTQLKQKMPNIATSIAPFEDPVVQKYYQPLWSKYSGVIDYVNFQFYGYGANTDVQTYVMFYNNQSANYPGGKVLASFKTGNVTGLLSPEQGISAAKELQRQNKLPGLFIWSADSSKQSSYGFKYETEAQQIIANH

SEQ ID NO: 45015 - protein, 407 aa, Sorghum bicolor
  Clone ID: SORBI-28MAY03-C25306_1.pep
MPSQGTVPVRRRCEGTAMGAITLDLRPGLGVGPFTLGMPISDAFAQIERQPNIYDVVHVKYFDEEPLKLDFVISFPDHGFHLRFDPWSQRLRLVEIYDVKRLQLRYATALIGGPSTLATFAAVYALFGPTFPGIYDKERGIYTLFYPGLSFAFPIPSQYTNLFTNGEVADLPLEFPDGTTPVTCRVCIYDSSTDSKVGVGSLMDKAVVPALPAGSLYMEEVHAKLGEELWFTIGGQHIPFGASPQDVWTELGRPCGIHQKQVDQMVIHSASEPRPRTTLCGDYFYNYFSRGIDILFDGQTHKIKKFVLHTNFPGHSDFNSYKKCNFVIYDAEAEGTVQPGNVSKNCITPSTKWEQVKEILGDCGRAAIQTQGSMNNPFGSTFVYGYQNIAFEVMKNGYIATVTLFQS

SEQ ID NO: 45016 - protein, 241 aa, Sorghum bicolor
  Clone ID: SORBI-28MAY03-C26043_1.pep
MKREGRQHGTVRISRSKVLKTTADADADAESAAAVAFALAATEKKAAAGKPTNASRSTGKCRRPRCAGCHAHPVTKARDKAKGAHKLRACDVALNHRLVSWRVVDDQGSGVPEYRGKSASSLLAYLAGGSGNSWHEDDDDTSEGGIGAPEAGLSDLYDLFVGRRADAEAEADPDPAARDTDLDDVGEIQAIGEPGLLLDGDDGKEDGDEKEEEDMGFCMVGITIAVEFSDGEEDWIVVEEV

SEQ ID NO: 45017 - protein, 364 aa, Sorghum bicolor
  Clone ID: SORBI-28MAY03-C14_2.pep
RRCVQTSDDDVVRRGQGSKPAREVAMERYEVIKDIGSGNFGVAKLVRDVRTKELFAVKFIERGMKIDENVQREIMNHRSLRHPNIVKFKEVVLTPTHLAIVMEYAAGGELFERICKAGRFSEDEARFFFQQLISGVSYCHSMQICHRDLKLENTLLDGSIAPRLKIFDFGYSKSSVLHSQPKSTVGTPAYIAPEVLARKEYDGKVADVWSCGVTLYVMLVGAYPFEDPDEPKNFRKTLTRILSVQYAVPDFVRVSMECRHLLSRIFVAIPEQRITIPEIKNHPWFLKNLPIEMTDEYQMNLQLVDMNGPSQSLEEIMTIIQEARKPGDGLKHSGQLPGLGSMELDDIDVDDIDVEDSGDFVCAL

SEQ ID NO: 45018 - protein, 117 aa, Sorghum bicolor
  Clone ID: SORBI-28MAY03-C14_1.pep
RRRVVRRGLGSKPAREVAMERYEVIKDIGSGNFGVAKLVRDVRTKELFAVKFIERGMKIDENVQREIMNHRSLRHPNIVKFKEVVLTPTHLAIVMEYAAGGELFERIWRTLSIGWMC

SEQ ID NO: 45019 - protein, 146 aa, Sorghum bicolor
  Clone ID: LIB5049-001-R1-XP1-B9.pep
RRRVVRRGLGSKPAREVAMERYEVIKDIGSGNFGVAKLVRDVRTKELFAVKFIERGMKIDENVQREIMNHRSLRHPNIVKFKECSFCYSAHFAKKKFGTKQGLNVHQEDVIHRMDVLNPQTMNQCQLLPSCCRVLWARSLQKPLRV

SEQ ID NO: 45020 - protein, 168 aa, Sorghum bicolor
  Clone ID: SORBI-28MAY03-C16354_1.pep
EKQGEQNDAPAADENKDNKDSAANEEEEKEEDKEMTLEEYEKIKEEKRKALLALKAEERKVEVDKDLQSLQPLSNKKENDEVFIKLGSDKDKKKEIAERDERAKKSVSINEFLKPAEGERYYGGRGRGRGGRGERGGFRGGYGGGYNRGPAAAPSIEDQAQFPSLGGK

SEQ ID NO: 45021 - protein, 157 aa, Sorghum bicolor
  Clone ID: SORBI-28MAY03-C16485_1.pep
MAAPLRRSLPSLGRALLTPAPARMLSAEASDALVEIKPGEIGMVSGIPEEHLRRKVLIYSPARTASQQGSGKVGRWKINFLSTQKWENPLMGWTSTGDPYANVGEAGLTFDSAESAKAFAEKHGWNYVVRKRHTPLLKPKAYAENFKWRGPPKAEQA

SEQ ID NO: 45022 - protein, 318 aa, Sorghum bicolor
  unsure (1)..(318): unsure at all Xaa locations
  Clone ID: SORBI-28MAY03-C17319_1.pep
MASSSPHHRAAVVAGVLLVVAAALCSRGAMAQLTADYYDCTCPDAYNIVKNVLIEAHKSDVRIYASLTRLHFHDCFVQGCDGSVLLDALPGVANSTEKLAPANNNSARGFPVVDKVKAALENACPGVVSCADILALAAELSVELXGAESVPSPFDNLTVLQQKFTAVGLHTVDLVALSGAHTFGRVQCQFVTSRLYNFSGTGRPDPTLNGGYRAFLTQRCPLNGNGSALNDLDPTTPNLFDNHYYTNLEVNRGFLNSDQELKSSPPAQGVTAPIVDQFASSQDAFFDNFAQSMINMGNIQPLTDPSKGEVRCNCRVAN

SEQ ID NO: 45023 - protein, 314 aa, Sorghum bicolor
  Clone ID: SORBI-28MAY03-C1739_1.pep
MDDDFEMPTAGADEMMGDDEMGDFGGDEGPVLKVGEEKEVGKQGLKKKLLKEGEGWETPEVGDEVEVHYTGTLLDGTKFDSSRDRGDPFKFKLGQGQVIKGWDQGIKTMKKGENAVFTIPPELAYGASGSPPTIPPNATLQFDVELLSWTSVKDICKDGGIFKKILKEGEKWENPKDPDEVLVKYEARLEDGTVVSKSEGVEFTVKDGYFCPALAKAVKTMKKAEKVLLTVKPQYGFGEKGRPAAGEEGGVPPNATLHIDLELVSWKTVTEIGDDKKILKKVLQEGEGYELSNEGAVVEVKITGKLQDGTVFTK

SEQ ID NO: 45024 - protein, 118 aa, Sorghum bicolor
  Clone ID: SORBI-28MAY03-C18133_1.pep
MAKSLRSKREKRLRTLRREIAEPFYDKKEAAKLAAQAAALAAPPLQVRGPPPSQDAGSSRGASSASAMDVEMSDEGNNRSKTLLKPLGTISKKKVQLHLKIKKDKRKARKKGKFSFKK

SEQ ID NO: 45025 - protein, 204 aa, Sorghum bicolor
  Clone ID: SORBI-28MAY03-C1791_1.pep
MSIFEYNGSAVVAMVGKNCFAIASDRRLGVQLQTIATDFQRVFKIHDKLYIGLSGLATDAQTLYQRLVFRHKLYQLREERDMKPETFASLVSALLYEKRFGPYFCQPVIAGLGDDDVPFICTMDCIGAKELAKDFVVSGTASESLYGACESMYKPNMEPDELFETISQALNSSVDRDCLSGWGGYVLIVTPTEVKERVMKSRMD

SEQ ID NO: 45026 - protein, 178 aa, Sorghum bicolor
  unsure (1)..(178): unsure at all Xaa locations
  Clone ID: LIB5049-008-R1-XP1-D1.pep
MSIFEYNGSAVVAMVGKNCFAIASDRRLGVQLQTIATDFQRVFKIHDKLYIGLSGLATDAQTLYQRLVFRHKLYQLREERDMKPETFASLVSALLYEKRFGPYFCQPVIAGLGDNNEPFICTMDCIGAKELAKDFVVSGTASESLYGACESMYKPNMEPEELFEXISQALQASGDRDC

SEQ ID NO: 45027 - protein, 132 aa, Sorghum bicolor
  Clone ID: SORBI-28MAY03-C18156_1.pep
MTFKRRNGGRNKHGRGHVKYIRCSNCAKCCPKDKAIKRFLVRNIVEQAAVRDVQEACVHDGYVLPKLYAKVHHCVSCAIHAHIVRVRSRENRRNREPPQRFRRRDDGPRPGQGPPRPGGAAPAAAPAAAPRT

SEQ ID NO: 45028 - protein, 300 aa, Sorghum bicolor
  Clone ID: SORBI-28MAY03-C30876_1.pep
AGLSPSWGALVYGPPGGGTSSVALAFATGGRPDFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEQSRLQIFKACLRKSPVAKDVDLNALAKYTQGFSGADITEICQRACKYAIRENIEKDIERERRRKDNPEAMEEDEVDDIAEIKAAHFEESMKFARRSVSDADIRKYQAFAQTLQQSRGFGSEFRFPDQPTAAAGSAGAADPFASAAAAADDDDLYN

SEQ ID NO: 45029 - protein, 167 aa, Sorghum bicolor
  Clone ID: SORBI-28MAY03-C3162_1.pep
MAGAEGERWVGLATDFSEGSRAALRWAAANLLRAGDHLLLLHVIKEPDYEQSEAILWESTGSPLIPLSEFSDPIIAKKYGAKPDIETLDILNTTATQKEIMVVVKVLWGDPREKLCQVIHDTPLSCLVIGSRGLGKLKRVLLGSVSDYVVNNATCPVTVVKSSSTEG

SEQ ID NO: 45030 - protein, 497 aa, Sorghum bicolor
  Clone ID: SORBI-28MAY03-C32224_1.pep
MGEEAAAAPTVAAAAATGTGGAPPHLLLICFPGQGHVNPMLRLAKRIAAKGLLVTFSSVSTVGAKLAASAGVSAGGDGVAVGRGRVRFEFLDDEDPGPDLDDLMRHLAREGPPAFAKLLARQAAERRPVACVVVNPFMPWAADVAADAGIPSAVLWVQSCAVFSLYYHHVHGLVEFPREDDPDARFTLPGLPEMSVADVPSFLLPPGPYKLLVDAIIAQFRAIGRASWVLVNSFTELERDVAAALPGVTPRPPELIPVGPLIELAGDGDGAVRGDLIKAADDCVEWLDAQPPRSVVYASVGSVVLLNAEEVGEMAHGLAATGRPFLWVVRPDTREHLPEGFLDAVAGRGTVVPWSPQDRVLAHPSTACFLTHCGWNSTLETIAAGVPVVAFPQWGDQCTDAKFLVEELRMGVRLRGSPLRRDAVREAVEAAVAGAEADAMLASARRWSAAAREAVAPGGSSDKHVQAFVDEVARRACGVQAAKVVPPPPPSSETPDS

SEQ ID NO: 45031 - protein, 585 aa, Sorghum bicolor
  unsure (1)..(585): unsure at all Xaa locations
  Clone ID: SORBI-28MAY03-C3315_1.pep
KCEMFEDAILVDWHQSLLDVDGIYHHFEWAIGTDEGKSDILNFENVGMNGQVHRKGLDLXDQFEDYFVTLRAWRLDGRCTEFCVKAHALKGQSCVHRRLIVGDGFVTITKGESIRSFFEHAEEAEEEDEDDVVDRDSNDPDGDIAHPQKHAKSPELAREFLLDAAAVIFKEQVEKAFREGTARQNAHSVFVSLALKLLEERVHVACKEIITLEKQTKLLEEEEKEKREEEERRERRRTKEREKKNRRKERLKGKDRDKEKTLVRSKKSDDLSPFSLCNQAAPNDNESQDVLDLRYSDIEEEDNVVVREHYPDSSADQSSSKDSDERSNEHECSATAEFVPSDCDGSFACDESKSSRNLRFRRDFPQDKDASYWYEDCRDDSGDTQWQSRERIRNNTRNYNAVFNANNRTRDRYNPCSCGHQEDYRYFSTATRSSRDTKMSRKTVAEKPRLQYRRCYPLDSFAVSNGGRVGGTPNKSPGPKQVWEPMDARKKIGNGNSATGPADGSDQVECSKDISECEKLEVVCETLAEICSEISAEACKSDTDQPCRQGEKNQSACSDGSKCVDKPTCCLTKDTGRTTNLTSSD

SEQ ID NO: 45032 - protein, 159 aa, Sorghum bicolor
  unsure (1)..(159): unsure at all Xaa locations
  Clone ID: SORBI-28MAY03-C184_1.pep
VFIKEAYQVYWSSCVKGIHTGQMVLKVARAADVYLAGTVMLIFGMGLYGLFISNACTRVPSASDRALSGSSLFGMFALKERPKWMKITSLDELKTKVGHVIVMILLVKMFERSKMVTIATGLDLLSYSICIFLSSASLYILHMLHKGDPEXEESAMPNL

SEQ ID NO: 45033 - protein, 335 aa, Sorghum bicolor
  Clone ID: SORBI-28MAY03-C195_1.pep
MAASPACAPVLVSGPTLPPQPVPFRCYRAQKPSSASSTSWRPRRRRFVPVAAASTRTSPAAARGLDADDFRHPLDKQNTLLLRAIPGLNDIGKALLGPVSEQVMVLQNIGTSVLVSPNQLPDLHQLLAEAATLLNTEAPDLYIRQNPVPNAYTLAINGKKPFIVVHTSLVELLTPKELQAGLAHELGHLKCDHGVWLTFANILTMGAYTVPGFGMVAGFLEEQLYRWLRAAELTCDRAALLVVQDPKVVISVLMKLAGGCPSLADQLNVDAFLEQARSYDKAASNPVGWYIRNAQTRELSHPLPVMRAREIDEWSRSQEYKTTMQKMLQLGLNRV

SEQ ID NO: 45034 - protein, 188 aa, Sorghum bicolor
  Clone ID: SORBI-28MAY03-C19581_1.pep
DSVFASFTDQDAAQRAIEDVQDREYKGRTLRCSLSQAKHRLFIGNVPKGLSEEELTNIIKGKGPGVVNIEMFKDQHDPNRNRGFLFVEYYNHACAEYARLKLSSRNFKVDGSQLTVSWAEPKGQTDPSSAAAQVKTIYVKNLPENVSKEKIKDLFDKHGEVTKIVLPPAKAGHKRDFGFVHFAFWHLC

SEQ ID NO: 45035 - protein, 266 aa, Sorghum bicolor
  Clone ID: SORBI-28MAY03-C20166_1.pep
MATLSSCSRLSSGTGAAAIHHRQPTRAGVVVVTSRRSSSASVRAAAAATAAPAAVEQQDKGVSLPTWAEFELGRAPVFWKTANGLPPSPGEGLTLFYNPAATKMAPNDVFGVAFSGGFNQPIMCGGEPRQMTLQVRGKADPPIYTIRIRVPQHAISLIFSFTNGAEWDGPYTLKFRVPKPWQNKPLSFFNEGLADELNMEGACDRAIYPDENIAITSCAMDGYLEEGGDRCKLDIVSGCMDPGSDMFDPLATVDDGSCPLESDSEE

SEQ ID NO: 45036 - protein, 300 aa, Sorghum bicolor
  Clone ID: SORBI-28MAY03-C2286_1.pep
LGSRLRRRRPGAPSWRPTPAPSCPSGGSPAWRTVPPRGPPRWRAPSPPGDASPGGVTHRFGRHGFPVALSWGVTRLLRATLGGCAPARAPGVPGGSGCPLFCSDREYIIGRRIWASGKTFYCVTKGVPRPSVPRHNKPRRVDLYYSSWCIRPVESRKGDGSMTACEVLLFHHEDLGIPWEIAKLGVRQGMWGCVKRIEPGLRAYQVARTAGEPISKCAAMAHVTTRFNADELITEENTEGSSSNNTEVEKPKHWTNNIPKVLMIGGAVALACTFDGGLLTKAVIFGTARRFAGPGGPGRR

SEQ ID NO: 45037 - protein, 155 aa, Sorghum bicolor
  Clone ID: SORBI-28MAY03-C23285_1.pep
MGKKRQLICLAAAVAAAAILLTASAKKSGDVTELQIGVKYKPESCTLQAHKGDKIKVHYRGALTDGSVFDSSYDRGDPFEFTLGNGQVIKGWDQGLLGMCVGEKRKLKIPAKMGYGERGSPPKIPGGATLIFDTELIAVNGKTSGGAKTESDSEL

SEQ ID NO: 45038 - protein, 233 aa, Sorghum bicolor
  Clone ID: SORBI-28MAY03-C2300_1.pep
MLSGDIPPNQTIYLNNLNEKVKKEELKRSLYALCSQYGRILDVVALKTQKLRGQAWVVFSEITAATNAFRGLQDFDFYGKKMRVQYAKTKSDCIAKEDGTYAPKEKRKKQEEKAAEKKRRAEEAQQAGPNASAAQSNGTGYQASRLGKVSQEPPAPPNNILFIQNLPDQTTSMMLQILFQQYPGFREVRMIEAKPGIAFVEFEDDSQSMVAMQALQGFKITPENPMAISYAKK

SEQ ID NO: 45039 - protein, 377 aa, Sorghum bicolor
  Clone ID: SORBI-28MAY03-C2365_1.pep
MGQDLVEIQPRELQFTFEVKKQSSCVVHLINKSNEYVAFKVKTTSPKRYCVRPNTGVILPRKTCEFIVTMQALRAAPPDMQLKDKFLVQTTVVPYGTSDEELVPAFFSKETGRYIEESKLRVVLVSAYQSLEEQPTNGIHDTEPAVGIPVQKEMPNIENQVPDVSIEVPAPLAQAPAIVTGIPSPVEETPGLTEIPVPLNEAPAVLAESPSAQKDPSAITVEHASTVTIEHAPAISIESPPSKQSVPVFKESPPLKQSVAVFKESPPLEETTPKEAVMLSDRGLFNVQNHQLSHVTEDVQNMKSKLNNLELKLEEAEKMIIRLREESRSTTQERDKLQQEMVFLRKKGTPRSQVGFPLLFVVYVALLGTSLGYLLRI

SEQ ID NO: 45040 - protein, 446 aa, Sorghum bicolor
  Clone ID: SORBI-28MAY03-C3915_1.pep
IAVLSPRGLSSPRARGRRRQRWQGGGGPEAAPGPCAQRAPAAGLFSASRGEVRGGRPGVAAGSTSEIMSSLCPFARATNGGGVCPVKSDKSNAGVCPAKSDKSISGVCPVTGKDHGSELKESSDHGEEKSTDPRVVPAKCPFGYDSNMFKLGPLSCIVCQALLHESSKCKPCAHKFCKACISRFKDCPLCGADIEGIEPDAELQTLVDRFIDGHARIKRSHAKGDVEAAGGKNKVIYEDVSMERGAFLVQQAMRAFRAQNIESAKSRLTVRADDIREELKSSEANLDLCSQLGAVLGMLGDCCRTLGDVPSAITYYEESAEFLSKPPAKDLELVHTLSVSLNKIGDLRYYDGDLQSARNYYARSLDVRRNAVKEHSAVASQVIDLATSLAKVADVDRNLGNESAAVEGFEEAIQCLEKLKLDSEQASLEQRRLSVLDFLHNQLADK

SEQ ID NO: 45041 - protein, 195 aa, Sorghum bicolor
  unsure (1)..(195): unsure at all Xaa locations
  Clone ID: SORBI-28MAY03-C2935_4.pep
NWVVIDTLRRHHAFCRQAXRHGSNPAASLSLPSDLTGTASSLPLPRQLINDGVVGLLLPWWIHATVARSTTWWWPRHRAGGLHGYVRVWYSADWLLTPGDQAXLNPSPPTPEPRCLASDLAATIWGRSLLDLNKVCCFPLPCAIGLVHDLWYIKFGATILCDLSCLVSPTMQISLKLQSIRFSNCWSMVMSLPLI

SEQ ID NO: 45042 - protein, 338 aa, Sorghum bicolor
  unsure (1)..(338): unsure at all Xaa locations
  Clone ID: SORBI-28MAY03-C2935_2.pep
AGRAAIACEKKKKKKIIPTPLLLPPRVASCERGASLPVASGVLLSQSRVASAVPGAARHPADTQPLLHGALHVEVGRHRHAASSPRVLPTNGAPWLESGGLPPSPLRSRRVLDNLKDYVVXAVVNAVDHLGTVAYKLTDLFEQQASEVSTYELKVARLNQQXLVTCQVYTDKEGIRQXQMMAANIKHHKHYILPSQYEXRSPAPARLSADSAAHFKPCHYPLIKTLSWHLSSENSTNANTQIPTFALLGSAPSTPASGKERSASPMRRPLQFNRSTSSDAMQKVGTKNQSGVKEFSTFHSFDNPKGRAIQKAPVGTKSMLAALFIKHKSSKMKKIAVR

SEQ ID NO: 45043 - protein, 141 aa, Sorghum bicolor
  Clone ID: SORBI-28MAY03-C2935_1.pep
MPAAAYGVASLPVASAVPGAERPPIDTQPLLHGALHVELGRHRHAASSPCILPTSGAPWLESGGLPQSSLRSHRVLDNLKDYAVRAVVNAVDHLGTVAYKLTDLFEQHGQIDNMVVATASSERAARVCSCVVLSRLAADSR

SEQ ID NO: 45044 - protein, 117 aa, Sorghum bicolor
  unsure (1)..(117): unsure at all Xaa locations
  Clone ID: LIB5048-001-R1-XP1-D10.pep
IRQRVNLPTNGAPWLESGGLPPSPLRSRRSGVGAVSRGIVPSPAAQKRDRTPIFIDFVSGKSYLLLLLLLVLDNLKDYVVXAVVNAVDHLGTVGYQLTDLFEQQASKVSNYELKVGR

SEQ ID NO: 45045 - protein, 153 aa, Sorghum bicolor
  Clone ID: SORBI-28MAY03-C3966_1.pep
MGISSMPEPRDSLLWYLVVNTVISITALAGLVRKALVFLDLQDDDAGDRLVASAPGLGLADRFLRAFRPALYGVLVSTSTTCSAAEADGDDCSVCLSGFVAKAVVNRLPCGHLFHRACLETWLRYERATCPLCRANVPLPPEETPVLRYPELE

SEQ ID NO: 45046 - protein, 334 aa, Sorghum bicolor
  Clone ID: SORBI-28MAY03-C2710_1.pep
LSAARGPSAVISQQPPPSHASALAPPTLPCRLSDLQGFRGWEGPAGAAPVVDAEYLRQVDRARRHLRALISNKGCAPIMLRLAWHDAGTYDVKTKTGGANGSIRYEEEYTHGSNAGLKIAIDLLEPIKAKNPKITYADLYQLAGVVAVEVTGGPTVEFIPGRRDQAVGPREGRLPDAKKGAPHLRDIFYRMGLSDKDIVALSGGHTLGRAHPDRSGFEGAWTKEPLKFDNSYFLELLIEESEGLLKLPTDKALLSDPEFRRYVDLYAKDEDAFFKDYAESHKKLSELGFTPRSTASAKSDLPTGAVLAQSAFGVAVAAAVVIAGYLYEASKKAK

SEQ ID NO: 45047 - protein, 136 aa, Sorghum bicolor
  Clone ID: SORBI-28MAY03-C18675_1.pep
MSGEEEENAAELKIGEEFLKAKCLMNCEVAIILEHKYEQIQQHSSESDPSSQVSQVFEKSLQYVKRFSRYKNPDAVRQVRETLSRYGLAEFELCTLGNLCPDTVPSLKSGGRFVGDARDEKIEKMLNDLSLIKKFE

SEQ ID NO: 45048 - protein, 143 aa, Sorghum bicolor
  Clone ID: LIB5050-010-R1-XP1-D3.pep
MSGEEEENAAELKIGEEFLKAKCLMNCEVAIILEHKYEQIQQHSSESDPSSQVSQVFEKSLQYVKRFSRYKNPDAVRQVRETLSRYGLAEFELCTLGNLCPDTSGEATALVPSLKSGGRFVGDARDEKIEKMLNDLSLIKKFE

SEQ ID NO: 45049 - protein, 143 aa, Sorghum bicolor; identical to SEQ ID NO: 45048
  Clone ID: LIB5050-012-R1-XP1-B8.pep

SEQ ID NO: 45050 - protein, 99 aa, Sorghum bicolor
  Clone ID: SORBI-28MAY03-C28638_1.pep
LKFESAARGLHVFGVYWWYRNDDLLRPLFMLPPKDIPPFWHAIFVIMVNDTTVRQAAMAVKCMLLLYYKNCRGRNYRRQVLAAGDMCAICQEKMHVPVL

SEQ ID NO: 45051 - protein, 226 aa, Sorghum bicolor
  Clone ID: SORBI-28MAY03-C2879_1.pep
MATPAVKVYGWAISPFVSRALLALEEAGVDYELVPMSLQAGDHLRPEHLARNPFGKVPVLQDGDDLTIFESRAIARHVLRKHKPELLGTGSLEQAATVDMWLEVEAHQLSPLAIAILVECIFAPYLGRERNQAAVDENVEKLKKVLEVYEARLSESKYLAGDFLSLADLSHFTVMHYVMATEYAAVVQALPHVNAWWESLAARPAAKKVAEFMPVDVPGSPKKLQE

SEQ ID NO: 45052 - protein, 182 aa, Sorghum bicolor
  Clone ID: SORBI-28MAY03-C2853_1.pep
MASPLLKPHSHVAAAAALHSARRSADRHGRCPATVHLAGRFHDHGRSRSGRSKRSGSAKVSALPSLEVVPLMVTMVEHVDMSRDYVVTKSIWHLSDAALKSVYTFYAMFTVWGVCFFASMKDPFYDSDTYRSAGGDGTVHWYYDRQEDLEASAREELLREELLEEIEQRVGGLRELEEVVTK

SEQ ID NO: 45053 - protein, 166 aa, Sorghum bicolor
  Clone ID: SORBI-28MAY03-C28833_1.pep
MSSSHRVKWNEDNLYEIESNKPVRQKITEPKTPYHPMIDDDGSLSPTRPFDKCLDETVQAEAILTALNGVASSSNSNSKDDGWGSSDDDTDAIEQDDDPEADTTRLSFKEHRRAHYDEYRKVKELMSTGSLTVEEADEDNRAATSSEYKGVGKRAANDDMKSSPQT

SEQ ID NO: 45054 - protein, 268 aa, Sorghum bicolor
  Clone ID: SORBI-28MAY03-C29644_1.pep
MSQGQPRRPQQGEDLQQHAQEQPVKYSDVLDVSGELAQRRVAPRDAALLQAAEQSVLGGTQRGGPAAVLQSAATVNARAGHVGRAQITGPVADAGATVVEAELGGRRVVTESVGGQVVSKMVTPPHVAMTDPPGALDKDAVTIGRALEAVVAMAGDRPVDQSDAAAIQVAETCATGSHATIPGGVAAAAQSAADQNARAVRDEDKVKLRNVLSNARERLPADKGATREDAERVVSAEIRNKLDMTTTPGGVADAVTTAARLNQERPRP

SEQ ID NO: 45055 - protein, 201 aa, Sorghum bicolor
  Clone ID: SORBI-28MAY03-C45208_1.pep
MCWTCFPSMEAVPRRTVLGACAVAVLMAIAVANAGSAEAASVVGLAKCADCTRKNVNAEAAFNGLKVAIKCKNSKGEYESKAVGELQSTGAFSVPVSVNLAGCVAQLHNAAGTPCPGQEPSRITPLSDGTFVAIPAGNTQQASSAVCASVTICGPVMKYFHEHFHKKDKKPEPSKPEPEPEPKPQPEHQPPTATYGSATPS

SEQ ID NO: 45056 - protein, 90 aa, Sorghum bicolor
  unsure (1)..(90): unsure at all Xaa locations
  Clone ID: SORBI-28MAY03-C4610_1.pep
LKRVRAYLILVEWAIWHSNHNVIPSQVEVEAYLAQTTEDGQDPKTLVEAIAHVLPKSTFLLNVGMESKXMKKDAKTAAMNKRVQELMFWM

SEQ ID NO: 45057 - protein, 263 aa, Sorghum bicolor
  Clone ID: SORBI-28MAY03-C46709_1.pep
MDLNQFVPSQNSALTMDSAESTAAAAARAPNGAARAVDDYDDDDDAVPEVAACISAMLDLGGSVESKRLFLARRTALEMLRDRGYAVPEDELARTLPEFRAWWEDKPELERLAFSTTLASDPSSKVKVVFCPPEPVKIAAIRVVYTGVKDENLSRLILILQGRIMSKAREAIKEIFPYKVDTFQITELLVNITKHALKPKHQVLTAEEKAKLLKEYNVVDSQLPRMLENDAVARYYGLGKGTVVKVIYDSELTGNHVTYRCIF

SEQ ID NO: 45058 - protein, 313 aa, Sorghum bicolor
  Clone ID: SORBI-28MAY03-C32377_1.pep
MAATAKYNRSNPAVKRILQEVKEMQSNPSPDFMALPLEEDIFEWQFAILGPRDSEFEGGIYHGRIQLPSDYPFKPPSFMLLTPSGRFEIQKKICLSISNYHPEHWQPSWSVRTALVALIAFMPTNPGGALGSLDYKKEDRRALAIKSREAPPKFGSSERQKLIDEIHEQMLSKAPPVPQALPNVPNEESNQLPTPNASGEHADKVDEGDNTSGSMSGSLSGLPVPESESGVAENTGEASAVEVANHHVPEASHRENIPTVPSSLQNPAVAIQKPKHDRLLTLAAFGLTLAIMALVIKKFLKINGLGGFIEGKF

SEQ ID NO: 45059 - protein, 316 aa, Sorghum bicolor
  Clone ID: SORBI-28MAY03-C3543_1.pep
MAASCASTLPSLSFVSSSSSSSRRFRRSGVVAMASVGQKVYAPGVAVSEGNGGLQKIDLKSPHGSEAEIYLFGACVTSFKVPNGKDLLFVRPDAVFNGQKPISGGIPHCFPQFGPGPMQQHGFARNVNWSITDSEVTEGDPAVTLELKDDSYSRSMWDFSFHALYKVSLHSTSLSTTLEIINTDVKPFSFNSALHTYFSASIAGVSVKGLKGCKTLNKDPDPKNPLESKEEREEVTFPGFVDCIYLGAPSELILDNGLGDKIAIANSNWSDAVLWNPHLQMEACYKDFVCVENAKIEMVQLEPKQSWVAEQKIELV

SEQ ID NO: 45060 - protein, 157 aa, Sorghum bicolor
  Clone ID: SORBI-28MAY03-C36204_1.pep
MAHQTAALAARAARASPVGRCRPQIVTMTAPAVGGSVTHCGWNSTLEAAGAAVPMVTCPPYADHFYNEKLVVELLKVGVGVGSTDYASKLETRRVIDGMANAVAIVMVIGEGAVAMRVRAKELALRAKPALAGAGAASAYDGRVRVVLVALTSSIYV

SEQ ID NO: 45061 - protein, 120 aa, Sorghum bicolor
  Clone ID: SORBI-28MAY03-C36289_1.pep
RPPPPGAPPNKAGAAKDAAAEKAEAAAKKAQESKEAAKGKATEKAASAKDAAWETVETAKEKASEGYERVKEKARETADTAKERLEEVKERVAGPSADADAGKGKHRRADADKYRSEDEL

SEQ ID NO: 45062 - protein, 466 aa, Sorghum bicolor
  unsure (1)..(466): unsure at all Xaa locations
  Clone ID: SORBI-28MAY03-C382_1.pep
MASLASASTSLLFPQATSSRSRVRLSTSLGFSAQPARLRSRAAAAGGQRRGRLLVVRAARGKFERTKPHVNIGTIGHVDHGKTTLTAALTMVLASVGGSAPKKYDEIDAAPEERARGITINTATVEYETETRHYAHVDCPGHADYVKNMITGAAQMDGAILVVSGADGPMPQTKEHILLAKQVGVPKIVVFLNKKDMVDDEELLELVELEVRELLSNYEYDGDDVPIIAGSALKALEALMANPALKRGDNEWVDYIFNLVDEVDNYIPVPQRQTDLPFLLAVEDVFSITGRGTVATGRIERGTVKVGDTVDIVGIRDTRTCTVTGVEMFQKTMDDAMAGDNVGLLLRGMQKDDIERGMVLAKPGSITPHTKFEAVVYVLKKEEGGRHSPFFPGYRPQFYMRTTDVTXSVTTIMNDKDEEAKMCMPGDRIKMIVQLIQPVACEQGMRFAIREGWKNVGAGVINKIIE

SEQ ID NO: 45063 - protein, 237 aa, Sorghum bicolor
  Clone ID: SORBI-28MAY03-C38328_1.pep
MAAAVVDDAGMDAVQKRLMFEDECILVDEKDNVVGHESKYNCHLMEKIESENLLHRAFSVFLFNSKYELLLQQRSATKVTFPLVWTNTCCSHPLYRESELIQEDYLGVRNAAQRKLLDELGIPAEDAPVDQFTPLGRMLYKAPSDGKWGEHELDYLLFIVRDVKVQPNPDEVADIKYVNREELKELIRKADAGEDGVKISPWFRLVVDNFLMGWWDHVEKGTLGEAVDMETIHKLKE

SEQ ID NO: 45064 - protein, 140 aa, Sorghum bicolor
  Clone ID: SORBI-28MAY03-C38376_1.pep
MTTLQFLRGQLWSSMVSSNGQEVEVWPRITWSPRWGLNFKSVKEKVHDNSSVSQRSALVINGQNVFLEGLSLDGTLIVNAIDEAEVKLTSHVQNKGWIIQHVDYKDTSEKEEIRIRGFKLEKIEQLEVNYTEPGKHSLSA

SEQ ID NO: 45065 - protein, 408 aa, Sorghum bicolor
  Clone ID: SORBI-28MAY03-C5814_1.pep
TRNILRPQDRELDLLIVILPDRHGALYGDLKRICETDLGLVSQCCLTKHVFKANKQQYLANVALKINVKVGGRNTVLVDALTRRIPLVSDVPTIIFGADVTHPHPGEDSSPSIAAVVASQDWPEVTKYAGLVSAQTHRQELIQDLFKVYQDPQRGSVSGGMVRELLISFWRSTKQKPKRIIFYRDGVSEGRCFPLVSDRPTIIFGADVTHPHPGEDSSPSIAVHVASQDWPEVTKYAGLVSAQAHRQELTGTVVDSKIGHPTEFDFYLCSHAGIQGTSRPAHYHVLWDENKFTADGLQTLTNNLCYTYARCTRSVSIVPPAYYAHLAAFRARFYMEPDAADSGSMASGATTSRAPGGARNTRAGPGFAALRPLPAPWVAMPAFREQAALLITMSCGMRTSLQLMSCRL

SEQ ID NO: 45066 - protein, 106 aa, Sorghum bicolor
  unsure (1)..(106): unsure at all Xaa locations
  Clone ID: LIB3476-011-P1-K1-B5.pep
GRVGAAVEARVLPPPRLKYHDSGREKDVLPRVGQWNMMNKKMVNGGRVSNWACINFSRNVQDSAARGFCHELAVMCQISXNGFALEPVLAPVTARPDMLKGVKGRI

SEQ ID NO: 45067 - protein, 368 aa, Sorghum bicolor
  Clone ID: SORBI-28MAY03-C59634_1.pep
MGSATMPRSFATPRAPCRSLHTLRCRCKATGGADRRDVLLGLGGAAAAGLLSSSLSSRGGALAAPIPAPNLRNCHPPDLPDTVSDINCCPPGAGTAIVDFTPPPTVGLRVRPAAHLVDEEYLAKYEKAVALMKELPDDDPRSFTQQWRVHCAYCDGAFDQVGFPDLEIQIHNCWLFFPWHRLYLYFHERILGKLIGDDKFALPFWNWDAPGGMSLPAIYANKSSPLYDERRDPAHQPPFTVDLDYDRIEQNIPRAQQIDQNLMIMYRQMISGAKKKELFFGLPYHQGDQPDPGAGTVESVPHGPVHFWSGDPSQPNNEDMGNFYSAARDPLFFAHHGNIDRLWSVWNGLRAGNTNFTDPDWLNASFLF

SEQ ID NO: 45068 - protein, 301 aa, Sorghum bicolor
  Clone ID: SORBI-28MAY03-C5900_1.pep
MASSQANLDKMQLRQSYRNVWHTDMTNAIQADFPYCCLALWCGPCVSYMLRKRALYNDMSRYVCCAGYMPCSGKCGESRCPEFCLATEVCLCFGNSVASTRFLLPDEFDILTSPCVICIIGFMFCLQQVACIFSIVAAIVGSEELSEASQILNCLSDLVYWTVCACMQTQHKVEMDKRDGKFGPPQPMAVPPVQQMSRIDQPMPPPAGYAPQPAYGQPYGGYPPPAGQGYPPAGYPQGGGYPPAQGYPQGGGYPPPAQGYPQGGAYPPPGSYPPQGSYPPAQGSYPPAQGSYPPAQSYPGK

SEQ ID NO: 45069 - protein, 215 aa, Sorghum bicolor
  Clone ID: SORBI-28MAY03-C402_1.pep
MATAPATSSVATNSPCLRLPSMPLRRAPGAISFPSRPWPATLTSCTGLSRRSDVVAAAGHQKLMGSLTNNEGLRFGVVVARFNEVVTNLLLQGALETFERYSVKAENITVVSVPGSFEVPITAQKLGKSGKFDAILCIGAVIRGDTTHYDAVANSAASGVLNAGLSAGVPCVFGVLTCEDMDQALNRAGGKAGNKGAETALTAIEMASLFRHHLG

SEQ ID NO: 45070 - protein, 148 aa, Sorghum bicolor
  Clone ID: SORBI-28MAY03-C4156_1.pep
MASKRILKELKDLQKDPPTSCSAGPAGEDMFHWQATIMGPPDSPYAGGVFLVNIHFPPDYPFKPPKVSFKTKVFHPNINSNGSICLDILKEQWSPALTISKVLLSICSLLTDPNPDDPLVPEIAHMYKTDRPKYESTARSWTQKYAMG

SEQ ID NO: 45071 - protein, 195 aa, Sorghum bicolor
  Clone ID: SORBI-28MAY03-C41703_1.pep
MAKHSAAMCSLLVLVLLCLGSQLVQSQVLFQGFNWESCKKQGGWYNYLRGQVDDIAATGATHVWLPPPSHSVAPQGYMPGRLYDLDASKYGTHAELKSLIAAFHAKGVQCVADVVINHRCADYKDSRGIYCIFEGGTPDSRLDWGPDMICSDDTQYSNGRGHRDTGADFGAAPDIDHLNPRVQEELSGWLNWLKS

SEQ ID NO: 45072 - protein, 281 aa, Sorghum bicolor
  Clone ID: SORBI-28MAY03-C4180_1.pep
MLPPAARLAARRLLGLASASASEAAGRRLASSPIAAAGYSAAASRGSVSSTRPFSTALNYHLDSPENKPDMKWEFSEANMKKVNEILSHYPSNYKQSGIIPLLDLAQQQHGGWVPVAAMDAIAKIVEVAPIRVYEVATFYTMFNRTKVGKYHLLVCGTTPCMIRGSREIEDTLLEHLGVKRNEVTSDGLFSVGEMECMGCCVNAPMIAVADYSKGSEGYTYNYYEDLTPKRVVEIVEMLRRGETPPRGTQHPERKNCGPAGGNTTLLGEPKPPPCRDLDAC

SEQ ID NO: 45073 - protein, 345 aa, Sorghum bicolor
  Clone ID: SORBI-28MAY03-C4248_1.pep
EVSWSPVGSLLAAAAPAACIALLQPSALCPFDGLTPADRQELAILSNTTHAAGPCSKKLRMAATSPDDVRLLGLLRRASMDDDNTIIMTFTNKAWTAPGSLMDLFLESFRVGVRTEPLLKHLVIVAVDGKAYARCTQVHPFCYHLRARGAGVDDYASEQSFMSKSYLDLMWRRNRFQARVLQLGYSFVFTDMDILWLRNPLLRVPVGADLAMSADYFYGDNPYDLNKTANGGFVYAKASARTAAFYDGWYEARREHPGKNEQDVFDQAKHALAARHGVRVQFVDTAYLSGFCELRKDFHVVCTVHGNCLFGLKDKLQKLTQVLDEWKQFRADAARMGSNTTALTD

SEQ ID NO: 45074 - protein, 221 aa, Sorghum bicolor
  Clone ID: SORBI-28MAY03-C4274_1.pep
MAGVGSALRRLYLSVYNWVVFFGWAQVLYYAVLTLRESGHKAVYAAVEKPLQFAQTAAIMEILHGLVGLVRSPVSATLPQIGSRLFLTWGVLWSFPETQSHLLVTTLVISWSITEIIRYSFFGMKEAFGFAPSWLLWLRYSTFMLLYPTGISSEVGLIYIALPYMKASEKYCLRMPNKWNFSYDYFYSSILALLIYVPGSPHMYRYMLSQRKKALSKAKAA

SEQ ID NO: 45075 - protein, 207 aa, Sorghum bicolor
  unsure (1)..(207): unsure at all Xaa locations
  Clone ID: SORBI-28MAY03-C43591_1.pep
SSFLSRRKEGTKKNPLHRRRRGDDDEAAAADRRPPPPPRRRRARVRAHWLPRGRRQRDGGDDVQGGGGQRRARGLRLLRGGAGHAPREPRRRRLGPRQGGRADGRQQRRQRRVRHQGPAAARRRRRRQXAGRRRRTARRARRWRSAGGCTTPSGSRSPRRTTRSTTAATPPGRARSRRRCPSRASATTPSPRPPPSRRRWRSTARTT

SEQ ID NO: 45076 - protein, 529 aa, Sorghum bicolor
  Clone ID: SORBI-28MAY03-C44387_1.pep
MASTAYSRPSKPPGPAAGERKGPRLAKELGRIEPKKLGIGLVAGCCLALLTYLSFARLFAIYSPVFDSSSLLLKNTPPATTTVPATEALPVQQKTQVEDQKDAPDPELDPNMPNLPEVTQKDQQEEATATKPAGAVTEAKITCDENGVDQGFPYARPPVCELAGDIRISPKEKAMYLVNPSGAGPFDSNGEKKIRPFARNDGFLLPGVVEVTIKSVSSAAAAPQCTRRHDVPVVVFSVAGYTDNFFHDNTDVLIPLFLTTAHLKGEVQFLITNFKPARGNKFTPLLKKLSNYDVINFDEDKEVHCFRAGHLGMYRDRDLIISPHPTRNPHNCSRVDYNRFLRRAFSLPRDAPAVLGAETSAKPKMLIIERKGTRKLLNLREVAAMCEALGFAVTVAEAGADVRGFAERVNAADVLLAVHGAGLTNQIFLPTGAVLVQIVPWGKMDWMATNFYGQPARDMRLRYVEYYVSEEETTLKDKYPRDHYVFKDPMRIHAQGWPAIAEIIMKQDVMVNMTRFKPFLLKALDELQE

SEQ ID NO: 45077 - protein, 163 aa, Sorghum bicolor
  Clone ID: SORBI-28MAY03-C67034_1.pep
MEAAEDVVIVGAGLAGLAAALGLHRKGVRSLVLESSPSLRASGFALTIWNNAFRALDVLGVGDKIRKQHLQLQKLRVMPSATGEIAQEVDLTQQGKQRGPNEIRCVRRDLLLQALEEELPRGTIRYSSRIVSIQDDGGVKVLQLADGSVIGPHAPVGCDGINS

SEQ ID NO: 45078 - protein, 185 aa, Sorghum bicolor
  Clone ID: SORBI-28MAY03-C67167_1.pep
MAPPANAQEQPQPQVQLVGGRKVVDEVSGWLRVLDDGSVDRTWTGPPEALPLMEPVAPYAVPRDGHTLHDLPGEPNLRVYLPEAKGETAGARLPVILQLHGGGFCISHPSWLMYHHFYARLACAVPAVVVAVELPLAPERRLPAHIDTGVAALRRLRSIALSAEDGALDDPAAAALLREAADVSR

SEQ ID NO: 45079 - protein, 192 aa, Sorghum bicolor
  Clone ID: SORBI-28MAY03-C67641_1.pep
MMSSRAGSILLRHAGSRLFTAAAVSPAAASRPLLAGGSNNGVQAVMLRLMSTSSPAAASEAKDEAAKASKEGGDKKAVVINSYWGIEQNNKLVRDDGTEWKWTCFRPWETYTADTSIDLTRHHEPKTLMDKIAYWTVKSLRFPTDIFFQRRYGCRAMMLETVAAVPGMVGGMLLHLRSLRRFEQSGGWIRAL

SEQ ID NO: 45080 - protein, 193 aa, Sorghum bicolor
  unsure (1)..(193): unsure at all Xaa locations
  Clone ID: SORBI-28MAY03-C4849_1.pep
MSSDDEVREEKELDLSSNDVVTKYKAAAEILNNALKLVVSECKPKAKIVDLCEKGDSFIREQTGNVYKNAKRKIERGIAFPTCVSVNNTVCHFSPLATDDAVLEENDMVKIDMGCHIDGFIAVVAHTHVITSGPVTGRAADVLAAANTAAEVAVRLVRPXKKNKDVTEAIQKVAAAYDCKIVEGVLSHQLKQF

SEQ ID NO: 45081 - protein, 324 aa, Sorghum bicolor
  Clone ID: SORBI-28MAY03-C447_1.pep
MAPKRSAPPPPPVASSEETASGSGSEEEEEEDEEEIAHSPPPAAHKSIAPPPQKDQESEASDEDEDGEEEEEEEEEEEEDEKANRVIPSSATKNPPPPPPAREESETSDEEEEEEADDEMPQTKLAPTQEMEAKGAKRPSALFQRTWSTDDEFRILEVLAAHRLEHGRLPKIDVLANALAGKLDNSGCSLPELQRKVKSLQSRNIKAVKKGVLPSKDEDRRLFDLFKNVWPVTKVAPTKVAPTSGAGREPDEMCELYPYLAEEVKALQKAHPGMFKREFAMIDDSKARALDEKIKRQRHAQMRLHLRRLDLTKEVTKTLMDLAE

SEQ ID NO: 45082 - protein, 126 aa, Sorghum bicolor
  Clone ID: LIB3476-002-Q6-K2-A2.pep
VLEEVEETVVVTLARRRALLDRFGVPGLQAPHLTLELGEAAATVVELTGESVGQHVCLRQRAVLQAVRGEDLQDAELVVSRRRRRRVLGGGRRDHVVGLLVLFLFLFFFFFVLLLLAIFILIGPFG

SEQ ID NO: 45083 - protein, 178 aa, Sorghum bicolor
  Clone ID: SORBI-28MAY03-C5403_1.pep
MAAPAPHQGQGQQGDHHQPKLQKVMVAVDESECSGHALEWVLRNLAPTLAPPLLVLTVQPHFPLGYVSAAAFGAPLGTVPPVAPELIKSMQEQQRQLTQALLDKVVAICAEHGVAVETIVEVGDAKEMICEAAEMKNVDLLVLGSHSRGPIQRLFLGSVSNYCVHHSKRPVLVVKNQG

SEQ ID NO: 45084 - protein, 229 aa, Sorghum bicolor
  Clone ID: SORBI-28MAY03-C4823_1.pep
AYVYDMRNKLYDKYSDFVTPEEKEGLIAKLQEVEDWLYEDGEDETKGVYISKLEELKKIGDPIEARYKEWTERGSAVDQLVYCINSFREAALSNDQKFDHIDVSEKQKVINECSEAENWLREKKQQQDALPKHANPVLLVSDLKKKAETLDRFCKPIMTKPKPAPKPQTPPPQTPPPQPETQAPEPQTPEQQQSGSGAAGEPGSEGGVQQASGEQMDMDKPDESAGAAA

SEQ ID NO: 45085 - protein, 103 aa, Sorghum bicolor
  Clone ID: SORBI-28MAY03-C550_1.pep
MSLLAVASSTRAAAVRPLCASAASAGVAVRTGETATRTDAQPRLLIPVVLVMMYNRWNGILVPDYGFMQLQLIPMLVGFFTYKIATFAQAIQDSIPAVGNREG

SEQ ID NO: 45086 - protein, 214 aa, Sorghum bicolor
  unsure (1)..(214): unsure at all Xaa locations
  Clone ID: SORBI-28MAY03-C459_2.pep
AAASRDQLTKLVKFAKDNGSIIVYDSAYAMYISDDSPKSIFEIPGAKEVALETASFSKYAGFTGVRLGWTVVPKELLFSDGHPVAKDFNRIVCTCFNGASNISQAGGLACLSPEGLKAMHDVXGFYKENTEIIVDTFTSLGFNVYGAKNAPYVWVHFPGRNSWDVFAEILEKANVVTTPGSGFGPGGEGFVRVSAFGHRDNIIEAARRLKQLYK

SEQ ID NO: 45087 - protein, 322 aa, Sorghum bicolor
  Clone ID: SORBI-28MAY03-C459_1.pep
PLGSFAKPPFLSSHPLLPSLHRPTDRTDPGSSRPVASLLPIPTAMAAAAASSSSEGPVAVSTCVSLGEAAAAPGGGDRAAADCGVCAICLDRIALQETALVKGCDHAYCVTCILRWASYKQNPLCPQCKHPFEFLSVHRSLDGCLHDYLFEESVCLLLRAAWFEPLIVEAHEEPLEDEEFFDQQYQYDDDEDDLDEESYYMSRSSSIPIGTRRWGDNGYIRGGSKEAGPVNTDASAGPSRTPKKKKEKTASSSSASVSVSGSGSGSGSVSKDVAGRRAKRAQKREAADRAAAEKHLKHLQRLGLRKAPEPEVPAEVGPLVNE

SEQ ID NO: 45088 - protein, 141 aa, Sorghum bicolor
  Clone ID: SORBI-28MAY03-C5589_1.pep
MARSSKMMMAAAALLALALAVATTAEARNIKTTTTAAAAEKKADNDAVVQPQTFPPFDRLGGGASPAFGGLPGTGSSIPGSSIPGFSLPGSSGGSSMPGFLPGSGSIGSMPLFGGGSPFSGFGGMPGSPTAGSVPEHANKP

SEQ ID NO: 45089 - protein, 314 aa, Sorghum bicolor
  Clone ID: SORBI-28MAY03-C5887_1.pep
MATLKVPATVPPVADDCEQLRKAFQGWGTNEALIVSILGHRDAAQRRAIRRAYAEAHGEELLRSITDEISGDFERAVILWTLDPAERDAVLANEAARKWQPGNRVLVEIACTRTSAQVFAARQAYHERFKRSLEEDIAAHVTGDFRKLLVPLVSTYRYDGPEVNTRLAHSEAKLLHEKIHHKAYSDDEIIRILTTRSKPQLLATFNHYNDAFGHRINKDLKADPKDEYLKTLRAIIRCFSCPDRYFEKVARQAIAGLGTDENALTRVITTRAEVDLKLIKEAYQKRNSVPLERAVAGDTSGDYESMLLALLGQE

SEQ ID NO: 45090 - protein, 367 aa, Sorghum bicolor
  Clone ID: SORBI-28MAY03-C9535_1.pep
MGSAARCFARLVDSWSPLASIERFDIENDQSGSGSAMGGDGALGDKRRSGSIGLYDSSNDSANQTLGKRPRFQTDSDNPQVEPWEEEDFRRSPDSTYRRGSTYSVRERLLGSKGTAERSLYAKLDRAENASRRYGMGSGMGGFAGLGDRRGAGSSMGRFPGFNDRSGSGSAMGGFGALSDKSSSGFIGLYDSSNDSINQTLGNVARFQTDDDSSEDDQWEEDDFDFRPDVTYRRGSTYSVRDLDLTRPAAAKNPPRPQFETTTAEVLRKADFRNVRFLSHFLTEAGIIIKRSQTRISAKAQRKIAREIKTARAFGLMPFTTMGRRPFIFGRSAEEHYSEEEYFGFGRQRDSEPVEDNGDEEPNVEAA

SEQ ID NO: 45091 - protein, 267 aa, Sorghum bicolor
  unsure (1)..(267): unsure at all Xaa locations
  Clone ID: SORBI-28MAY03-C9670_1.pep
MEGRMTSLEAAMKASSSMASSMARNADPDHQTLRSNSVEQFYFPRPGQSLPGIPPFFGPPSSSLYPPNDNEAKFGSQFESNPSQNTDWDPQAIVSNLTFLEQKIKQVKDIVQSMNNRENQVAGGSSELAAKQQLITADLTSIIIQLISTAGSLLPSMKNPLLSSNPAVRQLGNTLGSPMGFGMNANQRPSVDSKTDIPDTGKTSDYDELMNSLNTAQDERDELIKCPNLCGGEGSEPTPMEDHDVKESDDGGEXENLPPGSYVVLPL

SEQ ID NO: 45092 - protein, 587 aa, Sorghum bicolor
  Clone ID: SORBI-28MAY03-C9699_1.pep
MAGAERAEAVALEEGLLAPEESNQVVYTGDGSVDFSGNPVVKETTGRWKACPFILGNECCERLAYYGISTNLVTYLTKKLHAGNASAASNVTTWQGTCYLTPLIGAILADAYWGRYWTIATFSTVYFIGMSILTLSASVPMLMPPSCEGSFCPQASPFQYTVFFLGLYLIALGTGGIKPCVSSFGADQFDDTDPAERIQKGSFFNWFYFSINIGALISSSFLVWVQDNVGWGLGFGIPTVFMGLAIISFFSGTSLYRFQKPGGSPITRVCQVIVASLRKWNVPAPEDSSLLYELPNGVSTIEGSRQIEHTDELRCLDKAATVTEVDVKMADFSNPWRICTVTQVEELKILVRMFPVWATTIVFSAVYAQMSTMFVEQGMVLDPSLGSFKIPPASLSTFDTLSVIVCVPMYDYIVVPIARRFTGNERGFTELQRMGIGLVISILAMSVAAILEIKRLAVAREAHLVDQNVPVPLSIFWQIPQYFLIGLAEIFTFIGALEFFYDQSPDAMRSLCSALNLLTTAGGNYLSTFILTMVAYFTTRGGNPGWIPDNLNEGHLDYFFWLLAGLSFLNLIVYVICAGKYKGKKAA

SEQ ID NO: 45093 - protein, 425 aa, Sorghum bicolor
  Clone ID: SORBI-28MAY03-C9612_1.pep
MAAEAEQGFRPLDEASLLAYIKATPALSSRLGGGGSLDSIEIKEVGDGNLNFVYIVQSEAGAMVVKQALPYVRCVGDSWPMTRERAYFEASTLREHGRLCPEHTPEVYHFDRAMSLMGMRYIEPPHIILRKGLIAGVEYPLLADHMSDYMAKTLFFTSLLYNNTTDHKNGVAKYSANVEMCRLTEQVVFSDPYRVSKFNRWTSPYLDKDAEAVRQDDELKLEVAGLKSMFIERAQALIHGDLHTGSIMVTTGSTQVIDPEFGFYGPMGFDIGAFLGNLILAYYAQNGHADQANDRKAYKKWILKTIEESWNLFQKKFVELWNKHKEGNGEAYLPDIYNNSKLVSVAQKKYMTNLFHDSLGFGSAKMIRRIVGIAHVEDLESIKDASKRAECERAALSCAKEILKGRRQFETIEQVIEHIQSFDQD

SEQ ID NO: 45094 - protein, 155 aa, Sorghum bicolor
  Clone ID: SORBI-28MAY03-C5999_1.pep
MADELRSTSVVQKVHGQSVLLSRISSYSAMNNPVFNNAYSAYNVPQRSYYGMNATVGLSSVMAPSPVFASAPKEKGFSGFMIDFMMGGVSAAVSKTAAAPIERVKLLIQNQDEMLKTGRLSEPYKGIGDCFGRTIRDEGFVSLWRGNTANVIRYF

SEQ ID NO: 45095 - protein, 160 aa, Sorghum bicolor
  Clone ID: SORBI-28MAY03-C649_1.pep
MSGGIARGRLAEERKAWRKNHPHGFVARPETLADGSANLMVWNCTIPGKQGTDWESGYYPLTLHFSEDYPSKPPKCKFPQGFFHPNVYPSGTVCLSILNEDSGWRPAITVKQILVGIQDLLDQPNPADPAQTDGYHLFIQDPAEYKRRVRLQAKQYPALV

SEQ ID NO: 45096 - protein, 510 aa, Sorghum bicolor
  Clone ID: SORBI-28MAY03-C651_1.pep
HEGLKRRRRKHEIHSPVKTVVVVVMENRSFDHILGWLSRTRPDIDGLTGRESNRLNASDPSSPEIFVTDEAGYVDSDPGHGFEDIREQIFGSADTSAVPPPMSGFAQNARGMHEGMPQNVMSGFKPDAVPVYASLADEFAVFDRWFASVPTSTQPNRLFVHSATSHGLTFNARKDLIHGFPQKTIFDSLEENGLSFGIYYQNIPATLFYQSLRRLKHLVKFHQYSLKFKLHAKLGKLPNYVVIEQRYFDCEMFPANDDHPSHDVARGQRFVKEVYETLRASPQWNETALIITYDEHGGFYDHVPTPVVGVPQPDGIVGPDPYYFKFERLGVRVPTFLISPWIEKGTVIHAPNGPQETSQYEHSSIPATVKKLFNLHSNFLTKRDAWAGTFENYLKIRKTPRTDCPEKLPEVTKSLRPFGPKEDSSLSEFQVELIQLASQLNGDHVLNTYPDIGRTMTVGKANRYAEDAVARFLEAGRIALRAGANESALVTMRPALTSRASLSSGLSSEL

SEQ ID NO: 45097 - protein, 157 aa, Sorghum bicolor
  Clone ID: SORBI-28MAY03-C6510_1.pep
MGFVSFVGRVLFVAAFLLSAYQEFNEFGTDGGPAAKALQPKFNVFVKNISAQLGVAVPHIELKHVIAATIGLKGLGSLLFILSSSLGAYLLLFYLALITPIIHDFYNYDMEKAEFAQLFGKFTQDVALIGALLFFLGMKNSIPKRQGKKKAAKAKTN

SEQ ID NO: 45098 - protein, 163 aa, Sorghum bicolor
  Clone ID: SORBI-28MAY03-C66844_1.pep
EKCGGGTLQEAFKYVQKNGGIATEEEYGAYTAKAGSCHAGNVRKAVRIQTYDFLPRENETALAEKVVQQPVAVLFDAHDPAFAYYKGGIYSGGQPRTRYVLNHAMAIVGYGKNESTGQKYWIAKNSWGTGWGDGGYVYIAKDMPDKPQGVQGLVAKYPWYPIV

SEQ ID NO: 45099 - protein, 316 aa, Sorghum bicolor
  Clone ID: SORBI-28MAY03-C6672_1.pep
MSTTNLRRRLHHGDVDGRKNEHVDISSADSLNEPLLGKSSGDNFGSAVYDPRRQDLWDDDRKKEQLHWSFLFSNLIAQWAQWLASIIVSSGSIFGRLFPFSSENQINPVYLSPLQEQRLNNLRRRLQIPFDGSRIEHQDALRQLWRLAYPTREIPPLKSELWKEMGWQGNDPSTDFRGGGLISLENLIFFARNYPNSFQMLLSKVQGQRSDWEYPFAVAGINISFMLVQMLDLKSSIPSSKYGIRFLELLERDENVFDHLYCVAFRLLDAQWLVKRASYMEFNEVLKSTRTQLERELVLDDVLEVKDLPSYTMLDE

SEQ ID NO: 45100 - protein, 56 aa, Sorghum bicolor
  Clone ID: LIB3480-055-P1-K1-D7.pep
KNEYEIDCFISLNQHVRKATYKQHIFTKELYITPQKTSIYIQQGGKCGKVDKLNSC

SEQ ID NO: 45101 - protein, 301 aa, Sorghum bicolor
  Clone ID: SORBI-28MAY03-C66974_1.pep
MSSSASDSASSAAPFEKPRAVVKKLLAESQPEGQGATVRRSIGRHELRNLVPFLMLDEFSVSKPAGFPDHPHRGFVTVTYMLEGAFTHQDFAGHKGTIKTGDVQWMTAGRGIVHSEMPAGDGVQKGLQLWINLSAKDKMIEPRYQELESKDISRGERDGVEARVIAGEALGAASPVYTRTPTMYVDFTMRPGSRLHQPVPEGWNAFVYVVDGEGVFGRDKAAPTAAHHCLVLGPGDGLSVWNRSDRPLRFVLVAGKPLGEPVVQHGPFVMNSRAEIQQAMEDYYYGKNGFERASQWSSSSA

SEQ ID NO: 45102 - protein, 400 aa, Sorghum bicolor
  Clone ID: SORBI-28MAY03-C10631_1.pep
MASLAQHVAGLPCPPLSGASRRRPAAQRRPPSALVCGTYALTKDERERERMRQLFEDAADRCRTAPMDGVAFSPDDLDTAVESTDIDTEIGSLIKGTVFMTTSNGAYIDIQSKSTAFLPLDEACLLDIDNVEEAGIRPGLVEEFMIIDENPGDETLILSLQAIQQELAWERCRQLQAEDVVVTGKVIGGNKGGVVALVEGLKGFVPFSQVSSKTTAEELLDKELPLKYVEVDEEQGRLVLSNRKAMADSQAQLGIGSVVLGTVESLKPYGAFIDIGGINGLLHVSQISHDRVADISTVLQPGDTLKVMILSHDRERGRVSLSTKKLEPTPGDMIRNPKLVFEKADEMAQVFRQRIAQAEAMARADMLRFQPESGLTLSSEGILGPLSSDAPSEDSEPTDE

SEQ ID NO: 45103 - protein, 611 aa, Sorghum bicolor
  Clone ID: SORBI-28MAY03-C11066_1.pep
TRQTLTDALHLHGINIRYLGKIAGMVKHLPHLRDLFSAEIIVRSAKHVIKDILRQSLDHDIGPAIAHFLNCFVGKVLGASTKGSLSNAQSKTLKGHENSQIQKSSKGHKLSNAAASRKSLSAYSHLTSDGIWLSIKEFAKSKYQFEVPDDARLSAKRVAVLRNLCQKVGITIAARKYDLDASTPFEASDMLNLQPVVKHSVPTCTDAKNLMEAGKVRMAEGTLNEAYALFSEAFSLLQQITGPMHKDAANCCRYLAMVLYHAGDTAGAIVQQHRELIINERCLGLDHPDTAHSYGNMALFYHGLNQTELALRHMSRTLLLLSLASGPDHPDVAATLINVAMMYQDASNMNTALRYLQEALMKNERLLGPDHVQTAVCYHALAIAFSCMSLYKLSIQHEKKTYDILVKQLGENDSRTKDSENWLSTFKLREEQVNAQKQKGQGANASDNAVKFLKANPAFLQAMKAAAIQSGDGSANVNRSLNAAVVGEGVPRLRGVDERAARATAEARKKAAARGLNVRNGPAANHASDELAQILKLINAASGSSTSASAKTEESASEGQATNGSVQNGTATEAIAVDTNGPSASAKSTVNTPVGLGTTLELKKQKSKQKS

SEQ ID NO: 45104 - protein, 290 aa, Sorghum bicolor
  Clone ID: SORBI-28MAY03-C11656_1.pep
MVMTTAAQQQRRDAEAELNLPPGFRFHPTDEELVAHYLCARAAGRRPPVSIIAEVDLYRFDPWDLPERALFGRREWYFFTPRDRKYPNGSRPNRAAGSGYWKATGADKPVEHRGRTVGIKKALVFYHGKPPRGVKTEWIMHEYRLADAGGARAKKSGNGTLRLDDWVLCRLYNKKNEWEKMQQQKEKKEMESEASLSHSDTRTPESEIDDDPFPELASLPALDDMVGLAPAAGAILPKEEVEDFGDLGGDDWLAGINLDDLQMPGDADFFGNMLSPMAAKMEQDAGFPFF

SEQ ID NO: 45105 - protein, 454 aa, Sorghum bicolor
  unsure (1)..(454): unsure at all Xaa locations
  Clone ID: SORBI-28MAY03-C8396_1.pep
MESDQGKLFIGGISWETTEXEKLSEHFSAYGEVTQASVMRDKITGRPRGLGFVVFADPAVVDRALQDPHTLDGRTVVVKRALSREEQHAAKAANPSGGRNTGGAGGGGGGGAGDASGARTKKIFVGGLPSTLTEDGFRQSFRTFGSVTDVVVMYDQNTQRPRGFGFITFDSEDAVDRVLHKTFHDLGGKLVEVKRALPREANPGGSSGGRSGGSGGYQSNNGHNTSSGSYDGRSDGGRYGQAQQGSGGYPGYGAGGYGAGAAGYGYGANPAVGYGNYGAGGYGGVPAAYGGHYGNPGAAGSGYQGGPPGSNRGPWGSQAPSAYGTGGYGSSAGYSAWNNSSGGGNAPSSQAPGGPAGYGSQGYGYGGYGGDPSYASHGGYGAYGGRSDGAGNPATGGASGYSAGYGSGGANSGYSSAWSDPSQGGGFGGSVNGGAEGQSNYGTGYGSVQPRVAQ

SEQ ID NO: 45106 - protein, 303 aa, Sorghum bicolor
  Clone ID: SORBI-28MAY03-C853_1.pep
MDLDLWISKVKEGQHLAEHELQSLCEYVKEILIEESNVQPVNSPVTVCGDIHGQFHDLMKLFATGGHVPETNYIFMGDFVDRGFNSLEVFTILLLLKARYPAHITLLRGNHESRQLTQVYGFYDECQRKYGNANAWRYCTDVFDYLTLSAIINGQVLCVHGGLSPDVRTIDQIRTIDRNCEIPHEGPFCDLMWSDPEEIETWAVSPRGAGWLFGSRVTAEFNFVNGIELVCRAHQLVQEGLKYMFQEKGLVTVWSAPNYCYRCGNVASILSFDEKMERDVKFFTETEENNQMRGPRTAVPYFL

SEQ ID NO: 45107 - protein, 299 aa, Sorghum bicolor
  unsure (1)..(299): unsure at all Xaa locations
  Clone ID: SORBI-28MAY03-C807_1.pep
FLHHCLSVILSNGTLPKHIAIGVHCNRRYALFRCMLESLSYGLVPXHIAFIMDGNHRIDKFRSMQQGAGHSKCFSALIASLLYCYEMDVKYITVYAFSIDNFKRDPSEVEALMQLMEEKINELFENRSVINKINCKINFWGNLDLLCEPVRLAAEKLMASTAGNTGLVFSVCMPYNSTSEIVNAVSEVCAERRELLQSEHAGECNGHAANNGVHSEISVADLDRHMYSAGCPDPDIVIRTSGETRLSNFLLWQTTFSHLQNPDPLWPEFSFRHLVWAILQYQRAYPYLEQNRKLAKKQL

SEQ ID NO: 45108 - protein, 170 aa, Sorghum bicolor
  Clone ID: LIB3478-055-Q6-K1-D6.pep
SPSPSVDLKTEKSNEMITSGVLSSLQNFLHKCLIAILSYGPMPKHIAFIMDGNRRYAKFRSMQQGAGHRMGFSALIASLLYCYEMDVKYITVYAFSIDNFKRDPSEVEALMQLMEEKINELFENRSVINKINCKINFWGNLDLLCEPVRLAAEKLMASTAGNTGLVFSVC

SEQ ID NO: 45109 - protein, 443 aa, Sorghum bicolor
  unsure (1)..(443): unsure at all Xaa locations
  Clone ID: SORBI-28MAY03-C7910_1.pep
MDVEGEVPAAAAAAVANGLGGAEEASAAPVSAEQLDVEAYAAQYSGRTRLARLLFIADRCGVEAMQLEALRMAYDEIKRGEDVQLHRDVAAKIGGRLGPRFGLDQAWIDTVTRRADQRKEKLENELNGYRTNLIKESIRMGYNDIGDFFYAHGQLSDAFKSYIRTRDYCTTSKHIVQMCMNVILVSIELAXYAHVSNYVSKAEQTPDSLDPVIVAKLKAAAGLANLETKKYKFAARKFVETGIELGNNYSEVIAPQDVAVYGALCALASFDRSDLKSKVIDNINFRNFLELVPEVRELVNDFYASRYGSCLGHLEKLKPNLLLDIHLHEHVETLYMDIRHKAIIQYTLPFISVDLNLMATAFKTSVSMLEKELAALITENKIQARIDSHNKILYARHADQRNATFQRVLQTGNDFERDVKSMLLRANLLKHDYIQKASGPRKM

SEQ ID NO: 45110 - protein, 143 aa, Sorghum bicolor
  unsure (1)..(143): unsure at all Xaa locations
  Clone ID: LIB3481-060-Q6-K1-E5.pep
XFYASRYGSCLGHLEKLKPNLLLDIHLHEHVETLYMDIRHKAIIQYTLPFISVDLNLMATAFKTSVSMLEKELAALITENKIQARIDSHNKILYARHADQRNATFQRVLQTGNDFERDVKSMLLRANLLKHDYIQKASGPRKM

SEQ ID NO: 45111 - protein, 340 aa, Sorghum bicolor
  Clone ID: SORBI-28MAY03-C855_1.pep
MRPSLLRSTSQLLRRRSYSSASGQPERKVAILGAAGGIGQPLSLLMKLNPLVSSLSLYDIAGTPGVAADVSHINSPALVKGFMGEEQLGEALEGSDVVIIPAGVPRKPGMTRDDLFNINAGIVKNLSAAIAKYCPNALVNMISNPVNSTVPIAAEVFKKAGTYDEKKLFGVTTLDVVRAKTFYAGKANLPVTDVNVPVVARRAGITILPLFSQATPATNSLSDEDIKALTKRTQDGGTEVVEAKAGKGSATLSMAYAGAVFADACLKGLNGVPDIVECSFVQSTVTELPFFASKVRLGKNGVEEVLGLGELSDFEKEGLEKLKSELKSSIEKGIKFANEN

SEQ ID NO: 45112 - protein, 330 aa, Sorghum bicolor
  Clone ID: SORBI-28MAY03-C860_1.pep
RPRVRPRVRFDFIDGYVKPVVGRKINWMKAGIIESDLVLTVSPHYVKELTSGPEKGVELDGVLRTKPLETGIVNGMDVYEWDPATDKHISVKYDATTAPEARPLNKERLQAEVGLPVDSSIPVIIFVGRLEEQKGSDILIAAIPEFVGENVQIIVLGTGKKKMEEELTQLEVKYPNNARGIAKFNVPLAHMMFAGADFIIVPSRFEPCGLIQLQGMRYGVIPICSSTGGLVDTVKEGVTGFHMGSFSVECETVDPARGTAVASTVTRALKQYDTSAFHEMVQNCMAQDLSWKGPAKKWEEVLLGLGVEGSQAGIDGEEIAPLAKENVATP

SEQ ID NO: 45113 - protein, 263 aa, Sorghum bicolor
  Clone ID: SORBI-28MAY03-C9167_1.pep
MAGLGKAMYAVGFWIRETGQALDRLGCRLQGKYFFHEQISRHRTIMNIFDKTPHVHKDAFVAPSASLIGDVQVGPGASIWYGCVLRGDANNIQIGSGTNIQDNSLVHVAKSNLSGKVFPTIIGNNVTVGHSAVLPGCTVEAEAFVGMGATLLDGVVVEKHGMVAAGALVRQNTRIPCGEVWGGNPAKFLRKLTDDEIAFIAESAANYSSLSKVHAIENAKPLEKIEFEKVLRKKFAHQDEEYDSSIGVTREAPPELTSPNPAQ

SEQ ID NO: 45114 - protein, 278 aa, Sorghum bicolor
  Clone ID: SORBI-28MAY03-C15102_1.pep
MTTARKAACVLAAWVLVAAALSDLGSARAPLGSKPQREFDYFALSLQWPGTICASTRHCCASNGCCRSEPLQTFTIHGLWPDYDDGTWPSCCRRTQFELDKILPLMEVLNKYWPSLYCSKSGTCFSGKGLFWAHEWEKHGTCSAPVVQDELQYFTIALDLYFKYNVTEMLSSGGIQVSNGKEYALSDVIDTIKHAFGGSPQIVCKNGSVQELRLCFDKELKPRDCLTTSLTNGSVSKSKHCPRYITLPTYDPLVLANSTVEIMSQFDEFVVPTALYTA

SEQ ID NO: 45115 - protein, 194 aa, Sorghum bicolor
  Clone ID: SORBI-28MAY03-C15954_1.pep
MVHVSFYRNYGKTFKKPRRPYEKERLDAELKLVGEYGLRCKRELWRVQYALSRIRNAARELLTLDEKNPRRIFEGEALLRRMNRYGLLGEGQNKLDYVLALTVENFLQRRLQTIVFKNGMAKSIHHARVLIRQRHIRVGRQLVNIPSFMVRVESEKHIDFSLTSPLGGGPAGRVKRKNQKKASGGGDDGEDDDE

SEQ ID NO: 45116 - protein, 229 aa, Sorghum bicolor
  Clone ID: SORBI-28MAY03-C17028_1.pep
MASSSSSLVLLAAALLALVASWQQAIAYDPSPLQDFCVADKNSPVRVNGFPCKDPMAVTPDDFFNAAMIIDKRRDTNNKVGSNVTNINVESFPGLNTLGISLARIDYAPLGVNPPHIHPRATELLTVLEGTLYLGFVTSNPNRLFSKVVKKGDVFVFPKAMIHFQMNLDHEKPATALSSLSSQNPGVITIASAVFGSKPPISDDVLAKAFQVEKKLIDWLQSQFWDTNY

SEQ ID NO: 45117 - protein, 94 aa, Sorghum bicolor
  Clone ID: SORBI-28MAY03-C15072_2.pep
MGKGTGSFGKRRNKTHTLCIRCGRRSFHLQKSTCSSCGYPAARIRKYNWSIKAIRRKTTGTGRMRYMRHVPRRFKSNFREGTEAAPKKSAAAAN

SEQ ID NO: 45118 - protein, 94 aa, Sorghum bicolor
  Clone ID: SORBI-28MAY03-C15072_1.pep
MGKGTGSFGKRRNKTHTLCIRCGRRSFHLQKSTCSSCGYPAARIRKYNWSVKAIRRKTTGTGRMRYMRHVPRRFKSNFREGTEAAPKKSAAAAN

SEQ ID NO: 45119 - protein, 103 aa, Sorghum bicolor
  unsure (1)..(103): unsure at all Xaa locations
  Clone ID: LIB3480-032-P1-K1-G8.pep
GSRRRRGVCRVGQLRKRLRVPEQRIEPRGIKIKADLEYKEQPVGIVDNKERVTRNRIVRTYKVVWSHHDDRDATWETEDYXKTVYPKFHKKWLVTQNLGTRFP

SEQ ID NO: 45120 - protein, 157 aa, Sorghum bicolor
  Clone ID: SORBI-28MAY03-C10074_1.pep
PLFDISTDHPATYYEDMQRAVFCLCPLGWAPWSPRLVEAVVFGCIPVIIADDIVLPFADAIPWEEIGVFVEEKDVPKLDTILTSMPIDDILRKQRLLANPSMKQAMLFPQPAQPRDAFHQILNGLARKLPHPEGTYLQPGDQHLNWTAGPVGDLKPW

SEQ ID NO: 45121 - protein, 374 aa, Sorghum bicolor
  Clone ID: SORBI-28MAY03-C10239_1.pep
MAVPLVLVVLPLGLLFLLSGLIVNTIQAILFVTIRPFSKSFYRRVNRFLAELLWLQLVWVVDWWAGVKVQLHADEETYRSMGKEHALIISNHRSDIDWLIGWILAQRSGCLGSTLAVMKKSSKFLPVIGWSMWFAEYLFLERSWAKDEKTLKWGLQRLKDFPRPFWLALFVEGTRFTPAKLLAAQEYAASQGLPAPRNVLIPRTKGFVSAVSIMRDFVPAIYYTTVIVPKDSPQPTMLRILKGQSSVIHVRMKRHAMSEMPKSDEDVSKWCKDIFVAKDALLDKHLATGTFDEEIRPIGRPVKSLLVTLFWSFLLLFGAIKFFKWTQLLSTWRGVAFTAAGMALVTGVMHVFIMFSQAERSSSAKAARNRVKKE

SEQ ID NO: 45122 - protein, 284 aa, Sorghum bicolor
  Clone ID: SORBI-28MAY03-C10326_1.pep
MGYLSSVIGHPTDGSSVSGGGLSQNGKFSYGYASSPGKRASMEDFYETKIDCVDGQIIGLFGVFDGHGGAKVAEYVKENLFNNLVSHPKFMSDTKVAIDDAYKSTDSEFLESDSSQNQCGSTASTAVLVGDRLFVANVGDSRAIICREGNAIPVSKDHKPDQTDERQRIEEAGGFVMWAGTWRVGGVLAVSRAFGDKLLKQYVVVDPEIREEAVDDTLEFLILASDGLWDVVSNEEAVAMTRSIQDPEEAAKKLLQEAYKRESSDNITCVVVRFLRGQGSSGYA

SEQ ID NO: 45123 - protein, 316 aa, Sorghum bicolor
  Clone ID: SORBI-28MAY03-C102_1.pep
MVVPVIDFSKLELDGAERAETLAQIANGCEEWGFFQLVNHGIPLELLERVKKVCSDCYRLREAGFKASEPVRTLEALLDAERRGEEVAPVDDLDWEDIFYIHDGSQWPSDPPAFKETMREYRAELRKLAERVMEAMDENLGLDRGTIKAAFSGDGRHEPFFGTKVSHYPPCPRPDLITGLRAHTDAGGVILLFQDDKVGGLEVLKDGQWTDVQPLAGAIVVNTGDQIEVLSNGRYRSAWHRVLPMRDGNRRSIASFYNPASEATISPAAVATSGGEAYPKYMFGDYMDVYVKQKFQAKEPRFEAVKAAAPKSSPAA

SEQ ID NO: 45124 - protein, 75 aa, Sorghum bicolor
  Clone ID: SORBI-28MAY03-C892_2.pep
TPAPAAVPDDTPLKDLITKSPTGTSHAHRKLFRENTLTEKETIAEQNLNANGIIRITTMVQLIHYCRQKKKKGDT

SEQ ID NO: 45125 - protein, 105 aa, Sorghum bicolor
  Clone ID: SORBI-28MAY03-C892_1.pep
PVPYNQQVHLVLQSTQPEPQPVSFDCGTKSTPAPAAVPDDTPLKDLITKSPTGTSHAHRKLFRENTLTEKETIAEQNLNANGIIRITTMVQLIHYCRQKKKKGDT

SEQ ID NO: 45126 - protein, 122 aa, Sorghum bicolor
  unsure (1)..(122): unsure at all Xaa locations
  Clone ID: SORBI-28MAY03-C10445_1.pep
AGQARGIRPPSAQWRTAAKRKEAAEATSAAAKGADAAPAAETGLGAGASAALATDRATAARTATTARAFDPTPAIALLRFDGWWRXGGGGEKVLEGGCVAVEKERIDSGEHEISAGGPGPAG

SEQ ID NO: 45127 - protein, 233 aa, Sorghum bicolor
  Clone ID: SORBI-28MAY03-C10835_1.pep
MAASSSVTTVGGSFLAALALLAVASDAAVFTVVNRCPYTVWAASVPVGGGRRLNRGETWRITAPPGTTAARIWARTGCQFDASGRGSCRTGDCGGVLQCTGYGRAPNTLAEYALKQFNNLDFFDISLIDGFNVPMSFLPDGGSGCSRGPRCAVDVNARCPAELRQDGVCNNACPVFKQDVYCCVGSAANNCGPTKYSRYFKGQCPDAYSYPKDDATSTFTCPTGTNYKVVFCP

SEQ ID NO: 45128 - protein, 254 aa, Sorghum bicolor
  unsure (1)..(254): unsure at all Xaa locations
  Clone ID: SORBI-28MAY03-C1927_1.pep
RFQGFQYSKSMLKEEVERYKKFADRLEPFIADTVHVLNESIQQKKKILVEGGQATMLDIDFGTYPFVTSSSPSAGGICTGLGIAPRVIGDLIGVVKXYTSRVGSGPFPTELFGEEGDRLRKAGMEFGTTTGRPRRCGWLDIVALKYCCQINGFSSLNLTKLDVLSGLSEIKVGVSYSRPDGQKLQSFPGDLDTLEQVQVNYEVLPGWQTDISSVRSYNELPQAARLYVERIEELVGVPVHYIGVGPGRDALIYK

SEQ ID NO: 45129 - protein, 363 aa, Sorghum bicolor
  Clone ID: SORBI-28MAY03-C20239_1.pep
MASSRAYSLSVPLLLLVIGVCCCISEALPIGHHPVDPTCPPEPAASAAVPSSSSSYGEPEPRRRRCQPPAPHIPVPVFPYDVDPMQFALNLEFTEAEFFLHAAYGVGLDHVAPKLALGGPPPVGARKANLDEVTWRIVAEFALQEVGHIRAIERTVGGIPRPLIDLSARNFARLMDKAFGYRLDPPFDPYVNSLNFMLASYVIPYLGINGYVGTNPIIDGYETKKLLAGLARGEAAQDAVIRARLFEHLGEAVPPYRNITVAEFTDRVSALRNELGRCGVKDEGLTVPRALGAEGAICTNVLSADRDSLSYARTPAELLSILYLTGDEHVPGGFYPEGGNGRIARSFLAKPHGHGAAHGVPGN

SEQ ID NO: 45130 - protein, 231 aa, Sorghum bicolor
  Clone ID: SORBI-28MAY03-C20246_1.pep
MASVLHLLPLVVVVVFLAAAAADAATFTVTNKCQYTVWAAAVPGGGQQLDNGQTWSINVPAGTTGGRVWARTGCSFDGSGNGQCQTGDCGGVLRCTQYGQPPNTLAEFGLNQYQGLDFIDISLVDGFNVPMDFLPAGDGSGCPKGGPRCDADVTSQCPAALKATGGCNNPCTVFKTDEYCCTGSAANTCGPTDYSKFFKGLCPDAYSYPKDDATSTYTCPGGTNYNVVFCP

SEQ ID NO: 45131 - protein, 221 aa, Sorghum bicolor
  unsure (1)..(221): unsure at all Xaa locations
  Clone ID: SORBI-28MAY03-C959_3.pep
TDPWQAPAPPPGPSPRRPLHARPTRPPLPESNPLSFKAQAAIHQAYCDSYYSYHRSSSAAKKDGVDPAFDVHFSWIFAPWHRMYIYFYERALGQLIGDDTFALPAGNPGALFKGSFINPLCDPNRNMANVDALVDLDYLSHKDDKPIDFKGPKDEKYKDLVNRNLCTIYTQQVRKGPESFLXGEKYCTAIEGRGSAGTLESMAHTADARSGWAKPTTKPLR

SEQ ID NO: 45132 - protein, 255 aa, Sorghum bicolor
  Clone ID: SORBI-28MAY03-C959_2.pep
TDPWQAPAPPPGPSPRRPLHARPTRPPPALFKGSFINPLCDPNRNMANVDALVDLDYLSHKDDKPIDFKGPKDEKYKDLVNRNLCTIYTQQVRKGPESFLGEKYCTAIEGRGSAGTLESMAHTAMHVWVGKPTTKPCDASTGGVLSHKDGAFNCNNDMGFLGTAGNDPLFYSHHANVDRMWHLWSTRLGGGQGITDTDWLDATFVFYDDVKSPRKVRIKFRDVLDTRDLGYTYDAEYDRDLPWLRPKITKLVPHG

SEQ ID NO: 45133 - protein, 185 aa, Sorghum bicolor
  Clone ID: SORBI-28MAY03-C959_1.pep
MPVQQDHRRFGGASTGVVQSHKDGAFNCDNDMGFLGTAGNDPLFYSHHANVDRMWHLWSTRLGGGQGITDTDWLDATFVFYDDVKSPRKVRIKFRDVLDTRDLGYTYDAEYDRACWGCPARHEAGTARRARRDVMLNGLTGVPAGLAWYPGVASGADSSTTSPCTAADKVKRDGPAVHGHGESEA

SEQ ID NO: 45134 - protein, 542 aa, Sorghum bicolor
  Clone ID: SORBI-28MAY03-C13342_1.pep
MNTVSSLSLVPHLLIKPSIACFSRKGVGRYGGIKVYAVLREDGAEFAKNNNLEALFHVDDPGPRCPIKKGKFLDVNEALEVVRFDIQYCDWRARQDLLTIMLLHNKVVEVLNPLAREFKSIGTLRKELAELQQELEKAHNQVHLSEARVSSALDKLAHMETLVNDRLLPPDGASGTSTAESTSLVPSTSSTAHVRAKKQPRRSLNVSGPVKPYNPSLKNFWYPVAFSSDLKDDTMVPIDCFEEQWVIFRGKDGRPGCVQNTCAHRACPLHLGSVNEGRIQCPYHGWEYSTDGKCEKMPSTKMLNVRIQSLPCFEQEGMVWIWPGDDPPKATIPSLLPPSGFTIHAEIVMELPVEHGLLLDNLLDLAHAPFTHTSTFAKGWSVPSLVKFLTPASGLQGYWDPYPIDMEFRPPCMVLSTIGISKPGKLEGKSTQQCSTHLHQLHVCLPSSRNKTRLLYRMSLDFAPWLKHVPLMHLLWSHFAEKVLNEDLRLVLGQQERMINGANIWNWPVSYDKLGIRYRLWRDAVERGSDRLPFSNQAESGS

SEQ ID NO: 45135 - protein, 256 aa, Sorghum bicolor
  Clone ID: SORBI-28MAY03-C1309_1.pep
MASRKFFVGGNWKCNGTGEDVKKIVTVLNEAEVPTEDVVEVVVSPPFVFLQQVKGLLRLDFAVAAQNCWVRKGGAFTGEISAEMLVNLQVPWVILGHSERRALLGESSDFVADKVAYALTQGLKVIACIGETLEQREAGTTMDVVAAQTKAISEKISDWTNVVLAYEPVWAIGTGKVATPAQAQEVHDGLRKWLHSNVSPAVAESTRIIYGGSVNGANCKELAAQADVDGFLVGGASLKPEFVDIIKSATVKSSCA

SEQ ID NO: 45136 - protein, 355 aa, Sorghum bicolor
  Clone ID: SORBI-28MAY03-C13484_1.pep
HEEAFRDAGLQFSKQGAPGTQENSLLDNTARIEGWLARFPMFDWVGGRTSEMSAVGLLPAALQGIDIKEMLAGAALMDEETRTTVVKENPAALLALCWYWATEGIGKKDMVVLPYKDSLLLLSRYLQQLVMESLGKEFDLDGNPVNQGLTVYGNKGSTDQHAYIQQLREGVHNFFVTFIEVLRDRPPGHDWELEPGVTCGDYLFGMLQGTRSALYANDRESISVTVQEVTPRAVGALVALYERAVGIYASLVNINAYHQPGVEAGKKAAGEVLALQKRVLTVLNEATCENPGEPLSIDEIADRCHCPEDIEMIYKIIQHMAANDRALIAEGSCGSPRSVKVYLGECNVDEDMQAA

SEQ ID NO: 45137 - protein, 256 aa, Sorghum bicolor
  Clone ID: SORBI-28MAY03-C12895_1.pep
MDVMLLGRALNTYPQTTGEAQLADGSETMASRQPRPVDASLRSLSIASALLTWSVCCAAVSVRALPEPDGCSSNSNMTELQMHVSFFDRNKDGILTPLETFQGFVAIGCEVAFSTAAASTIHTALAPLTNPPGALPPYINIYVEYIHKAIHGSDTGAYDSKGRFVQAKFDEIFKKHAHIRKDALSLLEVEEMLTVNRDVLDPASWAAAEAEWQLIYQLAHDRYGFLTKERARGIYNGKIFVELEERISRRPLHSNA

SEQ ID NO: 45138 - protein, 126 aa, Sorghum bicolor
  unsure (1)..(126): unsure at all Xaa locations
  Clone ID: LIB3480-060-Q6-K1-E10.pep
MASRQPRPVDASLRSLSIASALLTWSVCCAAVSVRALPEPDGGSSNSNMTELQMHVSFFDRNKDGILTPLETFQGFVAIGCEVAFSTAAASTIHTALAPLTNPPGALPPYINIYVEYXHKAIHGSD

SEQ ID NO: 45139 - protein, 123 aa, Sorghum bicolor
  Clone ID: LIB3478-050-P1-K1-C5.pep
SHFSAARDLYGIILFFVHLFLYLGRHTGFVAIGCEVAFSTAAASTIHTALAPLTNPPGALPPYINIYVEYIHKAIHGSDTGAYDSKGRFVQAKFDEIFKKHAHIRKDALSLLEVEEMLTGNPD

SEQ ID NO: 45140 - protein, 202 aa, Sorghum bicolor
  Clone ID: SORBI-28MAY03-C1303_1.pep
MFGHILVDFLYCYSEWKFLGWFISHNKKMEYLLGKTIKHMLFLQSVTKHADNLKDTNESKILGGENGPLLGGLVGGASWALVVRWLALSSPIFVEARVRPRQMLVEMLCEDRGIFLEIADFIKGLGLTILRGVMEARKNKIWARFTVEANRDVTRMEIFLSLMRLLEPSCDGSGAGENPNNNTKMPLGIVRYPVIPATGHLR

SEQ ID NO: 45141 - protein, 142 aa, Sorghum bicolor
  Clone ID: LIB3476-054-P1-K1-H6.pep
EWKTPALPKDRQLIQDRIKELRELVPNGAKCSIDALLEKTIKHMLFLQSVTKHADNLKDTNESKILGGENGPLKDYFEGGATWAFDVGSQSMTCPIIVEDLERPRQMLVEMLCEDRGIFLEIADFIKGLGLTILKGRMGSTQ

SEQ ID NO: 45142 - protein, 169 aa, Sorghum bicolor
  Clone ID: SORBI-28MAY03-C14987_1.pep
MSPLLRRVLLLALAAAVAATASAASLNGAANDLLPKYGLPKGLIPDSVASYSFDEATGAFEIHLASTCYVHFGSHLVYYERTITGKLSEGAISDLSGVQAKKLFLWVYVTGMVAHPDQGTIEFQAGFISESLSASMFDDVPTCGSSVGAQLRGAAGVIGELGLLPVAQA

SEQ ID NO: 45143 - protein, 361 aa, Sorghum bicolor
  Clone ID: SORBI-28MAY03-C13728_1.pep
MMIMALSRAAASSRGFFFALMLVACCSLMLQAAAAAGGGADGVVVGADGDNKLMMDRFLRWQATYNRSYPTAEERRRRFQVYRRNMEHIEATNRAGNLTYTLGENQFADLTEEEFLDLYTMKGRMPPVRRDAGKKQQANFSSVVDAPTSVDWRSRGAVTPIKNQGPSCSSCWAFVTAATIESITQIRTGKLVSLSEQELIDCDPYDGGCNLGYFVNGYKWVIQNGGLTTEANYPYQARRYQCNRSKAGQRAARISNYRQLPQGEAQLQQAVAQQPVAAAIEMGGSLQFYSGGVWSGQCGTRMNHAITVVGYGADSSSGVKYWLVKNSWGQTWGERGYLRMRKDVRQGGLCGIALDLAYPIV

SEQ ID NO: 45144 - protein, 308 aa, Sorghum bicolor
  Clone ID: SORBI-28MAY03-C9861_1.pep
MARKMLVDGEVAAVADAGQYDYDLFVIGAGSGGVRGSRFAASFGAKVAICELPFHPISSEWLGGHGGTCVIRGCVPKKILVYGASFGGEFEDSKNFGWEINGDINFNWKKLLENKTKEIVRLNGVYQRILTNAGVTMIEGAGSLVDAHTVEVSQPDGSKQRYTAKHILIATGSHAQRVNIPGKELAITSDEALSLEELPKRAVILGGGYIAVEFASIWRGMGAEVDLFYRRELPLRGFDDEMRTVVASNLEGRGIKLHPGTNLSELSKTADGIKVVTDKGEELIADVVLFATGRTPNSQRLNLQAAGV

SEQ ID NO: 45145 - protein, 220 aa, Sorghum bicolor
  Clone ID: SORBI-28MAY03-C2447_1.pep
MGSEGPSVVTVHVTGFKKFHGVAENPTEKIVTNLNSFLEKRGLPKNLVLGSCTVLETAGQGALPTLYKVLESAIADRGTGSSAQGQVIWIHFGVNSGATRFALENQAVNEATFRCPDELGWKPQRVPIVPSDGSISRTRETTLPVNELTKSLRKIGYDVVPSDDAGRFVCNYVYYHSLRFAEQHGIKSLFVHVPLFLTIDEEVQMHFAASLLEVLASSSN

SEQ ID NO: 45146 - protein, 555 aa, Sorghum bicolor
  Clone ID: SORBI-28MAY03-C24640_1.pep
MARPPQEAIDTFISITGADEAVAVRKLEEHGGDLNRAINSHFNDGDSISNGISQNTMPASHDDMMDLDGPLDNTFQRPLFPHEAHDPFALMDPNFQRQFFDRVGSTDGVSHGPLVSHPREAREIPIEVKDSDPQTGPSGQAPVIEDVTGNESLNGPEVPETIIIDEEDGGLLSAPSAPHASIPSITSSVPTAPPLVHVNDYDDDIEEEMIRAAIEASKKDSEALANIVEQGGDQHQEGVNLEEHSSDKAGMGTTDGIVERQGPASGKAGTSRQPIDEEGFQEETEDVEEQPLVRRRSRRVPSENTELAQIVHPGASPVRNDRQYNNGDDFPSEWGGISSEEHDEAVMLEAAMFGGVPEGPTYPFSMPSHRSSTYYPPIAHSPSPALTEQRLLREQQDDEYLASLQADQEKELKALQEAELRRLEETAAREAALEKQKQEEEERRKKQLEEEELESSLASKQASLPSEPPPDAEGAVTVVVRMPDGSRQGRRFLKTDKLQFLFDFLDIGRTCKPGTYRLVRTYPRRTFTDSEGDVSFSDLGLTSKQEALFLEQITA

SEQ ID NO: 45147 - protein, 190 aa, Sorghum bicolor
  Clone ID: SORBI-28MAY03-C25255_1.pep
TRHIEVDRSGKIPMLRFRDRESYAQNKTKEYDAIAMKYLTYVLFLLVIGFSIYSLKYEKHKSWYSWILSSMTSCVYMFGFIMMCPQLFINYKLKSVAHMPWRQMTYKFLNTIIDDLFAFVIKMPMLHRLSVFRDDVIFLIYLYQRWKYPVDKKRVNEFGFGGEDEPAAQGALEGSAAQPTEAEAEDKKTK

SEQ ID NO: 45148 - protein, 199 aa, Sorghum bicolor
  Clone ID: SORBI-28MAY03-C25840_1.pep
MDATQLNRPMDATRLFLGALLLLLPAALLLLLRARGRRRLPPGPPSLPLLGSVVWLTNSPTEIEPLLRRLFERYGPVVALRIGARLFVFVADRRIAHEALVDRGAALADRPALASVRLLGENENSITRASYGPVWRLLRRNLVAETLHPSRVKLFTPARAWVRRVLVEKLGEPGPDAAPPRVVETFQYAMFCLLVLMCR

SEQ ID NO: 45149 - protein, 340 aa, Sorghum bicolor
  Clone ID: SORBI-28MAY03-C17604_1.pep
MASHHSEPLDSAAAADAPSDNNPELPCPPYHIVTKPGQLPVEFLEPSAAQKLVIGFDCEGVDLCRNGALCIMQLAFPDAVYLVDAIEGGKELIQACKPALESDHITKVIHDCKRDSEALYFQFGIKLHNVMDTQIAYSLIQEQEQEGKKKTSDDYNYISFVSLLADKRFCGIPYPEKEEVRTLLRQDPNFWTIRPLSDMMVRAATDDVRFLLNIYEKMMEKLSKVSLWRLAVRSELYCRCFCLNDNQFADWSPLPPVPDDIEADVYVPEVDILSVLDVPPGKMGRVIGRKGSTIMAVKESCNVEIHIGGAKGPPDRVFIIGPVKEVRKAEAIFRGRMLEF

SEQ ID NO: 45150 - protein, 62 aa, Sorghum bicolor
  Clone ID: SORBI-28MAY03-C1749_1.pep
MASLKASKPAGVAAQGKEPAPKLSETATKPSAAKSGGVKKAEQKPRETKKKVKSSKPAAAKK

SEQ ID NO: 45151 - protein, 62 aa, Sorghum bicolor; identical to SEQ ID NO: 45150
  Clone ID: LIB5052-004-A1-XP1-F9.pep

SEQ ID NO: 45152 - protein, 62 aa, Sorghum bicolor
  unsure (1)..(62): unsure at all Xaa locations
  Clone ID: LIB5052-008-A1-XP1-D10.pep
MDSLKVSKSAGVAAQGKEPAPKLSETATKPSAAXSGGVKKAEHKPRETKKKVNSSKPVADKK

SEQ ID NO: 45153 - protein, 64 aa, Sorghum bicolor
  Clone ID: SORBI-28MAY03-C18483_1.pep
MENNGNRQQAPPPPPGYPTAAAGAEEQGGRKGRRGKTTSRGEKGFIEGCIAALCCCWICEMCCD

SEQ ID NO: 45154 - protein, 71 aa, Sorghum bicolor
  Clone ID: SORBI-28MAY03-C16849_1.pep
MADWGPVVVAVVLFVLLSPGLLLQLPAKGGRFVEFGNFQTSGASIFVHAILFFALAAIFLIAIGVHITTDP

SEQ ID NO: 45155 - protein, 89 aa, Sorghum bicolor
  Clone ID: LIB5121-006-A1-PF1-A11.pep
FTRTGSTGEHYGPWPRSVALIALWRARWPTISPRGRVDVIICGRGGTRSRGPCHITTYSYALLCQSVSVSAPPVHTTSKCFYGCNLVVQ

SEQ ID NO: 45156 - protein, 86 aa, Sorghum bicolor
  Clone ID: SORBI-28MAY03-C18785_1.pep
EEGTGAMELSRKLFTAVLLVMLLLVATEIGPVAVAEARTCQSQSHRFRGPCVRRENCANVCRTEGFPDGKCRGFRRRCFCLTHCRN

SEQ ID NO: 45157 - protein, 86 aa, Sorghum bicolor; identical to SEQ ID NO: 45156
  Clone ID: LIB5050-005-R1-XP1-G10.pep

SEQ ID NO: 45158 - protein, 479 aa, Sorghum bicolor
  Clone ID: SORBI-28MAY03-C1924_1.pep
HEAGLEVLRIINEPTAASLAYGFEKKNNETILVFDLGGGTFDVSVLEVGDGVFEVLSTSGDTHLGGDDFDKRIVDWLAGNFKNDEGIDLLKDKQALQRLTEAAEKAKARRSSLTQTNISLPFITATADGPKHIETTLTRAKFEELCSDLLDRLRTPVDNALRDAKLQFKDIDEVILVGGSTRIPAVQELVKKMTGKDPNVTVNPDEVVALGAAVQAGVLSGDVSDIVLLDVTPLSLGLETLGGVMTKIIPRNTTLPTSKSEVFSTAADGQTSVEINVLQGEREFVRDNKSLGSFRLDGIPPAPRGVPQIEVKFDIDANGILSVTAVDKGTGKKQDITITGASTLPKDEVERMVDEAEKFAKEDKEKRDAIDTKNQAESVIYQTEKQLKELGDKVPGEVKGKVESKLQELKDAVAGGSTQTMKDAISALNQEVMQIGQSLYSQQGAPGAGPAPGADASAGSAEKPGDEGDVIDADFTDSK

SEQ ID NO: 45159 - protein, 163 aa, Sorghum bicolor
  unsure (1)..(163): unsure at all Xaa locations
  Clone ID: SORBI-28MAY03-C29896_1.pep
SDKTDEAELQRAVERASALLRPHGAAVVEYTSPADTETLPGRCLVYWELLTKGPAAGAGAAVDRETLDRCCLEMEEALNTVYRQSRVADGSIGPLEIRVVRPGTFEELMDYAISRGASINQYKVPRCVTFPPIIELLDSRVVSTHFSXPALPHWTPGQRSHSD

SEQ ID NO: 45160 - protein, 177 aa, Sorghum bicolor
  Clone ID: SORBI-28MAY03-C30142_1.pep
MAVMAEVVSTTGAALRSPASQPPPPPAAAAVKDADAEKLQFIEEMTSNVDAVQERVLGEILARNADTEYLAKYGITGASDRATFRAKVPMATYEDLQPYIRRIADGDRSPILSGHPVSEFLTSSGTSAGERKLMPTIEDELNRRQLLYSLQMPVMNLYVPGMDKGKALHFLFVKSET

SEQ ID NO: 45161 - protein, 245 aa, Sorghum bicolor
  Clone ID: SORBI-28MAY03-C30270_1.pep
MICAISGEVPDEPVVSKKSGLLFERRLIERYVEDHGKCPVTKEDLTMDDIVPVKTNKVVKPRPLQAASIPGLLGIFQNEWDALMLSNFALEQQLHTARQELSHALYQHDAACRVIARLKKERDEARALLALAERQIPASVPGAAPVAVVSNGKRAMEDEIGPDGKKIRPGINPVMIDELTECNTMLSAQRKKRQVPPTLAPIDALERYTQISSHPLHKTNKPGILSMDIHPSKDIGATGGIDTNA

SEQ ID NO: 45162 - protein, 334 aa, Sorghum bicolor
  Clone ID: SORBI-28MAY03-C2146_1.pep
HEDGIHLGTEMCKKILATGIKTLHLYTLNMDKSAIGILMNLGLIEESKVSRPLPWRPATNVFRVKEDVRPIFWANRPKSYLKRTLGWDQYPHGRWGDSRNPSYGALTDHQFTRPRGRGKKLQEEWAVPLKSVEDISERFTNFCQGKLTSSPWSELDGLQPETKIIDDQLRPINQKGFLTINSQPAVNGEKSDSPTVGWGGPGGYVYQKAYLEFFCAKEKLDQLIEKIKAFPSLTYIAVNKDGESFSNIAPNAVNAVTWGVFPGKEIIQPTVVDPASFMVWKDEAFEIWTRGWACLFPEGDSSRELLEKVQKSYYLVSLVDNDYVQGDLFAAFKI

SEQ ID NO: 45163 - protein, 566 aa, Sorghum bicolor
  Clone ID: SORBI-28MAY03-C20777_1.pep
HHDGTGSFKEESNLVSELPNLERTALAQLKELVAAALANGEFNLPPPPPPPAAKVEPAKKEEPTMEEAKEEAPAAAKEDEPKAEEAVAEEPVKEEAKPEEPKTEAPAEVAAAEEAKDEAPAPEEPKTKAPAPEEPKTEAPAPEEPAKEEPKAEAAAEAVAEEPKAEAATEETKPAEPEPEEKTVAAAEAVATIAVAAVAAPAAAAAAAVPPAAAALAQAAAPEPVLIWGVPLVGDDECTDTVLLKFLRAREFKVKEAMAMLKSAVLWRKRFGITSLLDADLGLPELENVVFYRGADREGHPVCYNVYGEFQDKDLYEKAFGDDEKRERFLKWRIQLLERGILSKLDFSPSGICSMVQVTDLKNSPPMLGKHRAVTRQAVTLLQDNYPEFIAKKVFINVPWWYLAANKMMSPFLTQRTKSKFVFASPAKSAETLFRYIAPEQVPVQFGGLFKVDDPEFTTYDIVTELTIKPSSKETIEIPVTENSTIVWELRVLGWEVSYGAEFTPDAEGGYTVIVQKSRKVPANEEPIMKGSFKVGEPGKLVLTVNNPASKKKKLLYRSKVKSTSE

SEQ ID NO: 45164 - protein, 355 aa, Sorghum bicolor
  unsure (1)..(355): unsure at all Xaa locations
  Clone ID: SORBI-28MAY03-C2216_1.pep
MAGSDEVNRNECKGAVPIHTWVLISNFKLAYNMLRRADGTFDRDLAEFLDRRVPPDARAQEGVSSFDHVIDTSTGLEVRIYRAAAAAANNNGGAAAVTLPILDFLAGAPSPDPFPVILFFHGGSFAHSSSGTAIYDNLCRRFVKLSKGVVVSVNYRRAPEHRYPCAYDDGWTALKWAMSQPFLRSGRGGDARPRVFLSGDSSGGNIAHHVAVRAADAGINICGNILLNAMFGGTERTESERRLDGKYFVTLQDRDWYWKAYLPEXRTRDHPACNPFGPNGRRLRGLPFTKSLIIVSGLDLTCDRQLAYAEGLQEDGHHAKLVYREKATVGFYLLPNTDHYHEVMEEIADFLRANL

SEQ ID NO: 45165 - protein, 438 aa, Sorghum bicolor
  Clone ID: SORBI-28MAY03-C2258_1.pep
MAASASSLLAAHAASSCAAISPRLPRGAPAAASVPSPSRHSCYPLRASPARRHRSRFVASAAPTMQPPAESRVSTVVDVDLGDRSYPIYIGAGLLDEPDLLQRHVHGKRVLVVTNTTVAPLYLEKVTWALTHNNPNVSVESVILPDGEKYKDMDTLMKVFDKAVESRFDRRCTFVALGGGVIGDMCGFAAAAFLRGVNFIQIPTTLMAQVDSSVGGKTGINHPLGKNLIGAFYQPQCVLIDTDTLNTLPDRELASGIAEVVKYGLIRDAPFFEWQEKNMLKLLAREPNALAYAIKRSCENKAEVVAQDEKESGLRATLNLGHTFGHAIETGLGYGAWLHGEAVAAGTVMAADMSYRLGWIDESLKNRVVDILKQAKLPIAPPEAMTVEKFKNIMAVDKKVADGLLRLILLKGPLGCCVFTGDYDRNALDETLHAFCDN

SEQ ID NO: 45166 - protein, 317 aa, Sorghum bicolor
  Clone ID: SORBI-28MAY03-C23733_1.pep
TRPALLTYYWRMKMPETARYTALVAKNAKQAAADMSKVLHTEIVDEQEKLDQMVTAESNTFGLFSREFARRHGLHLVGTATTWFLLDIAFYSQNLFQKDIFTAINWIPKANTMSALEEVFRISRARALIALCGTVPGYWFTVALIDVVGRFAIQLLGFFMMTVFMLGLAIPYHHWTTAGNHIGFVVMYGFTFFFANFGPNSTTFIVPAEIFPARLRSTCHGISAASGKAGAIIGAFGFLYAAQNQDKSKADAGYPAGIGVRNSLFVLAGCNMLGFVLTFLVPESKGKSLEEMSGEADDAEEEAVGARAVRPSETQMV

SEQ ID NO: 45167 - protein, 241 aa, Sorghum bicolor
  Clone ID: SORBI-28MAY03-C2400_1.pep
MATTAGAGGAGKLKLLGAWPSPFVNRVRVALHLKGLEYENVEEDLTNKSDQLLASNPVHKKVPVLLHGDTPVSESLVIVEYLDDAFPGAGQALLPADPYERAVARFWAAYVDGKLHGMMVKAILGATEEERAAATADALAAMETLEGAFAECSGGKEFFAGDEPGYLDVVLGGFIGWLRAWDKVGGVKLLDGGRRTPRLAAWAERFAALDVARDVIPDPDHIAEFAKVLQARSAAAAAAGN

SEQ ID NO: 45168 - protein, 394 aa, Sorghum bicolor
  Clone ID: SORBI-28MAY03-C2420_1.pep
MPTAYSLRAPPSAAQQRLRLPLPQPPPPLPFSPAGGGAARRRRAVGVAAASASPFDELHARGRPVRGPSKKSMLWNLIQDIEPLDLSVIQKDVAPETVDAMKRTISGMLGLLPSDQFRVVVEALWNPFFKLLVSSIMTGYTLRNAEYRLSFERNLELSEEVAECPKSDVTEDNHHNINLGRPVTIFRLSEEDMPRDPGKTDEESSYKNMGEELGDLTPQAEEYIIQMQSRLDAMKKELHDLRRKNSALQMQQFVGEEKNDLLDYLRSLTPEKVAELSESTCPGVQEAIHSVVHGLLATLSPKIHSKAPPLLDNTSGGVLNLGGEDDDRAELVENASLPFQPLISVPRDYLARLLFWCMLLGHYIRGLEYRLELTQLLRISSDVGSFSGGDDHVV

SEQ ID NO: 45169 - protein, 154 aa, Sorghum bicolor
  Clone ID: SORBI-28MAY03-C3812_1.pep
VRENNQPCPEATQNIQNKVQSSSTRSCKKVHKQGSALGRSIDLTKFTCYDELIAELDQMFDFDGELKNPCKNWLVVYTDNEGDIMLVGDDPWNEFCDMVHKIFIYTREEVERMNPGALNSRSEDSLSDSQGRGLASKEPPRGGPSTSTPNSESC

SEQ ID NO: 45170 - protein, 156 aa, Sorghum bicolor
  unsure (1)..(156): unsure at all Xaa locations
  Clone ID: SORBI-28MAY03-C296_2.pep
PSATAERITHCSSSLPLPGIHLFKKPRDREGVCLCLLLPPSSSSSSRIGIACHALVDLEIPHRAAVNFVTELFTSGTLRQYRRKHPRASAAAVRRWCRQILEGLAYLHARGIIHRDLKCDNIFVNGSQGQVKIGDLGLAAVVTRRXRXXGNAASCV

SEQ ID NO: 45171 - protein, 524 aa, Sorghum bicolor
  unsure (1)..(524): unsure at all Xaa locations
  Clone ID: SORBI-28MAY03-C296_1.pep
RPLLKSLRHRAVMRLHASWVDADAADAPATTAPTRPRRAAVNFVTELFTSGTLRQYRRRHPRASAAAVRRWCRQILEGLAYLHARGIIHRDLKCDNIFVNGSQGQVKIGDLGLAAVVTRRRRRGNAASCVVGTPEFMAPEVYAEDYDERADLYSPARXVLEMVTLEYPYSECVHPVHIYKKVTSGIKPAALYKVKDPAVRRFIDKCLAPASWRPSAAELLGDPFLQLEDDGLWYGDDDDGADYSTMYNYLHQPACLDHHHHNSGSNGSTASNGVVSNGVGGGDRWDDDDDSEDDDDDGSMFQGIDQLFNEHEDDDDELHVAGVDITIKGKRLEDGSIFLRLRIADKDGTGRVRNIYFPFDADADTALSVATEMVAELDITDHEVTHIAEMIDGAVAALLPHWRPGPGMDDDEDDDYDGGGGTDASGAAGRCKNCRSSASSAGSLDDYMSAAAAARRGCRCAEMHGRFEEITFQADEEQVRFQGSGCSSDDGGGQAEQCAAGDGKLEDIVNGVTLDGTTERSDQP

SEQ ID NO: 45172 - protein, 290 aa, Sorghum bicolor
  Clone ID: SORBI-28MAY03-C4057_1.pep
MQWAGLRSQAPVPTAAWTGPRPRIARWPQGRFTAARRALVASAAASDANSSSNSPGRDEEREEVVQREKKEKAVASLLMRSQKYAMLKQQLAVAAQFEDYKEAARLRDSLRSFEEEEPVLRLRRLMKKAIDEERFEDAAKYRDELMILAPHSLLKCSSDATTLGIRVQVRSVYIESRSQPLKGQFFFAYRIRITNNSQRPVQLLRRHWIVTDGNGRTENIWGVGVVGEQPVIFPKTGFEYSSACPLSTPNGRMEGDFEMKHIDKAGSSTFNVAIAPFSLSILGDDNDVLL

SEQ ID NO: 45173 - protein, 327 aa, Sorghum bicolor
  Clone ID: SORBI-28MAY03-C39688_1.pep
KGHTAFATKEEADEEVLQILELYRRIYEEFLAAPVSKGRKSEMEKFAGGLYTTSVEAFIPNTGRGIQGATSHCLGQNFAKMFDITFENEKGVREMVWQNSWAYTTRSIGVMVMTHGDDKGLVLPPKVAPIQVIVIAVPYKDADTTAIKGACESTVYTLNESGIRADQDTRENYSPGWKYSHWEMKGVPLRIEIGPKDLANKQVRIVRRDNGAKVDIPVTNLVEEVKVLLDEIQKNLFKTAQEKRDACVQVIKTWDEFTTALNNKRLILAPWCDEEEVEKDVKARTKGELGAAKTLCTPFEQPELPEGTLCFASGKQAKKWSFWGRSY

SEQ ID NO: 45174 - protein, 145 aa, Sorghum bicolor
  Clone ID: SORBI-28MAY03-C27436_1.pep
AGATDAGTSPLSAYWLVPQYALHGVAEAFTSVGHLEFMYDQAPESMRSTATALFWLSISLGSYASTLLVDAVHHWSAGPGGANWLPDNINHGRLDYFYWVVTMLQVMNLIYYAICAKRFRYKPVQLHKKEEEESGKALVELQEKV

SEQ ID NO: 45175 - protein, 671 aa, Sorghum bicolor
  Clone ID: SORBI-28MAY03-C27779_1.pep
DPMAPAAPAAGGGGGAEAGCGGGGGKDPLFVELWKACAGPLSSVPPLGEKVYYFPQGHIEQVEASTNQIAEQQGTPLYNLPWKIPCKLMNIELKAEPDTDEVYAQLTLLPDKKQDENTSTTVENEEAEEEVVPHAPPTNEGPRIHSFCKTLTASDTSTHGGFSVLRRHADECLPPLDMSQHPPNQELVAKDLHGIEWRFRHIFRGQPRRHLLQSGWSVFVSAKRLVAGDAFIFLRGENGELRVGVRRARTRQTTIPSSVISSHSMHLGVLATAWHAVNTGSMFTVYYKPRTSPAEFVVSRDRYYESLKRNYSIGMRFKMRFEGEEAAEQRFTGTIVGIGASDPSGWADSKWRSLKVRWDEASSVPRPERVSPWQIEPAISPSPVNPLPVRFKRSRSSVNASPSDVPTVSREVASKVMAESQQSNLPRALHNQGRTQLTGRYHDSSDVKTAQDLTMWSSGTEQQRNNIAAQTKRSLEGWTQSRTPEGYNQLFSAFQPLKDTHNPLCTFPSQISGTRSNTWDTADARYPAQQANHNMLHGTWPFMPHSSGFRTNQQNYLVMPEAAKFTGKSAFTSLQGHGTDQCSTGWFGHIESSSRTDHASSSSIRPQPLVIGNDVQKTKGTSFKLFGIPLGSPEKSEPLVSPPSVAYDGKLQTSPSEKGNQLDIVGVDNCS

SEQ ID NO: 45176 - protein, 115 aa, Sorghum bicolor
  Clone ID: SORBI-28MAY03-C2573_1.pep
MSDLDVQLPSAFDPFAEANAEDSGAGPGTKDYVHVRIQQRNGRKSLTTVQGLKKEFSYNKILKDLKKEFCCNGTVVQDPELGQVIQLQGDQRKNVATFLVQAGIAKKENIKIHGF

SEQ ID NO: 45177 - protein, 89 aa, Sorghum bicolor
  Clone ID: LIB3481-011-Q6-K1-F3.pep
VRANAEDSGAGPGTKDYVHVRIQQRNGRKSLTTVQGLKKEFSYNKILKDLKKEFCCNGTVVQDPELGQVICESNAFKVHKNGTCWLWVY

SEQ ID NO: 45178 - protein, 180 aa, Sorghum bicolor
  Clone ID: SORBI-28MAY03-C28185_1.pep
LQYAVNAAFLASLYSDYLEAADTPGWYCGPNFYTTEVLRKFARSQLDYILGKNPLKMSYVVGFGNKYPKRPHHRGASIPHNGVKYGCKGGYKWRDTKKANPNILVGAMVAGPDRHDGYKDVRTNYNYSEPTLAANAGLVAALISISDIKTGRFGIDKNTIFSAIPPMFPTPPPPPSAWKP

SEQ ID NO: 45179 - protein, 191 aa, Sorghum bicolor
  Clone ID: SORBI-28MAY03-C28733_1.pep
MKLSMQSLARKLSLPSPTKRDAGGEGGKKNKKRSLSRGETPSFASSSSSSSDDALARSSTPRSVLPPPAAPLEIPRRELEAVLRRLGHAEPSDAELDAVAALAAQPPPADGDGDDLMEAFRVFDADGDGRITAEELRAVLEGILGGGPDACSLDDCRRMIGGVDADGDGFVGFQDFTRMMMTATADARTFL

SEQ ID NO: 45180 - protein, 498 aa, Sorghum bicolor
  Clone ID: SORBI-28MAY03-C2934_1.pep
MAMALRRLAGVSGSPSASAAAAALLLRPALTRPISTGFREERDTFGPIQVPNDKLWGAQTQRSLQNFDIGGERERMPVPIIRAFGVLKKCAAKVNMEYGLDPTIGKAIMQAAEEVAEGKLDDHFPLVIWQTGSGTQSNMNANEVIANRAAEILGHKRGEKFVHPNDHVNRSQSSNDTFPTVMHIAAAVELEARFIPSLQQLHDSLHSKTVEFKDIIKIGRTHTQDATPLTLGQEFSGYTTQVKYGIDRINCTLPRMYQLAQGGTAVGTGLNTKKGFDVKIAAAVAEETNLPFVTAENKFEALAAHDAFVESSGAVNTISASLMKIANDIRLLGSGPRCGLGELILPENEPGSSIMPGKVNPTQCEALTMVCAQVMGNHVGVTVGGANGHFELNVFKPMIAAGLLRSLRLLGDASVSFEKNCVRGIQANHKRISQLLHESLMLVTSLNPKIGYDNAAAVAKKAHKEGTTLKKAALDLGVLTEQEFHELVVPEKMIGPSD

SEQ ID NO: 45181 - protein, 141 aa, Sorghum bicolor
  Clone ID: SORBI-28MAY03-C29565_1.pep
TAVAGKVKSAGTATPGVGAQQDTTATPGAGGQDKGVTVTGYIAEKLRPGDEDRALSEAISGAVQRRKEDVGGTVAQRVPAPGQVITKAREAVTSLTGGNRVSETVQSTTATGEDVKEGYAAEAPVIRGEEIGGAKLNTNTM

SEQ ID NO: 45182 - protein, 544 aa, Sorghum bicolor
  Clone ID: SORBI-28MAY03-C463_1.pep
FPTSQLASESRLQPTAHHRRRRRWTRPPPPTMAMATALRKLSANALRRQPLSRMTPLHYMASLPATEERSGITWPKQLNAPLEEVDPEIFDVIEHEKARQWKGLELIPSENFTSVSVMQAVGSVMTNKYSEGYPGARYYGGNEFIDMAESLCQKRALEAFRLDPAKWGVNVQPLSGSPANFQVYTALLKPHERIMALDLPHGGHLSHGYQTDTKKISATSIFFETMPYRLDESTGLIDYDQLEKSAILFRPKLIVAGASAYARLYGYDRMRKICNKQKAVLLADMAHISGLVAAGVIPSPFDYADVVTTTTHKSLRGPRGAMIFYRKGLKEINKQGKEVMYDFEDKINAAVFPGLQGGPHNHTITGLAVALKQATTPEYRAYQEQVISNCAKFAQSLTAKGYELVSGGTDNHLVLVNLKNKGIDGSRVEKVLESVHIAANKNTVPGDVSAMVPGGIRMGTPALTSRGFVEEDFAKVADFFDAAVNLAVKIKAATTGGTKLKDFVATLQSDSIQAEIAKLRHDVEEYAKQFPTIGFEKETMKYKN

SEQ ID NO: 45183 - protein, 206 aa, Sorghum bicolor
  Clone ID: SORBI-28MAY03-C48548_1.pep
AYARTPTPCTGAGTTNTPLHVKFLMTTHRLVVNNFLVVVALPVAAAAVPRSTPPEEVLALVREIRPVHCLLVLLLAAAVAKLWRMGRPKDVYLVEYGCFRPKPCFRAPFATCLEHAHLMPYLVDEESVSFAIRLLERSGLGEETCVPEAYHYMPPDRSLEASRDETELVIFSAVDEVFARSSVRPEAIDVLIVNCSIFTPSPPGRA

SEQ ID NO: 45184 - protein, 369 aa, Sorghum bicolor
  Clone ID: SORBI-28MAY03-C5245_1.pep
TRVVVVHCKAGKARTGLMISSLLLFLKFFPTAEESIEYYNHEGCVDGKGLILPSQIRYVKYFERILTYFNGENQPPRRCMLRGFRLHRCPYWIRPSITVSNHNGVLFSTKKHPRTKELMPEDFWFSAPKKGIMVFALPGEPGLAEVAGDFKIQFHDRQGDFYCWLNTTMMENRVTLNPTDLDDFDKRKLPSPGFQVEVVLVDYDGSQPPKPKPATGPADNKSDADSSASTVAKENNAAPAESNKGTGSNDKDEVFSDSDGEDGSSKGRKEKIASGGQNSVNAAKPSETSNVQKEVSAAASRLDKVAITSEQGTTKAPDASLKTEVSSKTSSLTTAPPTAADNSSMSEFKAIAADASVFSFGDEEDYESE

SEQ ID NO: 45185 - protein, 323 aa, Sorghum bicolor
  Clone ID: SORBI-28MAY03-C31307_1.pep
MATDASGGGKPSLLSTLPKQLPADFLKEITNGFHADRKLGQGAFGTVYKGFLQDGQPIAVKKLSDNSPVATDKQFKNEVGNLMAIQHENIVRLYGYCHEAQKKVIEHNGRYILVDVVESMLCYEYAPKGNLDKCIFDMSSRPNWATCFKIIKGICQGLYFLHKGMDRPIVHLDLQPANILLDDNMVPKIADFGLSRLFGEEQTRINTINVVGAKGYMAPEYLYRGEISTRSDIYSLGVLIMEIATGQKNSMNDKDMSGRDFVDQVRQTWTDEHIASKYSSLDADSLQQVKTCIETGLKCVDIDQKKRPSIVEIVEKLDGRHAR

SEQ ID NO: 45186 - protein, 189 aa, Sorghum bicolor
  Clone ID: SORBI-28MAY03-C31494_1.pep
DSAGREGEDAGKGDGGERGRRAEAERKAKLDAIAEKQRQREIELEEKAKASREKLLKGSEAVRAPDSSPVALPPRESAAAPAAAAAAAAAAPAPSKYVPKFKRGGDSSSSSSGSQRPTDVRPRDEDRWGSREERSRPDVRPLRQDGPARQDAPPTRQDGPPPSTDRWRPGSRYSSNSSSSSSTWGRPRN

SEQ ID NO: 45187 - protein, 388 aa, Sorghum bicolor
  Clone ID: SORBI-28MAY03-C33348_1.pep
MGIESMSPTAAPAEDSSSSSSRFSAASTATTESGAAQPRAASAAPGGGAVVVGRDASLADEQAVTSQPLAASTAPAVAQGSPRFTGVLPQPNGRWGAQIYERHARVWLGTFADEEAAARAYDGAALRYRGREAPPHFPGAPAPAPELTFLAAHSKAEIVDMLRKHTFADELRQGLRRGRGMGARAQPTPAWARSLLFEKAVTPSDVGKLNRLVVPKQHAEKHFPLKRAPEASAAAATTGKGVLLNFEDGEGKVWRFRYSYWNSSQSYVLTKGWSRFVREKGLRAGDTIVFSHSTYSSEKQLFIDCKKTKTTTVATTDGAPVPAPAEKKPSEARVVRLFGVDIAGDGCQKRARPVEIAFEHGPQQELLKKKQCVGVAHHRSPALGAFLL

SEQ ID NO: 45188 - protein, 249 aa, Sorghum bicolor
  Clone ID: SORBI-28MAY03-C33831_1.pep
QGMLATMEMRARHDLLSKFVELVFPRKDTITFEVVMNEEAMDHVILAVARKKAAKTMQKEERDLQRFANVLTSAPAGRKWVSDELAVVAESKEVAGDIITEAVLDQVLGEKAFEKFGKWFISLHISDQLAGSYKKVLTFKFVLPDASKMSEMTRLVALVPYFIDLVGRYKLSSHARSKTDGARTKAAQEAFRELQSARQEALQRKKAEKKKLMEEADAKLSAEALRKKEEKERARQMKKSGPKVKMLRS

SEQ ID NO: 45189 - protein, 235 aa, Sorghum bicolor
  Clone ID: SORBI-28MAY03-C3186_1.pep
MEAEGAAAAAENGGAGKGSDSGSRFRRVCVFCGSSSGKRSSYRDAAVELGKELVARKVDLVYGGGSLGLMGEVSEAVHKGGGHVIGVIPTTLMGKEITGETVGEVRAVAGMHQRKAEMARNSDAFIALPGGYGTLDELLEVIAWAQLGIHSKPVGLLNVDGYYDFLLAFIDKAVDDGFIKPSQRHIFVSAPDASELVQKLEEYEAVQDEDPATPKLCWEIEQVGYNASLLAEIAR

SEQ ID NO: 45190 - protein, 67 aa, Sorghum bicolor
  unsure (1)..(67): unsure at all Xaa locations
  Clone ID: LIB3481-019-P1-K1-B7.pep
MWRMHTQVGLLNVDGYDEXLLAFIDKAVDDCFIKPSQRHIFVSAPGACELVQKLEVCMVNTSTYSTS

SEQ ID NO: 45191 - protein, 324 aa, Sorghum bicolor
  Clone ID: SORBI-28MAY03-C3457_1.pep
MVGGGRRGGAAEEVKLNTGNVFAALESLKKKKKGDKGKAAGSSSRKKSGEGAAQQQEPPQKELFWAPAPLTTKSWADVEDDDDDDYFATTAPPRPVWGTADEPVKEEEDVEDAVRAALQEDIESDDEDIDDEADDGAEDEPEHEAEDAPVEPAIKTAAAPAAPPKDTERQLSKKELKKKELAELDAVLAELGLSGNSSSAAQDAEKKGANQTGDAEKKEDAPAPSESKTSKKKKRKDKSLKEGKETQEAADGSEETASAGPDEDTTAVDVKERLKKMASMKKKKSSKEMDTAAKIAAAEAAARSARLAAAKKKEKSHYNQQPVR

SEQ ID NO: 45192 - protein, 291 aa, Sorghum bicolor
  Clone ID: SORBI-28MAY03-C3657_1.pep
MSSMELLHAVIPEKQSEELMAPAAATTTTTTSSSATAMSGDEVAHVPQGWAKKKRSRRQRSEEENLALCLLMLSRGGNHRVQAAPPLVPSAAPVAAEFRCSVCGKSFSSYQALGGHKTSHRVKLPTPPAPPAAAVPAAVPLVEVEAPAPLTVIPPPPVEVVVREPATSSTAASSDGAAASSRVHRCSICHKEFPTGQALGGHKRKHYDGGVGGSSAASTDVLAATAPAATAETSEVGSSGNGSSAARAFDLNLPAVPEFVFRCGKAGKMWEEDEEVQSPLAFKKPRLLMTA

SEQ ID NO: 45193 - protein, 377 aa, Sorghum bicolor
  unsure (1)..(377): unsure at all Xaa locations
  Clone ID: SORBI-28MAY03-C6120_2.pep
FGTRKSRSLLVVMGATNRPNSIDPALRRFGRFDREIDIGVPDEVGRLEVLRIHTKNMKLAEDVNLELISKDTHGYVGADLAALCTEAALQCIREKMDIIDLEDETIDAEILNSMAVTNDHFKTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEQSRLQIFKACLRKSPVAKDVDLNALAKYTPRVSGADITEICQRAFXYAIRENIEKDIE

SEQ ID NO: 45194 - protein, 225 aa, Sorghum bicolor
  Clone ID: SORBI-28MAY03-C6120_1.pep
PRVRESSTATSKSYTFREGDRVLNQLLTEMDGMNAKKTVFIIGATNRPDIIDPALLRPGRLDQLIYIPLPDEQSRLQIFKACLRKSPVAKDVDLNALAKYTQGFSGADITEICQRACKYAIRENIEKDIERERRRKDNPEAMEEDEVDEIAEIKAAHFEESMKYARRSVSDADIRKYQAFAQTLQQSRGFGSEFRFSEQSATAGAAAADPFASAGAAADDDDLYS

SEQ ID NO: 45195 - protein, 360 aa, Sorghum bicolor
  Clone ID: SORBI-28MAY03-C6330_1.pep
MMALQAQQGRWMSSLVLAIFFLAGVPRGGEAQPLVPAVLTFGDSTVDVGNNDYLHTILKANFPPYGRDFANHVATGRFCNGKLATDITADTLGFTTYPAAYLSPQASGQNLLIGANFASAGSGYYDHTALMYHAIPLSQQLEYFKEYQSKLAAVAGAGQAHSIITGALYIISAGASDFVQNYYINPFLYKTQTADQFSDRLVRIFHNTVSQLYGMGARRIGVTSLPPLGCLPAAITLFGHGSNGCVSRLNADSQSFNRKMNATVDALSRRYPDLKIAVFDIYTPLYDLATDPRSQGFTEARRGCCGTGTVETTVLLCNPKSVGTCPNATSYVFWDAVHPSEAANQVIADSLITEGLILVT

SEQ ID NO: 45196 - protein, 405 aa, Sorghum bicolor
  unsure (1)..(405): unsure at all Xaa locations
  Clone ID: SORBI-28MAY03-C626_1.pep
SPRYICIGAALKALSMLCCWIEKSNSDAFKRHLARVADFLWIGEDGMKVRVCAGQLWDVAFAVQAILACNIAEEYRSTLKKAHDFIKASQIMDNPSGDFSRKYRHISKGGWGFQVADQGWQVSDCTAEALKVLLMLSKFSSDIGSDQMETCRLYNAVNVLLSLQNPNGGYGTWELARTYPWMEIFDMTEIYADIMVAHQHVECTSSVMQALALFKEKYPWHRKDEIDQCIRGATEFIEKLQNDDGSWFGSWGICFTYXGTWFAIEGLSAVGQSYGNSTCIRKACKFLLTKQLNSGGWGESHLSSRTKPDTVLEWPTSPVVRTARASWARLTAAQVEADPSPLHKAARLIMSMQLGNGDFPQEEMIGSFLKNGPLCYMAYRNIFPIWALGEYQKLVLQCDLQRPTF

SEQ ID NO: 45197 - protein, 95 aa, Sorghum bicolor
  Clone ID: LIB3481-042-Q6-K1-B5.pep
RPVLWELVTGNLPFANMTAVQAAFAVVNKGVRPAIPHDCLPALGEIMTRCWDADPEVRPPFTEIVRMLEQVEMEVLTTVRKARFRCCVAQPMTLD

SEQ ID NO: 45198 - protein, 233 aa, Sorghum bicolor
  Clone ID: SORBI-28MAY03-C5795_1.pep
MEEVAVSPMVAAAVVLDNNGADTVSSTTIPSVTVSIEEKEEINGDVPTITSAASNEFELFTTPVSSRSPSTRKKRGAFGLFRAMFLSFGRSDSIKKTGGDTTSPKKRAIAADAVDYKPAGDESPSWKNIVDSMRPLRLRGQELEYYPPPPPLGHADVYHDVILPPPSPARSGFEFEEVGMLCKKHGLTYSAASFWGANVLTWKTLRAAALQARSATSGAAPKNLVWEALNTHG

SEQ ID NO: 45199 - protein, 133 aa, Sorghum bicolor
  Clone ID: LIB3476-010-P1-K1-H6.pep
FTICGIQHVQFCLNHFSSDVYVGPPKGNDWFEKQTAGTLDILCPPWMDWFHGGLQFQIEHHLFPRLPRCHLRKVAPAVRDLCKKHGLTYSAASFWGANVLTWKTLRAAALQARSATSGAAPKNLVWEAFNTHG

SEQ ID NO: 45200 - protein, 141 aa, Sorghum bicolor
  unsure (1)..(141): unsure at all Xaa locations
  Clone ID: SORBI-28MAY03-C4108_1.pep
GGCLSVLRFTICDCNRATYCVLCFANCNVAVGCLIRKCFSLASAIYETDGSLIIMMTLCDEKKKKKRPLXXXXXXXXXXXXXXXXXXXXXXXXXXXXXXXXXXXXXXXXXXXXXXXXXXXXXXXXXXXXXXXXXXXXXXXX

SEQ ID NO: 45201 - protein, 56 aa, Sorghum bicolor
  Clone ID: SORBI-28MAY03-C42000_1.pep
MESRGKILMKRYELGRLLGKGTFGKVHYARNLESNQSVAIKMMDKDKVLNVGLSEQ

SEQ ID NO: 45202 - protein, 241 aa, Sorghum bicolor
  Clone ID: SORBI-28MAY03-C42186_1.pep
HEDSSQGNSIYQLDMIKFAKKMYPEVDLIGGNVVTIAQAQNLIQAGADGLRVGMGSGSICTTQEVCAVGRGQATAVYKVSSYAKDHNVPVIADGGISNSGHIVKALSLGASTVMMGSFLAGSHEAPGTYEYKDGRRVKKYRGMGSLEAMTKGSDARYLGDTLKLKVAQGVVGAVADKGSVLRFIPYTMQAVKQGFQDLGADSLQSAHDLLRSETLRLEVRTGAAQVEGGIHGLVSYEKKAF

SEQ ID NO: 45203 - protein, 128 aa, Sorghum bicolor
  Clone ID: SORBI-28MAY03-C44257_1.pep
MAQGRGSARGSNAVVLALVLLCVLLHGEFAESAVYTVGDRSGWSFNTANWPKGKRFRAGDVLVFKYNAKAHNVVPVSAAGYRSCSAPRGVRALTTGNDRVTLKRGANYFICSFPGHCQGGMKIAVTAA

SEQ ID NO: 45204 - protein, 129 aa, Sorghum bicolor
  Clone ID: SORBI-28MAY03-C44533_1.pep
DKYDYAIVVVGEPPYAETFGDNLNLTIPAPGPSVIQSVCKATKCVVVLISGRPLVVEPYVGDMDAFVAAWLPGSEGQGVADVLFGDYGFTGKLSRTWFKSVDQLPMNVGDKHYDPLFPFGFGLTTKGAK

SEQ ID NO: 45205 - protein, 302 aa, Sorghum bicolor
  Clone ID: SORBI-28MAY03-C4506_1.pep
MATPTATALTCSCRPSPSPSPSPSSSVASRRLNIFAPLSPRRRRLLRLAPLHVVDDSSTDLPEERSRTDKMVDGMDFGELCNDFECISSPYVESTARQIARDILELRDDNRAFNCYAVSVKYKDPLRTFVGREKYKRPLWITKALEKPVVTVQEMSMQSTSNLTIKWAFRGKPKNPFFATMGGDVIVRVVSQFVLNQISGQVLEQVDSWDLSASSFPAQAYFWLSRRVYSTVESGKDTIEAAKSTTSGLTKGDQNFEAYPDPSSDPTKFFQRPDDGFNQDVYQIGFLLAVIYFIVQFLRTVL

SEQ ID NO: 45206 - protein, 233 aa, Sorghum bicolor
  Clone ID: SORBI-28MAY03-C4606_1.pep
MACPAQSMLSLSASGGIFLRSKPQAAAACHVRGGIIIGGGSSRPFLLTCNASSPPAPTQEDPDCNEEECAPEKEVGSLSAEWLAEERTQVVGTFPPKKRKWGYVEKDTAGQTNIYSVEPMVYVAESAISSGTAGTSAEGAENTAAIAAGLVLITVAAASSILIQVNKSQPKVTPEAAYNGPPLSYYVAKFQPAAVAQTLEAPAPAEAVEAAAPEATTSTVDASAAPEAQQLSS

SEQ ID NO: 45207 - protein, 332 aa, Sorghum bicolor
  Clone ID: SORBI-28MAY03-C7319_1.pep
MRRTAAAALVFIPLLAAAVQTSSLPFIVLHGIGDQCANHGVAKFTKLLAGWSGSDGHCLEIGRGTWDSWVMPLQQQADIICNKVKEMKQLRDGYNIVGLSQGNLIGRAVVEYCDDGPPVKNFISLGGPHAGTASVPLCGSGILCILVDALIKLEIYSDYVQEHLAPSGYLKIPTDMADYLKSCRFLPKLNNEIPEKRNATYKERFSSLENLVLIMFQDDAVLIPRETAWFGYYPDGAFDPVLPPQKTKLYEEDWIGLKTLDKAGRVKFVSVAGGHLGISKSDMKKYIVPYLTSKASVKTLLRWSLSDLLGGTWHAALGLMEGDGAVLDSPSS

SEQ ID NO: 45208 - protein, 296 aa, Sorghum bicolor
  Clone ID: SORBI-28MAY03-C7371_1.pep
RLMGRAASHITLECALQTHPNAALIGEEVAEKKQTLKNVTNYITDIICKRADLGYNYGVILIPEGLIDFIPEVQKLIAELNEILAHDVVDEAGAWKSKLQPESKELFEFLPKTIQEQLMLERDPHGNVQVAKIETEKMLISMVETELEKRKAEGRYSAHFRGQAHFFGYEGRCGLPTNFDSNYCYALGYGAGALLQSGKTGLISSVGNLAAPVQEWTVGGTALTSLMDVERRHGKFKPVIKKAMVELDAAPFKKYASMRDEWAIKNRYISPGPIQFSGPGSDDSNHTLMLELGAEL

SEQ ID NO: 45209 - protein, 334 aa, Sorghum bicolor
  Clone ID: SORBI-28MAY03-C74_1.pep
TRIALVCGNCVVWKGAPTTPLITIAMTKIVASVLEKNNLPGAIFTSFCGGTEIGQAIAVDTRIPLVSFTGSTRAGLMVQQQVNARFGKCLLELSGNNAIIVMDDADIQLAVRSVLFAAVGTAGQRCTTCRRLILHESIYQTFLDQLVEVYKQVRIGDPLEKGTLLGPLHTPASKENFLKGVQTIKSQGGKILFGGSAIESEGNFVQPTIVEITPSAAVVKEELFGPVLYVMKFQSLKEAIEINNSVPQGLSSSIFTKRPEIIFKWLGPHGSDCGIVNVNIPTNGAEIGGAFGGEKATGGGREAGSDSWKQYMRRATCTINYGSELPLAQGINFG

SEQ ID NO: 45210 - protein, 264 aa, Sorghum bicolor
  Clone ID: SORBI-28MAY03-C805_1.pep
NLPSGSYVFLQLEKEEILAPHTHFCLICGKGFKRDANLRMHMRGHGDEYKTPAALAKPTKDSGADHAPVTRYSCPFVGCKRNKEHKKFQPLKTILCVKNHYKRSHCDKSYTCSRCNTKKFSVIADLKTHEKHCGRDKWLCSCGTTFSRKDKLFGHVALFQGHTPALPMEDVKVSEASELPQDSEPTNEMARSMVYSFPSSSSDGISNLDMKMADDVRGYFSPLNFDPCFGALDDFTRPGFDISENPFSFLPSGSCSYGQQNGDS

SEQ ID NO: 45211 - protein, 74 aa, Sorghum bicolor
  Clone ID: SORBI-28MAY03-C716_2.pep
MSSTAAAAPECGGAKTSWPEVVGKSVEEAKKVILKDKPDADIVVLPVGSPVTMDYRTNRVRIFVDTVAQTPHVG

SEQ ID NO: 45212 - protein, 74 aa, Sorghum bicolor; identical to SEQ ID NO: 45211
  Clone ID: SORBI-28MAY03-C716_1.pep

SEQ ID NO: 45213 - protein, 73 aa, Sorghum bicolor
  Clone ID: LIB5051-004-A1-XP1-E8.pep
MSSTATAADCGGAKTSWPEVVGKSVEEAKKVILKDKPDADIVVLPVGTIVTADFVPNRVRIFVDTVAQTPHIG

SEQ ID NO: 45214 - protein, 74 aa, Sorghum bicolor; identical to SEQ ID NO: 45211
  Clone ID: LIB5047-008-R1-XP1-A12.pep

SEQ ID NO: 45215 - protein, 74 aa, Sorghum bicolor
  Clone ID: LIB3481-016-P1-K1-D11.pep
MSSTATAAPECGGAKTSWPEVVGKSVEEAKKVILKDKPDADIVVLSVGSPVTMDYRTNRVRIFVDTVAQTPHVG

SEQ ID NO: 45216 - protein, 314 aa, Sorghum bicolor
  Clone ID: SORBI-28MAY03-C82653_1.pep
MTSAHPPYGETYFGPPTCRCSDGRVVVDFLSTQFGLPFPPPPEPGRPALQLPAAVVPANLLRRLRQRLRELPGQLPVRVRRVRGQRLQRDAVRATAVCGQSCKSYLANSLFVFGEFGGNDYNAMIFGGYTIEQARKYTPKIVNTISRGIDKLIGLGATDIVVPGVLPIGCFPIYLTIYQSSNSSDYDDLGCLKSFNDLSTYHNTLLQKRVDIIQSRHRKTARIMYADFYSAVYDMVRNPQTYGFSSVFETCCGSGGGKYNYQNSARCGMSGASACANPATHLSWDGIHLTEAAYKQITDGWLKGPYCRPPILHN

SEQ ID NO: 45217 - protein, 562 aa, Sorghum bicolor
  Clone ID: SORBI-28MAY03-C791_1.pep
MAASGLGLSTSFLPGHDTLLRRRRRRPASPSTASFRPVTAELGGVAAGLGRQLVEAVGVGLPCTVMQCGDVIYRSTRPQPDGPPVAAPAPPRAPPAVSYLWATPGVAPGFFDMFVLAFAERLFRPTFRKDDFVLGKKLGEGAFGVVYKASLANPEAAKKQGDVVVKKATEYGAVEIWMNERVRRACASSCADFLYGFRETKAKGKGAEEYWIIWRFEGEDTLYDLMQSKEFPYNVETKILGNVQDLPKGIARENKIIQTVMRQLLFALDGLHSTGIVHRDIKPQNVIFSEGSRTFKIIDLGAAADLRVGINYIPKEFLLDPRYAAPEQYIMSTQTPSAPSVPVATTLSPVLWQLNLPDRFDIYSLGLIFLQMAFPSLRTDSSLIQFNRQLKRCDYDLQAWRNLVEPRATAELRRGFDIMDLDNGIGWELLTSMVRYKARQRTSAEGALAHPYFNREGLLGLSVMQNARLQLFRATQKDYSEAARWVIGLMARSGTEEVGGFTEAQLQELREIKPKKGNAQRNVLASVLRLQKKIVKTINESMDELASQRKSIWWSRWIPREE

SEQ ID NO: 45218 - protein, 120 aa, Sorghum bicolor
  Clone ID: LIB3478-048-P1-K1-C3.pep
MSGSQLCTDWSSSALASRVSTTQRRGRSGPSSGPGVGAVVRFPSLRTDSSLIQFNSQLKRCDYDLQAWRNLVEPRATAELRKGFDIMDLDNGIGWELLTSKGRDKARQRTNAEGAMAHPY

SEQ ID NO: 45219 - protein, 447 aa, Sorghum bicolor
  Clone ID: SORBI-28MAY03-C9039_1.pep
MGQKDSKPSYGYGYSYDYGSTSSGYNSRNTGNTSSGYSARYAPSSENNVQPETTARLQRKYSRIGDDYRSLSQVTEALAQAGLESSNLIVGIDFTKSNEWTGKISFNRRCLHDIGNTPNPYEQAISIIGRTLSAFDEDNLIPCFGFGDASTHDQEVFSFYPENRPCNGFEEALDRYREIVPTLRLAGPTSFAPIIETAVGIVDSTGGQYHVLLIIADGQVTRSVDTQSGQLSPQERATIDAIVRASQFPLSIVLVGVGDGPWDMMHQFDDNIPARSFDNFQFVNFTEIMSKSVAADRKEAEFALSALMEIPTQYKATLDLQLLGRRQRITPRIALPPPIRNAYSRSTSFSQQSGVYSRSSSFDQQTSGFQQRSESLKQQQPAAPKRPDTDTYASERALEDRILCPICMYKSKDLAFGCGHQTCYECGKNLERCPLCQQHITTRIRLY

SEQ ID NO: 45220 - protein, 271 aa, Sorghum bicolor
  Clone ID: SORBI-28MAY03-C9171_1.pep
MTVIDILTRVDAICQKYDKYDVDKLNGANVAGDDPFARLYASVDADINQCVEKAETAKQEKNRAAVVALNAEIRRTKAKLIEEDLPKLQRLAVKKVKGLTREEIATRSDLVAALPDRIQSIPDGSSTATKKNGTWGGASGSRTGGAIKFDSTADGNFDDEYFKGTEESNQFRREYEMRRMKQDEGLDVIGEGLETLKNMASDMNEELDRQVPLMDEMDDKVDRANADLKNTNVRLKETVLQLRSSRNFCIDIILLCVILGIAAYLYNVLKK

SEQ ID NO: 45221 - protein, 132 aa, Sorghum bicolor
  Clone ID: SORBI-28MAY03-C949_1.pep
MALEWVVLGYAAGAEAIMLLLLTLPGLDGLRRGMISVVRSALKPMMSVVPFCLFLLMDIYWKYETRPTCDDEHACTPSEHLRHQKSIMKSQRNALLIAAALLLYWILFSVTQLVVRLEQMQQRVDKLKKRDD

SEQ ID NO: 45222 - protein, 373 aa, Sorghum bicolor
  Clone ID: SORBI-28MAY03-C11651_1.pep
MAERLTRIAIVSEDKCKPKKCRQECKKSCPVVKTGKLCIEVTSASKLAFISEELCIGCGICVKKCPFDAIEIINLPKDLEKDTTHRYGPNTFKLHRLPVPRPGQVLGLVGTNGIGKSTALKVLAGKLKPNLGRFKNPPDWQEILTYFRGSELQNYFTRILEDNLKAIIKPQYVDHIPKAVQGNVGQVLEQKDERDMKAELCVDLELNQVIDRNVGDLSGGELQRFAIAVVAVQNAEIYMFDEPSSYLDVKQRLKAAQVIRSLLRPNSYVIVVEHDLSVLDYLSDFICCLYGKPGAYGVVTLPFSVREGINIFLAGFVPTENLRFRDESLTFKIAETQESAEEIETYQRYKYPTMSKTQGNFKLTVVEGEFTDS

SEQ ID NO: 45223 - protein, 129 aa, Sorghum bicolor
  Clone ID: SORBI-28MAY03-C13382_1.pep
MSSEKEAALAAVPNDSPTIFDKIIKKEIPSTVVYEDEKVLAFRDINPQAPTHILIIPKVKDGLTGLSKAEERHIEILGYLLYVAKVVAKQEGLEDGYRVVINDGPSGCQSVYHIHVHLLGGRQMNWPPG

SEQ ID NO: 45224 - protein, 249 aa, Sorghum bicolor
  Clone ID: SORBI-28MAY03-C1368_1.pep
MAAAAATSFATLAVARSAGQRSLLASKAAPSPLLSLRSAGLPSQAVSFSGGLAASTSHSRARFATSASAEPKEADLQSKITNKVYFDISIGNPVGKNVGRIVIGLYGDDVPQTAENFRALCTGEKGFGYKGSSFHRVISDFMIQGGDFDKGNGTGGKSIYGRTFKDENFKLVHTGPGVVSMANAGPNTNGSQFFICTVKTPWLDGRHVVFGQVLEGMDIVKLIESQETDRGDRPKKKVVISECGELPVV

SEQ ID NO: 45225 - protein, 127 aa, Sorghum bicolor
  Clone ID: SORBI-28MAY03-C64739_1.pep
HFFPHLELSLGSSGIRSRQVQLQHHHPPLPTAYLSAVQLPGRSSPNASAPSCCSTAGKTKGWSRRRSRDEARARAPASAIAHSHCRMPYSRHLLPLLFLMTHGLPCGARRWTGQPVKCQCTLGFRRR

SEQ ID NO: 45226 - protein, 397 aa, Sorghum bicolor
  unsure (1)..(397): unsure at all Xaa locations
  Clone ID: SORBI-28MAY03-C6522_1.pep
MAYMDFKDQDSVSKAIELSGTNMGGDPDQKVQEAAPSADKEGGSGEDEDRSTGESSDDEPTKAEQKKAPKASASSGSEDESSEDDSDEDSDEPANTPKKEAPVRASEKQTATKEPKTRMGSQNEATEXVRTLFMANVPWRDEFEDVKEFFADADGVVDVRFPTHDYVHRKGFCYVEFVSAEAAEKAFKEKQSTELQGREVRLDFAKGGRNTQTPRSGNDGSFQKPARGTSNSIFVRGFDKELSEDEIRSALQEHFKKCGDITRVSIPTDYESGAIKGMAYMDFKDQDSVSKAIELSGTDIGGGYELYVDEAKPKGDGQRGGGRFGDRSGGRFGSGGRRGGGGRFGDRSGGRDGGGRFGGRRGGRDGGARGRGGGGRGFGRQNAGTPSAGKKTTFGDD

SEQ ID NO: 45227 - protein, 375 aa, Sorghum bicolor
  Clone ID: SORBI-28MAY03-C66309_1.pep
MASSSLPAPAPGRAELLKAFDDNRTGVRGLVESGVSSVPELFRHPDPYGSIPLAPPGASIPVVDLSLPPHLAAAAAASAARTWGFFHLVNYHHALPAAAAAADDDYPARAFAAVRAFNELPAAERAPHYSRTTGGVNYSSNVDLYNSPAASWRDTIQILLGPNRSPDLADRIPAVCRAEVLEWEARATAVARTLLGLLSQGLGLRAEALEDASCADGKLMVCHYYPHCPEPERTMGLVPHTDPGVLTVLAQDAVGGLQVKHQDEDGKISWVDVKPVPGALVINVGDLLQIMSNDKYTSVEHRVVMNTREEPRVSIGIFFSPGKRGDSVFYGPLPELVSSENPPKYSNFTMSEFYGKFFSRDLASKALLDNFKLSS

SEQ ID NO: 45228 - protein, 126 aa, Sorghum bicolor
  Clone ID: SORBI-28MAY03-C6468_2.pep
VMPLEVLLTSYKRLVVKDSAVNAICYGAKLMIPGLLRFENDIETGEEVVLMTTKGEAIAIGVAEMTTAVMATCDHGAVAKIKRVVMDRDTYPRKWGLGPVALKKKKLIAEGLLDKHGKPNEKTPTE

SEQ ID NO: 45229 - protein, 563 aa, Sorghum bicolor
  unsure (1)..(563): unsure at all Xaa locations
  Clone ID: SORBI-28MAY03-C6468_1.pep
MGDVCFSTPLIDRDGVFYVSGLENFMRDARFGEWGRYCDGVXLVGHRCGGKRTPWYRLFGPKGREREAFRAKEETAXPGGTPEAKTIDWCTSGLDWEGTGGGESGEDDEAGETHRGWFALAVSDSGLINMWGHGVGREHAANRPLVKAVFQAMVXGYVPAXTTCVDVHRDGCHSPLESREPILGEDIQKIWDSVPMPHAHKETPLSEFFDVQVVALEKEEKEEQGRKRRGSXLRXSVRRSLPPGGLAGDRRGVVPAARGSFSSQEFWKVIKENKDLDLPAHKVMVATVRCEEIGNEKVASFTADEEWQQFEEAVQHDFVPGFGKKLSSLLDRCLPEDDMEAIYFDEGVRSSKRQQLESKLLQLVNPAYQSLLGHLRTRTLEAFKESFDKALEKEGFAVAARNCSQTFLEKFEKGSEDAAIQQVNWDTSKVKDKLRRDIEAHIASVRATKLSELCAKYEAQLTKALAEPVESLLDSASEDTWPAIRKLLQRETKTAVSGLESAVSAFELDEASEKELLVKLEKHGRSVVESKAKEEAGRVLIRMKDRFSTLFSRDADSMPRVWT

SEQ ID NO: 45230 - protein, 209 aa, Sorghum bicolor
  Clone ID: SORBI-28MAY03-C67060_1.pep
MAMAKSLSPPAVLIFALLFSYAASIASSQATSSSDGFLQCLSASIPSQLVFTQSSPSFTPLLKSSIKNPKFFTPSIVRPLYIVTPTNASHVQATVLCGRRNGMRIRVRSGGHDYEGLSYRSERPEVFAVLDLSNLRAVRVDRQTSTAWVDSGATLGELYYAVGKASNLLGFPAGLCPTVGVGGHFSGGGFGMLLRKYGLAIDNVVDAVL

SEQ ID NO: 45231 - protein, 208 aa, Sorghum bicolor
  Clone ID: SORBI-28MAY03-C68855_1.pep
TRAGSKGITAFIIEKGMPGFSTAQKLDKLGMRGSGTCELVFENCFVPRENVLGEEGKGVYVMMSGLDLERLVLAGGPIGLMQACLDVVLPYVRQREQFGRPIGEFQFIQGKMADMYTSLQSSRSFVYSVARDCDNGKVDRKDCAGVILFAAENATQVALQAIQCLGGNGYINEYPTGRLLRDAKLFEIGAGTSEVRRMIIGRELFKED

SEQ ID NO: 45232 - protein, 206 aa, Sorghum bicolor
  Clone ID: SORBI-28MAY03-C68948_1.pep
MQRWLPALLRRAAPAVSGGGAARLFASSSLLYDDTQVQFKDSVRKFAQEAIAPHAAAIDASNHFPREVDLWRLMGDFNLHGLTAPEEYGGMGLGYMYHCIAMEEITRASGAVGLSYGAHSNLCINQLVRHGNPEQKLKYLPKLISGEHIGALAMSEPNSGSDVVSMKCKAEKVDGGYVLNGNKMWCTNGPSAQTLVVYAKTDLAAG

SEQ ID NO: 45233 - protein, 426 aa, Sorghum bicolor
  unsure (1)..(426): unsure at all Xaa locations
  Clone ID: SORBI-28MAY03-C71559_1.pep
MANVHKITLVLMFCLLVLGRADYLKYKDPKQPIAVRVKDLLSRMTLAEKIGQMTQIERENATADALAKYFIGSVLSGGGSVPAPQASAEAWASMVTEMQKGALSTRLGIPIIYGIDAVHGHNNVYKATIFPHNVGLGATRDPDLVKRIGEATALEVRATGIPYAFAPCIAVCRDPRWGRCYESYSEDPKVVQSLTSLISGLQGDAPADFVGRPYVGGSKKVAACAKHYVGDGGTYXGINENNTIIDTHGLMSIHMPPYYNSIIRGVSTVMTSYSSWNGKKMHANHFLVTDFLKNKLKFRGFVISDWEGIDRITTPPHANYSYSIEAGVGAGIDMIMVPFRYTEFIDDLTTQVQNKVIPMSRIDDAVYRILRVKFTMGLFENPYPDASLAGEIGKQEHRELAREAVRKSLVPLKNGKSSSAPLLPLP

SEQ ID NO: 45234 - protein, 148 aa, Sorghum bicolor
  Clone ID: SORBI-28MAY03-C14833_1.pep
MAVSIELTKEYGYVVLVLVAYAFLNFWMSFQVGKARKKYKVFYPTMYAIESENKDAKLFNCVQRGHQNSLEMMPLFFVMLLLGGLQHPTIAAGLGVLYVVARFFYFKGYATGVPDNRLKIGGLNFLAVIGLIICTASFGINLVIRETL

SEQ ID NO: 45235 - protein, 622 aa, Sorghum bicolor
  unsure (1)..(622): unsure at all Xaa locations
  Clone ID: SORBI-28MAY03-C14268_1.pep
MDFMKVFDQTVREIKREVNLKVLKVPEMEQKVLDATSDEPWGPHGSALSELAHATKKFAECQMVMNVLWTRLSERGANWRHVYKALTIIEYLIANGSERAVDDILDHYSKISVLSSFEYVEPNGKDAGINVRKKVETIVGIINDKERIKAVRDKAASNRDKYLGLSSTGITYKSSSASFGSNYSSGERYGSFSGEKEADSYGDSYRDKEPVKTSTSNSGVRKSGSKLRKDAKPDRRNEDSPSSFNPSSNTNNTEDGFDDFDPRGSNGKTTAKPNEVDLFGPNLMDDFIDTSAATPATESAVEPQVDLFADADFQSATETAANTDVQGNVDLFAEKASFPAAFPPQAGFIPPPSAGTSSENTSVSKKAAPEPFDPFGAIPLNSFDGSDPFGGFSSNAGSSTAAPPTHSSTGNISTRDQNLQAASDFGAFVSNNEGAAKDPFDLSSSANVRKTPLAAPKIDASDFGAFVSSTEEAAKDPFDLSSGSNLGRTDQAPAAAPKPNMKKENFQVKSGIWADSLSKGLIDLNITAPKKVNLADIGIVGGLGDGSDEKAMPSWTMGTGXWARNIWDSTINTRRWHRELSQLQQASIRLQISLELSPFIQENMSPAVSSSAGLLLPYTLLI

SEQ ID NO: 45236 - protein, 239 aa, Sorghum bicolor
  Clone ID: SORBI-28MAY03-C16552_1.pep
MASSQCCDNPPALNPACGEGKVVDSFGGLKAYVAGPEDSKAAVVLVADVFGFEAPILRKIADKVASSGYFVVVPDFFHGDPYVPENGKPIPEWLKSHTPEKGFEEAKPVIATLKEKGVSAVGAAGYCWGAKVVVELAKAHEIQAAVLLHPSFVTIDDIKEVKCPISILGAEIDKMSPPELVKQFEQVLSVNSGVGHFVKIFPGVAHGWSVRYSHDDAAAVKSAEEAFADMLDWFNKNLK

SEQ ID NO: 45237 - protein, 207 aa, Sorghum bicolor
  Clone ID: SORBI-28MAY03-C8032_1.pep
MTAQAAEELAAQIEQQKLEEQKTEAEEVVVEDEDDDDEDDDDDDKDDDELDGHEGDASGKSKQSRSEKKSRKAMLKLGMKPITGVSRVTVKKSKNMLFVISKPDVFKSPNSDTYVIFGEAKIEDLSSQLQTQAAEQFKAPDLSQMISKPETSGLGQEDNEEEVDETGVEAKDIELVMTQATVSRAKAVKALKASNGDIVTAIMELTN

SEQ ID NO: 45238 - protein, 400 aa, Sorghum bicolor
  Clone ID: SORBI-28MAY03-C942_1.pep
MADGEDAAAARRRAAITDYRKKLLNCRELESRVGTVRESLKNAKKDFTKTEDDLKSLQSVGQIIGEVLRPLDNERFIVKASSGPRYVVGCRSKVDKEKLTSGTRVVLDMTTLTIMRTLPREVDPVVYNMLHEDPGNVSYSAVGGLSDQIRELRESIELPLMNPELFLRVGIKPPKGVLLYGPPGTGKTLLARAIASNIDANFLKIVSSAIIDKYIGESARLIREMFGYARDHQPCIIFMDEIDAIGGRRFSEGTSADREIQRTLMELLNQLDGFDELGKVKMIMATNRPDVLDPALLRPGRLDRKIEIPLPNEQSRMEVLKIHAAGIAKHGEIDYEAVVKLAEGFNGADLRNVCTEAGMAAIRAERDYVVHEDFMKAVRKLNDAKKLESSAHYSADFGKE

SEQ ID NO: 45239 - protein, 519 aa, Sorghum bicolor
  Clone ID: SORBI-28MAY03-C993_1.pep
MQFSSVFPLEGKACMSPVRRGGEGAWSERVRIGNSCSIRRNKALRRMCFGARGAVSSAQCVLTSDAGPDTLVVRTSFRRNYADPNEVAAVILGRGAGTQLFPLTSTRATPAVPIGGCYRLIDIPMSNCFNSGINKIFVMTQFNSASLNRHIHRTYLGGGINFTDGSVEVLAATQMPGEAAGWFQGTADAVRKFIWVLEDYYKHKAIEHILILSGDQLYRMDYMELVQKHVDDNADITLSCAPVGESRASDYGLVKFDSSGRVIQFSEKPKGAALEEMKVDTSFLNFAIDDPTKYPYIASMGVYVFKRDVLLDLLKSRYAELHDFGSEILPKALHEHNVQAYVFTDYWGGHGTIRSFFDANMALCEQPPKFEFYDPKTPFFTSPRYLPPTKSDKCRIKDAIISHGCFLRECAIEHSIVGVRSRLNSGCELKNTMMMGADLYETEDEISRLLSEGKVPIGVGENTKISNCIIDMNARVGRNVSITNTEGVQEADRPELGYYIRSGIVVILKNATIKDGTVI

SEQ ID NO: 45240 - protein, 275 aa, Sorghum bicolor
  Clone ID: SORBI-28MAY03-C7873_1.pep
MDRYHRVEKPRNDTPISQNEIRITTQGRMRNYISYGMSLLEENGHDEINIKAMGRAINKTVMVVELIKRRVGGLHQNTATESVDITDTWEPLEEGLLPLETTRHVSMITVTLSKKPLDTSSPGYQPPIPAEEVKPAFDYDHEESYPTGRGRGRFGGRRGRGRGMSNGPPPPAYGYNDEWEEDGDYYNRGRGRGRSRGRGGRGRGGYYGGGRRGGYGYDYGYGGRGGYYEEQDEYYDEPEEYAPPPGRGRGRGRRGMPWRGRGGRGPPRGGRGGYY

SEQ ID NO: 45241 - protein, 74 aa, Sorghum bicolor
  Clone ID: LIB3476-040-P1-K1-E6.pep
DYYNRGRGRGRSRGRGGRGRGGYYGGGRRGGYGYDYGYGGRGGYYEEQDEYYDEPEEYAPPPGRGKPQTDDVTC

SEQ ID NO: 45242 - protein, 204 aa, Sorghum bicolor
  unsure (1)..(204): unsure at all Xaa locations
  Clone ID: SORBI-28MAY03-C10_1.pep
STWTSLLVARAQTCTASVVFTLAPLLGAFETPPYGLMGIPRSGTPSIRPMRRRPRGSASSRXDLTALHEMLEKTGYKDDEGTANELSFQMWTNQMQDTLNSKKKGDNAFRQKDFTTAIDCYSQFIEVGTMVSPTIYARRCLSYLMNGMPQEALNDAMNALVISPTWSTAFYLQAAALLSQGMENEAQEALRDGCSLEQSSSGGH

SEQ ID NO: 45243 - protein, 133 aa, Sorghum bicolor
  unsure (1)..(133): unsure at all Xaa locations
  Clone ID: SORBI-28MAY03-C1027_1.pep
STPPPXTTPGDASAAAPYIPDFKRAFEHFCMHAASRDVLEHLQSNLGLRNSDLEASRAALHRFGNTSSSSIWYELAYLEAKGRVRRGDRVWQLAFGSGFKCNSAVWRAVRRVRRPARSPWLDCVDQYPARMDA

SEQ ID NO: 45244 - protein, 428 aa, Sorghum bicolor
  Clone ID: SORBI-28MAY03-C10664_1.pep
PKPLAARCLLCQFGHCLGITRGPADAASLLPPPDGRVRGSGEVASGSIWRPATPAPRLIRGSAPVWGLTQEAAKQSREGSGSTGDWTEVQGAWVLRPKASVPPFVLHVGGGIFVGAAPQITYRFFLEWLANRGALVIATPYASGFDHFFIADEVQFKFDRCLRNLDEPVNDIPTFGVGHSLGSVIHMLIGSRYAVQRSGNVLMSFNNKEASSAVPLFSPVIVPMAQSFGPILSQLTSYPTIRFGAEAAIKQLENLSPPVVKQLLPLLQQLPPLYMDLVNGREDFIPKPEETRRLIKSYYGISRNLLIKFKDDQIDETSTLAQVLSSEAAISSLLDMSIRSLPGDHGLPLQQVLPDVPPAMADAVNRGGELLANLTMGTPWEAVAKEVGTSLGTDSGILRAQISKDIETLVDVIASWISSNSGPRLLRP

SEQ ID NO: 45245 - protein, 87 aa, Sorghum bicolor
  Clone ID: SORBI-28MAY03-C1043_1.pep
MGQIQYSEKYFDDTYEYRHVVLPPEVAKLLPKNRLLSENEWRAIGVQQSRGWMHYAIHRPEPHIMLFRRPINYQQQQEAAAAQLLAK

SEQ ID NO: 45246 - protein, 181 aa, Sorghum bicolor
  Clone ID: SORBI-28MAY03-C24221_1.pep
HEELLNHYRYNWPVNHTSVSPDKKLLAVVGDDRDALLVDSRNGKVTSTLVGHLDYSFATAWHPDSQTFATGNQDKTCRIWDTRNLSTSLAVLRGNIGAIRCIRYSSDGRFLVFSEPADFVHVYSVAADYKKRQEIDFFGEVSGITLSPDDESLFVGVCDRVYASLLQYRMIHAFDYLDSYV

SEQ ID NO: 45247 - protein, 256 aa, Sorghum bicolor
  Clone ID: SORBI-28MAY03-C24532_1.pep
MVALGQGGNRTKEAEEEAAARWESEKEAEIDYVFKVVVVGDSAVGKTQLLARFTRDEFALDSKSTIGVEFQTRTLTLHRKRVKAQIWDTAGQERYRAVTSAYYRGALGAMVVYDVTRRATFEHVARWVEELRAHADGSSTVVALIGNKADMPAGRREVAADEAARLAEEQGLFFSEASALTGDNVERAFLTLLEEVFAVVSRRALELDEARRMRGDQGQGDGGRGGEVLSLKGTAVDVGSIMETSAMKRSSQCACS

SEQ ID NO: 45248 - protein, 164 aa, Sorghum bicolor
  Clone ID: SORBI-28MAY03-C25340_1.pep
GKVTLAAVEKMELAKSVVWESLRLDPPVKFQYGHAKKDLLIESHDAVFQVKKGEMLFGYQPCATKDPRVFGDTAKEFVPDRFVGEEGSKLLQYVYWSNGRETENPSVDNKQCPGKNFVVLVGRLFLVELFLRYDTFTAEVATELLGASVVFTAVTKATSGAGSE

SEQ ID NO: 45249 - protein, 237 aa, Sorghum bicolor
  Clone ID: SORBI-28MAY03-C13902_1.pep
RYSMTSLDTVRGDLALVILYLNKAEARDKICRAIQYGSKFLSNGEPGPAQNVDKSTSLARKVFRLFKFVNDLHALISPPAKGTPLPLILLGKSKNAMLSTFLFLDQIVWAGRTGIYKNKERAEFLGRIAFYCFLGSNTCTTIIELAELQRLSASMKKLEKELKHQELYKNEQYRMKLQKSNERLLALIKSSLDIVVAVGLLQLAPKKVTPRVTGAFGFASSLIACYQLLPSPPAKSK

SEQ ID NO: 45250 - protein, 145 aa, Sorghum bicolor
  Clone ID: SORBI-28MAY03-C11131_2.pep
MDGSTHRCLASVLLRWSVGRVGEIQIWLAMAYEANRRHKDCIALYKELESTHPMINIRRQAAELRYILEAPKLKISNDEVVTIPQIGSSWDWYAGTWSDKIKEQEDKKRKMIAASNQVQPSPNIFGDFSFLRLPSEWKKSAWVIV

SEQ ID NO: 45251 - protein, 340 aa, Sorghum bicolor
  Clone ID: SORBI-28MAY03-C11131_1.pep
PPPVAGGVACSFPARGAGLLLGDAASLGAYHALRRRRTHLYRRNWGSKPLPRPPVWLGAAARVSRNRDDRRGHVPRFAASASGGRDEPGELAEDEAQRKREREAELNRRLKEAEEMEELERTAEQLQSQAAAEAPEESEEEKRERVRRELQKVAKEQAERRETAKQMFELGQRAYGKGMYGRSIEFLEAALTIIRPSSLLGGEIQIWLAMAYEANRRHKDCIALYKELESTHPMINIRRQAAELRYILEAPKLKISNDEVVTIPQIGSSWDWYAGTWSDKIKEQEDKKRKMIAASNQVQPSPNIFGDFSFLRLPSEWKKSAWVIVTLWVLLIGTAIYLQT

SEQ ID NO: 45252 - protein, 180 aa, Sorghum bicolor
  Clone ID: SORBI-28MAY03-C13992_1.pep
MYRAAGSHLRSLKHHGASRFASTNVVKQSSGGLFSWLLGGKSSQLPPLDVPLPGIAIPSPLPDFVEPSKTKVTTLPNGVKIASETSSSPAASVGLYIDCGSIYETPASSGVSHLLERMAFKSTVNRTHLRLVREVEAIGALVAASASPEQMSYSPLALASWGDVIHVPSYESVSRKFHSK

SEQ ID NO: 45253 - protein, 148 aa, Sorghum bicolor
  unsure (1)..(148): unsure at all Xaa locations
  Clone ID: LIB3480-010-P1-K1-E6.pep
GDHVQRGVRNNLLSDLPCVKRPEEPKSVYVGGDYRCQADSPSTHIALAFEVPGGWNQEKTAMVVTVLQMLMGGGGSFSAGGPGKGMHSRLYLRVLTNFQQIDSFSAFNSVYNNSGLFGIYAVTSPDFSSKAVDLAAGELLEXATPGKV

SEQ ID NO: 45254 - protein, 82 aa, Sorghum bicolor
  Clone ID: SORBI-28MAY03-C1211_1.pep
SSGGGWWRVVHGGGASANQRWWSVGWKIAKEQRDATKDFCILFVKFGVLMLVCISFYTHNGALLCIFVFLMLVSISFYTLLE

SEQ ID NO: 45255 - protein, 92 aa, Sorghum bicolor
  Clone ID: LIB3476-040-P1-K1-G3.pep
VDHASVNVPQTYDTNGKKSFQPCYITTKPPLTSHEIEESILTILWKTSLTESRHCCCPHHHPPPPIRTTLIHAVSQITGNSFRQQDRHRNMF

SEQ ID NO: 45256 - protein, 110 aa, Sorghum bicolor
  Clone ID: LIB3480-034-P1-K1-G7.pep
KCSIVCIETYAHKHKNTKFNKQNAKILGHVALLLCYLPSNRPPPLIRISAATVNYQHRGHGLHHAWTCHQNGFALIAFHFMQTTYSSKAATKNQIKPIQLSIEELGADNY

SEQ ID NO: 45257 - protein, 44 aa, Sorghum bicolor
  Clone ID: LIB3478-028-P1-K1-C12.pep
SACKKCIDQSIHMHRNSPGVSRGIHQFFKSKLRRNLSMNKTKHE

SEQ ID NO: 45258 - protein, 281 aa, Sorghum bicolor
  Clone ID: SORBI-28MAY03-C1615_1.pep
MEFEDRCHKVQEPKFDCLLFDLDDTLYPLSSGIAGHVKNNIEDYMVEKLGIDESKIENLGNLLYKNYGTTMAGLRAIGYSFDYDEYHAFVHGRLPYDNIKPDPVLKHILKNLRIRKLIFTNGDMVHAVRALERLGLEDCFEGIICFETLNPPCPPQGDEEPEIFDIAGHFARSGTADELPKTPVLCKPNVDAMEEALRIANVNPHKAIFFDDSVRNIQAGKQIGLHTVLVGKSQRVKGADHALESIHNIREALPELWEEAEKAKEDVLYAERVAMETSVTA

SEQ ID NO: 45259 - protein, 207 aa, Sorghum bicolor
  Clone ID: SORBI-28MAY03-C16319_1.pep
MVSLKLQKRLAASVLKCGKGKVWLDPNEVSEISMANSRQNIRKLVKDGFIIKKPQKIHSRSRARRAHEAKQKGRHSGYGKRRGTREARLPTKILWMRRMRVLRRLLRKYREAKKIDKHMYHDMYMKVKGNMFKNKRVLMESIHKSKAEKLREKTLSDQFEAKRAKSKASRERKIARREERLAQGPREPTAPVSATAPSAGAPKKAKK

SEQ ID NO: 45260 - protein, 242 aa, Sorghum bicolor
  unsure (1)..(242): unsure at all Xaa locations
  Clone ID: SORBI-28MAY03-C14000_3.pep
MAFNLAQCATAAASVAPRTPRPARSAVAASVSVSTRKAADGRLRLQRQASCEPSVAPSRSVFCRAAVSGKSAADRAASTRRRSGVPVFVMMPLDTVKKCGSALNRRKAVQASLSALKSAGVEGIMVDVWWGIAESDGXGRYNFAGYMELMEMARKAGLKVQAVMSFHQCGGNVGDSVNIPLPRWAVEEMEKDQDLCYTDQWGRRNYEYVSLGCDAMPGLKGRTPVECYTDFIAFGFTHAAAA

SEQ ID NO: 45261 - protein, 185 aa, Sorghum bicolor
  Clone ID: SORBI-28MAY03-C14000_2.pep
MMMPAMDDVDGGGREPPRECMTPVSVEEACRGASELHAGVDYDHCMASLGADPRSKEAGNKNMHGLAVLATKMAIDHAASTESKIDDLAELDADNQSSSPQARRARFNHCLEQYGGAADLLRDALDNLKAKIYGKAMEQLTAAMGASESCEDAWKGEEEIPVAAHDREYGRMAHIAFGFTHAAAA

SEQ ID NO: 45262 - protein, 95 aa, Sorghum bicolor
  Clone ID: SORBI-28MAY03-C14000_1.pep
AGENALPRYDETAHDQVVATAADRAAEDRMVAFTYLRMGPDLFQPDNWRRFAAFVKRMSQPGARDACREQVEREADGVAHATQPLVHEAAVALTN

SEQ ID NO: 45263 - protein, 354 aa, Sorghum bicolor
  unsure (1)..(354): unsure at all Xaa locations
  Clone ID: SORBI-28MAY03-C28732_1.pep
GKANDALHSSLVLTAASPRRRRRPDRCITISTTNRESSSSASALALLLLARALGGTAAAELYTGLFSLSSPGVYGADNSVMKPAIDGEKHMGPDLVRLFSHDCLVQGCDASLLLYDTDFFQGENMATHNNRSVRGFGHIGDDCWGVEXVCPGVVARRDILPCGASDCGDAWRVTFWSFXIFCNCEVIVLCLMCLHVISFXIMNESLLVLSAAQGLSQKDMVALSGAHTIGLARCTNFRAHIYNDTNIDGSFARSRQSVCPRTSGSGDNNLAPLALQTPTVFENNYYKTLVYKKGILHFDQEFFNGGSTDAQVQSYVSSQSAFFADFVTGMIKMGDIMPLTGSNGEIRKNCRRIN

SEQ ID NO: 45264 - protein, 422 aa, Sorghum bicolor
  Clone ID: SORBI-28MAY03-C3068_1.pep
MPMGRLRDGRAFLHRALVLSSLLLLASGEIFFEERFDDGWDSRWVKSDWKKSQGQTGTFRHTAGTYSGDPDDKGIQTTGDAKHFAISAKFPEFSNKDRTLVIQYSLKIEQDIECGGAYIKLMSGYLNQKKFGGDTPYSFMFGPDICGDQKKKLHLILSYQGQNYPIKKDLKCEADKLTHFYTFILRPDATYSILIDNREREFGSMYTDWDILPPRKIKDVNAKKPKDWDDREYIEDPDQVKPEGYDSIPKQIPNPKDKKPESWDDDEDGTWKPRMIPNPEYKGPWKRKKIKNPNYKGKWKTPWIDNPEFEDDPDLYVLKPLQYVGIEVWQVKAGSVFDNILICDDPDYARHVVDETFAANKEAEKEAFEGAERKRKAREEEEARRAREEGERRRRERDRDRGRDRYRDRYKRHRHYDYHDEL

SEQ ID NO: 45265 - protein, 143 aa, Sorghum bicolor
  Clone ID: SORBI-28MAY03-C32738_1.pep
GTFSLRQIRFASVDMELHTTYDPNGSLSIYDVDRRVAERTQVLAPLPEDRFLCSFSHIFAGGYAAGYYSYKWAEVLSADAFSAFEDAGLDNEKAIEETGRRFRDTVLALGGGKSPLEVFVSFRGREPSPEPLLRHNGLLPVAA

SEQ ID NO: 45266 - protein, 143 aa, Sorghum bicolor
  Clone ID: SORBI-28MAY03-C1728_1.pep
TVRRANQGASQPRPEQESILLQAQQQVQLQKLVYQVGALPTKVVCLTQVVTADELKDDEEYEDIMEDMRLEAGKYGTLVKVIIPRPDPSGQPVAGVGKVFLEYADIDGAAKAKTALHGRKFGGNPVVAVCYAEDKFANGEYDG

SEQ ID NO: 45267 - protein, 253 aa, Sorghum bicolor
  Clone ID: SORBI-28MAY03-C17718_1.pep
MEAYAAGAKFDCLLFDMDDTLYPLSLGINLACRKNIEEYMLNKLRIEESQVPKMCLDLYREYGTTMAGLKVLGYDFDYDDFHACVHGTLPYEKVKPDPVLRQLLLSLPQRKIIFTNSDKAHAARVLEKLGLEDCFEGIICFETLNPPPTEKKDDGRGILCKPSLESMEAVIEIAKLDAKRTVFFDDSARNIAAGKAAGFHTVIVGSSALVPGADVALESIHNIKEALPELWEAAGDHVEAVLRSAAVETTVIA

SEQ ID NO: 45268 - protein, 245 aa, Sorghum bicolor
  Clone ID: SORBI-28MAY03-C17664_1.pep
MDASHTGFSSAAGEAPTTGEHRMGTTIVGVCYDGGVILGADSRTSTGMYVANRASDKITQLTDNVYVCRSGSAADTQVISDYVRYFLHQHTIQLGQPATVKVAANLIRLLAYQNKNMLQAGMIVGGWDKYEGGQIFSVPLGGTILKQPFAIGGSGSSYLYALLDHEWKEGMSQEEAEKFVVKVVSLAMARDGASGGVVRTVTINADGVKRNFYPGDKLPLWHDELEPHHSLLDILAAGNPDPMVQ

SEQ ID NO: 45269 - protein, 631 aa, Sorghum bicolor
  Clone ID: SORBI-28MAY03-C2295_1.pep
HEGVVQLLSVAGGFISHLISDLINKKLKENEVARAIELREIVTSLGPAYIKLGQALSIRPDILSPAAMTELQKLCDKVPSFPDDIAMALLEEELGQPWQAIYSELSPSPIAAASLGQVYKGRLKETGELVAVKVQRPFVLAPGTIDLFIIRNLGLVLRRFPQVSVDVVGLVDEWAARFFEELDYVNEGENGTYFAEVMKEDLPQVVVPKTYHKYTSRKVLTTQWIEGEKLSQSTEDDVGSLVSVGVICYLKQLLDTGFFHADPHPGNMIRTPDGKLAILDFGLVTKLTDDQKYGMIEAIAHLIHRDYDAIVKDFVKLGFIPEGVNLDPILPVLAKVFDQALEGGGAKNINFQELAADLAQITFDYPFRIPPYFALIIRAIGVLEGIALVGDPEFAIVDEAYPYIAQRLLTDESPRLRSALRYTIYGKTGVFDAERFIDVMQAFENFIRAAKSGGGENLKGNMAELADLGGQPSTSLVPVFPMAIAQPEQPVKARAALAFLLSERGNFFREFILDEIVKAIDAISREQLIQIAASFGIGRATPVFSMVPVRARALLPTITEEDRVILNNVEKVVKFLTSGTATPTVGGDVNMVSVVQELLPVLPGISSKILPDVLSRLSSRVFARLIREAFL

SEQ ID NO: 45270 - protein, 220 aa, Sorghum bicolor
  Clone ID: SORBI-28MAY03-C23602_1.pep
MSVETERSSTESSAASGLDFEDTALTLTLRLPGSAPAPAAVAASLSSSSSSAFPDADRKRASSDANPDRSSPLAASSDAAPAPKARVVGWPPVRSYRKNALADVAGSSKANQAAKFVKVAVDGAPYLRKVDLQAYAGYDQLLRALQDKFFSHFTIRKFADDERKLVDAVNGTEYVPTYEDKDGDWMLVGDVPWKMFVETCQRLRLMKGSEAVNLAPRAAR

SEQ ID NO: 45271 - protein, 339 aa, Sorghum bicolor
  Clone ID: SORBI-28MAY03-C23684_1.pep
MRSWRPCSHARSPTVPLRLIRSRTTPTVLRPSVAAVPTVRTGHTYIKYLVTPKPRQPLPSSRNSSSKSKRQRRPISRAPSWRRATTSRGAAAAGTAATRSWRDGYNWRKYGQKQVKGSENPRSYYKCTYHSCSMKKKVERSLADGRITQIVYKGAHNHPKPLSTRRNSSSGGVVAAGEEQQAAANSLSAAAAAAGGCGPEHSGATAENSSVTFGDDEAENASHRSDGDEPDAKRWKQEDGENEGSSGGAGGKPVREPRLVVQTLSDIDILDDGFRWRKYGQKVVKGNPNPRSYYKCTTVGCPVRKHVERASHDTRAVITTYEGKHNHDVPVGRGAASRA

SEQ ID NO: 45272 - protein, 369 aa, Sorghum bicolor
  Clone ID: SORBI-28MAY03-C23876_1.pep
MATTRTLELTLISAKDLKDVNLMSKMEVYAVVSLSGDPRSRQRVQADRIGGRNPTWNATVRFAVPATGAGSLHVLLRAERALGDRDVGEVHIPLSELLSGASDGPVPAKFVAYQVRKISSGKPQGVLNLSYKLGEVTRSAAAANGYAPAQSAYTQAAAYPPPSAYPPPSGKADAYAPPAAAYPPPSGKADAYPPPAAYPPAGKADAYPPPGGAYPPTGGKADAPATAYPASSGYPTAAGKPAKAGEPVTAYPAAGPSTAAPYAAPPPQYGGYGYPPQQAAGYGYPPPPPQAGYGYGYPPQQAAGYGYQQQAVKPQKKKNNFGMGLGAGLLGGAVGGLLIGDMMSDASAYDAGYDAGFDDGGGFDGGFDF

SEQ ID NO: 45273 - protein, 407 aa, Sorghum bicolor
  Clone ID: SORBI-28MAY03-C5381_1.pep
MAAALQATPLKTLAISRRRVGVAGVRQRPMVASFRCSAAARSYNITLLPGDGIGPEVVAVAKDVLSLAGALEGVELRFQEKLVGGSALDATGVPLPDETLDAAKGSDAILLGAIGGYKWDNNEKHLKPETGLLQLRAGLGVFANLRPAAVLPQLVDASTLKKEVAEGVDIMVVRELTGGIYFGKPRGFGTNDKGEDIGFNTEVYSASEIDRIARVAFEVARKRRGKLCSVDKANVLEASMLWRKRVTALASEFPDIELSHMYVDNAAMQLVRNPKQFDTIVTNNIFGDILSDEASMITGSIGMLPSASVGESGPGLFEPIHGSAPDIAGQDKANPLATILSAAMLLRYGLGEENAAKRIEAAVTATLNHGFRTGDIYSPGTTLVGCKQMGEEVLKTVESLKEVAAVN

SEQ ID NO: 45274 - protein, 184 aa, Sorghum bicolor
  Clone ID: SORBI-28MAY03-C4636_2.pep
VHGVLRHGGERGELRRVRREREQEGHGGVRVRRAGGVEGAAGVQGGEGHQRHGLGVLQPAEADGEGVPDVPVRDPRAGAAQRRARQPGALRRRAPGPDRDRRRRALRRARRRSRPGVLRVRGGGRRRAQPHLRDVRAEQAVCALRHRAQRRVEPRRGHAPTPARVLQDHPVRRPVAVHRDLALI

SEQ ID NO: 45275 - protein, 332 aa, Sorghum bicolor
  Clone ID: SORBI-28MAY03-C4636_1.pep
MGMVLAFVAVAALCCAPGAAELPRLEHHRANNDGGSLKLLVVGDWGRKGTHNQSRVAEQMGRVGENLGIDFVISAGDNFYKNGLKGAPGRAGGESFTDIYTAKSLQKPWYLVLGNHDYRGNALAQLSPVLRKIDDRFICMRSFIVNTELADFFFVDTTPFQLEYWTHRGKHHYDWRGVAPRGKYIANLLKDLDEAMKKSTARWKIVVGHHTMRSVSEHGDTEELLKLLLPVLKDNGADFYINGHDHCLEHISSRDSPLQYFTSGGGSKAWRGILRPNKDKLRFFYDGQGFMSLQLNQDQAQFIFYDVFGNTLYQWSSSKTRHPKPSTYLDEE

SEQ ID NO: 45276 - protein, 300 aa, Sorghum bicolor
  Clone ID: SORBI-28MAY03-C5413_1.pep
MALVQAGMGLTRVVVLVGAGVAGSVVLRNGRLAEILGELQEILDKGNKGKDGGGGDGEADLKEALTSQVRSLAMEIRQLASSRPITVLNNGGSGQSGVSGLIVPAATVGALGYGYMWWKGISFADLMYVTKRNMANAVSSMTKHLEQVQSSLAAAKRHLTQRIEKLDDKLDQQKALSGQIRDDVTDARLKLENIGSEIKNIKDLVWGLDGKIDSMEAKQDFSCAGVMYLCQFIEQNGGKLPDRLEGPKVTTKRFADQRFIQGLQLAIESGNCGKDTIDMLLKDADSSDKINRTSSIKSSS

SEQ ID NO: 45277 - protein, 359 aa, Sorghum bicolor
  Clone ID: SORBI-28MAY03-C2558_1.pep
TIQYLISKGAKVILSSHLGRPKGFTPKFSLGPIVGRLSELLGIQVQKAEDVIGPEVEKLVDALPIGGVLLLENVRFYKEEEKNDPEFAQKLASLADLYVNDAFGTAHRAHASTEGVTKFLKPSVAGFLLQKELDYLVGAVSSPKRPFAAIVGGSKVSSKIGVIESLLEKCDILLLGGGMIFTFYKAQGLSVGASLVEEDKLDLATSLLAKAKEKGVSLLLPTDVVIADKFAPDANSQIVPASAIPDGWMGLDIGPDAVTSFNAALDTCQTVIWNGPMGVFEFDKFAVGTEAVAKKLAELSAKGVTTIIGGGDSVAAVEKVGVADVMSHISTGGGASLELLEGKELPGVVALDEAIPVAV

SEQ ID NO: 45278 - protein, 227 aa, Sorghum bicolor
  Clone ID: SORBI-28MAY03-C2575_1.pep
MCSITRLAFVLALAIASSTEVAESRDFNILAQGSLPDAAKGPGLTAASGKLCQLCEQYSTEALFYLTQNETQTEILSILHHECASLAPLKQQCITLVDYYIPLFFFEVSMVTPEKFCESMHLCKNGMKISLPTREGTCGLCHHVVVEVLVMLKDPNTQLEVIDLLNKTCSKAQNYEQQCKQLVLKYIPLILVKGEKFLETTDVCSAIHACKAGTQASMETMPLSATL

SEQ ID NO: 45279 - protein, 267 aa, Sorghum bicolor
  Clone ID: SORBI-28MAY03-C26042_1.pep
MYNNYGNPPGMQMPPQNSQPVQFDNPLYGASSRLIRSGIGVYGEKFLGSSSEFMQSNINRYLSNPQYYFHVNDQYVRNKLKIILFPFFHRGHWTRISEPVGGRLSYKPPIYDINAPDLYIPFMAFGSFIILSGFTLGFMGKFTPEAINLHFTRALIGWGFQLMLLKGLLYSMGGGEVPLLDLVAYGGYLFAGLSLAVVARLIWAYSYYVMMPWMSLCMGVFLVRTMKRVLFTEMRSSERHSSRQHYFLLFMAIAQFPLFFWLGSIGA

SEQ ID NO: 45280 - protein, 180 aa, Sorghum bicolor
  Clone ID: SORBI-28MAY03-C26616_1.pep
MASRRQWWWCLLLLAAWCCAVAAAQSSPPAADPLQSKCQGDFGKLTDCMDYATGHAASPSSTCCGDAGDTEKARPECLCYIIQQVHTGRNQVQSLGLRFDRLIALPAACNLPNSNVSLCINLLNLKPGSPDYALFANASKITPSTNPASDSTAGSGFKLQAGIHGSVVLAVISAIVSSLF

SEQ ID NO: 45281 - protein, 512 aa, Sorghum bicolor
  Clone ID: SORBI-28MAY03-C26046_1.pep
MASRDLAESPHPAAAPGRPASAPRASAPAAGAAPPPPASDAGGARAPPSPPPPSPPRLPPATAPARRRRAPLLDPGNLEGDLQAGAAAGYQLLWLLMWATVMGALMQLLSARLGVATGKHLAELCRDEYPTWATRALWAMTELALVGADIQEVIGSAIAIKILSGGTVPLWGGVVITALDCFIFLFLENYGVRKLEAFFAVLIATMAVSFAVMFGETKPSGKELLIGLVVPKLSSKTIKQAVGIVGCIIMPHNVFLHSALVQSRKIDTNKKSRVQEAVYYYNIESILALIVSFFINICVTTVFAKGFYGSKQADSIGLENAGQYLQEKYGTAFFPILYIWAIGLLASGQSSTITGTYAGQFVMGGFLNLRLKKWLRAMITRSFAIIPTMIVALFFDTEDPTMDILNEALNVLQSIQIPFALIPLITLVSKEQIMGSFVIGPITKVISWIVTVFLMLINGYLILSFYITDVRGALLRSSLCIVLIVYLAFIVYLIVRNTSLYSRLCSSMSKSP

SEQ ID NO: 45282 - protein, 452 aa, Sorghum bicolor
  Clone ID: SORBI-28MAY03-C26809_1.pep
MAEPSAAAVTAADVGALASLPPLVAEEADAAAMEEAAAAAKRWPGWPGDSVFRLVVPVLKVGSIIGRKGELIKRLVEETKARVRILEGPVGATERIVLVSGKEDPGLELPPAMDALMRVFKRVIGITDGAAEGTQAAATPGVCAARLLVPGAQAISPRGKQGATIKAIQESTGATIRVISVDERERPFYVTDDERIIEIQGDTEKVLKALQAVSNHLRKFLVDHSVLPLFEKTNTTVSQDRNGDGWSDMSHPSIGSAQVNQPPSVVDEYILPVKRESLYLEREPLVDHNIHRSGVSLYGRDPALSTLRPSGIHGAGPLLTQITQTMQIPLTYAEDIIGVKGANIAYIRANSGAVVTIQESLGSPDDITVEIKGTSSQVQAAQQLIQDSLAAHREPVRSSYVGAGLDSVYRSSYSQYGSSTYPSSSLPSYSSIDDVSRYPSSGLGGYGSSYRY

SEQ ID NO: 45283 - protein, 191 aa, Sorghum bicolor
  Clone ID: SORBI-28MAY03-C28242_1.pep
ERYCYTSSDIVKEFNKHDREPSKYVKHWTGIKPKTGAKYTCDIGYERFLGPEIFFNPEIYNNDFTTPLQVVIDKCIQSSPIDTRRALYKNIVLSGGSTMFKDFHRRLQRDLKKIVDARVRASNSRLISGDTKAQPIEVNVVSHPIQRYAVWFGGSVLASTAEFYEACHTKAEYEEYGASICRSNPVFKGMY

SEQ ID NO: 45284 - protein, 618 aa, Sorghum bicolor
  Clone ID: SORBI-28MAY03-C28381_1.pep
MYAALRRAAPLRRRAVSALAAALLQHQPAALGAAVAPRAPTLLPAAAWFHSSPAWLGFRETGAAGAAARAEFAAEEGSFYEEDKRAPATGGAAAEEGLEIAKLGISNKIVERLAKKGITKLFPIQRAVLEPAMQGRDMVGRAKTGTGKTLAFGIPILDAIIRHNEKYKPGKFPLAIVLAPTRELAKQVEREFLDSSPWETLCVYGGTPIMQQIRQLNYGVDVVIGTPGRVIDLLKRGALSLAEIRFVVLDEADQMLSVGFDQDVETILERVPPQRQTLMFSATMPTWIRKLTQKYLNSPVTVDLVGEDDQKLAEGISLLSVSSENRQKPAVLGELIKEHAKHEECIVFTQTKRDADRLSHSMSRSFQCEALHGDISQSQRERTLGGFRDGRFNILIATDVAARGLDIPNVDLVIHYELPNSSEIFVHRSGRTGRAGKKGTAIVMYNYEQSRAVRVIERDVGCKFTELPKINVEGSVLLDAGFDSFGGGGGGYGGSNYGRARGFGGRGGGGFGRSGGGGGFGNSGFGRSSGGFGDSGFDRSGGGGFGRSGGGGGFGDSGFGRSGGSGGFGDSGFGRSSGGGSGFGRSGGFGESGSGRFGGGFGSSGSGSFGGFGDKNSR

SEQ ID NO: 45285 - protein, 317 aa, Sorghum bicolor
  Clone ID: SORBI-28MAY03-C7664_1.pep
ARGPTGRGGRGASPPHRAPRQRRPRPLPGLRVIPAPVSARPRSRASPGCAAPPPAARAGNLDCIRKLLAWGADRLQRDSAGRIPYAVALKRNHEACAALLNPSSAEPMVWPSPLKFISELDPEAKALLEAALMEANREREKKILKGTKYSPPSSPPSTCEHEIDADAIDDVSSETSDTELCCICFDQACTIEVQDCGHQMCAPCTLALCCHSKPNPTTLTLPSPACPFCRGNISRLLVARASTASLDADTDKAAAAAASSPQLVRRRSRRSHNLSDGGSSSFKGLSSAVAGSFSKIGRGSSRMADSDNGMDKPEHDL

SEQ ID NO: 45286 - protein, 145 aa, Sorghum bicolor
  unsure (1)..(145): unsure at all Xaa locations
  Clone ID: SORBI-28MAY03-C6068_2.pep
HASAHASAYIRDGAEKDRLFRAIETVPAVRRKADWAMRWIDGGERFAERLVAFACVEGIFFSGSFCAIFWLKKRGLMPGLTFSNELISRDEGLHCDFACLLYDLLRGKLDESRVREDRRRPVDIEREXVCDASPVALVGMNGALM

SEQ ID NO: 45287 - protein, 339 aa, Sorghum bicolor
  Clone ID: SORBI-28MAY03-C6068_1.pep
MPAAPTLVPPCDAEEPLLAESSDRFSMFPIRFPQIWEFYKKAVASFWTAEEVDLSSDARHWDEALSPDERHFISHVLAFFAASDGIVLENLASRFMSDVQVAEARAFYGFQIAIENIHSEMYSLLLETYIRDDAEKDRLFRAIDTVPAVRRKADWAMRWIDGGERFAERLVAFACVEGIFFSGSFCAIFWLKKRGLMPGLTFSNELISRDEGLHCDFACLLYEPLRSKLDEARVREVVADAVVLEREFVCDALPVALVGMNGGLMSQYIEFVADRLLMALGCKKMYNATNPFDWMELISLQGKTNFFEKRVGDYQKASVMNSLNGSAAANHVFSIDEDF

SEQ ID NO: 45288 - protein, 351 aa, Sorghum bicolor
  Clone ID: SORBI-28MAY03-C7971_1.pep
HEAQSTVHHHFTQQQRSEQDPAAAMEARRSLLASFVLAALAAQALVAVVESRASPMEKASQGEDVKKPDCVPGMDPRSFPGTGGGHGITPVTPSHGGSGSPGTTPSHGGGGYGPTPSHGGTLPSPSHGGSGSSPTSPSTGGGGSPSHGGGAYGGSPSTPGGGAYGGSPSTPGGGAYGGSPSTPGGGGAYGGGSPSPAHGGAYGSSPTPAYGGNSPSHGGIGTSSPTSFLRLGTCDYWRSHPMEIWSAIGGRFPSTSSSMGTMSHFFGAAAGSVGGANMMSIQDALGNTRADGTGALLREGAAALLNSMTRAGFPYTTEQVRDAFAAAAAGGSDGAAAAQAAAFRKANEGKA

SEQ ID NO: 45289 - protein, 385 aa, Sorghum bicolor
  Clone ID: SORBI-28MAY03-C34451_1.pep
MGGLEEIKNEAVDLENIPIEEVFEQLKCTREGLSSSEGQQRLEIFGPNKLEEKKESKILKFLGFMWNPLSWVMEMAAIMAIALANGGGKPPDWEDFVGIIVLLVINSTISFIEENNAGNAAAALMANLAPKTKVLRDGRWGEQEAAILVPGDIISIKLGDIVPADARLLEGDPLKVDQSALTGESLPVTRGPGDEVFSGSTCKQGEIEAVVIATGVHTFFGKAAHLVDSTNQVGHFQQVLTAIGNFCICSIAVGIIVEIIVMFPIQHRKYRSGIENLLVLLIGGIPIAMPTVLSVTMAIGSHKLSQQGAITKRMTAIEEMAGMDVLCSDKTGTLTLNKLSVDKNLVEVFCKCVDKDHVLLLAARASRTENHDAIDAAMVGMLADP

SEQ ID NO: 45290 - protein, 313 aa, Sorghum bicolor
  Clone ID: SORBI-28MAY03-C2978_1.pep
MGDDGLDEEEDGFDCEIGTLENFEKAKGTVNISATYNTRHNDFESSVVARGDLWRLESSRGNLNSGNDSSPLFLVQLGPLLFVRDSTLLLPVHLSKQHLLWYGYDRKNGMHSLCPAIWSKHRKWMLMSMMCLNPVACSFMDVQFPNGQLTYVAGEGITASGLIPLFGGLLQAHGKCPGDTRVSFSFKNKQGTRFTPTFQWPDNSVSLGVAQAVAWKRSGLMVRPSIQISVCPTFGGSDPGIRTEFVHSLKDELSVMCGFSCSRHPSAFTSLSLGRSKWNGQVGSSGLVITLETPLDNMARPSLSVQLNGGFEF

SEQ ID NO: 45291 - protein, 67 aa, Sorghum bicolor
  Clone ID: LIB3481-028-P1-K1-B12.pep
SALFGGLLQAHGKCPGDTRVSFSFKNKQGARFTPTFQWPDNSVSLGVAQAVAWKKSGLMVRPSIQIR

SEQ ID NO: 45292 - protein, 394 aa, Sorghum bicolor
  Clone ID: SORBI-28MAY03-C3814_1.pep
HEDGSRGIGVPARISKKMQKKKQVVILLDPERQSIRREGEIPVADFLWYSAAKPCSRNCFDRAEIARVMNAAGRRREALPQDLQKGIDLGVVSPEILQNFFDLEKYPVMAELIHRFQGFRERLLADPKFLHRLAIEEGISITTTLLAQYEKRKGRFFEEIDYVLTDTIRGSVVDFFTVWLPAPTISLLSFADDGSGESVQLLKGILGSVPDNAFQKGIVGQNWNINQRFASVLMGGLKLAGVGFISSIGAGVASDVLYGARQILKPSASMEVARKRTPIWKAATVYSCFLGTSANLRYQVIAGLIEHRLGEDLMTYYNQPLLASLVSFVSRTVNSYWGTQQWIDLARATGVQSTKKELPSPEVSSATEMPLLECGTTEVQKVDDSSNNQSNDLT

SEQ ID NO: 45293 - protein, 264 aa, Sorghum bicolor
  Clone ID: SORBI-28MAY03-C42776_1.pep
MAAPSEDALRRALAERQAAADAQAEAVRALKAGGGASKADVDAAVEALKALKVEAGAAARRLQQALGAGAGGAAREELRQAVVNTLERKLFYIPSFKIYRGVAGLYDYGPPGCRVKANVLSFWRQHFVLEENMLEVDCPCVTPEVVLKASGHVEKFTDLMLKVDAAAKVIAKALTTAGISHIIDTTAISIGRRYARTDEIGVPFAVTVDSATNVTIRERDSKEQIRVDINEVASVVKQLTEGQSTWADVSAKYPAHVGPQGDQE

SEQ ID NO: 45294 - protein, 572 aa, Sorghum bicolor
  Clone ID: SORBI-28MAY03-C49140_1.pep
MKSGERPKLVRGLRQESRRFRLLVIVVGFFLVSLTFVVISKPDAILFSLNGKLPVDQAPTSILIQQKVNSPPATTVKTSTDALRGDPRVVDDEADPRPQGFKGEEEESRVLSEPDPTSGMTELTPNKDGSGRKSDEDKLGGGGDGEGKRREERGHEADKHKVTLPTVSNYTIHDTEDTETAKKDDTSYDQQGSKPLCDFSNFRANVCEMRGDVRVHPNATEIMFMEPGHSQRDELWKIKPYPRKGDEFCLSHITELTVKSSKVAPECTKYHDMPAVIFSARGYTGNLFHDFTDVMVPLFTTASEFNGEVQFLITDMALWWTIKYHTVLQKLSKYPVIDFSKDDQVHCFKHVIVGLHAYMEFTIDSSKAPHNYSMVDFNRFMRGAYSLGRDTVTVLGEYPKVKPRLLIIKRHRTRMFLNLDEIVVMAEELGFEVVIDEANVSSDISKFARLVNTVDVMMGVHGAGLTNCVFLPQNATLIQIVPWGGLEWVSRTDFGNPAELMGLHYKQYSIGVDESSLTEQYPRDHEIFKNPIAFHKNGFDFIRQTFMDKQNVKLDCKRFRPILLEALDNLNP

SEQ ID NO: 45295 - protein, 203 aa, Sorghum bicolor
  Clone ID: SORBI-28MAY03-C4483_1.pep
MNPEYDYLFKLLLIGDSGVGKSCLLLRFADDSYLDSYISTIGVDFKIRTVEQDGKTIKLQIWDTAGQERFRTITSSYYRGAHGIIIVYDVTDQESFNNVKQWLNEIDRYASDNVNKLLVGNKSDLTANKVVATETAKAFADEMGIPFMETSAKNATNVEQAFMAMAASIKDRMASQPAAANARPATVQIRGQPVNQKTSCCSS

SEQ ID NO: 45296 - protein, 60 aa, Sorghum bicolor
  Clone ID: LIB3481-040-P1-K1-D7.pep
RPIVYDVTDQESFNNVKQWLSESDRYASDNVNKLLVGNKSDLTANKVVATETAKVSYPVS

SEQ ID NO: 45297 - protein, 220 aa, Sorghum bicolor
  Clone ID: SORBI-28MAY03-C51038_1.pep
MATDGGEKGSSGHAAAEWRFARAAAAKEEGALAVAGDKMSIRAARFKISASVDARDPRPVLPLAHGDPSVFPAFRTAAEAEDAVAAALRTGKFNCYPAGVGLPDARRALAEHLSSDLPYKLSTDDIFLTAGGTQAIEVVVSVLAQPGTNILLPRPGYPNYEARAGLHNLEVRRFDLIPERGWEIDIDSLESIADKNTTAMVIINPNNPCGSVYTHEHLAT

SEQ ID NO: 45298 - protein, 473 aa, Sorghum bicolor
  Clone ID: SORBI-28MAY03-C9392_1.pep
HEASDFANDRIIPYNYSYDPLAEYLNFISDGGFSVDGVLSDYPITASEAIGCFANLNSSKTDHAEPLVISHNGASGDHPDCTDLAYHSAIDDGADVIDCPVQVTSDGVLMCMSSINLLDTTNVQRTPFATPPSLVPEIQSTPGIFTFNLTWANISSSALKPRISSPVSDYYLVRNPRYANQGNFLKLSDFLAIVMERDLSGAMIIIENAAYIAKSLGIDIVDSVTTALSAAGFDNQTAKEVLIQSKDSAVLVKLKQQKTKCKLVYTLPSDIGDASNSSLKDIKKFAHAVVVDRISVFALSYNFIIRQNRLVHDLQSAGLAVYAQVFRNEFVAVPFDFFGDATVQINYYVQSFNLSGIITDFPKTVRRYKKNTCTVLGKDMPNYMLPVVTGALDQKLQTFQTQPPSVAPMPILNSSSVEEPPLPPAAPRNVPGGGGPSGGATATPGGAPPSDAHHTATVSTGMLLVVVSAALLI

SEQ ID NO: 45299 - protein, 507 aa, Sorghum bicolor
  unsure (1)..(507): unsure at all Xaa locations
  Clone ID: SORBI-28MAY03-C9218_1.pep
MGPPQPARVGAINIEACARPIAVDHRIRLPYYFRIAGSLLRQANIYRNESNFLDLYVILLRYSSLLCETIPKHRDYHAFKLKEKAFFDKLNDVMKELETLKPVVQRQVAEHNRGGTVESNTNSLNGNYGITRRIEQRTPTSYTPQPFVGSTNGALQKTFHAGRQVALLPSVQKQFMNLPYPKEETLARHSILGPNGLNGRWNGPVTEIKVQYPSNFELSTRDITSLVPSILNQDDSHGPSTAPAPPPPDSSSNDNDDMKSVLSLDDGRWSVPAERTPLPSASLEEELFQLDIKQPSPPPVLAEVQRPISPSRVADPTPGLPTSGTARFQNLHVPIKLMECFLRVAESNTKRSLETCGVLAGTLKKRTFCVTTLIIPKQKSTSNTCEAINEEELFEVQDTGSLFTLGWIHTHPTQSCXLSSIDLHNHYSYQVMLPEAIAIVMAPTDTTRKHGIFHLTDPGGMGVIHDCQERGFHPHKAPLDGSPIYEQCSHVYMDNDIKFDMIDLRER

SEQ ID NO: 45300 - protein, 243 aa, Sorghum bicolor
  Clone ID: SORBI-28MAY03-C9842_1.pep
MSAAASKKLFQAARSLILSASQRSSAAAVLAAEGRTAALATLTNFGRKALPTAYYSYHRQGSHHAASGWGAIAAAVPAAVYMLQDQEAHAAEMERTFIAIKPDGVQRGLISEIVNRFERKGYKLVAIKLIVPSKEFAQKHYHDLKERPFFNGLCDFLSSGPVLAMVWEGEGVIKYGRKLIGATDPQKSEPGTIRGDLAVVVGRNIIHGSDGPETAKDEIALWFEPKELVSYTSNEEKWIYGVN

SEQ ID NO: 45301 - protein, 439 aa, Sorghum bicolor
  Clone ID: SORBI-28MAY03-C1020_1.pep
MAEHDLTALMAAQLDRHLVFPLLEFLQERQLYSEPEILEAKIRLLSGTNMVDYAMDIHKSLHGTDDVPEDMVKRRAEVVSRLRSLEEAAAPLVAFLQNPQLVQELRPDKQYNIHMLQERYQIGPDQIEALYQYAKFQFECGNYSGAADYLYQYRALCTNSERSVSALWGKLAAEILMQNWDVALEELNRLKEIIDSKNFSSPLNQLQNRIWLMHWALFIFFNHENGRNGIIDLFFQDRYLNAIQTNAHHLLRYLATAVVVNKRRRNMLKELIKVIQQEQHTYKDPITEFLECLYVNYDFDGAQQKLMECEQVILNDPFLGKRIEEGNFVTVPLRDEFLENARLFIFETYCRIHRCIDISMLSQKLNMSYDEAELWIMNLVRSSKLDARIDSVSGTLIMTTNHVNVHEQIIENLKGLNMRTYMLAKNIVEPAQAAQQATR

SEQ ID NO: 45302 - protein, 252 aa, Sorghum bicolor
  Clone ID: SORBI-28MAY03-C5583_1.pep
RTRGLQDGTVFTKKGHDEEPFKARADEEEVIDGLDRAVLNMKKGEVALVTIPPEYAFGSTESKQDLAVVPPNSTVVYEVELVSFVKDKESWDLNNEEKIEAAGKKKEEGNALFKLGKYARASKRYEKAAKYIEYESSFSEDEKKQSKQLKISCNLNNAACKLKLKDYKEAAKLCTKVLELDSQNVKALYRRVQAYIQLADLELAEADIKKALEIDPNNRDVKLEYKTLKEKIKEYNKKDAKFYSNMFAKMTK

SEQ ID NO: 45303 - protein, 251 aa, Sorghum bicolor
  Clone ID: SORBI-28MAY03-C5590_1.pep
MVRRRSRESGRGRSLSLGWPACCLGFLLKLLAFLQAFAAVSVLLYAAWMFSRWARHHQLHLSDLLSPDLWFSSLVMAAGLFYCLLLLAGYLAAEINTGCCLCFYTIPAMAMMLLEAALAAHLALNEHWVQDLPEDRTGELHNLLSFIHNNLDLCKWAALAIFATQALSLLLAMILRAMLSARIVDYDSDEDFVVIRRPLLVTQAPAPYLPTTVDARGARPDLWSSTLRHKYGLNTSDYTYNTMDANAAQSQ

SEQ ID NO: 45304 - protein, 135 aa, Sorghum bicolor
  Clone ID: SORBI-28MAY03-C5509_1.pep
QLPAARSRSSPAMVKDSAYYDVLGVSVDASPAEIKKAYYIKAKLVHPDKNPGNPDAALKFQELGEAYQVLSDPGKKEAYDKYGKEGIPQDNMVDPAAVFGMLFGSDYFEDYVGQLALASIASVLIGEISLSPKMS

SEQ ID NO: 45305 - protein, 172 aa, Sorghum bicolor
  Clone ID: LIB3476-007-P1-K1-C1.pep
LALASIASVEIDEISNSQEARAKVQEKMKELRREREGKLTQSLKDRLQPYVDGRKDEFVSYASAEARRLSEAAFGEAMLHTIGYIYVRQAARELGKSRIYMGVPFIAEWVRDKGHHIKSQVNAASGAISLIQLQEGMKKMEGSENSEEQLIEMFEEKKDAMLSSLCEIMWWY

SEQ ID NO: 45306 - protein, 288 aa, Sorghum bicolor
  unsure (1)..(288): unsure at all Xaa locations
  Clone ID: SORBI-28MAY03-C57308_1.pep
MANPAAPGGMRSFLQAVSTVTEEAPTPLRVVQMEGLAVLKIIKHCEEFAPALVTGQLLGLDVGSVLEVTNCFPFPIREEDDEADADGANYQLEMMRCLREVNVDNNTIGWYQSCLLGSFQTVELIETFMNYQESIRRCVCIVYDPSRSSQGVXLEPESPVTQCDFDRLKLSTAPFMERNLEFLIGCMDDLSSEQNKFQYYYRNLSRQQSQQQAWLQKRRQENMARKAAGEEPLPEEDPSNPIFKPIPEPSRLEGYLVTNQISSYCNHINGVAGQNFNRLYLMKALHED

SEQ ID NO: 45307 - protein, 345 aa, Sorghum bicolor
  Clone ID: SORBI-28MAY03-C686_1.pep
MFMILCYNQVNLVKGLKIYEDVFTTSEIVKVADFINEIRQAGRNGELSGETFIFFNKQIKGNKREIIQLGVPLFQPTTEEANCHTEPIPLVLQAVIDHLVLWRLIPESRKPNSVIINFFDEDEHSQPYFKPPHLDNPICTLLLSETTMAFGRSLVTDSNGNYKGPLTLSLKQGSLLVMRGNSADMARHVVCPSSNRRVSITFARVRPSTPVDLSPLPSPTKAMTPWQPQPATGSQVAAPACMTQKPPVSGAIIGYAPTPQAVLAPAAWGMAMRAPVMMVAAAPARPMVMASSGTGGGNISKRMGRSGTGVFLPWTVGPKRYNKHLPPRIQKRRFSAMMSPIEAQG

SEQ ID NO: 45308 - protein, 571 aa, Sorghum bicolor
  unsure (1)..(571): unsure at all Xaa locations
  Clone ID: SORBI-28MAY03-C7225_1.pep
PSHRFGIDSSSEVASQPANRARCPSLPAATAFSEEVPCDARILRRCKLITVRRVPDIVEIKHIMLPQSRKGFRKSLVKEATGGCAPLXMSTLERDLTKEHYQFFLYQLLRALEYIHTANVYHRDLKPKNILANSNCKLKICDFGLARVXAFNDTPTTVSRTYYVATRLYRGPELCGSFFSKYTPAIDIWSIGCIFAEVVTGKPFFPGLHAVHLRVWTTARRGPPSPDTIPRVRFGCARRVLSSRALWVPLPLSPPAPGAGPLARILAEKLLAFDPKDRPTAEEALRDPYFKGLSRIEREPSCQPIRKVEFDFEHKRMSKEEIRELIFREILEYHPQLLNSYINGTERTTFLYPSAVDQFKKQFSHLEESGGNVPSVPTDRKHASLPRTTVVHSNPIPAKEQPLAASSKVRPVSDDSCKNPWEKGSGPGNVPRASLAPQGLQTQAGSVRVNGSVMNSGYPPHQQIPQAYGYRQMPARLDSTNPSQAMGGYTQQSQAYAFSNSKGSPDVAVNMRAPPFHLPSGPKNNPLDRIASDTDIYTRSLNGIVAAAAASVGAGTHRNVGVVPSGMSRMY

SEQ ID NO: 45309 - protein, 462 aa, Sorghum bicolor
  unsure (1)..(462): unsure at all Xaa locations
  Clone ID: SORBI-28MAY03-C6292_1.pep
MASSSENTGAPPEEEQPQAPPTPNPEPTEAAAPGEAEEEPQTLERAQELFDRGAKAIEDEDFVEAVDCLSQALEIRTSHYGELAPECASTYFKYGCALLYKAQEESDFLGNVPKSVPNEESVKSTASKDDSGTSKVSGTNAEDAVSSEKADAEEGHDADGHEQVGGDGDVELDLAGDVVDVKMGDEEDNDLDPPGLILGIARAIVGLSPGHSMGSVLLVAAPAAGATVCAGMHISLSVFRWPPSIWVLLVLPDLPRAGRXNFRICLVYELVSKIGDAIPYCAKAISLCKSRIQSLKSSKDALLAGKDGDASAAKAEGGSENSDAEKELEQLTSILPDLEKKLEDLEQANPSPAMDEMLKTIASRVTDGMPRAASFTSSQMATSSNGFDSSVLSTAATTGSTGSTVTDLGVVGRGVKRASIKPISAEPAAKKPALDSPSLQGDSSINSEVVPATQNGDESIPK

SEQ ID NO: 45310 - protein, 164 aa, Sorghum bicolor
  unsure (1)..(164): unsure at all Xaa locations
  Clone ID: LIB3476-018-P1-K1-E2.pep
VEKDDDDDDDDEKMGDEEDNDLDLSWKMLDIARAIVEKTPDNTMEKVKIYSALAEVATEREDIDNSLTDYMKALSMLEHLVEPDHRRVVELNFRICXVYELVSKIGDAIPXCAKAISLCKSRIQSLKSSKDALLAGKDGDASAAKAEGGSENSDAEKELEQLTS

SEQ ID NO: 45311 - protein, 290 aa, Sorghum bicolor
  unsure (1)..(290): unsure at all Xaa locations
  Clone ID: SORBI-28MAY03-C7370_1.pep
TRRHEPPPPSCSRRPATGSPALPCSIRSPQAEEESLCGSVARQNKKESAVGSGIDDLLLCAGSDSTDDSLATVSQSDRGQPNPWPHDGRWAIQCFPLGENKVLCADQSGRTFLFDADTRHVPPMPSLHKPKDTPFSIFIPSASDDSNXVIDDDDVXHDDVGTLFVMEGYPSMEPTSDDQSPNDQPSDEFEAYVYGKRKLAHFKSWKCQPLPPPPYVRDPTWMKFRPQITTYAVVGGGAQILISAESAGTYCMDTATHKWSQVGRWMLALHGKIEYVPELDLWVGFSCQDQ

SEQ ID NO: 45312 - protein, 152 aa, Sorghum bicolor
  unsure (1)..(152): unsure at all Xaa locations
  Clone ID: LIB3476-033-P1-K1-A8.pep
MTLSRRFLNLIVDSQIRGVRTLRRIDLTRQQFFIPSASDDSNSDGFEDDDDDDVGTLFVMEGYPSMEPTSDDQSPNDQPSDEFEAYVYGKRKLAHFKSWKCQPLPPPPYVRDPTWMKFRPQITXYAVVGGGAQILISAESAGTYCMDTATHK

SEQ ID NO: 45313 - protein, 190 aa, Sorghum bicolor
  Clone ID: SORBI-28MAY03-C9286_1.pep
ARGPPEETKVTTLNLLKTMDPNDVQNEKSRGQRSMVLSYKPFKEEDGEIEDTEGTNVIEKAPDGTPAGGGLLFVIVHEAKDLEGKHHTNPYAKIIFKGEEKKTKVIKKNRDPRWVDEFEFVCEEPPVNDKLHVEVLSKAPKKGLIYGKETLGYIDVSLADVISNKRINEKYHLIDSKNGQIQIELQWRTS

SEQ ID NO: 45314 - protein, 67 aa, Sorghum bicolor
  Clone ID: LIB3480-010-P1-K1-B6.pep
EPPVNDKLHVEVLSKAGKKGLIHGKETLGYIDISLADVISNKRINEKYHLIDSKNGQIQIELQWRTS

SEQ ID NO: 45315 - protein, 96 aa, Sorghum bicolor
  unsure (1)..(96): unsure at all Xaa locations
  Clone ID: SORBI-28MAY03-C12259_1.pep
ARASRARHGPPHFHAYSFHGESPHFTPLIPSEEAPYLAHLAKAATYHTGFVAEPXLLYTDLITQRATYFVPDANRKDEFIGCMDVFVHQARNFHNV

SEQ ID NO: 45316 - protein, 55 aa, Sorghum bicolor
  Clone ID: LIB3478-040-P1-K1-F10.pep
VSDLFLILHYALCASSLLDHITTSQVLDLLLVHSEQPEPCPACEASTSNSLILPS

SEQ ID NO: 45317 - protein, 408 aa, Sorghum bicolor
  Clone ID: SORBI-28MAY03-C1355_1.pep
MQAAAWRRHLLDHHLSPSTSAAIAAFRSASQPGLAPQGLCGADGARYMSSARAPAVKGSGHLVRKGTGGRSSVSGIVATVFGATGFLGRYLVQQLAKMGSQVLVPFRGCEDSHRHLKIMGDLGQIVPMKYHPRDVDSIKAVMAKSNVVINLIGREYETRNYSFEEVNHHMAEQLATIAKEHGGIMRFIQVSCLGASPSSESRLLRTKAAGEQSILKEFPEATIMRPATMIGTEDRILNRWAQFAKNWGFLPLVGGGSTKIQPVYVIDVAAAIVNSLKDDGTSMGKIYELGGPEIYTVHELAELMYETIREWPRYVNVPLPVARAIASPREMLLNKVPFPLPTPSIFNLDQINAFAVDNLVSEDALTFEDLGIMPQKLKGYPVEFLVSYRKGGPSFGSTVSEKMRSSEM

SEQ ID NO: 45318 - protein, 365 aa, Sorghum bicolor
  Clone ID: SORBI-28MAY03-C19810_1.pep
MGSLASERKVVGWAARDATGHLSPYTYTLRNTGPEDVVVKVLYCGICHTDIHQAKNHLGASKYPMVPGHEVVGEVVEVGPEVSKYGVGDVVGVGVIVGCCRECSPCKANVEQYCNKKIWSYNDVYTDGRPTQGGFASTMVVDQKFVVKIPAGLAPEQAAPLLCAGVTVYSPLKAFGLTAPGLRGGIVGLGGVGHMGVKVAKAMGHHVTVISSSSKKRAEAMDHLGADAYLVSTDAAAMAAAADSLDYIIDTVPVHHPLEPYLSLLRLDGKHVLLGVIGEPLSFVSPMVMLGRKAITGSFIGSIDETAEVLQFCVDKGLTSQIEVVKMGYVNEALERLERNDVRYRFVVDVAGSNVEEDAADAPSN

SEQ ID NO: 45319 - protein, 304 aa, Sorghum bicolor
  Clone ID: SORBI-28MAY03-C208_1.pep
MDIDLFADIDLDALLASFSGEPAAVSDLIVPSPPPPAPAAHDAAEAGSPESVTSRANPAGEVGLSEIERFLMQEGEAEAELGGEVEGISVDQFFDALYDGGEGKDEGEAEAGASTDADSGRDEVVEVVTPEAETVEVDGDDPVSKKKKRQMRNRDSAMKSRERKKSYIKDLETKSKYLEAECRRLSYALQCYAAENMVLRQSLMKDRPVGAPTAMQESAVLTETLPLVSLLWLVSIVCLFLMPVLPNRSPAAPSSGGRDLVMAAGKTSSETPEILELILHGRRCKSTRARIKLYNLPFHPVIAC

SEQ ID NO: 45320 - protein, 250 aa, Sorghum bicolor
  Clone ID: SORBI-28MAY03-C21609_1.pep
MAAAPSATAVSTAALLAPIRAPTSAFLRRTQLTRHRDHSLKCRRAGPIVPAAAAAAAGSSSSPSSAVFHGECFVVGDNIDTDQIIPAEHLTLVPSKPDEYRKLGSFAFAGLPSAAYPTPFVAPGEESTRYAVVVGGANFGCGSSREHAPVALGAAGARAVVAEGYARIFFRNSVATGEVYPLELTDTGAWKECKTGDVVTVDLSNSVFINHTSGKEYKLKPIGDAGPVIEAGGIFAYARKTGMIASKAAA

SEQ ID NO: 45321 - protein, 368 aa, Sorghum bicolor
  Clone ID: SORBI-28MAY03-C14610_1.pep
AGRAHSQREWPAVRSCVAAAAGGAEGRLHIAGLKSHGQPCGRIHACSDVLHCIPARCREEAAAAFATAFDDASEQVLYRFFDVSWKPKRLLNISSEAAMKGSIRTIDGFVYGVIDRKIEQMGRDQQEFAKKEDILSRFLMERESDPGCFDNKYLRDIILNFVIAGRDTTAGTLSWFLYMLCRNQHIQDKVAREVRAATTGDRDVGVQEFVAFLTEDAISRMQYLHAVLTETLRLYPAVPIDVKYCFSDDTLPDGYAVKKGDMVNYQPYQMGRMKFLWGADAEEFRPERWLGDDGVFVPESPFKFTAFQAGPRVCLGKEFAYRQMKIFAAVLLYLFRFEMWEANATVGFRPMLTLKMDGPLYVRATLRQ

SEQ ID NO: 45322 - protein, 197 aa, Sorghum bicolor
  Clone ID: LIB5051-011-A1-XP1-D1.pep
MDSPPGQPTVVTLILALLLVLYLALRRRAGAGGAKNRSYPPVAGTVLHQLFNFGRLMEYHTELSRRYRTFRMLTPSSSYIYTVEPANVEYILKTNFSNYGKGSKVHEVGEDLLGDGIFSVDGAKWRHQRKVASHEFSTRVLRDYSTGVFRDTAAELAGIVAADAGEKVDMQDQLLRSTLDSIFTVGFGVRLGVLSGS

SEQ ID NO: 45323 - protein, 184 aa, Sorghum bicolor
  Clone ID: SORBI-28MAY03-C21718_1.pep
MSSPSKRREMDLMKLMMSDYKVEMVNDGMQEFFVEFHGPNESIYQGGVWRVRVELPDAYPYKSPSIGFINKIYHPNVDEMSGSVCLDVINQTWSPMFDLVNVFEVFLPQLLLYPNPSDPLNGDAAALMMRDRPAYEQKVKEYCEKDAKPEDAGVIPEDKSREVAPGEDLNVAGLVLIIGRPQPK

SEQ ID NO: 45324 - protein, 142 aa, Sorghum bicolor
  Clone ID: SORBI-28MAY03-C24083_1.pep
MGRVRTKTVKKTSRQVIEKYYSRMTLDFHTNKKVLEEVSILPSKRLRNKVAGFTTHLMRRIQRGPVRGISLKLQEEERERRMDFVPEKSALEVEEIRVDKETMEMLAALGMADLPGVERQQEVSNAPAYGRPQYGGPRRDRV

SEQ ID NO: 45325 - protein, 233 aa, Sorghum bicolor
  Clone ID: SORBI-28MAY03-C23514_1.pep
QNSLDLIGGGGGAACGSEMAPSGWRRSAGARSLWRPATVCLWLALAAAALTLAQAKKDLTEVTHKVYFDIEIDGKPAGRIVMGLFGKTVPKTAENFRALCTGEKGVGKSGKALHYKGSAFHRIIPSFMLQGGDFTLGDGRGGESIYGLKFADENFKIKHTGPGLLSMANAGRDTNGSQFFITTVTTSWLDGKHVVFGKVLSGMDVVYKVEAEGRQSGQPKSKVVITDSGELPM

SEQ ID NO: 45326 - protein, 232 aa, Sorghum bicolor
  Clone ID: SORBI-28MAY03-C16446_1.pep
TRVIRYFPTQALNFAFKDHFKRMFNFKKDKDGYWKWFAGNLASGGAAGACSLFFVYSLDYARTRLANDAKAAKKGGERQFNGLVDVYRKTLASDGIRGLYRGFNISCVGIIVYRGLYFGMYDSLKPVLLVGTLQDNFLASFLLGWGITIGAGLASYPIDTVRRRMMMTSGEAVKYNSSLDAFKQIVAKEGTKSLFKGAGANILRAVAGAGVLAGYDKLQVIVFGKKYGSGGG

SEQ ID NO: 45327 - protein, 107 aa, Sorghum bicolor
  Clone ID: SORBI-28MAY03-C16983_1.pep
MATALKSFLNSPVGPKTTHFWGPVANWGFVIAGLVDMNKPPEMISGNMTAAMCVYSGLFMRFAWMVQPRNYLLLACHASNESVQLYQLSRWARAQGYLEKKEPEAQQ

SEQ ID NO: 45328 - protein, 93 aa, Sorghum bicolor
  Clone ID: SORBI-28MAY03-C16916_1.pep
MDKSMLGDLDGLPEEDKMRMAGMIDQLQIRDSLRMYNSLVERCFTDCVDTFRRKTLDKQEESCVRRCAEKFLKHSMRVGMRFAELNQGVATPD

SEQ ID NO: 45329 - protein, 93 aa, Sorghum bicolor
  Clone ID: LIB5047-009-R1-XP1-G10.pep
MDKSMLGDLDGLPEEDKMRMAAMVEQLQIRDSLRMYNSLVERCFTDCVDTFRRKTLDKQEESCVRRCAEKFLKHSMRVGMRFAELNQGVATPD

SEQ ID NO: 45330 - protein, 93 aa, Sorghum bicolor; identical to SEQ ID NO: 45328
  Clone ID: LIB5051-003-A1-XP1-E4.pep

SEQ ID NO: 45331 - protein, 210 aa, Sorghum bicolor
  Clone ID: SORBI-28MAY03-C1052_1.pep
TCWHNVLHKASEKSAQAKKWAEPHIETAKTKWIPVKEKLVVLKKNAEPYVQKVSTRSVELYESSRDAVTPHVVKVKEFVHPYYQEAKMFSKPYIDQIAEITKPHVEKVRTTLKPYTKRAVHAYGSFLESATTYHRQAQASIMDYLHQHDITKSFATKELVWFLASALLALPVFIIYRLLVETFCTKKNKRPRGGNGNHGHKRQKRRHADK

SEQ ID NO: 45332 - protein, 129 aa, Sorghum bicolor
  Clone ID: SORBI-28MAY03-C1093_1.pep
MEIQHHGGVGNSKVVKVQSQEAWDLFTDQASKEGRPVVAHFGASWCVTSLSMNYKFEELAQTHPEVLFLYVDVDDVQSVSSKYGVKAMPTFFLIKNKEVVSKIVGANPDEVKKLVDASAEPFQTQIVVE

SEQ ID NO: 45333 - protein, 492 aa, Sorghum bicolor
  Clone ID: SORBI-28MAY03-C110_1.pep
MGSNAPPPPTPHVVLVPFPGQGHVAPLMQLARLLHARGARVTFVYTQYNYRRLLRAKGEAAVRPPATSSARFRIEVIDDGLSLSVPQNDVGGLVDSLRKNCLHPFRALLRRLGQEVEGQDAPPVTCVVGDVVMTFAAAAAREAGIPEVQFFTASACGLLGYLHYGELVERGLVPFRDASLLADDDYLDTPLEWVPGMSHMRLRDMPTFCRTTDPDDVMVSATLQQMESAAGSKALILNTLYELEKDVVDALAAFFPPIYTVGPLAEVIASSDSASAGLAAMDISIWQEDTRCLSWLDGKPAGSVVYVNFGSMAVMTAAQAREFALGLASCGSPFLWVKRPDVVEGEEVLLPEALLDEVARGRGLVVPWCPQAAVLKHAAVGLFVSHCGWNSLLEATAAGQPVLAWPCHGEQTTNCRQLCEVWGNGAQLPREVESGAVARLVREMMVGDLGKEKRAKAAEWKAAAEAAARKGGASWRNVERVVNDLLLVGGKQ

SEQ ID NO: 45334 - protein, 99 aa, Sorghum bicolor
  Clone ID: SORBI-28MAY03-C10205_1.pep
MAIKSMTVAPTTTRSLDADMTVDEFKEWLRRFDTDRDGRISREELRRAMRAIRARFSGWRSKQGISYADTDGDGYIDDSEVDGLIEFAQKNLGLKIVAY

SEQ ID NO: 45335 - protein, 252 aa, Sorghum bicolor
  unsure (1)..(252): unsure at all Xaa locations
  Clone ID: SORBI-28MAY03-C10273_1.pep
PAASSVTLRPVPSRRANKEKKWPCRRWWSXGVVFPPVARPPGSAGSHFLGGAGVRGIEIGGNFIKFTAIGVYLEDAAVSALAKKWAGKTADELASDAAFFRDVVTGDFEKFTRVTMLLPLTGEQYAGKVTENCVAFWKAVGLYTDAEGVAVEKFKEAFKPETFPPGASILFTHSSTGVLTVAFSKDSSVPASGGVAIENKHLCEAVLESIIGEHGVSPAAKLSLAARVSELLTKGTAGAADAPQAEPVSVTA

SEQ ID NO: 45336 - protein, 169 aa, Sorghum bicolor
  Clone ID: LIB3481-058-Q6-K1-B7.pep
RSIFCYVASGSLAPCKQRKKWPCRRWWSRASSSRRWPARRAPPARTSSAAQAFWKAVGLYTDAEGVAVEKFKEAFKPETFPPGASILFTHSSTGVLTVAFSKDSSVPASGGVAIENKHLCEAVLESIIGEHGVSPAAKLSLAARVSELLTKGTAGAADAPQAEPVSVTA

SEQ ID NO: 45337 - protein, 113 aa, Sorghum bicolor
  unsure (1)..(113): unsure at all Xaa locations
  Clone ID: LIB3478-012-P1-K1-D12.pep
MVLPLLWCVFSLKKKSGDFEKFTRVTMLLPLTGEQYAGKVTENCVAFWKAVGLYTDAEGVAVEKFKEAFKPETFPPGASILFTHSSTGVLTVAFSKXDSSVPASGGVAIENKH

SEQ ID NO: 45338 - protein, 155 aa, Sorghum bicolor
  Clone ID: SORBI-28MAY03-C1207_1.pep
MFGDEGASEGPAGPGAASQIPKAASSLAAALAGTSDMGVYTFVCRNTGGEWTAKQHSGELEASAATPYALQRALVAAASAADSASGVQSSFSMVTPTSAVFQVIVGAVGGGAMMVSGGGGAAAASGGAAAEAPKEEKKEEEKEESDDDMGFSLFD

SEQ ID NO: 45339 - protein, 209 aa, Sorghum bicolor
  Clone ID: SORBI-28MAY03-C1198_1.pep
MEASGKKLRPFLLTLLLVLSTAVTPILSLPEPDNEVDCDCDKPKAPKPSHSHPPKTKPSHPSPSPSPKPKNPKPPKGPAYPAPGHQQPPKSPSYPPVTRPPVVGPPKGPVTRPPVTRPPVVGPPVTYPPIIGPPVTRPPVVGPPVTYPPITGPPTTPPVVGPPVTYPPITGPPSTTPPITGPPSTTPPVTGPPVTYPPGGGGGSSTPSP

SEQ ID NO: 45340 - protein, 144 aa, Sorghum bicolor
  Clone ID: SORBI-28MAY03-C26722_1.pep
DQEVVNLSGGELQRVAICLCLGKPADIYLIDEPSAYLDSEQRIVASKVIKRFILHAKKTAFIVEHDFIMATYLADKVIVYEGRPSIDCTANAPQSLVSGMNKFLSHLDITFRRDPTNYRPRINKLDSTKDREQKSAGSYYYLDD

SEQ ID NO: 45341 - protein, 180 aa, Sorghum bicolor
  Clone ID: SORBI-28MAY03-C27127_1.pep
MTLTIPDDVRAKAEIYLGDEAGQEKTRLLLHETGLPSGLLPLQDIIECGYVEETGFVWLKQRRKVDHYFAKAGRHVSYGAEVSAVADKGRLKKITGVKAKEMLIWVTLHEICVDDPPQGKLHCKAIGGLSRSFPVEAFEANDGRVVVPRNVGGCAGAGAAAAAAGNGNGVVVGAAEEEGK

SEQ ID NO: 45342 - protein, 317 aa, Sorghum bicolor
  unsure (1)..(317): unsure at all Xaa locations
  Clone ID: SORBI-28MAY03-C2767_1.pep
MTRRCSHCSHNGHNSRTCPNRGVKIFGVRLTDGSAIRKSASMGNLSLLSAGSTSGGASPADGPDLADGGAGGYASDDFVQGSSSASRERKKXVFLGLKKNTGXVFAGITKAWERXWRGISRNFVVSRTPTQVASHAQKYFIRQSNMSRRKRRSSLFDMVPDESMDLPPLPGSQEPETSVLNQAPLPPPVEEEVESMESDTSAVAESSTASALMPESLQPNYPMIVPAYFSPFLQFSVPFWPNQEDGGDLPQETHEIVKPVAVHSKNPINVDELVGMSKLSIGEPGQETVSTSLSLNLLGGQNRQSAFHANPQTRAQA

SEQ ID NO: 45343 - protein, 129 aa, Sorghum bicolor
  Clone ID: SORBI-28MAY03-C27665_1.pep
RRAAPPVRYAACPAAAPAPVPGEMIGSGSPRNRENAAAVMLHLSVHNGHLARAQECGIMVPLRELALNGTDRGKRKAVQLLERMSRFLVMQHEDTVSQQLDEIERQFAALGPNVTEADLEQLGEQLGYL

SEQ ID NO: 45344 - protein, 138 aa, Sorghum bicolor
  Clone ID: SORBI-28MAY03-C14274_1.pep
SGYIGQCSGNIQYMLLGNVGETDDGLFSFALGCVNLRKLELRSCCFSERALALAILRMPSLRYVWVQGYKASQTGRDLMLMARPFWNIEFTPPSSENAGRLMEDGEPCVDSHAQILAYHSLAGKRLDCPQSVVPLYPA

SEQ ID NO: 45345 - protein, 397 aa, Sorghum bicolor
  Clone ID: SORBI-28MAY03-C12678_1.pep
MATSSTATASLHLLLPASRRRRHFVPRAAHSESTPPGAASVDRRRFIAHTAAAAAVSPLVLPRWTPAARADGAPALSEWERVFLPIDPGVVLLDIAFVPDDPSHGFLLGTRQTILETKDGGNTWFPRSIPSAEDEDFNYRFNSVSFKGKEGWIIGKPAILLHTSDAGESWERIPLSAQLPGNMVYIKATGEQSAEMVTDEGAIYVTSNRGYNWKAAVQETVSATLNRTVSSGISGASYYTGTFNTVNRSPDGRYVAVSSRGNFYLTWEPGQPFWQPHNRAVARRIQNMGWRADGGLWLLVRGGGLFLSKGTGISEDFEEVQVQSRGFGILDVGYRSQEEAWAAGGSGVLLKTTNGGKNWVRDKAADNIAANLYSVKFLDDSKGFVLGNDGVLLRYLG

SEQ ID NO: 45346 - protein, 159 aa, Sorghum bicolor
  Clone ID: SORBI-28MAY03-C1487_1.pep
MAEGKSSGDLFSSGKLVAEAAASAFQQKSVENVDKKEVAGAAAEILHAASTYGKFEDKPAGQYIEKAEGYLKEFSAGGHAAEPAAAGDAAPPKPAEEAPKEKEPVPAPAPKEEGGKSSSEGFGLGDVVKGAEQLVEKQGGAGEESAAGGLFKMAQGFLK

SEQ ID NO: 45347 - protein, 312 aa, Sorghum bicolor
  Clone ID: SORBI-28MAY03-C15039_1.pep
MAEICCEETKSTPPASASAITALARGRPRVEMAVAEAACRSSSSSTPAADEGAGGGGGASATRCGKRRGVACAAPVRSCQRSRTTSGFGSTWWWPRYGVTSVCGLRREMEDAVSIRPDFLRGAADPSPGLLRFYGLFDGHGGGHVARMCQDRMHALVADEYKKAGSGNSATAAAAEPAWEEVMKKVFARMDGEAATRAASRSSNGSIACRCELQKPTRCDHAGSTAVVAVVSPTSVVVANAGDSRAVLSRAGVPVPLSVDHKPDRQDELERIQEAGGRVIYWDGARVLGVLAMSRAIGDGYLNPFVTAEVLN

SEQ ID NO: 45348 - protein, 301 aa, Sorghum bicolor
  unsure (1)..(301): unsure at all Xaa locations
  Clone ID: SORBI-28MAY03-C15140_1.pep
MAHRLLRDAQADGWERSDFPIICESCLGDNPYVRMLRAEYDKECXICARPFTVFRWRPGRDARYKKTEICQTCCKLKNVCQVCLLDLEYGLPVQVRDTALAINSNDAIPRSDVNREYFAEEHDRRARAGIDYDSSYGKARPNDTILKLQRTAPYYKRNRAHVCSFFVRGECTRGAECPYRHEMPETGELSQQNIKDRYYGVNDPVALKLLSKAGEMPSLTPPDDETIRTLYIGGLDSRITEQDLRDQFYAHGEIESIRMVLQRAIAFVTYTTREGAEKAAEELANKLVIKGVRLKLMWGKP

SEQ ID NO: 45349 - protein, 126 aa, Sorghum bicolor
  Clone ID: SORBI-28MAY03-C153_1.pep
MSSMMNALANWLVNPRRNPLARLHMHAVSSRLRKYGLRYDDLYDPYFDVEIKEALGRLPREVIDARIQRLKRAMDLSMKHQYLPEHVQAQQVPFRGYLSDMLALVKKENAEREALGALPLYQRTLP

SEQ ID NO: 45350 - protein, 353 aa, Sorghum bicolor
  Clone ID: SORBI-28MAY03-C16070_1.pep
MRTHERAANLALAGLSLAPLVVNVNPNVNVVLTACLTVYVGCYRSVKPTPPSETMSKEHAMRFPFVGSAMLLSLFLLFKFLSKDLVNAVLTAYFFILGIVALSATLLPSIKRFLPKEWNDNLIVWQAPLIRWAPFIHSLSVEFTKSQIVASIPGFFFCLWYASKKHWLANNVLGLAFCIQGIEMLSLGSFKIGAILLGGLFVYDIFWVFFTPVMVSVAKSFDAPIKLLFPTADAARPFSMLGLGDIVIPGIFVALALRFDVSRGIKNRYFNGAFLGYAVGMTVTIIVMNWFQAAQPALLYLVPCVIGFVAVPSLWYGEVKQLLEFDESKVEAEEGGVEEEQDDNSSKGNKKVD

SEQ ID NO: 45351 - protein, 549 aa, Sorghum bicolor
  Clone ID: SORBI-28MAY03-C16466_1.pep
HEDVGRRISGGTERTGPDAYEVALKFEHRNSKGCNYGPPYEWQVYSALNGCYGVPWVHYKGRQGDYYVLVMDILGPSLWDVWNSFGQTMTANMVACIAVEAISILEKLHAKGFVHGDVKPENFLLGQPGSPDEKKLFLIDLGLASRWKEAGSSGQHVEYDQKPDIFRGTIRYASVHAHLGRTGSRRDDLESLAYTLIFLLRGRLPWQGYQGENKSFLVCKKKMATSPDLLCCFCPPPFKLFLETVTNMKFDEEPNYSKLISLFDELIEPQHLRPIRIDGALKAGQKRGRLLVNLEEDEQPKKKVRLGSPANQWISVYNARRPMKQRYHYNVADARLHQHIEKGNEDGLFISSVASSANLWALIMDAGTGFSSQVYELSPIFLHKDWIMEQWENNYYISAIAGATNGSSLVVMSKGTPYTQQSYKVSESFPYKWINKKWKEGFHVTSMTTAGSRWGVVMSRNSGYSEQVVELDFLYPSEGIHRRWENGYRITSTAATGDQAAFILSIPKRKLMDETQETLRTSAFPSNHVKEKWAKNLYIASICYGRTVS

SEQ ID NO: 45352 - protein, 354 aa, Sorghum bicolor
  Clone ID: SORBI-28MAY03-C3142_1.pep
MLWVDKYRPKTLDKVTVHDQVAQNLRKLVSEQDCPHLLFYGPSGSGKKTLILALIKQMFGAGAEKVKLENKTWKIDTGTRTLEIELAMLSSAHHVEMNPSDAGFQDRYVVQEVIKEMAKNRPIDAKGKRAFKVLVLNEVDKLSREAQHSLRRTMEKYSSSCRLILCCNSPSKVTEAVRSRCLNVRVNAPSEDQIVQVLEFIGKKENLRLPAGFAARIAAQSNRNLRRAILFFETCKVQQYPFTSNQAAPPLDWEQYVSEIATDILTEQSPKRLFAVRQKFYELLVNCIPPESILKKLLAELLRKLDADLKHEICHWAAHYEHKMRLGSKAIFHLEAFVAKFMSIYKEFLVATFG

SEQ ID NO: 45353 - protein, 159 aa, Sorghum bicolor
  Clone ID: SORBI-28MAY03-C34972_1.pep
GTGTTDAVAKIWDVKTQSNVAKFEGHVGPVTAMSFSENGYFLATAAHDGVKLWDLRKLRNFRTFSPYDSDTPTNTVEFDFSGNYLAIGGSDIRVYQVANVKSEWNLIKTLPDLSGTGKVTSVKFGADAKYIAVGSMDRNLRIFGLPGDDQMEESNTAAE

SEQ ID NO: 45354 - protein, 252 aa, Sorghum bicolor
  Clone ID: SORBI-28MAY03-C3517_1.pep
MPEHSENAAADLMGNIMETIAENLPKQKSVRFDDGEGSISDQAKKLFGGGQAGNKKSIHHVLGGGKSADVLLWRNKKISSSVLGVATLVWVFFEWLDYHFLTIVCFLLALGMAVQFAWSTFAAVLNRGSPSSVPRVQLPEELFANVGAAVGAQVNRALGFLQDVSCGRDLKQLLIVIAGFFAAAIVGSFCNFLTVIYIGFVCAHTLPVLYERYQDQVDDFLYNMLGVVQSQYQKLDTKGILKGGVSKFRKNE

SEQ ID NO: 45355 - protein, 191 aa, Sorghum bicolor
  Clone ID: SORBI-28MAY03-C17693_1.pep
MASQTTKMLALVAALLALSTIATATANCLQNIPHVMGMTVMDPCMQSCMMQQPLAMVMMGMTAMDPCMQSCMMQQPLAMVISSPSLMMRMNSMVSCVQSCMTQQAFSIGGSSLSKMVMQPQPFSMMQQQCCMQPMMMQGLMSPPCHCGAMCQLMMHLQQMQMTLQLPSMYSTTAMPTLVAYGQKPFPCCAF

SEQ ID NO: 45356 - protein, 143 aa, Sorghum bicolor
  unsure (1)..(143): unsure at all Xaa locations
  Clone ID: SORBI-28MAY03-C25480_1.pep
MTTINPFELLGADDNDDPTQLLAAAAAAKQKAEAKKQAAAATAGPAKLPTKPVPPAQAVKEARSGSAPSRGGYGRGERGRGRGGRGYGQNRDYGSEDANGFQGGYGTGXGARAGGEEGAQDRERGPRPPYRGGGGGRRGGYRD

SEQ ID NO: 45357 - protein, 388 aa, Sorghum bicolor
  Clone ID: SORBI-28MAY03-C24768_1.pep
TREQSTSKRASSPQTDAEQGGGSLKSMKDKSGQQDKDAKEGSNLQVAGPAGEITAGYLLKKSAKTNGWSKRWFVLNEKSGKLGYTKKQEERHFRGVITLEECNLEEVEEEEPSKSSKDSKKANGSEKTPSLVFKITNRVAYKTVLKAHSAVVLKAESMADKVEWVNKIKAVIQSKGGSFKGPSTEGGSMRQSNSDGALDTMARRPADPEEELRWMSQEVRGYVEAVLSSLAANVPKAIVLCQVEKAKEDMLNQLYSSISGQSNVKIEELLQEDHNAKRRREKYQKQSSLLSKLTRQLSIHDNRASVSSYSNDTTEAESPRTPSRSGEDWRSAFDSASNGPVAASKNSESRSRSADGRSRRYENGDVSSGANSGSRRTPNRLPPAPPKY

SEQ ID NO: 45358 - protein, 455 aa, Sorghum bicolor
  Clone ID: SORBI-28MAY03-C25602_1.pep
MGIGNGSSSNVSHKAMQDETTPLLPIKAEEDVVHEFDGASFSGAVFNLSTTIVGAGIMALPASIKMLGLIPGILMIILVALLTEASIDMLVRCSHQGKITSYGWLMGDTFGQWGRIALQASVVINNVGVLIVYMIIIGDVLSGTSSTGVHHSGVFEGWFGPHMWNSRPIVLLTTTLVVFAPLVSFKRLDSLRYTSALSVALAVVFVVITAGVAIVRLIQGTVEIPKLFPEIDGVSSVWKLFTAVPVLVTAYICHYNVHSIDNELEDKTQIKPIVQTSLGLCSSVYIATSFFAYLLFGEATLADVLANFDSDLRIPFSSVFNDIVRVSYVVHIMLVFPIVFFALRLNLDGLLFPTARHISHDNKRFTIITISLIAVIYLAAIFVPSIWDAFQFTGATAAVLIGFIFPAMIILRDPYGVSTKRDKVLAVTMIVLAVVSNSVALYSDALNIFYRKQEA

SEQ ID NO: 45359 - protein, 122 aa, Sorghum bicolor
  unsure (1)..(122): unsure at all Xaa locations
  Clone ID: SORBI-28MAY03-C25660_1.pep
MPPQRKGALLQAAHAADXPGLQQAGQGQPSSSSALGGHPAPPLYYHGQGPPYHPPPPPYXGYLPPPRMPYPPQYPRYQPMVAPPAQAQAPPTSCHHPPPAGAAQQPPHGPPPQLQPQPQIHN

SEQ ID NO: 45360 - protein, 546 aa, Sorghum bicolor
  unsure (1)..(546): unsure at all Xaa locations
  Clone ID: SORBI-28MAY03-C2656_1.pep
ASARHHAHVSTSESSPPPPPPCFSFPPPSSPPLASHSPSPPASQTLPLPPASSSSPASLXSSPLRAFCPRAPPSPSLATCAAFSSSSSTMAAADNPLLVADFDFPPFDRVEPTHVRPGIRELLTRLEGELEELEKGVQPTWGKLVEPLERITDRLEVIWGMVDHLKAVKDSADLRAAVEEVQPDKVKFQLRLGQSKPIYEAFKAIRNSSDWDSLSDARKRIVEAQIKEAVLSGVALEDEQREKFNQIEQELEKLTQKFSENVLDATKKFEKLITDKKEIEGLPATALGLAAQTAVSKGHENATAENGPWVITLDAPSYIPVMQHAQNRELREEVYRAYLTRASSGELDNTNIISQILKLRLEKAKLLGYKNYAEVSMAQKMATVERVEELLEKLRAASWDHAVKDMEDLKIFAKDSGSPEANDLTHWDLTFWSERLRETKYDINEEELRPYFALPKVMDGLFTLAHKLFGVTVEPADGLAPVWHSDVKFYCVKDSSNSPVAYFYFDPYSRPSEKRGGAWMNVVFSRSRVLARNGLSARLPVXHMVX

SEQ ID NO: 45361 - protein, 171 aa, Sorghum bicolor
  Clone ID: SORBI-28MAY03-C26653_1.pep
KQFRAMNKLKKMALKVIASNLNEEEIKGLKQMFMNMDTDNSGTITYEELKVGLAKLGSKLSEAEVKQLMEAADVDGNGSIDYVEFITATMHRHKLERDEHLFKAFQYFDKDNSGFITRDELESALIEHEMGDTSTIKEIISEVDTDNDGRINYEEFCAMMRGGMQQPMRLK

SEQ ID NO: 45362 - protein, 185 aa, Sorghum bicolor
  Clone ID: SORBI-28MAY03-C44229_1.pep
ARRAPRLRLPGRGPPVAAPLADRGHRVALPWLNARPTTETGSPVPAAGALPATLNQTVRVAVTRPRTSRTRQEKDAEEEVLVVEGIEVADHFSRFVKFDVFVNECQGGGGMGAAVAQCAGSVAMTPHLVRPGKGRGSVKTAARFGICDLLDNIGADGDKTIVVSLVPRCAGDMVTVGGVRIEYVK

SEQ ID NO: 45363 - protein, 424 aa, Sorghum bicolor
  unsure (1)..(424): unsure at all Xaa locations
  Clone ID: SORBI-28MAY03-C44253_1.pep
MYLVKDISGAIGLMAVALVLLGTWPVVLAVLERRGRLPQHTFLDFSGTNFLAAVLVALTFGQIGPDTPETPNFLTQLAQVQNNWPSVLFAMAGGVTLSLGTLATQYGWAFVGLSVTEVMASSLKVVIGTTLNYFLDGRINKAEILFPGVGCFLIAAILGSLVLAPNAADNQEKLANSXRSTAKIQGKNTADDEDLTKHLLNKEIPKDPEAAKPDAADQATEAPEKVEAGTAEFLVNLEEKRSIKVLGSHTLLGLGIVVFAGVFYALFAPALNLSTNDQWHALPAGVPHLVVYTAYFYFSLACLAVSAALNVWLLYRPIMAGVPASSTVSAYLRDGGEGRAPAMLAGMVCGLGNAFTFMAGQAAGYAAADSVQALPLVSTFWGVVLFGEYRRSSRRTYTLLASMLLMFTVAMVLLMASSNHRKPL

SEQ ID NO: 45364 - protein, 204 aa, Sorghum bicolor
  Clone ID: SORBI-28MAY03-C27843_1.pep
ARGLTEAVWQKISDPKSIQDILKQVYADHSTNVDKVFSRIVEITQHPAAAASFASIMFAPRGQISFQEAISRCQSQGVPLSLMYGREDPWIRPFWGIKVKQQVPEAPYYEISPAGHCPHDEVPEVVNYLLRGWLKNLESEGSIDLPFLEEPSYAEHGVSRELDFVREGSRKSVSVRLYGTKISLWSQLSSFLNTRVPNSRVVLR

SEQ ID NO: 45365 - protein, 175 aa, Sorghum bicolor
  Clone ID: SORBI-28MAY03-C2844_1.pep
GSTSEADCLHAAPSILHAIYWRLLSWSTATIRSCPALPLCPLAQTEAERGILPILKRIRTVFNKVGIKDSESVVVRITGCPNGCARPYMAELGFVGDGPKSYQIWLGGTPNQSTLAESFMDKVKLDDIEKVLEPLFSYWNSTRQEGESFGSFTNRTGFDKLKDVVNKWAESPSAA

SEQ ID NO: 45366 - protein, 253 aa, Sorghum bicolor
  Clone ID: SORBI-28MAY03-C29343_1.pep
TRAELTSHSTHLFSRLTAAEPHRQQKSPSHHHRTSTRSTTTKLRSTAMSTTSASENKQAQHQQARRPAAVVSSAADDAEMQRVFARIDADGDGRISPSELAAVSRAISPPSSSSHGRREVAAMMDELDTDRDGFVDLGEFKAFHARARAGGGRGGDNGGSGGDELDAELRAAFDVYDVDGDGRITAAELGKVLGRIGEGCSAEECQRMIASVDTDGDGCVGFEEFKKMMCPQQPQAGAGADAGAAGPDKAKKE

SEQ ID NO: 45367 - protein, 308 aa, Sorghum bicolor
  Clone ID: SORBI-28MAY03-C30361_1.pep
MAAGSIRVTMEVGADGVALITIANPPVNALHPIIIAGLKDKYAEAMRRDDVKAIVLTGAGGKFCGGFDINVFTKVHQTGDVSLMPDVSVELVSNMMEEGKKPSVAAIQGLALGGGLELIMGCHARISTPEAQLGLPELTLGIIPGFGGTQRLPRLVGLPKAIEMMLQSKFITAKEGKERGLIDALCSPDELIKTSRLWALEIANCRKPWMRSLGRTDRLGSLSEARAVLNAARQQAMKIAPNMPQHQACLDVMEEGILYGGQAGVLKEAKVFKELVIAPTSKALVHVFFAQRSTTKVPGVTDVQLKPR

SEQ ID NO: 45368 - protein, 315 aa, Sorghum bicolor
  Clone ID: SORBI-28MAY03-C30787_1.pep
MAVDLMGCYAPRRADDQLAIQEAAAESLRSLELLVSSLSTQAGAPHRAAHHLQQQQPFGEIADQAVSKFRKVISILDRTGHARFRRGPVESPPRAAAAPPVPAPAPALSLAPLAHVAPVSAAQPAPASQPPQSLTLDFTKPNLTMSGATSVTSTSFFSSVTAGEGSVSKGRSLMSSGKPPLSGHKRKPCAGAHSEATTNGGRCHCSKRRKNRVKRTIRVPAISSKIADIPPDEYSWRKYGQKPIKGSPYPRGYYKCSTVRGCPARKHVERATDDPAMLVVTYEGEHRHTPGAAGPSPLATASPVAAAVSAGNGHV

SEQ ID NO: 45369 - protein, 193 aa, Sorghum bicolor
  Clone ID: SORBI-28MAY03-C2820_1.pep
MFLVDWFYGVLASLGLWQKEAKILFLGLDNAGKTTLLHMLKDERLVQHQPTQYPTSEELSIGRIKFKAFDLGGHQIARRVWKDYYAKVDAVVYLVDAYDKERFAESKKELDALLSDDSLANVPFLILGNKIDIPYAASEEELRYHLGLSNFTTGKGKVNLGDSNVRPLEVFMCSVVRKMGYGDGFKWVSQYIK

SEQ ID NO: 45370 - protein, 327 aa, Sorghum bicolor
  Clone ID: SORBI-28MAY03-C34054_1.pep
MRAALLRLLHLPVVASRSPSSPLRPAPAARAMASQKQFPPQQQGSQPGKEHAMDPRPEAILQNYKAANKLKNKVALVTGGDSGIGRAVCLLFAAEGASVAFTYVKGHEDKDAEETLRALRDISSRTGARPPMALAADLGYEDSCRSVVEEVASAHGGRIDVLVNNAAEQHERRSITEVAEPDLDRVFRTNIFSYFLTTKHAVARMAPHGGGSVINTASVNAYKGHKTLLDYTSTKGAIVSFTRALALQLADKGIRVNGVAPGPIWTPLIPASFGEEKVEQFGSEVPMKRAGQPAEVAPSYVFLASEQDSSYITGQFLHVNGGVIVNG

SEQ ID NO: 45371 - protein, 219 aa, Sorghum bicolor
  Clone ID: SORBI-28MAY03-C13094_1.pep
MARIHLYLAAACAVALALAAPALAGDPDMLQDVCVADYASPVKLNGFPCKADISADDFFFSGLRNPGNTSNAAGSLVTAANVEKFPGVNTLGVSIARIDYAPGGQNPPHTHPRATEIIFVLEGTLEVGFITTANKLFSKTLIKGDVFVFPRGLVHFQQNRGYGPAAVVAAFNSQLQGTQQIAMTLFGATPPVPTDILAKAFRIGNGEVEHIKANFAPKK

SEQ ID NO: 45372 - protein, 374 aa, Sorghum bicolor
  Clone ID: SORBI-28MAY03-C6022_1.pep
MLGVARRRLGSGCVLSQLAHALRPAAAAPARTYSAAAKEITVREALNTALDEEMSADPSVFLMGEEVGEYQGAYKISKGLLDKYGPDRVLDTPITEAGFTGIGVGAAYHGLRPIVEFMTFNFSMQAIDHIINSAAKSNYMSAGQISVPIVFRGPNGAAAGVGAQHSQCYAAWYAHVPGLKVLAPYSAEDARGLLKAAIRDPDPVVFLENELLYGESFPVSAEVLDSSFCLPIGKAKIERQGKDVTITAFSKMVGYALQAADILAKEGISAEVINLRSIRPLDRAAINASVRKTNRLVTVEEGFPQHGIGAEICMSVVEDSFEYLDAPVERIAGADVPMPYAANLERMAVPQVDDIVRAAKRACYRAAVPMAATA

SEQ ID NO: 45373 - protein, 279 aa, Sorghum bicolor
  Clone ID: SORBI-28MAY03-C6286_1.pep
MDFLQGQSVETTVAVAVAVVAIAAGGAFLLLRSRKPKGCLDPENFRKFKLVEKKQISHNVARFKFALPTPTSVLGLPIGQHISCRGQDATGEEVIKPYTPTTLDSDLGYFELVIKMYPQGRMSHHFREMKVGDYLSVKGPKGRFKYQVGQVRAFGMLAGGSGITPMFQVARAILENPNDNTKVHLIYANVTYEDILLKDELDSMAKTYPGRFKIYYVLNQPPENWNGGVGFVSKEMIQSHCPAPAEDIQILRCGPPPMNKAMAAHLDELNYTKEMQFQF

SEQ ID NO: 45374 - protein, 430 aa, Sorghum bicolor
  unsure (1)..(430): unsure at all Xaa locations
  Clone ID: SORBI-28MAY03-C6389_1.pep
MDEDAGGASRSPTPASLPPPPSACSRPRPRRHRHAGAGRAGGPCRPPHPAAPPGGRAQGLAASPAPWLPVPQALGRAQRLGLRGYSLARGMGVGKHIASETVTLGGLQWAIYFYPDRMRRHRRPNYLCAHAPLASGGRXKHKGHSHSDPSTRSGPYTLKYRGSMWGYKRFFRRTSLEASDFLKDDCLKINCTLGYXXSTMDYSRPHSIEVPESDICYHFGTLLDTQEGVDVIFSVCGENFHAQWLVLAXKSDFFETDXFDHESGEEKSETDTKDDASLLLLGDPGPXDNELGASSSDGSIFDTLAAKLLAAADKYHLPRLRLLCESYLCKGISVASVATSGASPLAFAGRPLAVELKSVCLLLAAENPSAPIRTEGFDYLVDNCISLQSEILRTVAGCEGPCSCGVKSQSVWAQLSDGGDTSGRRVRPRV

SEQ ID NO: 45375 - protein, 429 aa, Sorghum bicolor
  Clone ID: SORBI-28MAY03-C35219_1.pep
ARGVKQAEDSASNKKPEKKDMVGMQEQVFVWKIIELHDKYVAYVTECFQGHTLFHKALKEAFEVFCNKGVSGSSSAELLATFCDNILKKGCSEKLSDEAIEDALEKVVRLLAYISDKDLFAELEGKKLARRLLFDKSANDEHERSILTKLKQQCGGQFTSKMEGMVTDLTVARDHQTKFEEFVAGHPELNPGIDLAVTVLTTGFWPSYKTFDINLPAEMVKCVEVFKEFYQTRTKHRKLTWIYSLGTCNINAKFDAKPIELIVTTYQAAARRLFNGSDRLSYSEIVTQLNLSDDDVVRLLHSLSCAKYKILTKEPANRSISPNDVFEFNSKFTDRMRRIKIPLPPVDEKKKVVEDVDKDRRYAIDASIVRIMKSRKVMGHQQLVAECVEQLSRMFKPDFKAIKKRIEDLITRDYLERDKDNANMYKYLA

SEQ ID NO: 45376 - protein, 333 aa, Sorghum bicolor
  Clone ID: SORBI-28MAY03-C3696_1.pep
MADASSRTDTSIVLDDIDKNQRMENGSGAVLPSNSSDRSDRSDKPLDQKTMRRLAQNREAARKSRLRKKAYVQQLESSKLKLAQLEQELQKARQQGIFISSSGDQTHAMSGNGALTFDIQYARWLEDQNKQINELRTAVNAHASDSDLRLIVDGIMAHYDEIFKVKGVAAKADVFHILSGMWKTPAERCFLWLGGFRPSELLKLLANHLEPLTEQQMLGLNNLQQSSQQAEDALSQGMEALQQSLAETLAGSLGPSGSSGNVANYMGQMAMAMGKLGTLENFLRQADNLRQQTLHQMQRILTIRQASRALLAIHDYFSRLRALSSLWLARPRE

SEQ ID NO: 45377 - protein, 196 aa, Sorghum bicolor
  unsure (1)..(196): unsure at all Xaa locations
  Clone ID: SORBI-28MAY03-C37369_1.pep
TRIGRPAKDVPQQPTPPLRVSISKKLRAYVEDKYSRAGVEKGKYVVIHGIASDSVANMKSRGDDDCLLPLEHWAQIAKEISSXTRGSSRAQIAKEISTGDKGLKPLFVIPHEKHRDEIEEEVGEDANILFMTXTNTAAVQLANARDKACVALFSSAEKAKLFLPYVEDKSSCTVISSATGKLIDIDINAVKNAVKG

SEQ ID NO: 45378 - protein, 119 aa, Sorghum bicolor
  Clone ID: SORBI-28MAY03-C39799_1.pep
LRCYILNMTLTSQIFGHKISFCCGLVPATVTKEKGKVGGSIAVYLDQRAKGEIGRTQATKQGSGASTQRTSRSGTPINTADRWTDQKPGASRGGRAGASAQDGRQAGQCKAAAHQDSVV

SEQ ID NO: 45379 - protein, 116 aa, Sorghum bicolor
  Clone ID: SORBI-28MAY03-C4069_1.pep
ITHATFSCDSQLIYASFMDATVGIFNASSLRLQCRILPASYLPPNISPSVHPVVVAAHPSEASQFALGLTDGGVFVLEPLESERKWGNPPPVENGSASNLSTPPPNGASSSDQPER

SEQ ID NO: 45380 - protein, 197 aa, Sorghum bicolor
  Clone ID: SORBI-28MAY03-C359_1.pep
HACMDDQLCVGFSISLSVSFSSSSASFLITSTVGSAITSPVAIFSSAGADGFSSSTTVFSTASSSSSLFSGSATTAASGVITSSAFCSGSAVAGSFCSAAVAAGSSSLSSSTTFSTTCSAATSVGTVVVSGATLGVEMLASAGACPSSVLGLVAQAPMVAVAVAAARFFGRWRRRSRRCLNVWRSASPVAGCAGPAG

SEQ ID NO: 45381 - protein, 67 aa, Sorghum bicolor
  Clone ID: LIB3481-052-Q6-K1-G10.pep
RSRRGRQPGGARALGVEMDLSDKPVGLGVRSRRYALLAEDGVVKVLNLEDGGAFTTSSAEEMLKVLG

SEQ ID NO: 45382 - protein, 143 aa, Sorghum bicolor
  Clone ID: LIB5047-005-R1-XP1-E8.pep
HACMDDQLCVGFSISLSVSFSSSSASFLITSTVGSAITSPVAIFSSAGADGFSSLSSSTTFSTTCSAATSVGTVVVSGATLGVEMLASAGACPSSVLGLVAQAPMVAVAVAAARFFGRWRRRSRRCLNVWRSQARAGLESGRH

SEQ ID NO: 45383 - protein, 116 aa, Sorghum bicolor
  Clone ID: LIB3480-052-P1-K1-C7.pep
WKEALGLGEDVMLLSDGNLELTRALGVEMDLSDKPEQKADEVITPEAAVVAEPENKEEEEEAVEKTVVEEEKPSAPAEEKIATGEVMAEPTVEVIKKDAEEEEKETDKEIEKPTQS

SEQ ID NO: 45384 - protein, 497 aa, Sorghum bicolor
  Clone ID: SORBI-28MAY03-C425_1.pep
EEENKGKETDADGKQERGGAEEKGSADKKDEDEDEDEGEGDKMEENKQETWKNKKARSARECSQGKSKKQDGSKSREAKSLLNTPSPYGTDRPQRERKTVERLVEVIEKGPNRNFVVDKGQGTPLKDIPSVAHRISRKKPSDLKFLHSILFGRKGKAVDFKGHILQFSGFVWHESDEKQRAKAKEKLDKCVKDTLLDLCWTLGIPTPKANIRKEDIVSKLLDFIAEPHSAADSGLSDDQGSNSKKRKRGGESASKTDDSTPSRSRKKFVERGASSKRQKKALQYDTDEDEDESMNSDSEENRDEDSDEAADKQEGDYRSGKEKAGKKLSEVKESSGKKKANTGSGHKSGPPKKIIKSPVKKVSSKVHEEKGSPNDSAKVFSRKKKPTAEKEIKEKKSSGKKKVAKGKGESAEAVLPSKDDLRKTITEILKKVDFNTATFSDILKKLDDHYKMDLTPKKEAIKVMIQDELTKLSEEDEEGEGDGDKQQEQPQAKEIEA

SEQ ID NO: 45385 - protein, 370 aa, Sorghum bicolor
  Clone ID: SORBI-28MAY03-C4394_1.pep
MAMMVDPPNGIGSKGKHYYTMWQTLFEIDTKYVPIKPIGRGAYGIVCSSINRETNEKVAIKKIHNVFDNRVDALRTLRELKLLRHLRHENVIALKDIMMPIHRRSFKDVYLVYELMDTDLHQIIKSPQGLSNDHCQYFLFQLLRARKYLHSAEILHRDLKPGNLLVNANCDLKICDFGLARTNSSKGQFMTEYVVTRWYRAPELLLCCDNYGTSIDVWSVGCIFAELLGRKPIFPGTECLNQLKLIVNVLGTMSEADLEFIDNPKARRYIKSLPYTPGVALASMYPHAHPLAIDLLQKMLIFDPTKRISVTEALEHPYMSPLYDPSANPPAQVPIDLDIDENISSEMIREMMWQEMLHYHPEVVTAISMS

SEQ ID NO: 45386 - protein, 181 aa, Sorghum bicolor
  Clone ID: SORBI-28MAY03-C7645_1.pep
MINLNLKQPLMLPAHQSNVVVGSRLASSPSAAAVSRPRRGGAGVSSSSSRSRSSSRRHTRLPRISCSATEEVSGAVAAVTVEPPQMLTVTATVEASPAIGQMYFERALDDVGDLLGKTLLLELVSSELDAKSGLEKPRVTAFAHKTLRRWLDTSTGATPHTRHLYVRPPPILFHDGWAPCM

SEQ ID NO: 45387 - protein, 428 aa, Sorghum bicolor
  unsure (1)..(428): unsure at all Xaa locations
  Clone ID: SORBI-28MAY03-C7742_1.pep
SKDVSAREMALGARESSRRLQNLSSDERKKILLDVADALEENVDLIRTENEIDVSAAQEAGYEPSLVARLTLKPGKIASLAKSIRTLAYMEDPINQIIKRTEVAEDLVLEKXTSCPLGVLLIVFESRPDALVQIASLAIRSGNGLLPRGGKEAMRSNTILHKVITSAIPSNVGEKLIGLVTSRDEIADLLKLDDVIDLVIPRGSNKLVSQIKSSTKIPVLGHADGICHVYIDKSADMNMAKRIVLDAKIDYPAACNAMETLLVHKDLINAPGLDDLLLALKTEGVAIYGGPVAHELLCIPKADSLHHEYSSMACTIEFVDDVQSAIDHIHRYGSAHTDCIVTTDDKVAETFLRQVDSAAVFYNASTRFSDGARFGLGAEVGISTGRIHARGPVGVEGLLTTRWIMRGSGQVVNGDKDIAYTHKNLPLQ

SEQ ID NO: 45388 - protein, 88 aa, Sorghum bicolor
  Clone ID: SORBI-28MAY03-C7886_1.pep
GMLVPTQRSSAIDFTYSPPPPRACSRSALLVSRPLHTPPRRHAYPPRYAAPQRCQGVLRRGGALSSAAAPRHWGGALICAAAGGVCTS

SEQ ID NO: 45389 - protein, 525 aa, Sorghum bicolor
  Clone ID: SORBI-28MAY03-C44941_1.pep
MGKYTRGCCGWLIVALIAALVATAAMFAIMKRKPGGRHIKPLPVPGPPGAIDSKYGDALGVALQFFQVQKAGKLENNQIPWRGDSALTDGKEAGLDLSKGMYDAGDHMKFTFPMAFTATVLSWSVLEYGDQMSAAKQLDPALDALKWITDFLIAAHPSDNVLYIQVGDPDLDHNCWERPETMTEKRPLTQINKKSPGSDVAAEAAAAMAAASMVFKSRDTTYSDVLLQHAQKLFTFADTYRGLSSESYPKLQDFYNSTSYVDELLWAASWLYHATGDQTYLSYVTVQNGKTYADWGRPTWFSWDDKNPGTQVLLSRLNFFGSKQISNAENEGLKSYRDTAEALVGGLIPDSPQATASRTGGGLVWISGWNSLQHATNAAFLAVVYSDYMLSTRTAAVQCSGKYYSPTDIRNFAASQANYILGDNPMKLSYLVGYGSSYPQQVHHRGASIPADAKTGCKGFQYLHSSDPNPNVAVGALVGGPFQNDTFVDSRDNAVQTESSTYNSGTLVGLLSGLVTTSSVVQSFT

SEQ ID NO: 45390 - protein, 539 aa, Sorghum bicolor
  Clone ID: SORBI-28MAY03-C46299_1.pep
HEEEAHLMPATPLFPLAGLHKYIAILLVVLSWALVHRWSLRKQKGPRSWPVIGATLEQLRNYHRMHDWLVGYLSRHKTVTVDMPFTSYTYIADPVNVEHVLKTNFTNYPKGDVYRSYMDVLLGDGIFNADGELWRKQRKTASFEFASKNLRDFSANVFREYSLKLSGILSQASKAGKVVDMQELYMRMTLDSICRVGFGVEIGTPSPDLPENSFAQAFDAANIIVTLRFIDPLWRVKRFFHVGSEALLAQSIKLVDEFTYSVIRRRKAEIVEARASGKQEKMKHDILSRFIELGEAGDDGGFGDDKSLRDVVLNFVIAGRDTTATTLSWFTHMAMSHPDVAEKLRRELCAFEAERAREEGVAVPCCGPDDDKAFAARVAQFAGLLTYDSLGKLVYLHACVTETLRLYPAVPQDPKGILEDDVLPDGTKVRAGGMVTYVPYSMGRMEYNWGPDAASFRPERWINEEGAFRNASPFKFTAFQAGPRICLGKDSAYLQMKMALAILFRFYSFQLLEGHPVQYRMMTILSMAHGLKVRVSRAV

SEQ ID NO: 45391 - protein, 312 aa, Sorghum bicolor
  Clone ID: SORBI-28MAY03-C55380_1.pep
MEKSRVLVVGGTGFIGRRIVRASLAEGHPTLVLMRPEIGLDIDKLQMLLSFKAQGARLVEASLEDHAALVAAVAQADVVISAMSGVHFRSHNLSLQHRLVEAIKEAGNIKRFIPSEFGMDPSKMTHALEPGRVTFEEKMDLRRAIEEANIPHTYVSANCFAAYFCPNLCQMRTLLPPKEKVHVYGDGNVKVIFCDEDDVATYTMKSVDDPRTLNKTIYLRPPENILTQNDVISTWENLSGNVLEKIHIPADEFLASMKDTDFANQVGVGHYYHIFYEGCLTNFEIGDDGAEGTLLYPEVQYTRMDEYMKRYV

SEQ ID NO: 45392 - protein, 250 aa, Sorghum bicolor
  Clone ID: SORBI-28MAY03-C5560_1.pep
MSRFGRSGPPPIRDTYSLLVLNITFRTTADDLFPLFDKYGEIVDIYIPRDRRTGDSRGFAFVRYKYEDEAQKAVDRLDGRLVDGREIMVQFATYGPNAERINKGRIVEPVPRPRGRSRGRSPRRRYRDDYRDDYQDRDYRWRSCSLSRDRYARDSYRDGDSPPASPSCCLCPQGCKKRGKDSFSSARSSPSRSRSPSYCPDDYKRRGRDSASPASRSPSRSPPRKMSPSPERSPAKHNDDRSPRSRSPST

SEQ ID NO: 45393 - protein, 437 aa, Sorghum bicolor
  unsure (1)..(437): unsure at all Xaa locations
  Clone ID: SORBI-28MAY03-C5535_1.pep
HEEPIPHGGTTKAATICAGGRATGGGDADALRRVERARREFNRLHIQPHGTTLLPDPCDLQPHAVPPPLGKDRGIDREKDKDRDRRTHRDRDSGRGRDRDSDRHRDRDRDRDRDLDRHSTLHRERREPRDRPDDRRGLDPERRXERDRDGHRRHRSRSRARGSNRRSRSRSRSKRVSGFDAPPPQAMGSPFPVIPTPSQLPGTSLPTIGGMFPNMLPFGVAGQFNPLVIQPQAMTQQATRHARRVYVGGLPPSANEQTVAVYFNQVMAAIGGNTAGPGDAVLNVYINHDKKFAFVEMRSVEEASNAMALDGIMFEGAPVKVRRPTDYNPSLAAALGPSQPSPNLNLAAVGLTAGSTGGLEGPDRIFVGGLPYYFTEAQVRELLESFGPLRGFDLVKDRETGNSKGYAFXVYQDLNAPTLWAXLNGIKMGDKTLTVRR

SEQ ID NO: 45394 - protein, 288 aa, Sorghum bicolor
  Clone ID: SORBI-28MAY03-C57_1.pep
MAPPPASLSAHNALSLLAPATARVSSGRWSSLSVSVSARPVTRVVSVALAPAAAVTAQRRLVAAAAATEMAPAASGEEGSKPFVEEMRAVAMKLHTKDQAREGEKEPEAPPVAKWEPSVEGYLRFLVDSKLVFQTLEDIVERAAVPWYAEFRNTGLERSEALKKDLEWFRQQGHTIPEPSPPGTTYASLLEELSEKDPQAFICHFYNVYFAHTAGGRMIGKKVSEKILNKKELEFYKWEGNLSQLLQNVRNKLNEVASSWSREEKDHCLEETEKSFAYSGGLLRHIFT

SEQ ID NO: 45395 - protein, 374 aa, Sorghum bicolor
  unsure (1)..(374): unsure at all Xaa locations
  Clone ID: SORBI-28MAY03-C36_1.pep
LPGLVSSSNSLARRGERVVRQPAPPKGRLGGLLLERRAGRASPIIQADATNVATTLVDCMLCCVGXGFTAPSRPGXLAEVSPLRWILQFISAFPLFIIIGYLVANLINYGTSRIPDWGWRLSLGLAAVPAAVMVAGAAFIPDTPSSLVLRGKHDDARAALQRVRGKGVDIGAEFADILAAAESDRRNEEGAFRRILRREYRPYLVMAVAFPVFLNLTGVAVTAFFSPILFRTVGFESDAALMGAVILGLMNIGGILASGFAMDRYGRKLLFVIGGALMFTCQVAMASIIGSQLGNGSKMPKGYAVTNRRAEQIVDCSSRLPRLGPLAVDGGRLSPAASNQALKVTRHKSPQHAMILFSPLIYRVFSSPSIPEKF

SEQ ID NO: 45396 - protein, 72 aa, Sorghum bicolor
  Clone ID: LIB3476-023-P1-K1-E12.pep
TDRSNSRRSPFTNIQSFISSWIDHFLPQRWCQERTSSSGIANFRSTSRALLAPTSREQQLNLGGISWGWGGA

SEQ ID NO: 45397 - protein, 65 aa, Sorghum bicolor
  unsure (1)..(65): unsure at all Xaa locations
  Clone ID: LIB3480-034-P1-K1-H10.pep
QLFLRXGFHLLSLCLRKLCRPYNVRCXIEKLIQLLPLSCGINQNRDFSLTCLQIWIFCEWFKDSF

SEQ ID NO: 45398 - protein, 397 aa, Sorghum bicolor
  Clone ID: SORBI-28MAY03-C5844_1.pep
MAMIDEPLYPIAVLIDELKNEDIQLRLNSIRRLSTIARALGEERTRKELIPFLSENNDDEDEVLLAMAEELGVFIPYVGGVEHAHVLLPPLETLCTVEETCVRDKAVESLCRIGAQMKESDIVDWFIPVVKRLAAGEWFTARVSSCGLFHIAYPSASDQLKTELRTIYGQLCQDDMPMVRRAAASNLGKFAATVEQNHLKTEIMSIFDDLTQDDQDSVRLLAVEGCAALGKLLEPQDCVAHILPVIVNFSQDKSWRVRYMVANQLYELCEAVGPEPTRADLVPAYVRLLRDNEAEVRIAAAGKVTKFCRILNPQISIQHILPCVKELSSDSSQHVRSALASVIMGMAPVLGKDATIEQLLAIFLSLLKDEFPDVRLNIISKLDQVNQVIGIDLLSQS

SEQ ID NO: 45399 - protein, 232 aa, Sorghum bicolor
  Clone ID: SORBI-28MAY03-C10423_1.pep
MSEADVRVIGLWPSPFVIRVLIALKLKGVEYELVEEVVGKKSELLLRSNPVHKKIPVLLHHGKPISESLIIVQYIDEVWSSDTPAFLLPADPYTRAVHRFWAQYVDDKLPPAIRILRGTDGGGKDEAAEQLSAALQLLEEAFTKLSQGKHYFGGDSVGYLDIALVSYVGWVKAVEKMAGVTLLDKAKVPNLVAWADRLCNHPAVVESIPDADKFVEFSVTYGSFSKPINGPK

SEQ ID NO: 45400 - protein, 251 aa, Sorghum bicolor
  Clone ID: SORBI-28MAY03-C1044_1.pep
MASPKMLPLLLLATSLLLSCGLLVSADYAPMTLTVVNNCPYPVWPGIQANSGHDVLEGGGFFLPALSHKSFPAPAHPWSGRIWARTGCTGAGAQLHCATGDCGGRLQCGGLGGAAPATLAQVNLHHGNDQTSYGVSVVDGFNVGLSVTPHEGRGNCPVLACRRNLTETCPGELQLRSPAGSVLACKSGCEAFRTDELCCRNMYNSPRTCRASKYSEFFKRECPQAFTYAHDSPSLTHECAAPRELKVIFCH

SEQ ID NO: 45401 - protein, 189 aa, Sorghum bicolor
  unsure (1)..(189): unsure at all Xaa locations
  Clone ID: SORBI-28MAY03-C642_1.pep
MATTVMATTTASSLAFFGPGARASAXASPVPLPPIFPRRPGVSSRRAAARCSSGPPSRPRTVXPAAAAPAPKAPGLWDALAFSGPAPERINGRLAMVGFVSALAVEATRGDGLLSQAGNGAGLAWFAYTAVVLSAASLAPVLQGESAESRSGGFMTADAELWNGRLAMLGLVALXAVTEYLTGAPFVNV

SEQ ID NO: 45402 - protein, 160 aa, Sorghum bicolor
  Clone ID: SORBI-28MAY03-C6454_1.pep
MSGGIARGRLAEERKAWRKNHPHGFVAKPETLPDGTVNLMIWHCTIPGKQGTDWEGGYFPLTLHFSEDYPSKPPKCKFPQGFFHPNVYPSGTVCLSILNEDSGWRPAITVKQILVGIQDLLDQPNPADPAQTDGYHLFIQDPTEYKRRVRLQAKQYPALV

SEQ ID NO: 45403 - protein, 328 aa, Sorghum bicolor
  Clone ID: SORBI-28MAY03-C6502_1.pep
MDRPVGASYQRFPRVRIRDLKDDYAKFELRDTDASMANALRRVMIAEVPTVAIDLVEIEVNSSVLNDEFIAHRLGLIPLTSAAAMQMRFSRDCDACDGDGSCEYCSVEFHLAARATDSDQTLEVTSNDLRSMDPKVCPVDQARAYQQALGGTDPFGANTSNENRGILIVKLRRGQELRLRAIARKGIGKDHAKWSPAATVTFMYEPDIRINEELMETLTVEERRRLIESSPTKVFKLDSANQVVVDNAEAYTYDDEVIKHAEALGKPGLVEINAKEDSFIFTVETTGAITAYELIMNAITVLRQKLDAVRLQDDDGDLGELGAHLGGP

SEQ ID NO: 45404 - protein, 123 aa, Sorghum bicolor
  Clone ID: SORBI-28MAY03-C5696_1.pep
MARIKVHELRGKSKTDLQAQLKELKSELSLLRVAKVTGGAPNKLSKIKVVRTSIARVLTVISQKQKSALREAYKKKKLLPLDLRPKKTRAIRRRLTKHQLSLKTEREKKREKYFPMRKYAIKA

SEQ ID NO: 45405 - protein, 279 aa, Sorghum bicolor
  Clone ID: SORBI-28MAY03-C6425_1.pep
MKEHLMLNIDDLSIPEPNEVMGAVKNKSSGETIARLPSKAHAIVAMGESMVSEEEPLLQVVECRICQEEDSIKNLESPCACTGSLKYAHRVCVQRWCNEKGDVICEICHEPYEHGYTAPPRAHPDETTIDISGGWTITGTAFDLRDPRILAVAQNHIMEAEYDDYSATNASTAAFCRSAALVLMALLLLRHALTLTDEDDDDTSAMFSLFLLRAAGFLLPFYIMAWAISILQRRRQRQEAAALAATEVAFILQSGQGRGVHFTIAPDSPATPQHEPPQP

SEQ ID NO: 45406 - protein, 119 aa, Sorghum bicolor
  Clone ID: SORBI-28MAY03-C6519_2.pep
PAGPGSPIQPRVSSAAAAAASVVSARRSHAVPQDVPDQEEAGQEDAPEPPHPLLDPHAHRQHHQVQRQAQALAPHQARLLSGRRDASQRCLGRIRALQARKLLFKILLVLLKGSYQLCL

SEQ ID NO: 45407 - protein, 51 aa, Sorghum bicolor
  Clone ID: SORBI-28MAY03-C6519_1.pep
MPSHKTFRIKKKLAKKMRQNRPIPYWIRMRTDNTIRYNAKRRHWRRTKLGF

SEQ ID NO: 45408 - protein, 69 aa, Sorghum bicolor
  Clone ID: SORBI-28MAY03-C67337_1.pep
MASAVDRLKELVGFVTQADHLRLTTLQQMHKILTTRQAARGLLALGDYFQRLRTLSSLWAARPREAAIS

SEQ ID NO: 45409 - protein, 211 aa, Sorghum bicolor
  Clone ID: SORBI-28MAY03-C72390_1.pep
SRAEIRTAPNNSERRHRTTAIRAPTQDDSNPHTILIRKNKNTMASQSRPEQRRRRRSVAVWLAIIPTATQNHHSNPHGDTESSQQSARSLSEKLKNTQQAGYGIAIRAEQRSAGGGGRSVGCSGSDSLGARRDLSRPSTAAGPDLHQASPRRRGGLGRLTSSLPRPARSLVWRGLDAGRRRRRRRGRHGARGPPLPRSPRSLPGEWCGLFQ

SEQ ID NO: 45410 - protein, 398 aa, Sorghum bicolor
  Clone ID: SORBI-28MAY03-C1130_1.pep
MAAAASSALHAVGAVASAKPRSAAPAVARRRSVRVAAAAAKGGAGSSGRGRLVARNAVAAKADEAAAAAGSKSGGHELLLFEALREALIEEMNLDPTVCVMGEDVGHYGGSYKVTKGLAEMFGDLRVLDTPIAENSFTGMGVGAAMKGLRPVVEGMNMGFLLLAYNQISNNCGMLHYTSGGQFKIPIVIRGPGGVGRQLGAEHSQRLESYFQSIPGLQMVACSTPYNAKGLMKAAIRSENPVVLFEHVLLYNLKEKIPDEEYICCLEEAEMVRPGEHVTILTYSRMRYHVMQAAKTLVNKGYDPEVIDIRSLKPFDLHTIGNSIKKTHRVLIVEECMRTGGIGASLRSAIIDNFWDYLDAPIMCLSSQDVPTPYAATLEDATVVQPAQIVAAVEQICQ

SEQ ID NO: 45411 - protein, 228 aa, Sorghum bicolor
  Clone ID: SORBI-28MAY03-C1154_2.pep
SFIYTSICTTLLAHISSSCAHVQGEDDSTPAPPRASESSSQAIPIGHAGNQSPGMLTYNAEQDAVLSSGNSTPESSPRLFNRRHSTGQSTTDRAGPSDIQSSSDSPWARLNAVSMKYKESITKSTRGWKERLFSRNSSVADLGSEVRREVNAGIASVSRMMERLETRGNSRTGDSPTASTSEVPPATESSNERVTESNSAAAAAGTTTTTSPSASNASAPCVATSGSN

SEQ ID NO: 45412 - protein, 121 aa, Sorghum bicolor
  Clone ID: SORBI-28MAY03-C1154_1.pep
MLVRMLRLFPRNASVLATGTQVLSGVPAGITSGSRLRERRETRGNCRTGDSPTGSSSGVPPATESSNERVTESNSAAAAAAAGTTTTTSPSASNTSAPCVATSGSIWDKVVSLAAVQNCRC

SEQ ID NO: 45413 - protein, 158 aa, Sorghum bicolor
  Clone ID: SORBI-28MAY03-C2704_1.pep
MSDRELRPLRSIRITGDGRCLFRSVAYGACLRREKHAPSDSAQKELADELRAKVADEFVKRRGDTEWFLEGNFENYVRQMRKPHAWGGEPELFMCSHVLRMPITVYMYTSSSDGPRIIAEYGQEYGMDDPVRVLYDGYGHYDALQPSVVRTQSRLRGV

SEQ ID NO: 45414 - protein, 187 aa, Sorghum bicolor
  Clone ID: SORBI-28MAY03-C51489_1.pep
MAKLAVFLLLLAVAASATVPAHGRDPPTEIKLIRGADASGVGGDSMECVYTVFIRTGSIWKAGTDANITLQLAGADGNGVGISDLPSWGGLMGQGHAYFERGNLDIFSGRGPCMAKPPCWMRLISDGTGEHHGWYCNYVEVTVTGPHKGCTQQLFTVEQWLATDAAPYKLEAVRDLCSADGKSVAAA

SEQ ID NO: 45415 - protein, 421 aa, Sorghum bicolor
  Clone ID: SORBI-28MAY03-C4916_1.pep
MSDVTPAGSAPNRPSPPPPSPSPSMPRFQQQPSGRQPPPPGADPFAFRVGAFLGLCFVLISLSAPSTVLHQVPGGRAGVFRRGGALQSSFPPRRQQPPSRNRAATQRTRGGRQESREQRDMAPHQRVLLPFPLVFLLLLLLVVPPRADAWGKEGHIMVCKIAEKYLSEKAAAAVQALLPESAGGELSTVCPWADTVRWHYHWASPLHYVNTPQVCNFKYSRDCHNSRGQQGMCVVGAINNYTDQLYSYGQKTSYNLTESLMFLAHFVGDVHQPLHVGFEDDEGGNTITVHWYRRKANLHHVWDVSIIDTAIKDFYNKSMDTMVETLKMNLTDGWSDDITHWENCENKHATCANDYAIESIHYSCNYAYKDVEQGITLGDDYFFTRYPIVEKRLAQAGIRLALILNRIFDGDKADDIPLRVQ

SEQ ID NO: 45416 - protein, 96 aa, Sorghum bicolor
  Clone ID: LIB3476-001-Q6-K2-H1.pep
SLMFLAHFVGDVHQPLHVGFEDDEGGNTITVHWYRRKANLHHVWDVSIIDTAIKDFYNKSMDTMVETLKMNLTDGWSDDITHWENCENKHATCANE

SEQ ID NO: 45417 - protein, 449 aa, Sorghum bicolor
  Clone ID: SORBI-28MAY03-C552_1.pep
SPAHPPVGLGLAGARGPPVVRRPVPRPPADLAWACVRIPVPAAPPPAGPPPPFGAARPPGPPPARLPAGAVARQCKAPVEDMAAAEGANPPDAHAGPLLVAPSAGPDRDDWPLYRRIVVSFSWRRQMPRLALTLGLEEEMADIIEELIAKRQQLDAVNFAYEAGLQEKFPPVPLLKSYLEDSKKTSTAASDNSSTSSGQSGSNANKKEQSALRAVIKCVEDHNLEAEFSLEDLRKQLEELEKAKTEKKKAASSATSGSSSGPATKRIRASNGGPMPPAKAGRLTNNVCVSSFPAPTTFTQSPSHASYATTSPSHTSYATTSPSHTAYATTSPSHTAYAMTSPSHTAYATASPSHPTYATASPSHPSYTTASPYPYDRPVGHGLYCNRSPPVIREPYVYPAEEVASVNVGIPMPYSTPPMSYPAPYGGYGNGMAAYTNGMAPAFHQAYYR

SEQ ID NO: 45418 - protein, 438 aa, Sorghum bicolor
  Clone ID: SORBI-28MAY03-C57911_1.pep
MSEKENILMHRYEMGKLLGIGSFAKVYHARNVKTSQSVAIKVIDKDKILKCGLMDQITREISVMKLVKHPNIVQLYEVMATKTKIYFVIEYVKGGELFNKVQRGRFKEDVARAYFQQLISAVDFCHSRQVYHRDLKPENLLLDGSHNLKISDFGLSALPDCKRKDGLLHTVCGTPAYVAPEIISRKGYDGAKADIWACGVILYVLLAGYLPFQDKNLMDMYKKICKAELKWPSWFSSDVRKLLRRILHPNPNRRISIEEIMKHPWFKIGLDARMFDSTINTKRDDVPIEMGLTLDSLKSNIVECNSATEKVTNLNAFDIISLSNGFDLSGIFENNSNKEESKFTSTNTTLTIVTKLMEVAKNLGLRVIKKNGGLLKMEVSQPRIKGVMSINVEIFRITPNFHLVEIKRINGDSLEYQNFMNQGMRPALKDIVWAWLGE

SEQ ID NO: 45419 - protein, 624 aa, Sorghum bicolor
  Clone ID: SORBI-28MAY03-C6328_1.pep
MLEELLIFTRGGLILWSSCRALGAAALKGSPIDALIRSCLLEERSADASFSQDNYALKWTFHNDLGLVFVAVYQKILHLLYVDDLLAAVRREFSQIYDPKRTSYDDFGDIFRQLHREAEARAEEMKKSKQALSSRPQPALSQKKVGPKGRRGDSHGAAANKGGSGAKDDSDGDDSGNKDQNTLVNGAFKGQENGVRKENSLARPVVVKGKENGGPKDNGAFDVSKLQKLRTNKKNVAADNGTKKLTKPDTKKKGKQDRVWDDKPSNKKLDFTDPADERGDEVTDNVAVIEGESMMDKDEDLSSDSEDEEVEDGPKKKGWFSSMFQSIAGNNVLEKSDLQPALKALKDRLMAKNVAEEIAEKLCESVAASLEGKKLGSFTRISSTVQTAMEDALLRILTPRRSIDILRDVHAAKERGRPYVIVFVGVNGVGKSTNLAKVAYWLLQHNLSVTLAACDTFRSGAVEQLRTHARRLQIPIFEKGYEKDPAVVAREAIQEATRNKSDVVLVDTAGRMQDNEPLMRALSKLINLNSPDLVLFVGEALVGNDAVDQLTKFNQKLADLSAVPTARLIDGILLTKFDTIDDKVGAALSMVYISGAPVMFVGCGQSYTDLKKLNVKSIVKTLLK

SEQ ID NO: 45420 - protein, 335 aa, Sorghum bicolor
  Clone ID: SORBI-28MAY03-C6586_1.pep
HEGGLNLGDEYCFSTKELWSIIFPSDSERIAISETRKMNEVVHTQAKIIGDHDVMYKYLSKNLVFVATLSPKAAGDIGSALPEEASVVAYLIDAVTGRILHRVTHHGAQGPVHAVLSENWVVYHYFNLRAHRFEMAVIEIYDQSRADNKDVMKLILGKHNLSAPITSYARPEVAVKSQSFFFTHSVKAMAVTQTAKGITSKQLLIGTIGDQVLALDKRYLDPRRSVNPTQQEKEEGIIPLTDSLPIIPQSFVTHSHQVEALRGIVSIPAKLESTTLVFTYGVDLFYTQLAPSRTYDSLTDEFSYALLLITIAVLVGAIIATWIWSEKKELRDKWR

SEQ ID NO: 45421 - protein, 268 aa, Sorghum bicolor
  Clone ID: SORBI-28MAY03-C599_1.pep
MRIQCDACEAAAATVVCCADEAALCARCDVEIHAANKLASKHQRLPLALGDATAASASSLPRCDVCQEKPAFIFCVEDRALFCRDCDEPIHVPGTLSGNHQRYLATGIRVGFSSVCGAGAGPEGLPAPAPPKGSSKPAAVVSAPAAGATQTTTPGPDQPPPALLPSPLLLLDSRTLKSTSFSSVLYFLVQKDSPLGFKELEWFGDIDLFHAHSPAKTTTAEVPELFASPQPASNAGFYKTNGVARQSKKPRMEVPEDDEDYFIVPDLG

SEQ ID NO: 45422 - protein, 366 aa, Sorghum bicolor
  unsure (1)..(366): unsure at all Xaa locations
  Clone ID: SORBI-28MAY03-C6713_1.pep
MASVKVFGSPTSAEVARVLMCLLEKEVEFQLIRVDAYRGTKRMPQYLKLQPHGEALTFEDESLTLSDSRGILRHISHKYAKQGNPXPDRHGRSGARVHRAVAADGGTELRLAQRRDGLQPRHPAAHPAQAAERQQRHRQRVQRQGRGRGQQRRRVQRQARCGRIRAAGGEPEPAEPAEGGGDAEAVRAEEEGPGEAAGHLRAAAGGGQVPGRRQLHHRRPVAPAQRRPPRLRPALPPPVRVPQERQQVVAXRLQPRNLEVRQEPAAPAVHVHRRQRHERPGPAAAPAGIHRRPRREERAALLVLAAAVPSRRXMNYLRRRRPSTRFLQLFVSLISYVVRXLLFFKFPGCVQGPMSPFRLCSLQHVF

SEQ ID NO: 45423 - protein, 716 aa, Sorghum bicolor
  Clone ID: SORBI-28MAY03-C15_1.pep
MASADVHMAGGGAETETFAFQAEINQLLSLIINTFYSNKEIFLRELISNASDALDKIRFESLTDKSKLDAQPELFIRLVPDKATKTLSIIDSGVGMTKSDLVNNLGTIARSGTKEFMEALAAGATDVSMIGQFGVGFYSAYLVADKVVVTTKHNDDDQYVWESQAGGSFTVTLDTTGERLGRGTKITLFLKDDQLEYLEERRLKDLVKKHSEFISYPIYLWTEKTTEKEISDDEDDEDKKEGDVEEVDDDDGDKDDKDSKTTKKKKKVKEVTHEWVQINKQKPIWLRKPEEITREEYASFYKSLTNDWEDHLAVKHFAVEGQLEFKAILFVPRRAPFDLFDTRKKLNNIKLYVRRVFIMDNCEELIPEWLGFVKGVVDSDDLPLNISRETLQQNKILKVIRKNLVKKCIEMFFEIAENKDDYAKFYDAFSKNIKLGIHEDSQNRAKLADLLRYHSTKSGDEMTSLKDYVTRMKEGQKDIYYITGESKKAVENSPFLERLKKKGYEVLFMVDAIDEYAVGQLKEYDGKKLVSATKEGLKLDDDDEEAKKRREERKKQFEDLCKVIKDILGDRVEKVVVSDRIVDSPCCLVTGEYGWTANMERIMKAQALRDSSMSAYMSSKKTMEINPDNGIMEELRKRAEADRNDKSVKDLVLLLFETALLTSGFSLDDPNTFAARIHRMLKLGLNIDEDAAADEDADMPALEEGAAEESKMEEVD

SEQ ID NO: 45424 - protein, 397 aa, Sorghum bicolor
  Clone ID: SORBI-28MAY03-C1776_1.pep
MSSSSPSPAAAAARLDLDGNPIAPLTICMIGAGGFIGSHLCEKLMAETRHVVLAVDVYCDKIRHLVDPAPPHLAGRISFHRLNIKNDSRLEGLIKMADLTINLAAICTPADYNTRPLDTIYSNFIDALPVVKYCSENSKRLIHFSTCEVYGKTIGSFLPKDHPLRKEPEFYVLKEDESPCIFGPIVKQRWSYACAKQLIERLIFAEGAENGLEFTIVRPFNWIGPRMDFIPGVDGPSEGVPRVLACFSNNLLRREPLKLVDGGQSQRTFVYIKDAIEAVVLMIENPARANGHIFNVGNPDNEVTVRELAQMMTEVYANVSGEAPLDEPMIDVSSSQFYGEGYDDSDKRIPDMTIINKQLGWNPKTPLKDLLETTLTYQHKTYKEAVKRQMSQASSTS

SEQ ID NO: 45425 - protein, 181 aa, Sorghum bicolor
  Clone ID: SORBI-28MAY03-C1055_1.pep
MLRAGGRLLLAPGLRRFGLGTGAAAGEAGPAAAAAGVRAYHERVVDHYNNPRNVGSFDKEDPNVGTGLVGAPACGDVMKLQIRVDEDSGKIVDACFKTFGCGSAIASSSVATEWVKGKPMDEVLTIKNTEIAKHLSLPPVKLHCSMLAEDAIKAAVKDYEAKKVKMGQKGVDSPSEKAAEA

SEQ ID NO: 45426 - protein, 203 aa, Sorghum bicolor
  Clone ID: SORBI-28MAY03-C10637_1.pep
MAVKVYVVYYSTYGHVGKLAEEIKKGASSIEGVEAKIWQVPETLPEEVLGKMGAPPKPDVPVITPQELAEADGILFGFPTRFGMMAAQMKAFFDATGGLWREQSLAGKPAGIFFSTGTQGGGQETTPLTAITQLTHHGMVFVPVGYTFGAKLFGMDQVQGGSPYGAGTFAADGSRWPSEVELEHAFHQGKYFAGIAKKLKGSA

SEQ ID NO: 45427 - protein, 229 aa, Sorghum bicolor
  Clone ID: SORBI-28MAY03-C10648_1.pep
MGTCASVHKDPEYPKKQFLDSPTKAKTANGKGGGGGVAPVGDGFGDLKSKVDAEQQRAEFNPKSPDSGSKDEVFFESRAWLDSDCEDDFYSVNGDFTPSRGSTPIYQPRAQTVMSNIFQPDTHSSKSPEPSPTGRRKLAELLQEAMQDGPEESTDEQQQLQSVVADGKPVSESTSSSACSTVPTPTAVDKSRKEKAWYTGRCCLPSFVHSLTLDESERGQKMSSRQCAV

SEQ ID NO: 45428 - protein, 144 aa, Sorghum bicolor
  Clone ID: SORBI-28MAY03-C10708_1.pep
RKTEKDIEEEHEGGGSFELDFTRPKPQAYMPYTATPQSHSVSSVDVEVVPERGDLPAVRPVPLMGESREARLMRYREKRKNRRFEKTIRYASRKAYAETRPRIKGRFAKRADHDGDGDADDAEAEAAVPSSYVLDFGYGVVPSF

SEQ ID NO: 45429 - protein, 123 aa, Sorghum bicolor
  Clone ID: SORBI-28MAY03-C107872_1.pep
MAYYSESGYCAEEARRPYAEPGFCHGEGGGERYAVVRKEYEEVDELARAGRGHHYGHGHSGSGHQHRHVVHAEHEGSCHGGYLGLGEEHREQHQVHGHGHGGRRLYDACESKRYDSCTGQYYA

SEQ ID NO: 45430 - protein, 174 aa, Sorghum bicolor
  Clone ID: SORBI-28MAY03-C108525_1.pep
DILALITFEQIAVLSSDQRKKQQTNNARIQITPPNYTTLLAVPTHIQHHPPIVTPNSHNRDTEARWDKSHTTSFGHSRILCSLFSCIHTCPPSTTAIVPAAESSPSAHLSHQHVQGVDDPRNVPQYGQQEVDPELHAAAVAQEDADRREEDGEEHLQERRRRHCLCVSRCAFFL

SEQ ID NO: 45431 - protein, 305 aa, Sorghum bicolor
  Clone ID: SORBI-28MAY03-C11096_1.pep
MATAVLRRPLLAALLPAGAGESGPSRLRLRRRMSPPPARAVSSDSPKPVASTSSPAGGDSPEEEPPVLPLLQELADCLVLPPKFLAQLPRDLRLDLNDAAFDLSNGPVLDECGQEVGDLLLNLAKAWELADTSASNSIAKQLPSMEPYLTHSAKPAFGKRLVSAGRRFQSMGQYGQGELKKIAETMIKNGKLLSTRPVVQSDVQAMKEKRRLKFGELEFEVTAESANIGAAVAAIFGFISWQLAQGVQNVPDSTMQYANDNALQLAKSLKTALLVLGYTSTGLSLFTAFGLLLLAQRINSENKSE

SEQ ID NO: 45432 - protein, 215 aa, Sorghum bicolor
  unsure (1)..(215): unsure at all Xaa locations
  Clone ID: SORBI-28MAY03-C79_2.pep
MATKIFVLLALLALSVSTTTAVIIPQCSLAPNAIISQFLPPLTLVGFEHPALQAYRLQQALANSILQQPFAQLQQQSLAHLTGQTIAAQQQQQQQFLPALSQLALANPVAYLQQLAYNPLVAANAAAYLQQQQLQQILPALSQLALVNPAAYLQQQQLLPFNQLAVTNTAAYLQQQQLLRVNPVVAANPXAAAFLQQQQLLPFQQISLMNPALSW

SEQ ID NO: 45433 - protein, 268 aa, Sorghum bicolor
  Clone ID: SORBI-28MAY03-C79_1.pep
MATKIFVLLALLALSVSTTTAVIIPQCSLAPNAIISQFLPPLTLVGFEHPALQAYRLQQALANSILQQPFAQLQQQSSAHLTVQTIAAQQQQQQFLPALSQLALANPVAYLQQQLLASNPLALVNNAAYQQQQLQQVLPVISQVAMANPAAYLQQQQLAYNPLVAANAAAYLQQQQLQQILPALSQLALVNPAAYLQQQQLLPFNQLAVTNTAAYLQQQQLLRVNPVVAANPLAAAFLQQQQLLPFNQISLMNPAFSWQQPIVGSAIF

SEQ ID NO: 45434 - protein, 582 aa, Sorghum bicolor
  unsure (1)..(582): unsure at all Xaa locations
  Clone ID: SORBI-28MAY03-C2232_1.pep
KAPSGSSGSLSRPWLSLWRAAIFVEVDKQVKEMLKLIEDEGDSFANEAEMYFQRRPLLVNHVENFYRMYRALAERYDNVTGELRKGLAPQSPRSRVSVPDAATPSLPPAPVPCRAPNSPVPXRSSRAARCQAFLGPGASSVGPFLGSGGSSSSSSDSDSEAAAAREENGNGISYIMDGRITELEDELQEARQQIEALEAKNLHCQCEKLEENLKQVSNEKEDLVAAILASKNEIEDLKGEMASTAKHFEAQLVHRDHEIEKRKQEVEQVSEKYFHGKSALVSEIERLQEVVKNFERNLTEVTGEKLQLEAQVKDLEQVSNNLDDSSAEIIKLQGIIKDLQARLENDSNEKGVLEERAMELEQVRRQLEDSRAEARELQATIKDLKDDLEKALQEKAELQNRMKDVEQVTSDLNSLIASLESKLTATEAQLEQLHVEKAEASLESEKHLSHLIQTIAHLKTEIELLSSEKAAVENKVSVLLIDVTTRDEKLKEMDNHLHQLHLEHVKLIEEADIAWKDMSGLRSRVCELEEEIEKQKLIISDSAEGKREAIRQLCFSLDHYRHGYQQLRQLLQDHRRPVVMAT

SEQ ID NO: 45435 - protein, 216 aa, Sorghum bicolor
  Clone ID: SORBI-28MAY03-C23652_1.pep
MAAPSLIRLRPPRASLLILLLLALNISLSFAANFEGFDSDDLPSAAGGLDADDDEEGLDGVDLPPPPPISLSTSAPSPPVTTTSAPNPNNPATPAPRDPTPALDLWDEDEFEGIPVPEAISSDDSAAPAEADPSDPSAEAPAEAAPAAKRTPAELLRAFSVEIACVSFLICFVLNYFTGKRQNENIALAWATKFATRDSIFDKNFSLLGTGDGKDT

SEQ ID NO: 45436 - protein, 328 aa, Sorghum bicolor
  Clone ID: SORBI-28MAY03-C24397_1.pep
MSWCTIESDPGVFTELIQQMQVKGVQVEELYSLDVDSLSQLRPVYGLIFLFKWIPGEKDERLVVRDPNPNLFFAHQVITNACATQAILSVLMNRPEIDIGPELSQLKEFTGAFTPDLKGLAISNSESIRTAHNSFARPEPFISDEQRAATKDDDVYHFISYLPFEGVLYELDGLKEGPVNLGQCGGADDLDWLRMVQPVIQERIERYSQSEIRFNLMAIIKNRKEVYSAELEELEKRREQILQEMNKTAATESLNNSLTEVISAIETVREKMVMEEEKFKKWKTENIRRKHNYIPFLFNLLKMLAEKQQLKPLVEKAKQQKSSSPSTR

SEQ ID NO: 45437 - protein, 409 aa, Sorghum bicolor
  Clone ID: SORBI-28MAY03-C1307_1.pep
MAAALAVLLLACSGAVAVARAQDTERIEGSAGDVLEDDPVGRLKVYVYELPTKYNKKMVAKDSRCLSHMFAAEIFMHRFLLSSAIRTLNPEEADWFYTPVYTTCDLTPWGHPLPFKSPRIMRSAIQFISNRWPYWNRTEGADHFFVVPHDFGACFHYQEEKAIERGVLPLLRRATLVQTFGQKDHVCLKEGSITIPPYAPPQKMKTHLVPPGTPRSIFVYFRGLFYDTANDPEGGYYARGARASVWENFKNNPLFDISTDHPPTYYEDMQRAVFCLCPLGWAPWSPRLVEAVVFGCIPVIIADDIVLPFADAIPWEEIGVFVAEDDVPKLDTILTSIPMEVILRKQRLLANPSMKQAMLFPQPAQPGDAFHQILNGLARKLPHGEDVFLKPGLKVLNWTEGPRGDLKPW

SEQ ID NO: 45438 - protein, 289 aa, Sorghum bicolor
  Clone ID: SORBI-28MAY03-C12533_1.pep
MPAAMAAAAAQRLLAASTKIIGVGRNYVAHAKELGNPVPKEPVLFPKPSSSKASGPPTMPAAMAAAAAQRLLAASTKIIGVGRNYVAHAKELGNPVPKEPVLFLKPTSSFLHAGVATAAVEIPEPLESLHHEVELAVVISQRGRDVPEASAMDFVGGYALALDMTARDLQSVAKSAGLPWTLAKGQDTFTPISAVVPKSAVTNPDDLELWLKVDDELRQKGPTSDMLFKIPFLISYISSFMTLMEGDVILTGTPEGVGPVRVGQKITAGVTDLIDVEFDVQRRNRSFST

SEQ ID NO: 45439 - protein, 74 aa, Sorghum bicolor
  unsure (1)..(74): unsure at all Xaa locations
  Clone ID: LIB3478-044-P1-K1-D8.pep
THHVFTSVNDNFSINQVPKSAVTNPDDLELWLKVDDELRHXVPTSDMLFKIPFLISYISSFMTLMEGDVILTST

SEQ ID NO: 45440 - protein, 150 aa, Sorghum bicolor
  Clone ID: SORBI-28MAY03-C12588_1.pep
HEAGFTCKEFERPEDWQESQEPQFVSLGSGKFCIARFFHTTVTVSNGYYTDDEVTNRSFGVLTGVEVLPRVYVRNGDGSANDSKGDGSANGSNGNGNGNGNASSNGNSTSICNGGSGRGNGNGGKRKLRMVKHKSRCHVSANGTVIESVF

SEQ ID NO: 45441 - protein, 231 aa, Sorghum bicolor
  Clone ID: SORBI-28MAY03-C14166_1.pep
MTTAARPTWAPAKGGNEQGGTRIFGPSQKYSSRDLAAHTSLKPRKDGQQTQEELQKRNLREELEERERKHYSSKDKSYSEERDRRKSSSQLLLEGSKREAEDKIVPREIDADDSDVEPKSDDESDEDDDDDDDTEALMAELERIKKERAEEKLRKERQQAEEEAKMKEAELMRGNPLININNPGSFSVKRRWDDDVVFKNQARGETKTPKRFINDTIRSDFHRKFLQRYMK

SEQ ID NO: 45442 - protein, 137 aa, Sorghum bicolor
  Clone ID: SORBI-28MAY03-C13678_2.pep
YFHISVHGLNIFVAEKIFEGSSHVNVSHVIHELSFGPKYPGIHNPLDETSRILHDTSGTFKYYIKVVPTEYKYLSKKVLPTNQFSVTEYFLPIRPSDRAWPAVYFLYDLSPITVTIKEERRNFLHFITRLCAVLGGT

SEQ ID NO: 45443 - protein, 350 aa, Sorghum bicolor
  Clone ID: SORBI-28MAY03-C13678_1.pep
MARIPSLKSLNAFPHAEEHLLKKTYSGAVVTILGLLVMITLFVHELQFYLTTYTVHQMSVDLKRGETLPIHINMSFPSLPCEVLSVDAIDMSGKHEVDLHTNIWKLRLDKYGHIIGTEYLSDLVEKGHGAHHDHDHGQEHHDEQKKPEQTFNEEAEKMIKSVKQALGNGEGCRVYGMLDVQRVAGNFHISVHGLNIFVAEKIFEGSSHVNVSHVIHELSFGPKYPGIHNPLDETSRILHDTSGTFKYYIKVVPTEYKYLSKKVLPTNQFSVTEYFLPIRPSDRAWPAVYFLYDLSPITVTIKEERRNFLHFITRLCAVLGGTFAMTGMLDRWMYRLIESVTNSKTRSVLR

SEQ ID NO: 45444 - protein, 376 aa, Sorghum bicolor
  Clone ID: SORBI-28MAY03-C1450_1.pep
WSCLYYSDFWFRYVLRTVDKGSLDLANNALARATHVFVKKQPEIHLFRARFKELNGDISGARAEYQHLYSDLCPGFLEAIVKHSNMEHRLGEKELSCTVYEKAIAAEKGKEQSQLLPTLLIQYSRFLFLAVRDSEKAREILNVLHEQLNVTKPVLEAVIHLESIFPCEKRIEFLDSLVEKFVTPESSQGEVASLVDKEEISSIFLEFLDLFGDAKSIKKALTRHTTLFSCKRSILPSKKRKADDVVVSERDKFAKTGAVQSATGTDPNASNPPVWPATSEASGQQWGASYAQQAAYPAYGTYDYSHQMPQPAPQAAAYGAYPPTYSAQAYTQQNYAQPAAIPAAPVPAVVPAATPASAYPQQPAAAPQPYYGTTYY

SEQ ID NO: 45445 - protein, 647 aa, Sorghum bicolor
  Clone ID: SORBI-28MAY03-C1477_1.pep
MLAPVLAPLAGRVERLITLATGSRLPPPLAPALFRGTLSTNDSDLSGPSDAEVDAVGSICAFLHVTFNTFPLERIMTVLAYRTEIVPALWNFIKRCNAVRRWPFFSKFASSLPADVPGWLLPVAVFCPIYRHMLKIIDNGEFYEQEKPLSLTDLKSLVLILKQALWQLLWVIPSSSPQKVSPNPSGLKKLSVENVKTRARVGLSELLTQLQDWNNRLPFTSASDFYSQEATSENFVSQAILGNTRASEIIKLTPFLAPFTSRVKIFNNQLTSSRQSTSHSALTRQRFKIRRNRLLEDAFDQLSLLSEEDLKGPIRVSFINEHGEEEAGIDGGGIFKDFMENITRAAFDVQYGLFKETADHLLYPNPGSGLVHELHLQYFHFLGSLLGKAMYEGILVDLPFATFFLSKLKQKYNFLNDLPSLDPELYRHLLFLKHYNGDISELELYFVIVNNEYGEQCEEELLPGGREMRVTNDNVITFIHLVANHRLNYQIRAQSTHFLRGFQQLIPKDWIDMFNEHEIQVLISGSLESLDIDDLRSNTNYSAGYHPDHELIEMFWEVLKSLSSDNQKKFLKFVTGCSRGPLLGFQYLEPKFCIQRAGVPGLEEHADRLPTSATCMNLLKLPPYKSKEQMQTKLLYAINSEAGFDLS

SEQ ID NO: 45446 - protein, 146 aa, Sorghum bicolor
  Clone ID: SORBI-28MAY03-C13948_1.pep
MPRGGFSGSLRSPKIDVVIDMGNPFLNRTVDGFLKIGAVGACKVAAEETFDCLHRGDVSKHKVKHALKKMCQEGAYWGTVAGVYVGMVYGVERVRGRNDWKNAMIGGALSGALISGASNNHKDKIIKDAITAGAVATAVEFINCLT

SEQ ID NO: 45447 - protein, 64 aa, Sorghum bicolor
  Clone ID: LIB5050-005-R1-XP1-E1.pep
PRKKKKKKKKKKKIDMGEPLSSNQHRRRLSSRSGAVRRLQGGPPRRPSIASTGGMLQSTRLSMP

SEQ ID NO: 45448 - protein, 199 aa, Sorghum bicolor
  Clone ID: SORBI-28MAY03-C14357_1.pep
MSGKVLLVAVLLVGVAASRCSGSRGLQGGDHVAEQKYGGGGYGGGGSGGGYGGGGSGGGYGGYGGGGGGSGYGGGGGGYTPAYSGTGTCDYWKSHPDAIISCIGSLGSILGSLGDVCSAFFGSKVQTLQDALCNTRSDCYGDLLREGAAAYLNSVAAKKQQFAYSTQQVKDCIAVGLTSKAAAVAQAAMFKKANYACHY

SEQ ID NO: 45449 - protein, 360 aa, Sorghum bicolor
  Clone ID: SORBI-28MAY03-C30749_1.pep
MATKLVVLGIPWDVDTEGLREYMAKFGPLDDCVVMKERSSGRSRGFGYVTFASADDAKNVLDCNHVLGSRTLEVKIATPKEEMKSQGTKKATRIFVARIPQSVDESMFRRHFEAFGEILDLSWPWGHGSKGHRGIGFITFQSAESVDSIMQESHELDGTTVVVDRATPKDEDVRYPPSRPSQGGYGAYNAYISAATRYAALGAPTLYDHPGSAYGRGYYGSSQAVGKKIFVGRLPQEANTDDLRHYFGRFGRIVDAYIPKDPKRSGHRGFGFVTFADEGVAERVARRSHEILGHEVAIDPAAPLENDSAAGGYIDPMDLYGAYGSMRSFGRFCGGLDYNYGYGPSSGSSRSRSDWRYRPY

SEQ ID NO: 45450 - protein, 459 aa, Sorghum bicolor
  Clone ID: SORBI-28MAY03-C3573_1.pep
MMKWGLSSGTPADSYYEVRSDCTDGVPKSKFKIKAGKTLSARKWQAAFSPDGCLDIASVLGRIQRGGVHPTVRGEVWEFLLGCFDPRSTFDEREEIRQIRRIQYARWKEDCRLMDSHVGSGKVITAPLITEDGRPIKDPLVLLEATSDNNRSEGAPTTSINRTEIDESAEPITDKQIIEWKLTLHQIGLDVLRTDRTMVFYENKENLSKLWDILAVYAWIDKDVGYCQGMSDLCSPMIVLLNDEADAFWCFEKLMRRLRGNFKCTDQSVGVANQLQHLASIIQVLDPKLHDHLETLGGGDYLFAFRMFMVLFRREVSFGDSLYLWEMMWALEYDPDIFFAACEEQGAVHKNKVSKSKLKGLRHFGKWENSKDKDKDKDKDKDKNGAEDGEDGPVPISVFMVASVLKEKREKLLQEARGLDDLIRILNDVNGNLDAKKACAGALKLHKKYLKKVQQAKKP

SEQ ID NO: 45451 - protein, 571 aa, Sorghum bicolor
  Clone ID: SORBI-28MAY03-C1808_1.pep
TRLQLAVAIAQAISDLPEGPRTMVGIATFDSAIHFYSLKRAQQQPLMLIVPDVQDVYTPLQTDLILPVSECRENLEQVLESIPNMFENNRVADSAFGAAMKAGFLAARATGGKLLVFQSVLPSLGIGSLSAREAEGRANITTGDKEAHKLLQPVDNTLKTMALEFAEYQVCVDVFLTTQSYVDIASISVVPQTTGGRVYYYYPFSALSDPAKLFNDLRWNISRPQGFEAVMRVRCSQGLQVQEYFGNFCKRVPTDIDLPAIDSDKTVMVTFKHDDKLPENVECGFQCALLYTTVYGQRRIRVINLSLSCTSLLANLFRCADLETQFACFLKQAANGIPTSPLPRIRDEATNTCINILQSYRKHCASVTSSGQLILPEALKLLPLYTLALVKSVGLRTDGRLDDRSYWISLVSSISVVLAVPLVFPRLIPIHDLTSRDDDDSLVPSPLMLNSENVQEDGVYLLENGEDGLIYVGNMVNPGTLEQIFGVSSLAALPVQLALDQFDNELSRKVNEVVNEIRRQRCSYLRLRLCRRGEPSGDFFRSFLIEDKAPGVFSYVEFLVHVHRQIQSKMT

SEQ ID NO: 45452 - protein, 116 aa, Sorghum bicolor
  Clone ID: SORBI-28MAY03-C17498_1.pep
MARSSSSSSALVVVLVVLAAAVACSATRPVPAQQEAVSSSAAEDVMRPDTLQEGTVLIPGLGRIEIGSHYIPDIGGLDHSIPAATHAQYMPGADDTWVPNPGFEVPNPFLPGAATP

SEQ ID NO: 45453 - protein, 121 aa, Sorghum bicolor
  Clone ID: SORBI-28MAY03-C14804_1.pep
MASSSSFCFLLAAVALTALFAIGSCGTTLTIEVGKDSTSTKLSLITNVAISEVSVKPKGATDFTDDLKESEPKTFTLDSKEPIEGPIAFRFLAKGGGYRVVDNAIPADFKAGSVYKTTEQV

SEQ ID NO: 45454 - protein, 278 aa, Sorghum bicolor
  Clone ID: SORBI-28MAY03-C1914_1.pep
MAGIVVVFDFDKTIIDVDSDNWVVDNLGFTELFERLLPTMPWNTLMDTMMGELHAAGKTLGDVAEVLRAAPIDPRVPAAIKAAYALGCDLRVLSDANAFFIETVLEHHGIRGCFSQINTNPSHVDADGRLRIGPYHAAPHGCGVGTCPPNMCKGLVLDRILREAAAGTTGRSTKRVIYLGDGRGDYCPSLRLAREDFMMPRRGYPVWDLIREDPARVQAEVHPWADGADLEETLLRLVGRALVEEAALPPPLDCKLESTMPVAAQDGGMPIMPLGVKN

SEQ ID NO: 45455 - protein, 353 aa, Sorghum bicolor
  Clone ID: SORBI-28MAY03-C20727_1.pep
MDASYDREFWNFSDQLRLHNNFSNLSIADSIWSSTTSPPDPSSSFPGGNTNSPGLIGSAKLAFGNATTTSADRYNANAAGAGAGVGSNNAAAISVTDYYLNKNTTNANAGKTISVTDYYLNKNNANAAAGKTMSVTDYYLNKNNANANNDAVKSYFNKSVGRPANNNNNNTVVGGKKNSTAAAHHDKKHKNSGNGNGAGVDKRFKSLPASEALPRGEAIGGYIFVCNNDTMEENLKRQLFGLPSRYRDSVRAIRPGLPLFLYNYSTHQLHGIFEAASFGGSNIDPKAWEDKKCPGESRFPAQVRVATRKICDPLEEDAFRPILHHYDGPKFRLELSVPEALSLLDIFAEKIFA

SEQ ID NO: 45456 - protein, 219 aa, Sorghum bicolor
  Clone ID: SORBI-28MAY03-C2043_1.pep
MVMAPQPLRALRPSAPAAGHAACRCSAAAPLFGKRAPLVVAFPRAGSGGGAVVVSCSAVQESSTSTTVSKKKDAADGAKEATAAAAKPAAAAKPKKAAALPLPEMMQQEIIPPLKAALEAEDDVSQVELAFQNNTLEGSFIKNDVPYYFWAFFPKGDLTGPKGFALSSYSNEVSTIEPFLIDEKRITAKYVVFWVYKRLAGQGILPVWKEEEGEEEDAK

SEQ ID NO: 45457 - protein, 452 aa, Sorghum bicolor
  Clone ID: SORBI-28MAY03-C221_1.pep
MEQEEAQKDRNETRSFLLPLYPSARPGRALREFGDVKLAARRIDDGWRKARNKMEVAKAAAAGTNSTALLPIKGNVFPDGQYYTSIFVGNPPRPYFLDVDTGSDLTWIQCDAPCTNCAKGPHPLYKPTKEKIVPPRDLLCQELQGNQNYCETCKQCDYEIEYADQSSSMGVLARDDMHLIATNGGREKLDFVFGCAYDQQGQLLSSPAKTDGILGLSNAAISLPSQLASHGIISNIFGHCITREQGGGGYMFLGDDYVPRWGITWTSIRSGPDNLYHTEAHHVKYGDQQLRMREQAGNTVQVIFDSGSSYTYLPDEIYENLVAAIKYASPGFVQDSSDRTLPLCWKADFPVRYLEDVKQFFKPLNLHFGKKWLFMSKTFTISPEDYLIISDKGNVCLGLLNGTEINHGSTIIVGDVSLRGKLVVYDNQRRQIGWTNSDCTKPQSQKGFPFFL

SEQ ID NO: 45458 - protein, 176 aa, Sorghum bicolor
  Clone ID: SORBI-28MAY03-C2136_1.pep
MSSDSSSWARALVQISPYTFSAIGIAVSIGVSVLGAAWGIFITGSSLIGAAIKAPRITSKNLISVIFCEAVAIYGVIVAIILQTKLESVPTSQMYAPESLRAGYAIFASGLIVGFANLVCGVCVGIIGSSCALSDAQNSSLFVKILVIEIFGSALGLFGVIVGIIMSAQATWPAKA

SEQ ID NO: 45459 - protein, 478 aa, Sorghum bicolor
  Clone ID: SORBI-28MAY03-C4974_1.pep
MAEETVRELRASFAAGRTRSPEWRAEQLRGLIRMIDEKEAEISAALHEDLAKPHMESYLHEISLTKSSCKFAINGLKNWMKPEKVPASITTFPSSAQIVPEPLGVVLIISAWNYPFILSIDPVIGAIAAGNAVVLKPSEIAPATSSVLANLLPKYVDNSCIKVVEGGVPETTALLEQRWDKIFYTGSGTVARIVMAAAAKHLTPVALELGGKSPVVVDSNVDLHVAVKRIVVGKWGCNNGQACIAPDYIITTKSFAPELVASLKRVLVRFYGEDPLQSADLSRIVNSKQFKRLQDLIEEKRVADKIVFGGEADEEQLKIAPTVLLDVPQDSAIMTGEIFGPLLPIVTVEKIEESFNLINAKPKPLAAYLFTKNKKLQEEFVANVPAGGMLVNDTALHLANPYLPFGGVGDSGMGCYHGKFGFDCFSHKKAVLIRGFGGEANARYPPYTTEKQKILRGLINGSFIALILALLGFPREKR

SEQ ID NO: 45460 - protein, 224 aa, Sorghum bicolor
  Clone ID: SORBI-28MAY03-C55925_1.pep
MSRLEEVAYQLSSPLVQVQWLLLLLVPLLLRLHYYYASRRRSSRRHGSNCSDDKQPQLQLPPSPPGLLPIIGHLHLIGDLPHVSLCDLAAKHAAGGDGLMLLHLGAVPTLIVSSPQAANAIMRTHDHVFASRPASTATDDLMYGSTDIAFSPYGEHWRQARKLVTSHLFTVKKVQSYRSARKEEVRLVLAKLHTAAAATAARAVAGVFFRFANDVVSHAVTGKF

SEQ ID NO: 45461 - protein, 191 aa, Sorghum bicolor
  Clone ID: SORBI-28MAY03-C2514_1.pep
MALLAPSPRALCVREAAAAAAAPHPHSLAAAACSTVGGGGVAGRALWLWNGGGTGRRRREREGKVRVEAYFWDVSKPVEMEEIDSMEKLDDALRWSVENNQPIIIDWMASWCRKCIYLMPRMEKIAGEYPGVRFYFIDVNKVPQAVVKRGNVTKMPTIQLWKDGEWKAEVIGGHKAWLVMDEVREMIQQNK

SEQ ID NO: 45462 - protein, 641 aa, Sorghum bicolor
  Clone ID: SORBI-28MAY03-C25269_1.pep
MAVGATATKLHLSSAAAAARRPSLLHLAAVAVLCSVSYLLGIWHHGGFSAGPAAAGGGVSSSVSIATAVSCATPALTTASSSPPAGPLDFAAHHTAEGTEAEAALRHRSYEACPAKYSEYTPCEDVERSLRFPRDRLVYRERHCPADGERLRCLVPAPKGYRNPFPWPASRDVAWFANVPHKELSVEKAVQNWIRVDGDRFRFPGTRTMFPRGAGAYIDDIGKLIPLHDGSIRTALDTGCGVASWGAYLLSRNILAMSFAPRDSHEAQVQFALERGHEAMIGVLASNRLTYPARSFDMAHCSRCLIPWQLYDGLYLIEVDRILRPGGYWILSGPPINWKKHWKGWDRTKEDLDAEQKAIESVAKSLCWKKIKEEGDIAIWQKPTNHIHCKAIHKVIKSPPFCSNQNPDAAWYDKMEACITPLPEVSDLKEVAGGALKKWPERLTAVPPRIASGSIEGVTEEMFVEDTELWKKRVGHYKSVIAQLGQKGRYRNLLDMNAKFGGFAAALVNDPLWVMNMVPTVGNSTTLGVIYERGLIGSYQDWCEGMSTYPRTYDLIHADSVFTLYNGRCEAENILLEMDRILRPEGTVIIRDDVDLLVKIKSITDGMRWNSQIVDHEDGPLVREKLLLVVKTYWTLDDNKQ

SEQ ID NO: 45463 - protein, 355 aa, Sorghum bicolor
  Clone ID: SORBI-28MAY03-C27039_1.pep
MGQCCSRATAPDSGRGGTNGYGYSNQAKPAQAPPSYNLPQQAAEVRYTPPAMNAPVVPPVTVPPKPTADTILGKQYEDVRSVYSLGKELGRGQFGVTYLCTEIATGRQYACKSISKRKLTSKADREDIRREIQIMQHLSGQPNIVEFRGAYEDKSNVHVVMELCAGGELFDRIIAKGHYTERAAATICRAVVNVVNICHFMGVMHRDLKPENFLLATKEENAMLKATDFGLSVFIEEGKMYRDIVGSAYYVAPEVLRRSYGKEIDVWSAGVILYILLSGVPPFWAETEKGIFDAILREEIDFESQPWPSISESAKDLVRKMLTRDPKKRLTSAQVLQHPWLREGGDASDKPIDSA

SEQ ID NO: 45464 - protein, 465 aa, Sorghum bicolor
  Clone ID: SORBI-28MAY03-C27873_1.pep
MFGRDPWGGPLEISNADSATDDDRSRDLDRAALMRQLDETQQSWLLAGPGDQAGKKKKKYVDLGCVVVDRKIFMWTVGTILGLGVFIGFIMMIVKLVPHKRPPPPPPDQYTQALHKALMFFNAQRSGPLPKHNGVSWRGNSCMKDGLSDSTVRRSLVGGYYDAGDAIKFNYPMAWSMTMLSWSVIEYRAKYEAIGELDHIKELIKWGTDYILKTFNSSADTIDRIVAQVGVGDTSKGGSQPNDHYCWMRPEDIDYKRPVTECHSCSDLASEMAAALAAASIVFKDSKTYSDKLVKGAKALYKFGRLQRGRYSPNGSDQAIFYNSTSYWDEFVWGGAWMYFATGNNSYLTVATAPGMAKHAGAYWFGSPNYGVFTWDDKLPGAQVLLSRLRLFLSPGYPYEEILRTFHNQTDNVMCSYLPLFNSFNFTKGGLIQLNHGRPQPLQYAVNAAFLASLYSDYLEAADTP

SEQ ID NO: 45465 - protein, 369 aa, Sorghum bicolor
  Clone ID: SORBI-28MAY03-C2645_1.pep
MATVMQKIKDIEDEMARTQKNKATAHHLGLLKAKLAKLRRELLTPTSKGGGGGAGEGFDVTKSGDARVGLVGFPSVGKSTLLNKLTGTFSEVAAYEFTTLTCIPGVIMYKGAKIQLLDLPGIIEGAKDGKGRGRQVISTARTCNVILIVLDAIKPITHKRLIEKELEGFGIRLNKTPPNLTFRRKDKGGINFTSTVTNTHLDLDTVKAICSEYRIHNADVSLRYDATADDLIDVIEGSRIYTPCIYVVNKIDQITLEELEILDKLPHYCPVSAHLEWNLDGLLEKVWEYLDLVRIYTKPKGLNPDYEDPVIVSSKKKTVEDFCNRIHKDMVKQFKYALVWGSSVKHKPQRVGKEHELEDEDVVQIIKKI

SEQ ID NO: 45466 - protein, 81 aa, Sorghum bicolor
  Clone ID: LIB3481-012-Q6-K1-E7.pep
RGYYSKELELGLCLLVMLICNVPCSQKICFDIKTMLVDISLYKSCSCDILLSNLVPYGLESPMYQVSATTVEHMERCSPYL

SEQ ID NO: 45467 - protein, 438 aa, Sorghum bicolor
  Clone ID: SORBI-28MAY03-C2780_1.pep
MPVAASAIYFLNLRGDVLINRLYRDDVGGNMVDAFRMHIMQTKELGTCPVRQIGGCSFLYMRISNVYIVIVVSSNANVACAFKFVVEAVALFKSYFGGAFDEDAIRNNFVLIYELLDEIMDFGYPQNLSPEILKLYITQEGVRSPFSSKPSDKPVPNATLQVTGAVGWRREGLVYKKNEVFLDIVESVNLLMSSKGSVLRCDVTGKILMKCFLSGMPDLKLGLNDKIGLEKEAQLKSRPAKSGKTIELDDVTFHQCVNLTRFNSEKTVSFVPPDGEFELIKYRITEGVNLPFRVLPTIKELGRTRMEINVKVKSVFGAKMFALGVVVKVPVPKQTAKTSFQTTSGKAKYNASIDSLVWKIRKFPGQTEATMSAEVELISTMGEKKSWNRPPIQMEFQVPMFTASGLRVRFLKVWEKSGYNTVEWVRYITRAGSYEIRC

SEQ ID NO: 45468 - protein, 118 aa, Sorghum bicolor
  Clone ID: SORBI-28MAY03-C280_1.pep
MASFAVATIPSLAAPAAAKKRSSGGVTYVEGMNAYSGLKGLNKVNMLGVRKTADYSFAKIVASLSPAGKNRRGSAFGAQMNVAGEIFRIAATMNGLVLVGVAVGFVLLRVEAAVEEAE

SEQ ID NO: 45469 - protein, 399 aa, Sorghum bicolor
  Clone ID: SORBI-28MAY03-C28045_1.pep
MRVGPGSCLLLPTTATTMAVAHAPQRRRGVLLLVLVAALVAALPATCAAARSKSKKSYTAIFSFGDSLSDAGNLIVNGTPKALTTARPPYGMTFFRKPTGRCSNGRLVVDFLAEHFGLPLPQPSQAKGKDFKKGANFAITGATALEYSFFKAHGIDQRIWNTGSINTQIGWLQDMKPSLCKSDQDCKDYFSKSLFVVGEFGGNDYNAPLFSGVKFSEIKTYVPLVTKAIANGVEKLIELGATDLLVPGVLPIGCFPLYLTLYNTSSKSDYNARTGCLRRYNRLAFHHNRELKQQLDELQKKYPKTKIMYGDYFKAAMQFVVYPGKFGFSTALQACCGAGGQGNYNFNLKKKCGEQGASVCSNPSSYVSWDGIHMTEAAYKKVADGWLNGPYAEPPILKS

SEQ ID NO: 45470 - protein, 394 aa, Sorghum bicolor
  Clone ID: SORBI-28MAY03-C9647_1.pep
LESITKAPVIHHFSETVQGVMTIRCFRKHESFLQENLNRVNSSLRMDFHNNGANEWLGFRLELIGSFVLCFTAVMMVTLPSSIVKPEYVGLSLSYGLSLNQVLFWAIWISCFIENKMVSVERIKQFTNIPSEAAWRIKDCLPDSNWPTKGDIDVIDLKFRYRHNTPLVLKGITISIHGGEKIGVVGRTGSGKSTLIQALFRIVEPSEGRIVIDGVDICTLGLHDLRSRFGIIPQEPVLFEGTIRSNIDPLEQYSDDEIWQALDRCQLKEAVASKPEKLDASVVDNGENWSVGQRQLLCLGRVMLKRSRILFMDEATASVDSQTDAVIQKIIREDFAACTIISIAHRIPTVMDCDRVLVIDAGLAKEFDRPANLIERPSLFGALVQEYANRSSDV

SEQ ID NO: 45471 - protein, 246 aa, Sorghum bicolor
  Clone ID: SORBI-28MAY03-C1260_1.pep
MSSVQLSGAGVAAVAFTNKSLVSQPAALRVCSSRRSVRSLVVKAATVVTPKYTSLKPLGDRVLVKLGAAEEKTVGGILLPSTAQTKPQGGEVVAVGEGRTIGDKKVAVDIKTGAQVVYSKYAGTEVEFNDSKHLILKEDDVIGILETDDAKDMKPLNDRVLIKVAEAEEKTPGGLILTETAKEKPSIGTVVAVGPGPLDEEGKRQPLSVPAGSTVLYSKYAGSEFKGADGTGYIVLRASDVMAVLS

SEQ ID NO: 45472 - protein, 704 aa, Sorghum bicolor
  Clone ID: SORBI-28MAY03-C31192_1.pep
ARGFDVSFYGADFVYGLPEHGSTSLALLPTRGPGVEESEPYRLFNLDVFEYLHESPFGLYGSIPFMIGHGDRASSGFFWLNAAEMQIDVLAPGWDGATAQENGQIDTLWMAEAGVVDAFFFVGSEPKDVIKQYISVTGTPSMPQQFATAYHQCRWNYRDEADVDGVDAGFDEHDIPYDVLWLDIEHTDGKRYFTWDRSAFPNPEEMQRKIADKGRKMVTIVDPHIKRDSSFHLHQEATDKGYYVKDANGNDFDGWCWPGSSARPPSCSPELREWWADKFSYENYKGSTPTLYIWNDMNEPSVFNGPEVTMPRDAMHYGDAEHRELHNAYGYYFHMATADGLLKRGEGKDRPFVLSRAFFAGSQRYGAVWTGDNSADWDHLKSSIPMVLTLGLTGLPFSGADVGGFFGNPEPDLLVRWYQVGAFYPFFRGHAHHDTKRREPWLFGERRTAIIREAIHMRYSLLPYFYTLFREASVNGIPVMRPLWLEFPDDKETYNNGEAFMVGPSLLAQGIYEEGQKSVSVYLPGKESWYDLRNGSPYKGSVTHKLQVLEDSIPSFQRAGTIVPRKDRFRRSSTQMVNDPYTLVIALNSSGAAEGELYVDDGKSYDYQQGAFIHRRFVFADNKLTSFNIAPDNLGKKFASDCVIERIIVLGLRSGAKKAIIEPGNQEVEIESGPISLRSGSSPVAPTIRRPNVRIADSWTIRIA

SEQ ID NO: 45473 - protein, 338 aa, Sorghum bicolor
  unsure (1)..(338): unsure at all Xaa locations
  Clone ID: SORBI-28MAY03-C37208_1.pep
ARGQLVIFSAIDDLVRRTGLKPKDIDILVVNCSLFSPTPSLSAMIINKYKLRSHVRSFNLSGMGCSAGLISIDLARDMLQVHPNSNALVVSTEIITPNFYQGSRRDMLLPNCLFRMGAAAILLSNRRREARRAKYRLVHVVRTHKGADDRAYRCVYQEEDDQGFSGISLSKELMAIAGDALKSNITTIGPXLVLPMSEQLLFFFRLVGRKLFNKAWKPYIPARGLAFEHFCIHAGGRAVIDELQKNLQLSPRHVEASRMTLHRFGNTSSSSLWYELAYIEAKGRMRRGDRVWQIGFGSGFKCNSAVWKCLRSIKTPTNGPWDDCIHRYPVDVPEVVKL

SEQ ID NO: 45474 - protein, 197 aa, Sorghum bicolor
  Clone ID: SORBI-28MAY03-C37323_1.pep
LGYLQRETRGGTEGRAGQGKLSSGVGTQARAFADEVRGGLEQKNWMLDLGHPLLNRIAESFVKAAGIGAVQAVARESYFMAIEGEGGSVSGATGSRKRSFPELNGTNSSSKSAEAMVKNVSKESLQWGLAAGVHSGLTYGLTEVRGAHDWRNSAVAGAITGAAVALTSEHASHEQVVQCAITGAALSTAANVLSGIL

SEQ ID NO: 45475 - protein, 162 aa, Sorghum bicolor
  Clone ID: SORBI-28MAY03-C38578_1.pep
HEETLRPEPCVEGYSTPGGYSARAVHPIALAKVMQIARMMKEEFADGQSLSAIGGVETGNDAAEFILLGADTVQVCTGVMMHGYPLVKKLCAELQDFMREHNFSSIEEFRGASLPYFTTHTDLVHRQQEAIKQRKAIKKGLQSDKDWTGDGFVKETESMVSN

SEQ ID NO: 45476 - protein, 265 aa, Sorghum bicolor
  Clone ID: SORBI-28MAY03-C4415_1.pep
MEGSAADAEQEQEQKRAAAAAAYDYEGDARWADYWSNVLLPPNLASRPDVVDHFKRKFYQRYIDHDLVVEPRSFTGSTQPSRPDVRSSSSSSSENVRARNSGSTSRSAPSPPPTTQTDSAANPLRFDARTIHFSINAWILVVSGLGMLPILPKHLADRACKLSLLGTILSSGYSLYSTYGKPRLSSNAEIALGFLLIISLLSWRRSIIQTFMYWQVLKLMYHAPVTSSYHQSAWAKIGRIVNPYIHRYAPFLQTPISAIQRWWFR

SEQ ID NO: 45477 - protein, 285 aa, Sorghum bicolor
  Clone ID: SORBI-28MAY03-C43207_1.pep
MPSPFSVPSLIMEEEGRFEAEVAEVESWWTTERFRLTKRPYTARDVVLLRGTLRQSYASGEMAKKLWRTLKAHQAGGTASRTFGALDPVQVTMMAKHLDTIYVSGWQCSSTHTSTNEPGPDLADYPYDTVPNKVEHLFFAQLYHDRKQREARMSLPRADRARAPYVDFLKPIIADGDTGFGGATATVKLCKLFVERGAAGVHLEDQSSVTKKCGHMAGKVLVAVSEHVNRLVAARLQFDVMGVETVLVARTDAVAATLIQTNVDARDHQFILGATNPRLRGQSLA

SEQ ID NO: 45478 - protein, 379 aa, Sorghum bicolor
  Clone ID: SORBI-28MAY03-C46270_1.pep
MKLVHRNLVRNGPGSVKLVPEEEDDLWHAYNLIAVGDNLQAVTVRKVLREVASGGRDAERVKLKLEIVVESVDYDKEGSVLRVRGKNITENDHVKIGQFHTLELELKRPFVLRKEIWDWLALETIQQACDPAASADLAVILMQEGLAHLFLIGRSITATRARIETSIPRKHGPAIAGYETALKKFFEHVLQALLKHIDFEVVQCVVIASPGFTKDQFRDYLFLEAARRDLRVIIENKQRLVLAHATSGYKHSLKEVLDTPGVMALIKDTKAAQEVRALQDFFNMLTNDPARACYGPKHVEIAHEQYAAVQTLLITDTLFRNTDIATRQKYVNLVENVKKSNSTVHIFSSMHVSGEQLAQLTGIAAILRFPLPQLEDIEM

SEQ ID NO: 45479 - protein, 134 aa, Sorghum bicolor
  Clone ID: SORBI-28MAY03-C45084_1.pep
SDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 45480 - protein, 333 aa, Sorghum bicolor
  Clone ID: SORBI-28MAY03-C1884_1.pep
MDLVHIMDNQQKHNTQREVDTMRTTSRGNDEKGSIPAHQLELSLRRTDYGKLENHDKNDRRTLNHSTSSAFSLYNCRAVSTSGNAGDGQLCSTSETLMDVENKNGDSAAPSQDMTETNRPPIRVVPFPVPVQGLTFDGQPFWNGTPMASLFYPQSAPPIWNSKTSMWQESTQATSLPQKSQQNEPNEMGAKPVENAEEQFVTGPPSASGKQLCVEVPKDDPRHISPMTGESGISTMLDSTRNTLSSSGCDSTSNQFTAPTESSNVYKGVPETPSTEGSRHLSQREAALNKFRLKRKDRCFEKKVRYQSRKLLAEQRPRVKGQFVRQDHSIQGS

SEQ ID NO: 45481 - protein, 159 aa, Sorghum bicolor
  Clone ID: SORBI-28MAY03-C14720_2.pep
NCRLLAAARRPLLTSLSPASLHYPLLASLARSRPALLPPAGCRSIYTYKRAPRTRKKNSGCWIGECAIQLAGRGSQQPGGASGRAMVFFCFLVDQRRKVRSSKPAAGICSRCGGCASVADMETATRVCYLLTVHRRTWRAIICTFCGAMLKSYRHYRLY

SEQ ID NO: 45482 - protein, 620 aa, Sorghum bicolor
  Clone ID: SORBI-28MAY03-C14720_1.pep
FDYQTKLLEQVIYEPVSHGLSRPSPRSPRQPRPRCSRPRPRRRARRASPSANFPVAARRSPRLLRQRQRRPARSSSPPPGCPRSPRALLAPAPLCLAETGHEAVFFTVQGCCTHVVPLAGAVGLNIAAVGAPNLEALPNPKTSLSDAPRPLAASRDQAVEALCHPRPQGGTAMDSAPSCRPWEHGDLLRRLATFKPSTWASKPKAASSLSCAQRGWVNVDLDKIECESCGAHLIFNALTSWSPVEVANAGESFAEQLDATHHNSCPWRGNNCADSLVQLHLTQSALIGGFKDRCDGLLQFTSLPVIAPSAIENMKLSRSAQIDRLLSQSITFLSGILGCRAESTAGIDIHQDFSCSYSQAQKLISLCGWEPRGLPNVQDCEENSTHSAKNAPSVGPDERFYPHFVEHNKNSFSASAKSTRGKGKLPVGDSGCSMRSPLLDCNLCGATVRMRDFRPVLRPSRFSPNNIDVPETGRKLTLTRGVSATSGINEWVTDGVDRGQDEGRDEAATDEGKPLSLVGVDLNLSMAGGLPSPQSAMPAMSERFNNGGMGRDLMIGEPTGSEVGDCETSYESRGPSSRKRNLEGGGSTADNPQDRLQHADSIEGNFIDRDGEEVDDDAEQ

SEQ ID NO: 45483 - protein, 331 aa, Sorghum bicolor
  Clone ID: SORBI-28MAY03-C18948_1.pep
MSMAASTAAAVAVPEVSLRSGDARPMPMVGMGTAQFPVVNEATRNAVLAAIEVGFRHFDTAFLYGTEEPLGEAAAEAIRRGLVRSREDLFVTSKLWCTQNHPHLVLPSLRETLKNLQMEYVDLYLIHWPVCIKPGPPKFPNKKEDAVPVDFEGVWRAMEECQRLGLARAIGVSNFTTKHLDRVLAVATIPPAVNQVELNPAWQQRTLRAYCADRGIHVAAYSPLGGQNWDGQGNAVLDSEVLAEIAKARGKTVAQVALRWIHEQGVTSIAKSYNKERLKQNLEIFDWELTEEDRLKISQIPQRKVVQATSLFSEEGEFTSVDPEEMNIAEE

SEQ ID NO: 45484 - protein, 69 aa, Sorghum bicolor
  Clone ID: SORBI-28MAY03-C5592_2.pep
MPKQIHEIKDFLLTARRKDARSVRIKRAKDAVKFKVRCSKYLYTLCVHDADKANKLKQSLPPGLTVQEI

SEQ ID NO: 45485 - protein, 153 aa, Sorghum bicolor
  Clone ID: SORBI-28MAY03-C5592_1.pep
MQIFVKTLTGKTITLEVESSDTIDNVKAKIQDKEGIPPDQQRLIFAGKQLEDGRTLADYNIQKESTLHLVLRLRGGTMIKVKTLTGKEIEIDIEPTDTIDRIKERVEEKEGIPPVQQRLIYAGKQLADDKTAKDYNIEGGSVLHLVLALRGGY

SEQ ID NO: 45486 - protein, 419 aa, Sorghum bicolor
  Clone ID: SORBI-28MAY03-C5745_1.pep
TRIKLARDVDPSGDRTFGVLTKLDLMDKGTNAVDVLEGRQYRLQHPWVGIVNRSQADINKNVDMLSARRKEKEYFESSPEYGHLAHKMGAEYLAKLLSQHLEAVIRAKIPSIIAMINKTIDEIEAQLDRLGRPIGGDAGAQLYTILDMCRAFDRVFKEHLDGGRPGGDRIYGVFDNQLPAALKKLPFDRHLSMQNVRKVISEADGYQPHLIAPEQGYRMLIDSSLSYFMGPAARGLVPVHLVLKELVRRSIAATEELKRFPTLQSDIAAAANDSLERFREDGRKTVLRLVEMEASYLTVEFFRKLPTEPEKAADKNTPVSDRYQDNHLRRIGSNVSSYINMVCETLRNTIPKAIVHCQVKEAKRNLLNRFYAHVGSKEKKQLSAMLDEDPALMEKRDALVKRLELYKSARNEIDSVAWK

SEQ ID NO: 45487 - protein, 473 aa, Sorghum bicolor
  Clone ID: SORBI-28MAY03-C5880_1.pep
MGKKGKWFGAVKKVFSPESKEKKEERLRRKSAASNPAPLDLTPSTSLEVNVSVPPPPAPAPPPVLHQAEEVRVPEPEQEQSKHVTVEEPPAVPAQPSVLPPGVPTEELAAVKIQTAFRGYLARRALRALRGLVRLKSLVEGNSVKRQSASTLRCMQTLSRVQSQIRSRRAKMSEENQALQRQLLLKQELENFRMGENWDDSTQSKEQIEASLISRQEAAIRRERALAYAFSHQWKSTSRSVNPMFVDPNNLQWGWSWLERWMAAKPWEGRNGADKESNFDRGSVKSMSLNLGEGEITKAFNRRDSKPEKPSPPTPKPTRPAWQSPSTPSAKVAPIPARRKSATPKNGLSQVDDDARSVLSVQSERPRRHSIATSTVRDDESLASSPSLPSYMVPTESARAKSRLQGSSMTNGAETPEKGGSTGPVKKRLSFQGGTAAASPMRRHSGPPKVESAVKDIVAPPQPEALVVNGGSK

SEQ ID NO: 45488 - protein, 564 aa, Sorghum bicolor
  Clone ID: SORBI-28MAY03-C58817_1.pep
MSAAACLFAAATASLSLPSTSAPTSSGRRSVRSPTALLRCSLTRRRGQPVRVRALDERLLEAAPAETEEVQTGVDVGDGGGVAEGDGVGAEEELELEQQRPSPRAFVKSRRQRQEEEEAAAGQDRFRLINGKEIFQEKAYLVGVECKRTGGNLFGIVESLKELEQLADTAGLVVVGSTYQKLSTPNPRTYIGSGKVSEIRSAIQALDVETVIFDDELSPGQLRNLEKSFGGSVRVCDRTALILDIFNQRAATHEAALQVTLAQMEYQLPRLTKMWSHLERQAGGQVKGMGEKQIEVDKRILRTQIGALRKELESVRKHRKLYRNRRQSVPIPVVSLVGYTNAGKSTLLNRLTGADVLAEDKLFATLDPTTRRARGKNGTEFLLTDTAGFIQKLPTMLVPALRAYSSSAFRATLEEISESSVIVHLVDISHPLAQQQIDAVERVLKELDVESIPKLIVWNKIDNTDEPLRVKEEAQKQGIICISAMNGDGLEEFCNAVQAKLKDSMVPIEAIVPYDKGDLLNDIHKVGMVEKMEYKENGTFVKAHVPLPLARLLTPLRQQVVATV

SEQ ID NO: 45489 - protein, 326 aa, Sorghum bicolor
  Clone ID: SORBI-28MAY03-C5962_1.pep
ALGLLYLGKQDSVEATAEVSKTFDEKIGKYCDVTLMSLAYAGTGNVLKVQKLLGICSQHLEKGETHQGPAVLGIALIAMAEELGAEMAVRSLERLLQYGEQNIRRAVPLALGILCISNPKVNVMDTLSRLSHDADADVSMAAIISLGLIGAGTNNARIAGMLRNLSSYYYKEAAHLFCVRIAQGLVHLGKGLLTLSPYHSDRFLLSPMALGGLVTVLHACLDMKSTILGKYHYILYIIVLAMQPRMLLTVDEDLKPLSVPVRVGQAVDVVGQAGRPKTITGFQTHSTPVLLAAGERAELATEKYIPLTPVLEGFVILKKNPEYHEE

SEQ ID NO: 45490 - protein, 359 aa, Sorghum bicolor
  Clone ID: SORBI-28MAY03-C5786_1.pep
MAEQASAGRYWCHMCAAVVSPAEGEAEMKCPLCHSGFLEEMETARGATVAAVATDDGDGDGTVAQVYPGGADRPSSIWAHAILSTVDSSVRRRRNRRQQEAAGDVYDWNDPEFSLRRRRVTAFLRLLHELRDRQLQRLEAAAGVALEGDQLTPFGRSLFIGAAGGGGGSEHGVALGDYFLGPSLDALVQQLAENDAGRQGTPPAKKEAVEAMPIVEIPSGNDDDTASCPVCLEDYAAGERAREMPCRHRFHANCIVPWLEMHSSCPVCRFQLPATDDKSSCSSGNGGGFVSVDADREGNDDGGGDGTGRATSPPGNAEPAEAEESGRRLPPSLQWLNSLFSPSAQSSGSGSSSSHHWEN

SEQ ID NO: 45491 - protein, 221 aa, Sorghum bicolor
  Clone ID: SORBI-28MAY03-C671_1.pep
MARRGSLLAVAAALLVAVVAAAVPPTCERIECPAYEVVDSANGFEIRRYTDAMWITTAPIEDISFVAATRTGFLQLFNYIQGKNLYNETIEMTAPVLTQVSPSDGPFCASSFTVSFYVPAKNQADPPPAEGLRVDRWAGARYAAVRRFGGFVADADVGEQAAQLDASLQGTRWAAAVNDARRADPASPYTVAQYNSPFEFSGRVNEIWMLFDDAAAAATSM

SEQ ID NO: 45492 - protein, 291 aa, Sorghum bicolor
  unsure (1)..(291): unsure at all Xaa locations
  Clone ID: SORBI-28MAY03-C6943_1.pep
MPRSGTAPSPPPPPRASAAPTTAPPPPPPRXKAEDDRPVRVYADGIFDLFHFGHARALEQAKLLFPNTYLLVGCCNDELTNRYKGKTVMTQEERYESLRHCKWVDEVIPDAPWVLTQEFIDKHQIDYVAHDALPYADTSGAANDVYEFVKKIGKFKETKRTDGVSTSDLIMRILKDYNQYVMRNLARGYSRKDLGVSYVKEKQLQVNMKINKLRETVKAHQEKLQTVAKTAGLNHEEWLANADRWVAGFLEKFEQHCHNMETAIKDQIQVRLGRQLSKGIIAGLVQESVTA

SEQ ID NO: 45493 - protein, 248 aa, Sorghum bicolor
  Clone ID: SORBI-28MAY03-C8100_1.pep
MARRIAVAAAAFLALSAVVPAALAQAPGPAATPSGPPNVTAVLEKGGQYTMFMRLMKETQQDTQLNSQLNSSFASNGGGYTVFAPTDNAFNSLKPGTLNSLTQQQQVALVQGHVLPQFYSMDSFQTASNPVRTQASGRDGPYTLNVTSTTNNQLNVSTGVVEVTVNNALSAVKPLAVYSVDKVLLPLELFGAKAPAAAPTASKPKKGGSDDAASGPAGSDDAAPTGAASARAVGWSVAGLAALLGYLL

SEQ ID NO: 45494 - protein, 472 aa, Sorghum bicolor
  Clone ID: SORBI-28MAY03-C24776_1.pep
ARGVRASTKQSHNWKKATAARNLGTIGEEIAAAMAAKGRTELDVGADGVAVITIHNPPVNSLSIDVLYSLKESYEEAFRRSDVKAIVVTGKGGKFSGGFDISSFGGLQGGQKMQPKVGYIAIDILTDTVEAATKPSVAAIDGLALGGGLEVAMACHARIATPTAQLGLPELQLGIIPGFGGTQRLPRLVGLTKSLEMMLLSKPIKGGEAHQLGLVDALVSPNDLVNTARQWALDIYECRRPWIKSLYKTDKLEPLGEAREILKFARAQAQKQAANLHHPLVCIDVIEEGIVAGPRAGLWKEATSFQELLFSDTCKSLVHVFFSQRATSKIPGATDLGLMPRKITKVAILGGGLMGSGIATAMILSNYPVVLKEVNEKFLNAGIDRIKANLQSRVRKGKMTEERYEKAMSLVTGVLDYERFKDVDLVIEAVIENVKLKQQIFADLEKYCPSHCVLATNTSTIDLNLIGEKTKS

SEQ ID NO: 45495 - protein, 283 aa, Sorghum bicolor
  Clone ID: SORBI-28MAY03-C26791_1.pep
MAAAQAVAKGSVVAPCGNRAAPGLLGRRRGAVAARMAPSAVRIGASWRKTAFTGGRLALGLGTRRSRPASRSSFASPAQMNMNLAIGKSMRWWEKGLQPNMREIESAQDLVDSLTNAGDKLVIVDFFSPGCGGCRALHPKICQFAEQNPDVLFLQVNYEEHKSMCYSLHVHVLPFFRFYRGAQGRLCSFSCTNATIKKFKDALAKHKPDRCSLGPTRGLEESEFLALAANKDLQFTYTKEPELIPRGDAPGEVIAPEPAKLPAATKPLVRLGSEERSLVSSGR

SEQ ID NO: 45496 - protein, 243 aa, Sorghum bicolor
  Clone ID: SORBI-28MAY03-C26340_1.pep
MSSSMQSSYLPATTESIAKAQEAKDASESISILYRVLEDPSSSADALRVKELAITNLTSYLTKENRAEDLRNLLTQLRPFFALIPKAKTAKIVRGIIDAVAKIPGTSELQISLCKEMVEWTRAEKRTFLRQRVEARLAALLLENQEYTEALTLLSGLIKEVRRLDDKLLLVDIDLLESKLHFSLRNLPKAKASLTAARTAANAIYVPPSQEGTIDLQSGILHAEEKDYETAYNCCGCADGWKS

SEQ ID NO: 45497 - protein, 580 aa, Sorghum bicolor
  Clone ID: SORBI-28MAY03-C13255_1.pep
MAAATSPAAAANLAGKSGVRVAVIGDPGSGKSSLIVALPAERFPENVPRVAPPSRLHAVHFHDRVPITPIDTSSGPEQKPKLIAECQAAAAVVRSYACDRPATLERLSSFWLPLLRPPQLKAPVMGVGCKLDLRDEQRVSLVQVSAPGLLSRHETDTCVQSSSLSQSPAPAGFSCVQKAVPHPTPPRFDQGCLSLTPLRVLPALRIVIGRVDATGAALSDVELNEFQVRCVGPPPLPTESAPDQTLEMTSVVVEFLRGIFTMFDIDNDGALLPTELEDLFSTAPENPWSSDPYKDCAEKNVLGGLSLEGFLSKWALMTVLDPTNSYANLVYVGYPGEFSSAFTVTRKRRVDRKKQQTQRNVFQCYVFGARGSGKTSLLQSFIGRQPSDALPSNSERFATNSVEMADGTRKTLILREIPEGDVRSLLSDKESLAPCDVAVFVYDSCDEYSWQRARDLLVQVATHGENTGYEVPCLIVAAKDDLDQSSQALQESTRVSQDMGIETPIPISVKLRDLNNIFCRIIHAAQQPHLSIPETEAGKTRRQYRQLLNRSLMVVSVGAAVAVVGLAAYRVYAARKNSSS

SEQ ID NO: 45498 - protein, 298 aa, Sorghum bicolor
  Clone ID: SORBI-28MAY03-C13302_1.pep
MAAVAEGSASAAAKEVEYQAGVQKLVDLLSKLNPAAKEFVPSAAASPPKKALSADAPVFDYRSIGGGNGATDAAFYVGFGNQHRRRGNGYINQGRRRTNDRVRRAEREDSIRRTVYVSELDHTVTEERLADIFATCGQVVDCRICGDPHSVLRFAFIEFSDEEGARTALNLGGTIFGFYPVRVLPSKTAILPVNPKFLPRTEDEKEMVMRTVYCTNIDKMVTQLDVKKFFEELCGEVSRLRLLGDNVHSTRIAFVEFVHAEGAIMALNCSGMILGTLPVRVSPSKTPVKPRVNRVGPN

SEQ ID NO: 45499 - protein, 268 aa, Sorghum bicolor
  Clone ID: SORBI-28MAY03-C12976_1.pep
MAAALFSTSLSPRFLALSSAKPAAPAASAFLPFRLPLRAVSAPGRRVFEPVAVAVSSEYETEGAEQEEEGAEEFSEDLKLFVGNLPFSVDSAQLAGLFEQAGSVEMVEVVYDRMTGRSRGFGFVTMSSAEEAGAAVEQFNGYTFQGRPLRVNCGPPPPRDESAPRAPRGGGGGGGGGSFVDSANKVYVGNLAWGVDNSTLENLFSEQGQVLDAKVIYDRESGRSRGFGFVTYGTAAEVNNAISNLDGIDLDGRQIRVTVAESKPRRQF

SEQ ID NO: 45500 - protein, 69 aa, Sorghum bicolor
  Clone ID: LIB3478-051-P1-K1-F4.pep
GRVDYTLAQYKPETFEALAYYGTIEKLVKDLRYPEELLTWEFDWKYMVRGLVLDKKRGNILKRIDQVVK

SEQ ID NO: 45501 - protein, 371 aa, Sorghum bicolor
  Clone ID: SORBI-28MAY03-C6481_1.pep
MLPLLFHPRIVSLQKKKKKISGTCARLFKSEVQFGHAGAKSGGELESAQAKNQALREAGAIVPTSYEALESAIKEAFDKLVEEGKISPVTEITPPPIPEDLKTAIKSGKVRAPTHIISTISDDARGEPCYAGVPMSTIIEQGYGVGDVISLLWFKRSLPRYCTQFIEICIMLCADHGPCVSGAHNSIVTARAGKDLVSSLVSGLLTIGPRFGGAIDDAARYFKDACDRNLTPYEFVEGMKKKGIRVPGIGHRIKSRDNRDKRVQLLQKYAHTHFPSVKYMEYAVQVETYTLSKANNLVLNVDGAIGSLFLDLLSGSGMFTKQEIDEIVEIGYLNGLFVLARSIGLIGHTFDQKRLKQPLYRHPWEDVLYTK

SEQ ID NO: 45502 - protein, 121 aa, Sorghum bicolor
  Clone ID: LIB3476-030-P1-K1-D2.pep
MDLAIRASLKGWKFVYLGDVQVKSELPSTFKAFRFQQHRWSCGPANLFRKMLMEIVTNKKVTIWKKIHVIYNFDEIVEIGYLNGLFVLARSIGLIGHTFDQKRLKQPLYRHPGGCPVHQVR

SEQ ID NO: 45503 - protein, 252 aa, Sorghum bicolor
  Clone ID: SORBI-28MAY03-C13896_1.pep
HGGRSLSSVTMAAQGSLVTWRAVFAALGLLMVATLVYTIATDGSPFRPELLTPWMVATLIDFYVNVIAISAWVIYKEANWISSAVWVVLLVCFGSAATCAYIVKKLFEVTSAGSSQDPLDLLFIRQGNLSQRKCSYIVIGRVIFSILGIFMVAVVTYTVITDGLPFRKELLTPWMAATLIDFYINIFAISVWVTHKESSWISTTIWIVLLICFGSITTCGYIVLQLFKVSYQDPIYHVLLNSHSKYGISTSL

SEQ ID NO: 45504 - protein, 137 aa, Sorghum bicolor
  Clone ID: SORBI-28MAY03-C1738_1.pep
MADSKATSAVTLRTRKFMTNRLLARKQFVLEVIHPGRANVSKAELKERLAKVYEVKDPNTIFVFKFRTHFGGGKSTGFGLIYDNLEAAKKFEPKYRLIRNGLATKVEKSRKQMKERKNRAKKIRGVKKTKAGDAKKK

SEQ ID NO: 45505 - protein, 151 aa, Sorghum bicolor
  Clone ID: SORBI-28MAY03-C17589_1.pep
MAAAMISGGRAAALVLAAVVLCSVAAMAAAQQASNVRATYHYYNPQQNNWNLNAVSAYCSTWDAGKPLAWRQKYGWTAFCGPAGQKGQAACGKCIRVTNRATGAAITARIVDQCSNGGLDLDYETVFKKIDTNGQGYQMGHLNVNYQFVAC

SEQ ID NO: 45506 - protein, 212 aa, Sorghum bicolor
  unsure (1)..(212): unsure at all Xaa locations
  Clone ID: SORBI-28MAY03-C15929_2.pep
LQGPRSLAPIAVQHFKNRSIRXDEMHESRRDMDHQVAQLRGELRKVRDERDRAHRVLEVTDWKALASANDRTAIETLEADLAVSRESEKRMLDSLATQTKQLELTKISLEEAKLQIASLQDTVQRLEADRSPLATTPRNRRDRDMQRVHGELRVALAAEEKSKKAMEEFVQALKEVNAELHTTRCXAARAQHEAESARLDADRLHMSAKRKD

SEQ ID NO: 45507 - protein, 230 aa, Sorghum bicolor
  Clone ID: SORBI-28MAY03-C15929_1.pep
ARGANRTAQPAPPLCQDRTLLRGPDAANPPAHVAARRRDSRRSTPAPRRASSRPAPQAWPRLEPPAARQRSRHAGVTGRRPGSPRQGGDKQEELEKLPKEENARFLAEAHAAMEARRAEAEAQAERKRDFEREKARLALLGASMERTVEINDNLHIKDLEMLARGTTEHIVSSVDETSPERSQDGMAGYHPGSVNPLEQLGLFIKADDEEDDEEPSSVPSIKEPEEGEIN

SEQ ID NO: 45508 - protein, 460 aa, Sorghum bicolor
  Clone ID: SORBI-28MAY03-C34981_1.pep
LAAEDNPAVILPDHLQAANADCAHLSFGSFESGAFSGLLSSKVPKGSLEDDEVRIPDESRSVNRIDDRNQDYYDNDALNSSANEDVETRIGTNMDNIDGPSVSESDVLRQGAIALPGLQYELPSVSSHAYSNTTQPITMEDPQGNTQAQPLSHFSGLLQANTLPNNLLGSNHTPLREFDFSQLLQTQSAPKYNPSVAPNNLPAISMQETLKPGGFPNTQSTQHVPSTSIPSGLPLPQQLPVYSQPTLPLGPFTSLVGYPYLPQNYYLPSAAFQQAYSSNGPFHQSAAPAVPGAGMKYSMPQYKSSPPASSLPQPSSLSGYGGFGNANNIPGNFSLNQGAPSAPTTLGFDEALGTQFKDPNHYAALQQSDNSAMWLHGGAGSRTVSAVPPGNFYGFQGQSQQGGFRQTHQPSQYGGLGYPSFYQSQASLPQEHPQNPTEGSLNNPQGVPSQPSHQLWQHSY

SEQ ID NO: 45509 - protein, 698 aa, Sorghum bicolor
  Clone ID: SORBI-28MAY03-C3666_1.pep
HEAGTHGESYLQFSSATGDLSATENSFPQQNDGSLEAAIGYPFLKTQSSNLSDILKDSFKKTDSFTRWMSKELPEVEDSQIHSSSGGFWSTEEANNIIEASSREPLDQFTVSPMLSQDQLFSIVDFAPNWTYVGSKTKILVAGSILNDSQINEGCKWSCMFGEVEVPAKVLADGTLICYSPQHRPGRVPFYITCSNRLACSEVREFEFRPTVSQYMDAPSPHGETNKVYFQIRLDKLLSLGPDEYQATVSNPSLEMIDLSKKISSLMASNDEWSNLLKLAVDNEPSTADQHDQFAENLIKEKLHVWLLNKVGMGGKGPSVLDDEGQGVLHLAAALGYDWAIRPTLAAGVNINFRDVHGWTALHWAAFCGRERTVVALIALGAAPGALTDPTPDFPGSTPADLASANGQKGISGFLAESSLTSHLQALNLKEANMSQISGLPGIGDVTERDSLQPPSGDSLGPVRNAAQAAAQIYQVFRVQSFQRKQAAQYEDDKGGMSDERALSLLSVKPPKSGQLDPLHSAATRIQNKFRGWKGRKEFLLIRQRIVKIQAHVRGHQVRKHYRKIVWSVGIVEKVILRWRRRGAGLRGFRSTEGSVESSSGGTSSSSIQDKPSGDDYDFLQEGRKQTEERLQKALARVKSMAQYPEARDQYQRILTVVSKMQESQAMQEKMLEESAEMDFMSEFKELWDDDTPIPGYF

SEQ ID NO: 45510 - protein, 137 aa, Sorghum bicolor
  Clone ID: SORBI-28MAY03-C1770_1.pep
MAGKGGKGLLAAKTTAAKSAEKDKGKKAPVSRSSRAGLQFPVGRIHRQLKQRTQANGRVGATAAVYSAAILEYLTAEVLELAGNASKDLKVKRITPRHLQLAIRGDEELDTLIKGTIAGGGVIPHIHKSLINKSSKE

SEQ ID NO: 45511 - protein, 374 aa, Sorghum bicolor
  unsure (1)..(374): unsure at all Xaa locations
  Clone ID: SORBI-28MAY03-C15159_1.pep
MIMMKVHGMAGVVLAAAMLLAAVVAVAAAPPLVPVTDKDLESDASMWDLYERWCSVYAGSSDLAEKQRRFDAFKMNARQINEFNKREDESYKLALNQFSGLTEEEFNSGMYTGALPELDAGGNISSSVGTSGMSMTDDNDDKLLVSAGGNDDKVPAKWDWRRHGAVTPVKNQGQCGSCWAFSMVXAREGINAIKTGKLQTLSEQEVLDCSGAGTCKGGDPYKSFDHAMRPGLALDHQGNPPYYPAYVAEKKKCRFNAEKPVVKINGKRMMRNTNEAELLMRVSKQPVSVVVEASQAFSRYSKGVFTGPCGTNLNHAVLVVGYGTTPNGINYWIVKNSWGKGWGENGYIRMKRNVGTKAGLCGIYMMPMYPIKNK

SEQ ID NO: 45512 - protein, 168 aa, Sorghum bicolor
  Clone ID: SORBI-28MAY03-C17745_1.pep
MVKGSKHHELEADDVPASELWKIYGTLRFVELVHELLPQVLHQVEVLRGDGTVGTVIKVTFPPGNPGVQTYSEEFVKIDNENRVKEAAVIEGDLLTLGFTTYLTRFQIIDKGPSSSVIASTVEYEYDDGRPELEAAASTAPLAAAAERLVQYVKEQMTTTTTAQATAA

SEQ ID NO: 45513 - protein, 444 aa, Sorghum bicolor
  Clone ID: SORBI-28MAY03-C25429_1.pep
EKHEGKKLISEAGEDSASSDLIRCLPRNYRILRRHPPLRLPRLIIAFRIPNRRPRRSSELLIEGTVTVVKRMIRCAVTAGGCVASWSGDRRSPAVNNPCSVRMPTGNGGGWCGGLRSRAADLAGLEMASLRGGVGGLFRASPRYGRLQATAAVDPEDIPLEKVQVKSSGHVLPYVGVACLGAILFGYHLGVVNGALEYLAKDLGIAENAVLQGWVVSTSLAGATLGSFTGGSLADKFGRTRTFILDAVPLALGAFLSATAQDIRTMIIGRLLAGIGIGISSALVPLYISEISPTEIRGTLGSVNQLFICIGILVALLAGLPLAGNPAWWRTMFGIAVVPSILLAVGMAFSPESPRWLFQQGKVIQAESAVKRLYGKEMVTEIMYDLRASGQSSSEPEAGWFDLFSKRYWKVVSVGAALFLFQQLAGINAVVYYSTSVFRSAGIA

SEQ ID NO: 45514 - protein, 595 aa, Sorghum bicolor
  Clone ID: SORBI-28MAY03-C25613_1.pep
MAASPAPAAAAALLVLLALAAAGGVAADGSDHRYKMNEPVPLYANKVGPFHNPSETYRYFDLPFCSPEKVREKSEALGEVLNGDRLVDAPYKLDFRLEVESKAVCSKKLTVEDVVKFRNAVAKDYYFQMYYDDLPLWGFIGKVEKGGKADPSEWKYYLYRHIIFDILYNNDRVIEINVHTDQSALVDLTEDKETNVEFLYSVKWKETPTPFEKRMEKYSSSSNMPHHLEVHWFSIINSCVTVLLLTGFLATILMRVLKNDFVKYAHDEEAADDQEESGWKYIHGDVFRFPKNKSLFSAALGTGTQLFALTTFIFLLALVGVFYPYNRGALFTALVVIYALTSGIAGYVATSFYCQLEGTNWVRNLLLTGCLFCGPLFLTFCFLNTVAIAYSATAALPFGTICVIVLIWTLVTFPLLVLGGIAGKNSKSEFQAPCRTTKYPREIPPLPWYRRTVPQMAMAGFLPFSAIYIELYYIFASVWGHRIYTIYSILFIVFIILLIVTAFITVALTYFQLAAEDHEWWWRSFLCGGSTGFFVYGYCLYYYYARSDMSGFMQTSFFFGYMACICYAFFLMLGMVGFRAALFFVRHIYKSIKCE

SEQ ID NO: 45515 - protein, 395 aa, Sorghum bicolor
  unsure (1)..(395): unsure at all Xaa locations
  Clone ID: SORBI-28MAY03-C2718_1.pep
VPAHLRVTSIILFALAQVIVWSSPADARGAAMAASDLESKAKEAFVDDDFELAAELYTQAIDAGPATAELYADRAQAHIKLGNYTEAVADANKAIELDPTMHKAYYRKGAACIKLEEYQTAKAALELGSSYASGDSRFTRLLKECEERIAEESSQAPAKNVEPPVAAAAATVEDKEDVANMENTPPVVEPPSKPKXSHDYYNSATEVVLTIFAKGVPADSVVIDFGEQMLSVSIEVPGEEPYHFQPRLFAKIIPEKCKYQVLSTKVEIRLAKAEQVTWTTLDYSGRPKAVPQKISTPAETAPRPSYPSSKAKKDWDKLEAEVKKEEKEEKLDGDAALNKFFRDIYKDADEDMRRAMMKSFVESNGTVLSTNWKDVGSKKVEGSPPDGMELKKWEY

SEQ ID NO: 45516 - protein, 262 aa, Sorghum bicolor
  unsure (1)..(262): unsure at all Xaa locations
  Clone ID: SORBI-28MAY03-C2608_1.pep
MHFWARFFACTRFFIDGDDKCQDNNVSTILTSASLVRNSDPFDGENKVIDGLKIEVKHTKGPLLEGSLIHYNLDYNVALVSVKRLKSYSACPLAIWQRNLIYESSKGGPVGCCLSNGXLMASGGKLVAWSGSLDCKLLIYSTCEITKAGIGGPLVDFDGNFIGMNFYDPKLGTPAVSCDDIVDVLERFKEKWTGGVDSLSNPNGVGGVQGDCSVSLNWWPVPRPYWRQPDEPEKSYLDEYERGVLDSGSKFEYVGGYIYILK

SEQ ID NO: 45517 - protein, 347 aa, Sorghum bicolor
  Clone ID: SORBI-28MAY03-C5848_1.pep
MACELGKMGQEKARTPTIACERGRTDGGRFEDEKEDDDDFEIVGFRRTWELCYASDYGSFEDITVPSMRYTFRPFPKNAIRQGGLQFFSAKVAELKEEEGLHWPLHVYGLIATRDSADPRRNLLFDRTRDSCQIITQEDPILQLTGPSRAVVLIDPVTIEVQLKAKCKTESEDKVLNFSVFEYSHQDSYEEPPFLTTIYTRCKRSKLEFAVAFLVQSVEATVRVRVVRGSWPDHFRGQIMSRTASISHGAIVLLDSRYGRMNFNKYGVIELSRCVVSVEPCGQLKVDVVASQVDDDRNVVAQGLVDFTPKMAGVSHGICDLGFCVLRFSVHWSLPCYAGEHVGLITK

SEQ ID NO: 45518 - protein, 521 aa, Sorghum bicolor
  Clone ID: SORBI-28MAY03-C5797_1.pep
MGMEVVGAEAAPAEVKVSDGEVNLFQEKESKATAKEREEAVVFGSETTTNIADLAPPKDAKDEWPEPKQTYAFYFIKIRSFEDPKLRAKLEQADKEFQKKIQARSKLIEAVRAKKAERSSIIAELKPLSAENKQYNEVVNEKIKEMEPLRNSLGKFRDENNAMRAQSAGLCSSIEELDLTIKMLNDRMVHESIPLSEEKRLVKEIKDLEKTRSKVISNAANRAKLQGTVVEKEAIQDQVKIIGEGIDGIKKERQAVRSKIKVLEDELKLVDAEIASLQEDLDAATARKDKAYESLSELRAVRDAKNASATQNRAVLGKARDCSSRNMLAELQELHKTEVDKFMTQWCESKAFREDYEKRILASLNSRQLSRDGRMRNPDEKPIFIESQAPAPEPEPIPVKLPAKQTKEVPAPQEDDAPKIEARSKGPVKSHKAKAALDADDDYEAEPPKEKAKPTEADVAKLKEIKRQEEIEKNKLALERKKRQAEKHAAKAAARAQKEAEKKLKKEEKKAKKKSGAADTD

SEQ ID NO: 45519 - protein, 263 aa, Sorghum bicolor
  unsure (1)..(263): unsure at all Xaa locations
  Clone ID: SORBI-28MAY03-C26709_1.pep
MLVGRHELHSSRRGFASFFADRSNCARTSSAAGVHSSGGWLTAGAAHYAAPNGGGRDGGACGCKSAVGQXRPFSSMCASLFPALAEEGSVCCDRIRLLAGCCTTRCGRASSATKSFQRTELLFSGLAGRLPGRQSPMNAAXNLGHNFLRLICRRVPCKYSGVNIAFRVDQGSNPFYFEVLVEFEDGDGDLSAVDLMEAGCGTWTPMVQNWGALWRYNSNTGKALKAPFSLRLTSDSGKVLVANNVIPAGWNPGATYRSLVNYS

SEQ ID NO: 45520 - protein, 341 aa, Sorghum bicolor
  Clone ID: SORBI-28MAY03-C28461_1.pep
MKVSALCAAAVLLLLVAQAPSAAEASHLKLGYYKKTCPGVEKIVKYHVAKAIKANRAAGAALVRLIFHDCFVRGCDGSVLLDPTPANPKTEKTAPVNIGLAAFDVIDDIKAALESHCPGTVSCADIVIYAARDASSLLSNGHVHFAAPAGRLDGVISRAADAQRDLPDSTFTISELIRNFRRKNFTVEELVILSGAHAIGVGHCSSFRARLSSPPSQIVPAYRNLLSAKCAAGPDPVVTNNVRDEDPRAVAASFPSFLKKLRKAKDFLDNSYYHNNLARIVTFNSDWQLLTEKEALGHVKEYAENGTLWDEDFSDALVKLSKLPMPPHSKGEIRKSCRWVN

SEQ ID NO: 45521 - protein, 273 aa, Sorghum bicolor
  Clone ID: SORBI-28MAY03-C2848_1.pep
MANASLQSFLLPQHHSFASNGGSHDGSPSALFKLSTNTGSSISFRLHPNTSRSVTTTSTTNSSAPTPVAPAAASAAEEDSSPAPSLDLLSRQLAAGDYRQADETTRALIIDLAGESARRRGYVFFSEVQFISAEDLRAIDELWKEHSNGKFGYSVQRRLWEKSQRDFTRFFIRVGWMKKLDTEVEQYNYRAFPDEFMWEIKDDTPEGHLPLTNALRGTQLLGNILTHPAFQEENQQDEAAAAAESATTGQSKDDNKGRERPKFMKDFKPDYSF

SEQ ID NO: 45522 - protein, 181 aa, Sorghum bicolor
  Clone ID: SORBI-28MAY03-C33467_1.pep
MPAMLAAKFTVLHLSQSPSPQSSFRLGIRPSPAARARSVAPRAAASATAVSAKPAAASSPLVADRKVVRIGLPSKGRMAEQTLSLLKSCQLSVRQLNPRQYTADIPLIPNLEVWFQRPKDIVRKLQSGDLDLGIVGFDIVSEYGEGTEDLVVVHDALDFGHCRLSLAVPKEGIFENIITLE

SEQ ID NO: 45523 - protein, 184 aa, Sorghum bicolor
  unsure (1)..(184): unsure at all Xaa locations
  Clone ID: SORBI-28MAY03-C29912_1.pep
GRQFQLYKSGVFSGSCTTNLDHGVVAVGYGTENGKDYWIVRNSWGPKWGEAGYIRMERNINATTGKCGIAMMASYPTKKGANPPKXPSPTPPTPPPPVAPDHVCDENFVCSAGSTCCCAFGFRNVCLVWGCCPIEGATCCKDHASCCPPDYPVCNIRARTCSVSKNSPLSVKALKRTLAKLNTA

SEQ ID NO: 45524 - protein, 376 aa, Sorghum bicolor
  Clone ID: SORBI-28MAY03-C33606_1.pep
MDGQAPPLLDAVVPEPLAAGDELHPPRPVEVEDALHSGMDGQAPHLDGVARDPLTVSDEPQPTVEVAEEHAIPVAHDIAKGEVVEEDALPVASDIVKGEVVEEDALPVATDIINDASSEVPEAGSGGVVLTDELRDRIVKQVEYYFSDENLPTDEFMLKYVKKNKKGFVPIETIASFRRMKKLVQDLSVIEAALRTSPKLVVSSDGKRVRRLHPLPHNELKDSKKSTVLVENLPPDFSMESIQEKFSTVGKVVSKENQDAVSKKIDQNQHSKEDQRITSEKISNADAVGSAKDKENLKSVFTTETEHHDQKPNSRGRKGRYKGQGQMQQNTNKQGSSGSESLNKPIPGPRMPDGTRGFTLGRGKSLPLQKSDKAEE

SEQ ID NO: 45525 - protein, 328 aa, Sorghum bicolor
  Clone ID: SORBI-28MAY03-C3364_1.pep
MAGSAFLNALVLRAPSPSPSLSCSSSSTRRSAGAFAFPNPPRLPSLRSARRVVLARAAAPGAGGDPEPEDDEWGPEPEGGSAVTGATAVAEAPEAPEAREVAELKAQLKDALYGTERGLRASSESRAKVLELITQLETRNPTPAPTEALTLLNGKWILAYTSFSQLFPLLGFGNLPELVKVEEISQTIDSENFTVQNCIKFSGPLATTSVATNAKFEIRSPKRVQIKFEEGIVGTPQLTDSIVLPEKFELFGQNIDLSPLKGIFTSIENAASSVAKTISDQPPLKIPIRTNNAESWLLTTYLDEELRISRGDGSSIFVLFKEGSTLLN

SEQ ID NO: 45526 - protein, 335 aa, Sorghum bicolor
  Clone ID: SORBI-28MAY03-C9334_1.pep
MASSGDPPGSTDEKKTPKSEGSSDERQGVPPAGFSNPFDFASMQSLLNDPSIKEMADQIAKDPAFNQMAEQLQKSAHSTGEQGMPPLDPQQYMETMQKVMENPQFMTMAERLGNALMQDPAMSSMLETFSSPSHKEQLEERMSRIKEDPAMKSILDELENGGPSAMMKYWNDPDTLQKIGEAMGASFPFGAGSSAEPSGPEETEEEGGDDDESIVHHTASVGDEEGLKKALDGGADKDEEDSEGRRALHFACGYGELKCAQILLEAGAAVDALDKNKNTPLHYAAGYGRKECVDLLLKHGAAVTLQNLDGKTPIDVAKLNNQDEVLKLLEKDVFL

SEQ ID NO: 45527 - protein, 445 aa, Sorghum bicolor
  unsure (1)..(445): unsure at all Xaa locations
  Clone ID: SORBI-28MAY03-C91_1.pep
AAAQGVRTTKVNIRVVKYQVGMRKLGRTIAKVTFAKVTXAIDPVTGEVLDKEKVLRHKMVEQKMLEKFTRKMFKHPYIVRIYVVMVCKTKVNIMLEYVTGGELFDTIANHGRMREDEARRYFQQLINAVDYCHSRGVYHRDLKPENLLLDSYGNLKVSDFGLSALSQQIKDDGLLHTTCGTPNYVAPEVLEDQGYDGAMADLWSCGVILFVLLAGYLPFEDSNLMTLYKKISNAEYTFPPWTSFPAKRLLTRILDPNPMTRITITKIPEDEILKKEYKNPGYDETYFKPLDDIESDFNDAELHHVTEKKEEEPVVLNAFELISRSAGLNLGNLFDSEQEFKRETRFTSKCPPKEIVRKIEEAAKPLGFGVQKKNYKLRLEKVKAGRKGNLNVATEILQVAPSLHMVEVRKAKGDTLEFQKFYKNLSKTLKDVVWKSEDLQMQPAS

SEQ ID NO: 45528 - protein, 111 aa, Sorghum bicolor
  Clone ID: SORBI-28MAY03-C9059_1.pep
MAPPQPKSGLFVGINKGHVVTKRELPPRPSHRKGKATKRVSMVRGLIREVAGFAPYEKRITELLKVGKDKRALKVAKRKLGTHKRAKKKREEMAGVLRKMRSAGTHTDKKK

SEQ ID NO: 45529 - protein, 158 aa, Sorghum bicolor
  Clone ID: SORBI-28MAY03-C387_1.pep
MSLIRRSNVFDPFSLDLWDPFEGFPFGSGGSNSLFPSFPRTSSETAAFAGARIDWKETPEAHVFKADVPGLKKEEVKVEVEDGNILQISGERNKEQEEKTDTWHRVERSSGRFLRRFRLPENAKTEQIRAAMENGVLTVTVPKEDVKKPEVKSIQISG

SEQ ID NO: 45530 - protein, 119 aa, Sorghum bicolor
  Clone ID: SORBI-28MAY03-C3722_1.pep
MKDTSFKASGAKRKKAGGAKRGITPFFAFLAEFRPQFLEKHPELKGVKEVSKAAGEKWRSMSDEEKAKYGSTKKQGDKASKKESTSSKKAKTDGREGEEAVKSEVEDDDEQDGNEDENE

SEQ ID NO: 45531 - protein, 375 aa, Sorghum bicolor
  unsure (1)..(375): unsure at all Xaa locations
  Clone ID: SORBI-28MAY03-C4_1.pep
MVQQQAAKEVIPLLTPYKMGQFQLSHRVVLAPLTRCRSYGNVPQPHAAVYYSQRATKGGLLIAEATGVSPTAQGYPEAPGIWTQEQVEAWKPIVDAVHRKGGIFFCQIWHVGRVSTYEFQPDGQAPISSTDKQITAAEISPSGESGXTEEIPGIVDDFRRAARNAIEAGFDGVEIHGAHGYLLEQFMKESSNDRTDEYGGSLENRCRFAVEVVDAIVREVGAHRVGIRLSPFVDFVDCVDSDPVALGHYMIQQLNKHEGFLYCHMVEPRMAIVDGRRQIPHRLLPFRKAFHGTFIAAGGYDREEGNKVVAEGYADLVAYGRLFLANPDLPKRFELNAPLNKYDRSTFYTQDPVVGYTDYPFLEDNCDNDESSNQA

SEQ ID NO: 45532 - protein, 225 aa, Sorghum bicolor
  Clone ID: SORBI-28MAY03-C40821_1.pep
GYDRCVSNEQARDIAAGLGVASVFWDWDLPRTREGFYRFRGSVGAAVVRGRAFAPHADVLWMETSSPNVAECTAFAEGVKAACPEAMLAYNLSPSFNWDASGMTDAEMAAFIPSVARLGYVWQFITLAGFHADALVTDTFARDFARRGMLAYVERIQREERINGVETLEHQKWSGANFYDRVLKTVQGGISSTAAMGKGVTEEQFKDSRPATGSSGLQVMAKSRI

SEQ ID NO: 45533 - protein, 108 aa, Sorghum bicolor
  Clone ID: SORBI-28MAY03-C44417_1.pep
MAAAALRPLTAPNAALPPRGPGKEHRTAITVPEFKRWVKQFDTDHDGRISRKELREAIRRRGAWFSGLRALFAVRRADRNRNGFVDDSEIEGLIDFAERELGFRITTE

SEQ ID NO: 45534 - protein, 480 aa, Sorghum bicolor
  Clone ID: SORBI-28MAY03-C43049_1.pep
HEAEAYFPPISQPEGLPLKVQDASGKEWIFQFRFWPNNNSRMYVLEGVTPCIQAMQLQAGATVTFSRIDPEGKLIMGFRKATNNSSEQEQITKPANGAPATSEANGKVSGADSSPNAAVSRQNKVNIETKSSSPVEQATALKMDKDGLTQKEGPGTASSSPGSVKRKTTNLGQKNKRLRMDNEESMELKITWEEAQELLRPPPKAPSIVIVDGHEFEEYEEPPVLGRKTYFVADKSGSDHQWAQCEDCSKWRKLPIDALLPSKWTCSDNKWDPERSSCEHAQEISMEELAEIIPIKYAKKPKSRMESDAIDASRGLDTLANLAILGEGEALPSQPTTKHPRHRPGCSCIVCIQPPSGKGPKHKQTCTCNVCMTVRRRFRTLMLRREKKATTDTPRKKETGQSSEKVTQAVSTPPVASASATSPPRKADGNADGAEDMAVDHKVTSSPVKNHIDLNIQPDRDDEQSPKSGTAGLLSRDNPS

SEQ ID NO: 45535 - protein, 609 aa, Sorghum bicolor
  Clone ID: SORBI-28MAY03-C4902_1.pep
MDNLITLVNKLQRACTALGDHGEESALPTLWDSLPAIAVVGGQSSGKSSVLESVVGKDFLPRGSGIVTRRPLVLQLHRIDGDREYAEFMHLPRKRFTDFAAVRKEIADETDRETGRSKQISTVPIHLSIFSPHVVNLTLIDLPGLTKVAVEGQPESIVQDIENMARSYIEKPNCIILAVSPANQDLATSDAIKISREVDPKGERTFGVLTKIDLMDKGTDAVDILEGRAYRLQTPWVGVVNRSQQDINKNVDMIAARRREREYFATTPEYKHMASRMGSEYLGKMLSKHLEQVIKSRIPGLQSLITKTIAELETGLNRLGKPIANDAGGKLYTIMEICRMFDSIYKEHLDGVRPGGEKVYHVFDNQFPVAIKRLQFDKQLSMENVRKLITEADGYQPHLIAPEQGYRRLIESCLISIRGPAEAAVDAVHAILKDLVRKAINETHELKQFPTLRVEVGNAAFESLDRMRDESKKNTLKLVDMECSYLTVDFFRKLPQDVEKGGNPSHSIFDRYNDSYLRRIGQTVLSYVNMVCSTLRNSIPKSIVYCQVREAKRSLLDHFFTELGAREMKQLSKLLDEDPAVMERRTNLAKRLELYRSAQSEIDAVAWSK

SEQ ID NO: 45536 - protein, 470 aa, Sorghum bicolor
  Clone ID: SORBI-28MAY03-C530_1.pep
TRDWENRDAMFRDVEEIIRRQIKMSVLPSVQPFHAIAYPIDPMLALEISCKYAAHCSLIASRFGLPPFVHPSPVPVKAEGKHCRLRVGYVSSDFGNHPLSHLMGSVFGMHDRANIEVFCYALSQNDGTEWRQRIQSEAEHFVDVSAMTSDNIARLINQDKIQILINLNGYTKGARNEIFALQPAPIQVSYMGFPGTTGAAYIDYLVTDEFVSPSRYSHIYSEKLVHLPHCYFVNDYKQKNRDCLTPVCPHKRSDYGLPEDKFIFACFNQLYKMDPEIFDTWCNILKRVPNSALWLLRFPAAGETRVRAHAVARGVRSDQIIFTDVAMKNEHIRRSALADLFLDTPLCNAHTTGTDILWAGLPMITLPLEKMATRVAGSLCVATGLGEEMIVSSMKEYEDRAVDLALNPVKLQALTNKLKEVRMTCPLFDTARWVRNLERAYYKMWNLYCSSRHPEPFKVLEDDNEFPFDR

SEQ ID NO: 45537 - protein, 159 aa, Sorghum bicolor
  Clone ID: SORBI-28MAY03-C5125_1.pep
MAAAGGENSGAGEGEFYLRYYVGHKGKFGHEFLEFEFRPDGKLRYANNSNYKNDTMIRKEVFVSPSVLREARRIIQESDIMKEDDSNWPEPDRIGRQELEIVMGNEHISFTTSKIGSLVDVQSSKDPEGLRIFYYLVQDLKCFVFSLINLHFKIKPIQS

SEQ ID NO: 45538 - protein, 521 aa, Sorghum bicolor
  Clone ID: SORBI-28MAY03-C1716_1.pep
TRVQFIVNHAAAGVIFCVPQTLSILLSFIAQMPCVRLIVVVGGDDANMPSTPVTTGVEIITYSKLLIQGKISPQHFRPPKPEDVATICYTSGTTGTPKGVVLSHENLIANVAGSSLNIKFYPSDVYISYLPLAHIYERVNQIAALHCGVAIGFYQGDNLKLMDDLAALRPTIFASVPRLYNRIYTAITNAVKESGGLKEKLFHTAYNVKRQAILNGKNPSPVWDKLVFNKIKARLGGRVRLMSSGASPLSADVMEFLRICFGGEVLEGYGMTETSCIISAMDVGDRSIGHVGSPIASCEVKLVDVPEMNYTSEDQPYPRGEICVRGPIVFHGYYKDEVQTKEVIDEDGWLHTGDIGLWLPGGRLKIIDRKKNIFKLAQGEYIAPEKIENVYAKCKFIAQCFIYGDSLNSFLVGIVAVEPEVLKAWAASEGIQCEDLRQLCADPRARAAVLADMDSVGKEAQLRGFEFAKAVRLVAEPFTVENGLLTPTFKVKRPQAKTYFAKEISDMYAELREAEAPRSKL

SEQ ID NO: 45539 - protein, 360 aa, Sorghum bicolor
  unsure (1)..(360): unsure at all Xaa locations
  Clone ID: SORBI-28MAY03-C1372_1.pep
GVLGEACRVQHDMENMYMWVFKERPENALGKMXLMGFSGAXDSVGVPRFPGSPVRGFVRSHRMQRKHYRGLSNPQCLHGIEIVRAPNLAGVPEADLKRWMELTGRDANFSVPTEASXFESWRNLPSTDFELERPATMAPAKSSSHGHHKKLLNGSGLNLSTXPSNHSSGDGMEITATCNKRRKDSSPAAMEEDCSNSNSDKAQDMDVSHTFEPTWMNDFSGVMRHASGPVTAAKTIYEDSKGYLIIISLPFADFQKVKVSWKNTLTNGIVKVSCTSVGRMPFLKRHDRTFKLADPAPEHCPPGEFVREIPLPTRIPEDATLEAYRDETGTGLEIIVPKFRVGPEEHEVHVSMRPPSSWCQ

SEQ ID NO: 45540 - protein, 125 aa, Sorghum bicolor
  unsure (1)..(125): unsure at all Xaa locations
  Clone ID: LIB3476-058-P1-K1-B9.pep
MGEDLVTTLSMENGGGGGGHHGPCTLLSMDPSGHLSAPDDRAVGVMVQALIGGAVGVGARAHAVSPSGAPPPDINQPWQTDLCDMLDVGLGPQVYSAEAVLSCAPKAGNRKAAKRXDTIWGAWFF

SEQ ID NO: 45541 - protein, 223 aa, Sorghum bicolor
  Clone ID: SORBI-28MAY03-C19493_1.pep
MATVTEEVAPAVAQEPAPEEAKGVMETPEKVEEGKKPEEGVEGKKAAAEKEKKARKPRSRKPKSAGPHHPPYFEMIKEAILSQDVGKVGASPYAIAKHIGEKHRDVLPPNYRKVLAVQLRGFAAKGRLVKVKASFKLAASEEKKAAAASAAAKTKKTPPAKRKRAAAPAKKKPAVAAAAPPREARKARAKRARKVAPAPVQPKPKAARAAAGGGGKKANKASA

SEQ ID NO: 45542 - protein, 208 aa, Sorghum bicolor
  Clone ID: SORBI-28MAY03-C5969_1.pep
MVSLKLQKRLAASVLKCGKGKVWLDPNEVSEISMANSRQNIRKLVKDGFIIKKPQKIHSRSRARRAHEAKQKGRHSGYGKRRGTREARLPTKILWMRRMRVLRRLLRKYREAKKIDKHMYHAMYMKVKGNMFKNKRVLMESIHKTKAEKTREKTLSDQFEAKRAKSKASRERKIARREERLAQGPREPTAAPAAAPAPAAAAPKKAKK

SEQ ID NO: 45543 - protein, 209 aa, Sorghum bicolor
  Clone ID: SORBI-28MAY03-C6717_1.pep
MADPAEHRPAEEEEEAAAAGEDEDTGAQVAPIVKLEEVAVTTGEEDEDVLLDMKAKLYRFDKDGNQWKERGTGTVKLLKHKETAKVRLVMRQAKTLKICANHLVVATTKMQEHAGSDKSCVWHALDFAEGELKEEMFAIRFGSVENCKKFKDIVEEIAEQQGNTEEKENEEASTAADLVEKLTVTEASKEETVEKEEAPASDDKKDAKE

SEQ ID NO: 45544 - protein, 746 aa, Sorghum bicolor
  Clone ID: SORBI-28MAY03-C7193_1.pep
MAGTESSTGTSFTDSYSVSVLSKPTIDQSADVDLKPSAPPLAYSEGDGFMPLPSAPLAPKMEVPGSGPAPGTRDIDQSAFDYTTNRNKERDALKRQDTPMPIRKDILVKDEPRDGHSDVPMLPNPRLMFQVGGNAPRLVTPSEIISGTLSSAENNDVSKSDGGKSQDVSSRSSRVAEVEPKHIDESKPDQNVGLEAVKETQIVCENMEKTQSSLEQTVEMISERSVTTDKYSVEESQSSSDRRASDQIGVADENVLKKFVEIPEKIDYSSASREQSSSFTKEEKVLHPQTSGQPSPPVSAFNSTESHEPLSSTYLPASSFPEAAATQGMLQQLMGMQKDMEKQLSTVVPASIAKEGKRLETSLGRTVEKSIKANIDAFWVRLQEENTKREKADRERMQQLVTLITNSINKDLPSNMEKSLKKEISSLGPIVARAITPIIEKCLTSAVYDSVQKGVGDKVCNQLEKSITGKLEATLARQIQMQFHTSGKQALQDALRTSFESLLVPAFEQTCKTMFEQIDGAFQKGMSEHSIAIQQQVEAAHTPLALTLKETINSASSITQSFSSELLDGNRKLLALVTSGNAKAHNTSALQPFNGPMGGPQEAEAPLDPMKELSRLISERKFDEAFTMALQRSDVSIVSWLCSQVDLRALCAMTPVPLNQGVLLALLQQLAIDIHNETSRKVQWMTDVAMAINPSDQMIAVHVRPIFEQVYNQLAHQRTLPTTTASDGTSIRVIMHVINSVLLSYK

SEQ ID NO: 45545 - protein, 171 aa, Sorghum bicolor
  Clone ID: SORBI-28MAY03-C6291_1.pep
MVKYSREPSNPTKSAKAMGRDLRVHFKNTRETAFAIRKLQLSKAKRYLEDVIAHKQAIPFRRYCGGVGRTAQAKSRHSNGQGRWPAKSAKFILDLLKNAESNAEVKGLDVDTLYVSHIQVNQAQKQRRRTYRAHGRINPYMSSPCHIELMLSEKEEPVKKEAETQIAARKA

SEQ ID NO: 45546 - protein, 279 aa, Sorghum bicolor
  Clone ID: SORBI-28MAY03-C7397_1.pep
MESLTLRASSAAAAASPLQQRRLPGRQRATYVRATASASAAGEPDLSVRVNGLQMPNPFVIGSGPPGTNYTVMKRAFDEGWGGVIAKTVSLDAEKVINVTPRYAKLRADPNGAAMGRIIGWQNIELISDRPLETMLNEFKQLKKEYPDRILIGSIMEEYNKAAWHELIERVEESGVDALEINFSCPHGMPERKMGAAVGQDCDLLEEVCGWINEKATVPVWAKMTPNITDITQPARISLKSGCEGVSAINTIMSVMGINLKTLRPEPCGGGYSTPLGLF

SEQ ID NO: 45547 - protein, 279 aa, Sorghum bicolor
  Clone ID: SORBI-28MAY03-C8529_1.pep
MLVLFETPAGFALFKVLDEGKLDKVEDLWKEFTTSDSARKVVELKAFNKFENTSDALSAATLIIDSKPSKGLRKFLQKHCEGETLAVADSKLGNAIKEKLKIDCLHNSAVMELMRGLRNQLTELITGLGAQDLGPMSLGLSHSLSRYKLKFSPEKVDTMIIQAIGLLDDLDKELNTYAMRVREWYGWHFPELTKIVTDNIQYAKVVKMMGNRTNAVDLDFSEILSDEEIETQLKEAAVISMGTEVSDLDLSNIKELCDQVLALSEYRAQLYDYLKSRMN

SEQ ID NO: 45548 - protein, 199 aa, Sorghum bicolor
  Clone ID: SORBI-28MAY03-C7360_1.pep
MSSAQIAPADHVCYVHCNFCNTVLAVSVPGNSMLNIVTVRCGHCTNLLSVNLRALMHSLPEQDQLQENIKVHGVNGTLHDQCGHLELGSSSSSKFRLPMMYSPQNEHLLQEQTLNNARPPEKRQRVPSAYNRFIKEEIRRIKANNPDISHREAFSTAAKNWAHYPNIHFGLNSGREGGKKLVDEAVAAAPAPKKIQGFY

SEQ ID NO: 45549 - protein, 489 aa, Sorghum bicolor
  unsure (1)..(489): unsure at all Xaa locations
  Clone ID: SORBI-28MAY03-C8573_1.pep
FFFFAINLFGIYYGDDWEGLYEAITGYGLGGSSMALFGRVGGGIYTKAADVGADLVGKVERNIPEDDPRNPAVIADNVGDNVGDIAGMGSDLFGSYAESSCAALVVASISSFGINHEFTPMLYPLLISSVGIIACLITTLFATDFFEIKAVDEIEPALKKQLIISTAVMTVGIALVSWLGLPYTFTIYNFGVQKTVYNWQLFLCVAVGLWAGLVIGFVTEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAAIATVPPXGHLVFSLPLLVGTCFGAETLPGVFAGALVSGVQIAISASNTGGAWDNAKKYIEAGASEHARTLGPKGSDPHKAAVIGDTIGDPLKDTSGPSLNILIKLMAVESLVFAPFFATHGGILFKWL

SEQ ID NO: 45550 - protein, 121 aa, Sorghum bicolor
  Clone ID: SORBI-28MAY03-C25457_1.pep
TLNLENLFEAKEEYKRETRFTSQCPPKEIISKIEEAAKPLGFDVQKKKYKMRMENPKAGRKGNLNVATEVFQIAPSLHVVELKKAKGDTLEFQKFYRSLSTQLKDVVWKCDGEVKGNSTAA

SEQ ID NO: 45551 - protein, 332 aa, Sorghum bicolor
  unsure (1)..(332): unsure at all Xaa locations
  Clone ID: SORBI-28MAY03-C26663_1.pep
MAASLLRRGAVASRRRCPEGMLRRLVSSEAAPERAPSSRPPPEMPSFDHQPRPYAGMGGAEIFQKRKAVLGPSLFHYYQKPLNIVEGKMQYLYDENGKRYLDCFGGIVTVSCGHCHPDIVNAVVEQTKLLQHTTTIYLHHAIVEFAEALTSXMPGNLKVAYFVNSGTEANELAMLMARLYSGNLSMVAPTPAFPGVLAQKIRLTALRAWPVPSPGGLAVLKVLDKEKRQAHCADVGAHLVERLKSLQEKHEIIGDVRGRGLMLGVELVTDRKEKTPAKAETTELFEKLKDLGVLVGKGGLHGNVFRIKPPMCFSKDDADFLVDCMDYAMSGL

SEQ ID NO: 45552 - protein, 118 aa, Sorghum bicolor
  Clone ID: SORBI-28MAY03-C2568_1.pep
VTHELLERLEAHLRATAELMVTANMRGNSAEEVAERVLSQTSICGLQGPTVSPVYCRRDGKVDLEYYAINVVVPQKLLYKSIQQLRSIGGSGVLVTKLTYIFDEETPRWRNLLSELGL

SEQ ID NO: 45553 - protein, 436 aa, Sorghum bicolor
  Clone ID: SORBI-28MAY03-C9653_1.pep
MVQYSGDKMKTSLLLLPLFIALLSATSPLPSADALNVKGRLVKSKTFLSPPIFLRPGDVADKIYYDIAFPRGHLAFKSFNGEVVDEHGVPVPLHETYLHHWVVEPYYAAKDASTAAAEGRPRMIPARNSGVCNHTLGQYYGLGSETRRTATWVPDPYGIEIGDPDAAPEGYEERWMLNVHAIDTRRVVDKLACTECRCDLYNVTVDQYGRGIEDGYAGGLRCCYDETRCALEERGRLLVNADEEAPPRKVFLRYTVMWQDWSDAAVLPVKIYIFDVTACKVEYDVDECAAGNDNGGGGECVHVQTATQVLPRGGDVVFGVAHQHSGGIAASLHGEDGRLLCESTATYGDGEEAGNEAGYIVGMSTCYPKPGDVKVRDGEALTVVSRYSSERRHTGVMGLFYILVAEQQVPADGKPPGLCFSFPVSWCLPSWLSSNM

SEQ ID NO: 45554 - protein, 394 aa, Sorghum bicolor
  Clone ID: SORBI-28MAY03-C10734_1.pep
MAPTVAFSSVSAQAGLIQKPRNLGATSYAGLKVPSFRSESSFLGRNASLRAAVTPRIVPKAKSGSQISPQASYKVAVLGAAGGIGQPLGLLIKMSPLVSELHLYDIANVKGVAADLSHCNTPAQVLDFTGPSELANRVEGVDVVVIPAGVPRKPGMTRDDLFNINASIVKSLVEAVADNCPEAFIHIISNPVNSTVPIAAEVLKQKGVYNPKKLFGVTTLDVVRANTFVAEKKNLKLIDVDVPVVGGHAGITILPLLSKTRPSVTFTEEETEELTKRIQNAGTEVVEAKAGAGSATLSMAYAAARFVESSLRALAGDPDVYECTFIQSEKTDLPFFASRVKLGKNGVESVVSADLEGVTEYEAKALEALKAELKGSIEKGIAFANKQQEAAASV

SEQ ID NO: 45555 - protein, 269 aa, Sorghum bicolor
  Clone ID: SORBI-28MAY03-C10511_1.pep
MAGQNQRLNVVPTVTMLGVMKARLVGATRGHALLKKKSDALTVQFRAILKKIVAAKESMGETMRASSFSLAEAKYVAGDGVRHVVLQSVRAASVRVRSHQENVAGVKLPKFTHFVDPAAASGGPSNASPSLTGLARGGQQVAACRAAHVKAIEVLVELASLQTSFLTLDEAIKTTNRRVNALENVVKPRIENTISYIKGELDELEREDFFRLKKIQGYKKREIERQMAAAKLFAEEQLAEDLALKRGISVGAAANLLVAGGEKDDDIIF

SEQ ID NO: 45556 - protein, 183 aa, Sorghum bicolor
  Clone ID: SORBI-28MAY03-C108031_1.pep
VYTTHDDNGWSSRSTATSATCFPAGRASGLGGAGEAGGDGGVVHGVVEGLGLRHPRTQLPGLLLRQATHELPAARARLVVLRHRRRRRRGLEVVGLPRPPQQRRPPPAALRRPSRADHPSGGGGGARTDRRRRPRRRRAGGQGNGGDRCARCHRHSDRPVASFSARLCFAWVLRLRCERPSCC

SEQ ID NO: 45557 - protein, 236 aa, Sorghum bicolor
  Clone ID: SORBI-28MAY03-C11287_1.pep
TKLTVVFLVSAKSRMTLNEWFLPCESLGLAAEHGYFLRLCSAAVSASACRPAIGCSWKQIAEPVMKTYTETTDGSTIENKEPAIVWCYEDADPDFGSCQAKELHEHLESVLSNEPVSVKAGPNLVEVKPQGVSKGLVAKRILSTMQERGDLPDFVLCVGDDRSDEDMFEVITTAARGVSLQAEAEVFACTVGRKPSKAKYYLDDPADIVRLVQGLANVSDDDQTHAPPLPTDTVPR

SEQ ID NO: 45558 - protein, 124 aa, Sorghum bicolor
  Clone ID: LIB3478-026-P1-K1-F7.pep
ADAWVLVVSEFIGCSPSLSGAIRVNPGNVDSVARAVDYALEMPEGEKVLRHEKHHRYVSTHDVGYWANSFLQDLERICLDHNRRRCWGIRFGLKFKVVALDPNFKKLAVEHLVSAYRRTTKRVI

SEQ ID NO: 45559 - protein, 536 aa, Sorghum bicolor
  Clone ID: SORBI-28MAY03-C12475_1.pep
TRLARGLDGFMGTRDEETRRFFKHSSVQVLLCPRSAGKRHSWVKQQETGTIFTHHQKTVIVDADAGNYRRKIVAFVGGLDLCGGRYDTPWHPLFRTLQNEHKEDYYNPNFNTVDARGPREPWHDLHSKIDGPAAYDVLQNFQERWLKAAKRHGIKKLAKSYDDALLSIERIPDIININDAIYFSDNDPETWHVQVFRSIDSNSAKGFPKDPRAATMKNLVCGKNVLIDMSIHTAYVHAIRAAQHYIYIENQYFIGSSFNWDSNKDLGANNLIPIEIALKIANKIKANERFSAYIVVPMWPEGNPTGAATQRILYWQNKTMQMMYETIYRALKEVGLDDMYEPQDYLNFFCLGNREVDDSTSNSNASNTANNPQEHARKNRRFMVYVHSKGMIVDDEYVIVGSANINQRSMEGIRDTEIAMGAYQPQYTWANKLSAPRGQIYGYRMSLWAEHIGSIEEDFHYPESLECMRRVRHLGEENWKQFVADEVTEMRGHLMKYPVSVDRKGKVKPLPGCTTFPDLGGNICGSFTAIQENLTI

SEQ ID NO: 45560 - protein, 331 aa, Sorghum bicolor
  Clone ID: SORBI-28MAY03-C1424_1.pep
LPGIVVDLPTLTEKDKEDILGWGVPNDIDMIALSFVRKGSDLVTVRQVLGQHAKRIKLMSKVENQEGVVNFDEILRETDAFMVARGDLGMEIPVEKIFLAQKMMIYKCNIAGKPVVTATQMLESMIKSPRPTRAEATDVANAVLDGTDCVMLSGESAAGAYPEVAVEIMARICIEAESSLDHEAVFKAMIRSAPLPMSPLESLASSAVRTANKAKAALIVVLTRGGTTAKLVAKYRPRVPILSVVVPVLTTDSFDWTISSEGPARHSLIYRGLIPLLAEGSAKATDSESTEVILEAALKSAVQKQLCKPGDSIVALHRIGVASVIKICIVK

SEQ ID NO: 45561 - protein, 320 aa, Sorghum bicolor
  Clone ID: SORBI-28MAY03-C1777_1.pep
MKKCPSELELEAFLRGREDATAAAAAAVAEQKPVHDVAALAPFGAGGVFPPSDLSAFSFADSNTLNGSIHNHLWSHNHNVRHPAVSTTIESQSSICAAASPTSATNLYLKESQTLGGTSGSDSDSESLLDIEGGPCEQSTNPQDVKRMRRMVSNRESARRSRKRKQAHLADLETQVDQLRGENASLFKQLTDANQQFTTAVTDNRILKSDVEALRVKVKLAEDMVARGALSCGLGSLGLSPVLNPRQACRGPDVLSGLDFPGDDACFTGLSATEQLQNSPLQSIASLESLENRMASEVTSCGGPGVDVWPWDHSNGGLSK

SEQ ID NO: 45562 - protein, 231 aa, Sorghum bicolor
  unsure (1)..(231): unsure at all Xaa locations
  Clone ID: SORBI-28MAY03-C3593_1.pep
MERMLARLMRRRSSSPLSDLLHHGGAAAAGSLQAAAGATAASPWLFSHHQQQQQQHTAAAALPGLKIRDSASQLIGRTPMVYLNKVTEGCGARIAAKLEFLQPSFSVKDRPAISMLEDAEKRGLITPGKTTLIEPTSGNMGIGLAFMAALKGYELILTMPSYTSLERRVTMRAFGANLVLTDPTKGMGGTVRKAXXLYEKHPSAYMLQQFQNPANCKVHYETTGPEILEDT

SEQ ID NO: 45563 - protein, 354 aa, Sorghum bicolor
  Clone ID: SORBI-28MAY03-C38389_1.pep
RSNGVYMLEDLNMRYCNCITDSDMKYLSDLTNLRELQLSSCKISDFGVSYLRGLHKLGHLNLEGCSVTAACLEVISELASLVLLNLSRCGICDEGCENLEGLTKLKALNLGFNHITGACLIHLKDLISLECLNLDSCKIGDEGLFHLKGLIQLKSLELSDTEVGSNGLRHLSGLRNLQSINLSFTLVTDIGLKKISGLSSLKSLNLDNRQITDTGLASLTNLTGLTHLDLFGARITDSGMNCFRFLKNLQSLEVCGGLITDAGVKNIKDLKALTLLNLSQNGNLTDKTLELISGLTALVSLNVSNSRVSNSGLHHLKPLLNLRSLSLESCRVTASEIDKLRLVALPNLISVRPE

SEQ ID NO: 45564 - protein, 185 aa, Sorghum bicolor
  Clone ID: SORBI-28MAY03-C38430_1.pep
RAPLAVRRLGRRKLFLQGGAQMIVCQLVVGTLIAAKFGTSGTGDIARGYAAVVVVFICAYVAGFAWSWGPLGWLVPSEIFPLEIRPAGQSINVSVNMFFTFCIAQAFLTMLCHFKFGLFYFFAGWVVIMTVFIALFLPETKNVPIEEMVLVWKSHWFWKKFIADDDVHVGGNHLQMGRDGKGADA

SEQ ID NO: 45565 - protein, 160 aa, Sorghum bicolor
  Clone ID: SORBI-28MAY03-C20055_1.pep
MADHHRGGTGGGAGGYGDYNRGGGAGMYGESQQQQQKQGAMMTAIKAATAATFGGSMLVLSGLILAGTVIALTVATPVLVIFSPVLVPAAIALALMAAGFVTSGGLGVAALSVFSWMYKYLTGKHPPGADQLDHAKARLASKARDIKDAAQHRIDQAQGS

SEQ ID NO: 45566 - protein, 222 aa, Sorghum bicolor
  Clone ID: SORBI-28MAY03-C22472_1.pep
MPGLTIGDTVPNLELDSTHGKIRIHDYVGDGYAIIFSHPADFTPVCTTEMAAMAGYAKEFEKRGVKLLGISCDDVESHREWTKDIEAYGGGKQKVTYPILADPGRDAIRQLNMVDPDEKDSNGVSLPSRALHVVGPDKAVKLSFLYPATTGRNMDEVLRAVDSLLTAAKHGGKVATPANWKPGDRAVIAPSVSDEEARKMFPHGFETADLPSKKSYLRFTKV

SEQ ID NO: 45567 - protein, 102 aa, Sorghum bicolor
  Clone ID: SORBI-28MAY03-C10063_3.pep
MGSLGPSVVTLQQQQQHPKAGKPPAAAGGGHHEQQSSNCGGGSSSSSFRMPLHYPRYKKADYEAMPEWRVDCLLREYGLPVAGDLREKREFAMGAFLWPDQY

SEQ ID NO: 45568 - protein, 121 aa, Sorghum bicolor
  Clone ID: SORBI-28MAY03-C10063_1.pep
MGSLGPSTKSRAGMVAAAPCVRGIPGAYRVVDQQQQAQPRTAAGAGGGGHHEQQSRKCGGGSSSSSFRMPLHYPRYKKADYEAMPEWRVDCLLREYGLPVAGDLREKREFAMGAFLWPDQY

SEQ ID NO: 45569 - protein, 99 aa, Sorghum bicolor
  Clone ID: LIB5121-003-A1-PF1-A1.pep
MGSLGPTVSLSIMAKPSGGQQPERERKEGGGRCGDGGVFSGGCGFRMPLHYPRYKKADYESMPEWRVDCLLREYGLPADGDLDSKRRFAMGAFLWPDQY

SEQ ID NO: 45570 - protein, 103 aa, Sorghum bicolor
  Clone ID: LIB3478-009-P1-K1-G4.pep
MGSLGPSTISSMNMAKAASVVGGKTGVVAVADQQKEVPPKTMNCSSYAFQMPLHYPRYKKADYESMPEWRVDCLLREYGLPADGDLDSKRKFAMGAFLWPDQY

SEQ ID NO: 45571 - protein, 374 aa, Sorghum bicolor
  Clone ID: SORBI-28MAY03-C2150_1.pep
MESSLLDTAAAAGLCPAAAGRRHAGRAASFLSCSCASRDCRVSASYSHSISRMLSGVRSAARKKLFRTDQAADLLGIANWSDETSGGAGGHGHHQQQHWWTALEHNFVLEATDDEYGGVVVDADRLPDDKAAFARSLAASLSYWKSVGKKGVWLKLPVDRAEFVPLAVKEGFKYHHAEEAYLMMTYWIPDEPNMLPANASHQVGVGGFVINDQMEVLVVQEKYRGSSLDGVWKLPTGFILASEEIYTGASREVKEETGVDTEFVDVVAFRHAHNVAFQKSDLFFICMLRPLSSEIKIDETEIQAAKWMALEEFVKQPFIQEDHMFQKIMDICIQRLRKCYCGLTPHHVVSKFDDRTSTLYYNVAEPEDVNCSAT

SEQ ID NO: 45572 - protein, 77 aa, Sorghum bicolor
  Clone ID: LIB3481-004-Q6-K1-C9.pep
LTHRGVLFQWMALEEFVKQPFIQEDHMFQKIMDICIQRLRKCYCGLTPHHVVSKFDDRTSTLYYNVAEPEDVNCSAT

SEQ ID NO: 45573 - protein, 304 aa, Sorghum bicolor
  Clone ID: SORBI-28MAY03-C25380_1.pep
SSAPLLAALVGGLVAAPPIPPARGGLLVGARLIAHGGSLLNLAKQPGSTIQILGAEKALFRALKTKHATPKYGLIYHASLIGKASQKHKGKISRSLAAKTALAIRYDALGDGEDNSIGTESRLKLETRLQVLENRELGKSAGSIKGKPKIEVYEKDRKKGAGALTTPAKTYNPAADLVLTEETPKKSELASKKRKHHEVKTEPSAVPAEEAIQEDGDQEDRKKKKKKKSKESEEAPAVEGDGEKKKKKKSKEAQEEPAVAAASEGEKKKKKKKSDADGEDVAMQTEESGKKDKKKKKKKHADDE

SEQ ID NO: 45574 - protein, 189 aa, Sorghum bicolor
  Clone ID: SORBI-28MAY03-C251_1.pep
MEMASSSTAPTTSYYNVSVAQAVFTLSINAILVWLTTVIKSSSSSSSSSSSGRRRDAAPAATPAPASATAPPPSPSSPAKPAAAAVDMDVVLGLMGAGASAVSVGFEEAAALFEEEEATVEEAREAFAVFDRNGDGFIDAAELRSVLTSLGFQAGVADAECQRMIDAYDGDRDGRIDFLEFVKLMETSH

SEQ ID NO: 45575 - protein, 115 aa, Sorghum bicolor
  Clone ID: SORBI-28MAY03-C25416_1.pep
QNASTCQCSRHNLPTRLKGHWRRESAAHQRGYSKQSQVQHNSCANVATTVEPSKASHRTRHGESTCEDGNRRSTRVRSNRNLSTNKQHGVRLSLPRKTSVFLQFHPWSQPAEPSC

SEQ ID NO: 45576 - protein, 242 aa, Sorghum bicolor
  Clone ID: SORBI-28MAY03-C25418_1.pep
MAASTTAAPAPCYDAPEGVDVRGRYDREFASILTRDALGFVAGLQREFRGAVRYAMEQRREAQRRYDAGELPRFDPATRLVRDGDWTCAPVPPAVADRTVEITGPAEPRKMVINALNSGAKVFMADFEDALSPTWENLMHGQVNLRDAVAGTITYRDAARGREYKLNDRTAKLFVRPRGWHLPEAHILVDGEPAIGCLVDFGLYFFHNHAAFRAGQGAGFGPFFYLPKMEHSREARIWNGVF

SEQ ID NO: 45577 - protein, 290 aa, Sorghum bicolor
  unsure (1)..(290): unsure at all Xaa locations
  Clone ID: SORBI-28MAY03-C49209_1.pep
MASGGGSSSRVTGGGGNLNLPAGFRFHPTDEELIVHYLMNQAASIPCPVPIIAEVNIYQCNPWDLPAKALFGENEWYFFSPRDRKYPNGVRPNRAAGSGDWKATRHRQGHHVHAPRPSTAASRARSSYXGPPPRGLKTVWLARVPPLRPPDRXAAGDDKNSSIKRRSGSSMRLDDWVLCRIHKKSNDFQLSDQEQEKEGSTVEELDTLANTTNTDXSMNDSXETTTLGHHDQLRHETAAMTTMSKSCSLTDLLNSIDYASLSQMFLDIPAEAEEPAQQQSTPLIYPPATQ

SEQ ID NO: 45578 - protein, 107 aa, Sorghum bicolor
  Clone ID: SORBI-28MAY03-C5116_1.pep
MGEVKHLCLVKFKEGVVVEDVLKGMTDLVAGMDMVKSFEWGQDVLNQEMLTQGFTHVFSLTFAFADDLATYMGHDRHAAFAATFMAALDKVVVIDFPVVVAKPPPPA

SEQ ID NO: 45579 - protein, 360 aa, Sorghum bicolor
  Clone ID: SORBI-28MAY03-C26775_1.pep
MATTTATATNRRVILKEYVEGYPREEHMELLPGSSVPLRLTGTEPAGSVLVRNLYLSCDPYMRPKMSRPLRESYTAAFVPGDAITGYGVSRVLDSSDPRFAPGDLVWGITGWEDYSVVTPPVSKFLAKISHHGEGVPLSYYTGILGMPGLTAYVGFHEICAPKKGETVFVSAASGAVGQLVGQFARLAGCHVVGSAGSKEKVELLKTKFGFHDAFNYKEEPDLGAALKRCFPDGIDIYFENVGGAMLDAVLLNMRVHGRIAVCGFISQYNLADGEKDAVRNLAAVIAKRLRLQGFIEPDHKHLYPQYEAWVLPYIRDGTLAYVEDVAEGLENAPKALIGLFHGRNVGKQLVRVADDESAA

SEQ ID NO: 45580 - protein, 449 aa, Sorghum bicolor
  Clone ID: SORBI-28MAY03-C30792_1.pep
MSRSLVLARPPLLYPDDLDPPPASILVDPRGYIDDRTNATTAEGVTSKGKRIKVTFWIVNPPRCSCFTVYSPDLEKSAFGGIPMLLSTEDDLAMLRVPICRLGGDGVAWNNDHFVYHAGDENKPPSLDLIPRDPGRVFDENVGLLRCRAGDMYFIAILCWAYCVGKYELHLYSSKTETWSCKMMYLASLEQKLLYTYPSKVITIGGEHGSIGWVDLWRGILVCDVLKDSSELRYIPLPPPLVPRKLKGPPLYVRDIIVVEGYIKYFEMCSHIVGPEAWKAVTWERKDSWDEWKKDCVIEVPKYPAQTNPDQQEAETKTLPTLKGFYSGYPALSHHDSGVVYILDRHGLEDTDVTVLAVDMRKQTLKGVANCYSPRPLGYSSVYFGSGISKHLLSPRGNAATEPSKHKTLQFGNQGGPRKNVQSEMSSKKLMEHTASVEEDDAVVTKLTT

SEQ ID NO: 45581 - protein, 530 aa, Sorghum bicolor
  Clone ID: SORBI-28MAY03-C3233_1.pep
RAGLIFKFPGCKTLVVSRFKFPTLVKQTYEMQLLDEAAALSVFCRAAFDQESVPQTADKKLVRQVSAECRGLPLALKVIGASLRDQPPKIWLSAKNRLSRGEAISDSHETKLLERMAASVECLSEKVRDCFLDLGCFPEDKKIPLDVLINIWMEIHDLDEPDAFAILVELSNKNLLTLVNDAQNKAGDLYSSYHDYSVTQHDVLRDLALHMSGRDPLNKRRRLVMPRREETLPRDWQRNKDTPFEAQIVSIHTGEMKESDWFQMSFPKAEVLILNFASSLYYLPPFIATMQNLKALVLINYGTSSAALDNLSAFTTLNGLRSLWLEKIRLPPLPKTTIPLKNLHKISLVLCELNSSLRGSTMDLSMTFPRLSNLTIDHCIDLKELPSSICEISSLETISISNCHDLTELPYELGKLHCLSILRVYACPALWRLPASVCSLKRLKYLDISQCINLTDLPEELGHLTSLEKIDMRECSRLRSLPRSSSSLKSLGHVVCDEETALLWREAEQVIPDLRVQVAEECYNLDWLAD

SEQ ID NO: 45582 - protein, 237 aa, Sorghum bicolor
  Clone ID: SORBI-28MAY03-C2581_2.pep
TRRVTSPRAIRVAAAVADGEVVYRNKWPEDLPGFREALEEYTNALEELALKLLELLARSLKLRPDRLHGFFKEHTSFFRLNHYPPCPAPEVVLGVGRHKDPGALTVLYQDDVGGLDVRRRSDGEWVRVKCVPNSFVINVGDTVQVSSDDRYESAEHRVSVNSEKERFSMPYFFNPASGAIVEPLEEVVSEEKKPPRYSAYSWGDNFSAKLNGNFKWLDVDNLQIADFRKSYSSGDVP

SEQ ID NO: 45583 - protein, 173 aa, Sorghum bicolor
  Clone ID: SORBI-28MAY03-C2581_1.pep
TRLLTARHRSLTTTQQRDRHGRAHHGAGLRAGPRAPPQAHRHRGHRHPGHRPLASHPHRHRRGRGGRVGRRAGRVEPGLGLLRRVWRRHGYESAEHRDAGDSARLSFAVRAFFNPASDTMGEPVEELVSDDDPPRYDAYSWGEFFSTRKNSNFKKLSVENIQIAHFKKTLVLA

SEQ ID NO: 45584 - protein, 124 aa, Sorghum bicolor
  unsure (1)..(124): unsure at all Xaa locations
  Clone ID: LIB3478-028-P1-K1-H2.pep
ATGIPVTDVDALAAEVGAASRDWGFFVVVGHGLPAGTVARATAAHRAFFALSAXRKADVRRSEAEPLGHYESEHTKNVRDWKEVFDLFPRDPASSAVVADGVVVYMNKWPEDLPGFKVALEEFT

SEQ ID NO: 45585 - protein, 186 aa, Sorghum bicolor
  Clone ID: SORBI-28MAY03-C33339_1.pep
MADRDRSGIYGGTYGQHQQGGGRPMGEQVKGMIQDKGPTASQALTVATLFPLGGLLLVLSGLALAASVVGLALATPVFLLFSPVLVPAALLIGTAVTGFLTSGALGLGGLSSLTCLANTARQAFQRTPDYVEEARRRMAEAAAHAGQKTAQAGHAIQSRAQEAASGGAGAGGGTGAGTGGGGRASS

SEQ ID NO: 45586 - protein, 374 aa, Sorghum bicolor
  Clone ID: SORBI-28MAY03-C3557_1.pep
MGSYTTRVHAVEKAANNQDDETCMHALMLLGGLAVPCTIKAVIELGIMDLLLAADRAMTAEELTARLPCPAAATAAAMVDRMLRFLASHGVVRCAAATKESSELGSDGGKSCRRYAAAPVCRWFTRSGGVESVVPMGLWMTGKTVLETWYNIKEAVLEGETPFDRAYGQPFFEYLGENGTVNTLFDEAMANHSTIITKRLVEVFRGFENYSVLVDVGGNKGTTLQMIRSQYENISGINYDLPRVIAQAPPIEGVEHVGGNMFDNVPRGDAIILKWILHDWGDKDCVKILKNCYAALPVNGTMIILEYILPETPEETLTSQLAFNFDFGMMLMYGAKGKERTEKELSELAREAGFSGDCTATYIFASIWALEFTK

SEQ ID NO: 45587 - protein, 246 aa, Sorghum bicolor
  Clone ID: SORBI-28MAY03-C3521_1.pep
QPTRTQRRTPAAAAALPARDRTRLRPTPLPPLRLRATAPDPTLVSPASAGMASPTVAASSSRAGPTDILTAAPSPASPPRRLASAPPAVDASGSFSPDSAVDAPHFLFFSFLFCPGACLMWRGVWLCIARCSRAGARSTGFCSGCRLTRLFSQSLRLSRRRRSTPLTRPRGTASNPSGSAPTPRVCARPHPNLVSDLSPAPDDGHVRPASLEDHGHHNPRTLVHFVHNLALVCIFGRFVFRETGPV

SEQ ID NO: 45588 - protein, 51 aa, Sorghum bicolor
  Clone ID: LIB3481-024-P1-K1-B6.pep
QQITASMIMSGCQADNILNTKVGTEHQVRKLRHAHSNQIPRRQPDRTKIQI

SEQ ID NO: 45589 - protein, 398 aa, Sorghum bicolor
  Clone ID: SORBI-28MAY03-C69_1.pep
MTTGKVTLEAVRKAQRAEGPATVLAIGTATPANCVYQADYPDYYFRVTKSEHLTDLKEKFKRICHKSMIRKRYMHLTEDILEENPNMSSYWAPSLDARQDILIQEIPKLGAEAAEKALKEWGQPRSRITHLVFCTTSGVDMPGADYQLIKLLGLCPSVNRAMMYHQGCFAGGMVLRLAKDLAENNRGARVLIVCSEITVVTFRGPSESHLDSLVGQALFGDGAAAVIVGADPSEPAERPLFHLVSASQTILPDSEGAIEGHLREVGLTFHLQDRVPQLISMNIERLLEDAFAPLGISDWNSIFWVAHPGGPAILNMVEAKVGLDKARMCATRHILAEYGNMSSVCVLFILDEMRNRSAKDGHTTTGEGMEWGVLFGFGPGLTVETIVLHSVPITTVAA

SEQ ID NO: 45590 - protein, 118 aa, Sorghum bicolor
  Clone ID: SORBI-28MAY03-C5614_2.pep
WRTTFFSIATHAFSHGLRFYPLKTWTNLNDVPSQLCFRSGTAPLISSRTAAPRYSRSGAPLQHLESTHAGCSFVWPAAGRPGLEGRSSCRTQGPGRRTAEGRLRLCLCCASPRVSTPG

SEQ ID NO: 45591 - protein, 250 aa, Sorghum bicolor
  Clone ID: SORBI-28MAY03-C5614_1.pep
GDICTFFFDGIAKLIAAAGYAVDAMDYSGFGMSYGLHGYIASFDGMVDHVIEQYARIRGMKEVCELPHFLLGQSMGGAVALKVHLKQQKEWDGVLLVAPMCKISEDVTPPAPVLKALSILSCLLPEAKLFPQKDIRDLAFRDPRFRFLAEYNAISYSDQMRLRTAVELLKATKDIESQLEKISSPLLILHGAADMVTDPQVSKFLYEKASAKDKTLKLYEGSYHSILEGEPDERISTAISDIISWLDSHC

SEQ ID NO: 45592 - protein, 90 aa, Sorghum bicolor
  Clone ID: LIB3476-024-P1-K1-E3.pep
GFIHFKLGLAKKSIRQDQARVPCLSCFCKAATSLACRWDSRPPCGTPSIPVVRVMRNSMRNSPSLQIGPDPRMLEVGRHPSAFSVDHALS

SEQ ID NO: 45593 - protein, 266 aa, Sorghum bicolor
  Clone ID: SORBI-28MAY03-C699_1.pep
MASTVTAANSHGSVLRTHTAPSSRQLAGWSSRRTLAMPAHHAPSPRARVVAVRAAGTQRPTWLPGLDPPPHLDGTLPGDFGFDPLGLGEDPASLKWYVQAELVHCRFAMAGVAGILFTDLLRVSGNSDLPVWFEAGAAKFEFANTTALFFVQLLLMGFAETKRYMDFKNPGSQAEEGTFIGLEAALAGQQPGYPGGPLFNPLGLAKDIENAHEEKLKEIKNGRLAMVAMLGFMVQASVTHAGPIDNLLTHLSDPFNKNIIHAFSSS

SEQ ID NO: 45594 - protein, 266 aa, Sorghum bicolor
  Clone ID: SORBI-28MAY03-C40480_1.pep
MNRRSHSTRDRGQEKATGQATPIRIESRGAIGGGECDYSDAETKRTRPRLKPLLSTSFFVQCRIRADAHESECTMYCLDCMYGALRSLCLARHRDHHSFRIWTASYHAVIRVSEIQTVLDTAGVQPYIINTARVVFLNERPQPRPGKGVTNTCEVCERSLLDCFRFCSLGCKIVGTARGYRPKKKHGIGGGGHKKKRAALKVKDVRSDSEDSCTSTSGASSDKSSVVQSFSPSTPPPTSASHRRPGNKRRKGVPHRSPFGSLIVEF

SEQ ID NO: 45595 - protein, 114 aa, Sorghum bicolor
  Clone ID: SORBI-28MAY03-C4292_1.pep
MAATASLSAVAAPLSVAGLRKPLGASSFRPLQPRAAARMTAVRASSSVKEKAAAGLTAAALAAALVVPDVAEAAQSLTPSLKNFLLSIVSGGVVLVAIVGAVVAVSNFDPVKRA

SEQ ID NO: 45596 - protein, 92 aa, Sorghum bicolor
  Clone ID: SORBI-28MAY03-C44599_1.pep
MAHYQEVDYCSEEVKSVAAGGPAGFGRHHGGHGGVQQHVVKEKFEEVDSVSRAGGGRHGHFEARESKFEEDVNTRTGEFHERKENFVVKADN

SEQ ID NO: 45597 - protein, 119 aa, Sorghum bicolor
  Clone ID: SORBI-28MAY03-C4493_1.pep
MARSSFKLEHPLERRQAEANRIREKYPDRIPVIVEKAERSDIPDIDKKKYLVPADLTVGQFVYVVRKRIKLSAEKAIFIFVKNTLPPTAALMSAIYEENKDEDGFLYMTYSGENTFGLF

SEQ ID NO: 45598 - protein, 126 aa, Sorghum bicolor
  Clone ID: SORBI-28MAY03-C45318_1.pep
SSVEQLNLAGNRPVGQVPDALCKLAGPAGRLANLTLSSNYFTSVGPACAELIRDGVLDVKNNCIPGFANQRRPAECAAFQSQPKTCPAASTTQVTCPAAAAMDAAAPGERKVRDYSSYVTYATLHD

SEQ ID NO: 45599 - protein, 278 aa, Sorghum bicolor
  Clone ID: SORBI-28MAY03-C45331_1.pep
MFISSNAHEKHSLVVDKTVCFFLLIDQWPPSWLPWAPKAATPPMMSFPFPPTQAPAPSPAAAMVSNPWHSSITLPPQPPAAVVVPAGVGSKPVVAGGGAARPPHSGVSRPVYVIAAAGASLVAAMSVALFVLCYRSNKVVTVRPWATGLSGQLQKAFVTGVPSLKRSELEIACEDFSNVIGTLSDYMVYKGTLSTGVEIAVVSTTKNSAKEWSKHCESQFREITASPPGAAPPNVSPLRGAGLEVLPSAGIWALDGPPDGPLLVQLPARQVRYLDWPK

SEQ ID NO: 45600 - protein, 476 aa, Sorghum bicolor
  Clone ID: SORBI-28MAY03-C46218_1.pep
TRKKLGESLKKSVENGDMLSVLLDWRESLPHPDERVEYEFWTNSNDECGPKCDMQMDFVRSFRGTAQILEKKGYTQFTPHYITWYCPEAFVSSKQCKSQCINHGRYCAPDPEQDFSQGYDGRDVVVQNLHQICVFKIANETGKPWLWWDYVHDFALRCPMKDKKYNHDCASDVIKSLGLEMEKINKCIGDPEADVENEILKAEQDAQIGHGNRGDVTILPTLVINNRQYRGTLDKVAVMKAICSGFEETTEPAVCLSEEVQTNECLENNGGCWLDTANNVTACKDTFRGRVCECPIVRGVKFVGDGYTHCEASGIGRCEINNGGCWQETKDGKTISACSNEVSEGCKCPVGFKGDGEKSCEDIDECKDKLYCQCKGCSCKNTWGSYECSCGDDNMLYMREHDTCISKKGTTSTVGWSFLWVIFFGLVFAGVGAYAVYKYRLRSYMDSEIRAIMAQYMPLDNQEGANQHQVVHANDI

SEQ ID NO: 45601 - protein, 281 aa, Sorghum bicolor
  Clone ID: SORBI-28MAY03-C4785_1.pep
SRGTPRTRSALPRDGLNTSAVVVDGPAANSVKRKRKNQFRGIRRRPWGKWAAEIRDPRKGVRVWLGTFNSPEEAARAYDAEARRIRGKKAKVNFPDEGSTIPQKHRAGPTPLKVPEMDFEEKPIIKPAVNNMTNSNAYHYPVVDHNIPEPFMHTQNMSFAPFVNSAAPIQEPFVNLSSDQGSNSFSCSDFSLENDTRTPDITSVVVGESAFVQNTGPAVVPPLMGNASVDLTELDPYMNFLMDSGSEDSINTLLSCDGSQDVVSNMDLWSFDDMPMSAGFY

SEQ ID NO: 45602 - protein, 428 aa, Sorghum bicolor
  Clone ID: SORBI-28MAY03-C28857_1.pep
MMLEGKSYLVSRSLPSSCEPETEWAYLAHEVLSGKRPTPEDVEVEDLDEADGGGKRSKPPSPQPHTPDICEGHGSSRHASGCGEQQGTGSNPMNSIGRDLTINCLLRLSRSDYGSVASLSRDFRAMVRSGEIYRLRRQSGVAEHWVYFSCNVLEWDAYDPYRERWIQVPKMPPDECFMCSDKESLAVGTQLLVFAMAHIVFRYSILTNSWTMADPMNSPRCLFGSTSVGEKAFVAGGTDSGGNILSSAEMYDSETHTWTPLPSMNRARKMCSGVFMDGKFYVIGGVANNNRVLTCGEEYDLKRRSWRIIENMSEGLNGVTGAPPLIAVVNNELYAADYSEKDLKKYDKKNNRWITLGKLPERSVSMNGWGLAFRACGDRLIVIGGPRTYTGGTIELNSWIPDERPPVWNLIARRPSGNFVYNCAVMGC

SEQ ID NO: 45603 - protein, 234 aa, Sorghum bicolor
  unsure (1)..(234): unsure at all Xaa locations
  Clone ID: SORBI-28MAY03-C82834_1.pep
MATTKLAALCFIVLLGIGGANAARVARYVSAGGGGGGGGGGRGRWRGGASRWGSGSGSGCGXYGEAGGSGXAYAQGGGQGGGGGGGQYGGSGSGYGSGSGYGQAGGSGSNGGAYAQGGAQGGGGGGGQYGGSGSGYGSGSGYGQASGYGPYGGGYAQGGGQGGGGGGGQNGGSGQGSGSGSGYGQAGGYGPYGGGYAQAGGQGGGGGGGQSGQNGIGYGSGSGSGSGSAGSGYP

SEQ ID NO: 45604 - protein, 230 aa, Sorghum bicolor
  Clone ID: SORBI-28MAY03-C851_1.pep
MNDTDVAKQIQQMVRFIRQEADEKANEISVSAEEEFNIEKLQLVEAEKKKIRQEYERKEKQVEVRKKIEYSMQLNASRIKVLQAQDDLVNKMKDDAMKELLLVSHNHHEYKNLLKDLIVQGLLRLKEPAVLLRCRKEDHHHVESVLHSAKHEYASKADVHEPEIIVDHVVYLPPAPSHHDAHGQFCSGGVVLASRDGKIVFESTLDARLEVVFRKKLPEIRKLLFGQTAA

SEQ ID NO: 45605 - protein, 349 aa, Sorghum bicolor
  Clone ID: SORBI-28MAY03-C8592_1.pep
MAPELAGKMTAKAAAAAAAAAVTKPATRAYVTFLAGDGDYWKGVVGLAKGLRKARSAYPLVVAVLPDVPESHRRILVSQGCIVREIEPVYPPENQTQFAMAYYVINYSKLRIWEFVEYERMVYLDADIQVFENVDELFELEKGYFYAVMDCFCEKTWSHTPQYKIGYCQQCPDKVAWPATAELGPPPALYFNAGMFVHEPSMATAKALLDTLRVTPPTPFAEQDFLNMFFRDQYRPIPNVYNLVLAMLWRHPENVQLEKVKAVHYCAAGSKPWRFTGKEPNMDREDIKMLVKKWWDIYNDETLDFKGLLPLSPADADADDEVEAVAKKPLRAALAEAGTVKYVTAPSAA

SEQ ID NO: 45606 - protein, 184 aa, Sorghum bicolor
  unsure (1)..(184): unsure at all Xaa locations
  Clone ID: SORBI-28MAY03-C14469_2.pep
FTETHSASGTKEFQVYHKSSREKGKEVVLNNTSPKRIFTDIRAENGAASKVVTPLSTPAASSQREVDQPEPTMMLLMGMKMSLTKKPTNPMTTKPIAVRAATLVNSLRSGLWQRLTRRMLSLANSRSGSTTESTASIAAARGGGEAERSRGAGALRLLGDDDAGGGFARALPSARXPAFEAAAT

SEQ ID NO: 45607 - protein, 69 aa, Sorghum bicolor
  Clone ID: SORBI-28MAY03-C14469_1.pep
MDAIDSVVDPLRDFAKDSVRLVKRCHKPDRKEFTKVAARTAIGFVVMGFVGFFVKLIFIPINNIIVGSG

SEQ ID NO: 45608 - protein, 91 aa, Sorghum bicolor
  Clone ID: LIB5052-005-A1-XP1-E2.pep
FTETHSASGTKEFQVYHKSSREKGKEVVLNNTSPKRIFTDIRAENGAASKVVTPLSTPAASSQREVDQPEPTMMLLMGMKMSLTKKQARPA

SEQ ID NO: 45609 - protein, 133 aa, Sorghum bicolor
  Clone ID: SORBI-28MAY03-C114_1.pep
MRKHRIVPLVAALLVLLALAVSSTRNRNAQEGEESMALAGGIKDVPANENDLHLQELARFAVEEHNKKANALLGYEKLVKAKTQVVAGTMYYLTVEVKDGEVKKLYEAKVWEKPWENFKELQEFKPVEEGASA

SEQ ID NO: 45610 - protein, 48 aa, Sorghum bicolor
  Clone ID: LIB3481-051-Q6-K1-E10.pep
TPPLFFFFFFFFFFFFFFFFFFFFFFFFFFFFFFPPPLFFFFFFFFFF

SEQ ID NO: 45611 - protein, 502 aa, Sorghum bicolor
  Clone ID: SORBI-28MAY03-C2027_1.pep
MANIDMAKILADLDRGAGDARVPKTKLVCTLGPASRTVPMLEKLLRAGMNVARFNFSHGTHEYHQETLDNLRQAMHNTGILCAVMLDTKGPEIRTGFLKDGKPIKLTKGQEITVTTDYDIKGDENMIAMSYKKLPVDVKPGNVILCADGTISLAVLSCDPDAGTVRWRCVNPPGLGVGLPTLTDKDKEDILKWGVPNKIDMIALSFVRKGSDLVEVRKVLGEHAKSIMLMSKVENQEGVANFDDILANSDAFMVARGDLGMEIPIEKIFFAQKVMIFKCNIQGKPVVTATQMLESMIKSPRPTRAEATDVANAVLDGTGPVMLSGETAAGAYPELAVQTMAKICLQAESCVDHASVFKSIMASAPIPMSPLESLASSAVRTANSAKAALILVLTRGGTTARLVAKYRPSMPILSVVVPELKTDSFDWTCSDEGPARHSLIVRGVIPMLSAGTAKAFDNEATEEALGFAIENAKAMGLCNTGESVVALHRIGTASVIKLLTVN

SEQ ID NO: 45612 - protein, 314 aa, Sorghum bicolor
  unsure (1)..(314): unsure at all Xaa locations
  Clone ID: SORBI-28MAY03-C20648_1.pep
MSHPPPPPVDQNISLRFCESFSLQGTETPGAFTPPAPAFPSRPRTGATTRLLLETFHSSMAKLVNKLVDSFEEQDTPDVGCVRAVLAELVLTFLFVFTGVSAAMAAGSGVKPGEAMPMATLAAVAIAHALAAGVLVTAGFHVSGGHLNPAVTVGLMVRGHITKLRAVLYVAAQVLASSLACILLRYLSGGMVTPVHALGAGISPMQGLVLAMXHNFCLCFISYAMMLDPRRQVRTIGPLLTGLIVGANSLAGGNFSGASMNPARSFGPALASGVWTNHWIYWIGPLLGGPLAGFIYESLFIVNKTHEPLLNGDI

SEQ ID NO: 45613 - protein, 219 aa, Sorghum bicolor
  Clone ID: SORBI-28MAY03-C26614_1.pep
MAVKDCGGHKGCECERERLYRRCCAALVAFILLVLFVILVVWLVLRPHKPKFYLQDLSVLCLNVTPPASTYLFTTMQATVAARNVNDRVGVYYDQADAYAEYKGVAITVPTRLPVQYQGPNDASVWSPFLRSLDSVQLPPQLAVALAQDETAGYVLIDVRVDGWVRWKVGTWISGHYHLRVNCPALLTVNEGKGSYGANTGGGTGYFRFQQAAACAVDV

SEQ ID NO: 45614 - protein, 185 aa, Sorghum bicolor
  Clone ID: SORBI-28MAY03-C2821_1.pep
MPPAPKSGDALFASVDRVNAELFTLTYGAIVRQLLTDLEEVEEVNKQLDQMGYNIGTRLVDEFLAKSNVSRCVDFKETADVIAKLGFKMFLGVTATVTNWDAEGTSCSLVLEDNPLVDFVELPDTCQGLQYCNLLSGVIRGALEMVSMKTEVTWVRDMLRGDDAYEMRVKLIKQVPEEYPYKDDD

SEQ ID NO: 45615 - protein, 203 aa, Sorghum bicolor
  Clone ID: SORBI-28MAY03-C29618_1.pep
ARGANSNLPRRIIKETQRLLSEPAPGISASPSEENMRYFNVMILGPSQSPYEGGVFKRELFLPEEYPMAPPKVRFLTSPSDENMRYFNVTILGPSLSPYEGGVFTLALFLPEEYPMAPPKVRFLTKIYHPNIDKLGRICLDILKDKWSPALQIRTVLLSIQALLSAPNPDDPLADNVAKHWKANEAEAVETAKEWTRVYASGA

SEQ ID NO: 45616 - protein, 120 aa, Sorghum bicolor
  Clone ID: SORBI-28MAY03-C3442_1.pep
MAKTSSFKLEHPLEKRQSEANRIREKYPDRIPVIVEKAERSDIPDIDKKKYLVPADLTVGQFVYVVRKRIKLSAEKAIFIFVKNTLPPTAALMSSIYEENKDEDGFLYMTYSGENTFGLL

SEQ ID NO: 45617 - protein, 277 aa, Sorghum bicolor
  Clone ID: SORBI-28MAY03-C12516_1.pep
MSAVVCGKRSSIFGDDLVASPSSPPSPSHHHHPAKRARCSPSRRREVLLHHHLLPLFPDMDPQLLEKALEASGDDLDSAIKRLNELRLESAGAMLSGTLCESENGMSSALKLSAEGTASNGHLDVATENPPATDNSQASHHSSEWVELFVKEMMSSSDIDDARARASRALEVFEKSIMDRVGAEAVQNLHRENVMLKEQLAIILRENAVLKRGVAIQHERQKDFDMRTQEVDSLKQLVLQYQEQLKTLEINNYALRVHLKQAQQNNSMPGRFPPDVF

SEQ ID NO: 45618 - protein, 386 aa, Sorghum bicolor
  Clone ID: SORBI-28MAY03-C11535_1.pep
MERSNSSWFGWWRKKAREGQGGGRRRDREKVVVDGTEIRELVEDREAFGMLVDSKFRQLDADGHGMLSVSELRPAVEDIGAALGLPAEGASPNTDHVYAEVVSELTHGTSQGEVSKAEFQEALSDILLGMAAGLKRDPLVILRMDGEDLRDFVAGSRYEPTAAAVFSKVGFGSEEDASSLRQCVLAALQKLTVDHGVPPASDTWVAKNIVEPALQQLPADQLEQQPASRDDLFQQLKKLLCAIADRLQEQPVIVAHTENHYDGSGVKRLLANKFELDKLLDSVWKGLPVEHKNKASKEYLIAALDKMADAASLPYYGAVKEVDAVVDESIKTAGVEEGKAADEAEFKKSLTDILRAIMLRLNDKPVFVSTNIVVHEPLSGSSTLLK

SEQ ID NO: 45619 - protein, 101 aa, Sorghum bicolor
  Clone ID: LIB3478-030-P1-K1-F3.pep
FGSEEDASSLRQCVLAALQKLTVAHTENHYDGSGVKRLLANKFELDKLLDSVWKGLPVEHKNKASKEYLIAALDKMADAASLPYYGACKEVDAVVDESIKT

SEQ ID NO: 45620 - protein, 473 aa, Sorghum bicolor
  Clone ID: SORBI-28MAY03-C7104_1.pep
MVLPTQQQVVEAGYVQPHFSAGDMAVPMSAQVAAAVTPGRTLLQRRPLTVSVIHNEAFEKEKRTPKANQLYQNSEFLLAKDRIPPADSHGRKKSKHHKKKHRSLESRGADFDAERRLYSHAFKKSSSLLSRLMKHKFGWVFNKPVDPVALGLHDTRTIIKHPMDLGTIRGRLSHGQYRNPKEFAEDVRLTFHNAMTYNPKGQDVHFMAEQLSGIFEAQWPEIEAEVNYLASCPPLPKKFPPPPIDLRFLERSDSMRHHMALDTNSRPISHTPTYTRTPSMKKPRAKDPNKRDMTIDEKRKLSENLQNLPPEKLDAVVQVIKNKNLSVMQHDDEIEVEIDSMDAETLWELDRFVANYKKNLSKQKRKAERAMLARQDAELRAQHQHQHQHPIQPPQPISATQEPVGEKSPKQAAKDSLAGKQPPTSAPEQNEENRQNASSSSNSSSSSSDSGSSSSDSDSDSSSSDGSDAGNSS

SEQ ID NO: 45621 - protein, 108 aa, Sorghum bicolor
  Clone ID: SORBI-28MAY03-C744_1.pep
MVAPVVIASAGLGMLAGVAMANRSLGGDGLPAASRWDARPRCATCGGSGRVECMCNRWSDGDSGCRTCAGSGRMPCRSCGGSGTGRPLPARLIVQHQKPPPPPPARHN

SEQ ID NO: 45622 - protein, 177 aa, Sorghum bicolor
  Clone ID: SORBI-28MAY03-C7931_1.pep
MYRAAAAAISRSSSVLRRQLPRGADGEPPRLLARGYASTAKEVSFGGGAVALLYATKELDKISTSNEDEKIGVQIIKNSLKAPLMTIAANAGIDGAIVIGKLIEQEDLSLGYDAAKGEYVDMIKAGIIDPVKVIRTALQDAASVSLLMTTTEAAVSELPATKARIASRMPQMSGMDF

SEQ ID NO: 45623 - protein, 148 aa, Sorghum bicolor
  Clone ID: SORBI-28MAY03-C7738_1.pep
MTPGSSAAGSGVVVPRNFRLLEELERGEKGIGDGTVSYGMDDADDIYMRSWTGTIIGPHNTVHEGRIYQLKLFCDKDYPEKPPSVRFHSRINLTCVNHETGVVDPKKFSVLGNWQREYTMEYILTHLKKEMASPQNRKLVQPPEGTFF

SEQ ID NO: 45624 - protein, 433 aa, Sorghum bicolor
  Clone ID: SORBI-28MAY03-C7979_1.pep
TSPEPACIQVHKHNTHTYTSLVVVGSVTVSMAVLCSSSCCSRPLLQGMLLLAVLLLASIQAGPVMAALDAQEVQAFGDMFHKAFDYGGKKLATEVSRRPGMERFGKGLKTGFTVDRRAHGMMDKHQNTGMPYVVDTIATATGLRLKVVTVDITATPVARTGLCGTGTAVAAGGTGTQIIRLLGSSEGEAVLLARPFAGTLQYCAGPQGAVLGLGRGGELSRNLRTFSYVTSTGNTVVWFPQPQVAGTTGASSITLVPSKYPNDGRYYVRMTGIRVGDQQPIVPTSTAFNLGRPPPPPLYLYLSTTQPNTYIESNLYDRLRNAIIQQMGNPWATPTSSSQLTAGKLCYAAAAASSLPRIAILLANNNGDTTMELGLSGAAAWYPEPTTSRFCLGILPATTEEPVLGSMIQSGNIMTIDLMAAGGQGTLTFEAYR

SEQ ID NO: 45625 - protein, 225 aa, Sorghum bicolor
  Clone ID: SORBI-28MAY03-C7914_1.pep
MAAGLQVFGQPASTDVARVLTCLFEKNLEFELIRTDTFKKSHKLPEFIKLRDPTGQVTFKHGDKTIVDSRAICRYLCTQFPDDGYKKLYGTGSLERASIEQWLQAEAQSFDAPSSELVFQLAFAPHLKDVRVDEARVAENEKKLHNMLSVYDDILSKNEYLAGDDFTLADLSHLPNSHYIVNSSDKGKKLFTARKHVARWYDKISSRDSWKQVIKMQREHPGAFE

SEQ ID NO: 45626 - protein, 143 aa, Sorghum bicolor
  Clone ID: SORBI-28MAY03-C81929_1.pep
GKASCGFIRGNDDFSRRLAANCSAGRTGKQSLDVITPDAFDNRYFVALRSTQGVLLSDQGLAGDRRTARFVTAFASNQAAFFNQFAKSMVKLGSIKAAAAGEIRRNCFRPNGRVSFDDVSALTLTGDDAAAVASSDEGFAASA

SEQ ID NO: 45627 - protein, 174 aa, Sorghum bicolor
  Clone ID: SORBI-28MAY03-C8320_1.pep
PANVKVHYETTGPEIWEDTLGQVDIFVMGIGSGGTVTGVGKYLKEKNPNAKIYGVEPAEANVLNGGKPGPHLITGNGVGFKPDILDMDVMEKVLEVKGEDAVKMARELALKEGLLVGISSGANTVAALELAKKPENKGKLIVTVLPSLGERYLSSALFDELRKEAEAMEPVPVD

SEQ ID NO: 45628 - protein, 217 aa, Sorghum bicolor
  Clone ID: SORBI-28MAY03-C2191_1.pep
TRLLWYGYDRKNGVHSLCPAIWSKARGGSVCPTFGGSDPGGPAVVLHSPNGQLTVVAGLACSPRPSPPSAGGLLQAHGKYPGETRVSFSCKNKRGTRFAPMFQWPDKSVSLGVTQPLAWKRSGLMVRPSIQVSVCPTFGGSDPGVRAEVVHSLKEELNVMCGLSCSRHPSAYTALSIGRSKWNGQVGSSGVVITLETPLNNIGRPSLSVQLNGGFEL

SEQ ID NO: 45629 - protein, 92 aa, Sorghum bicolor
  Clone ID: LIB3481-004-Q6-K1-H1.pep
HPCSRCAVGSVCPSFGGSDPGVRAEVVHSLKEELNVMCGLSCSRHPSAYTALSIGRSKWNGQVGSSGVVITLETPLNNIGRPSLSVQLNGGF

SEQ ID NO: 45630 - protein, 256 aa, Sorghum bicolor
  Clone ID: SORBI-28MAY03-C18685_1.pep
MDEWIRQAEVWVRQAESWIRQQPPEQIYVAAAVVAVTILVLIVASCLKSSKLNTIVLSGLSGSGKTTLFYQLRDGSSHQGTVTSMEENSDTFVLHSEQEKKGKVKPVHIVDVPGHARLKPKLDEVLPKAAGVVFVVDAQDFLSSMQAAAEYLYDILTKATVVKKKVPVLIFCNKTDKVTAHSKEFIKKQLEKELNKLRESRTAISSADISDEVQLGVPGEAFNFSQCQNKVAVAEGAGSAGNVLAVEQFIREHVKA

SEQ ID NO: 45631 - protein, 133 aa, Sorghum bicolor
  unsure (1)..(133): unsure at all Xaa locations
  Clone ID: LIB5049-001-R1-XP1-G8.pep
MDEWVRQAEVWVRQAESWIRQQPPEQIYIAAVVVALTILLLILASCLKSSKLNTIVLSGLSGSGKTTIFYQLRDGSSHQGTVTSMEENNDTFVLHSEQERKGKVKPVHVVDVPGHSRLKXKLDEVLPKAAGVV

SEQ ID NO: 45632 - protein, 96 aa, Sorghum bicolor
  Clone ID: LIB5052-009-A1-XP1-H5.pep
GKTCIASMWLPFMHIYLRSGPRTLLSLEVQSYSAALLQLTLVIVIEAGITCCIVDAWQSSDMNRSILLKVVSAGHGPMVLLHKKKKKKEKKKKKGP

SEQ ID NO: 45633 - protein, 259 aa, Sorghum bicolor
  Clone ID: SORBI-28MAY03-C228_1.pep
LPLLFRPKEMVKNGEFIYKFDPTKKARFGILPRYAKDEKVIRWFELPNCFIFHNANAWEEGDEVVLITCRLENPDLDKVNGHQSDKLENFGNELYEMRFNMKTGAASQKQLSVSAVDFPRVNESYTGRKQRFVYCTILDSIAKVTGIIKFDLHAEPESGKKELEVGGNIQGIYDLGPGRFGSEAIFVPKQPGVSGEEDDGYLIFFVHDENTGKSEVNVIDAKTMSADPVAVVELPNRVPYGFHAFFVTEDQLAQQAEGQ

SEQ ID NO: 45634 - protein, 92 aa, Sorghum bicolor
  Clone ID: SORBI-28MAY03-C823_1.pep
MEKCRSVPHEHSSAYYGCGGGYDYEDVGGGPGQAGKSYSFNGPSGRDDPEAKRRRRVAAYNVFATQGRIKTTVRSSVKWLKSKFSDIRYGGL

SEQ ID NO: 45635 - protein, 105 aa, Sorghum bicolor
  Clone ID: LIB3478-056-Q6-K1-E12.pep
NPTVDGIRSVIQFISTSKGGRRVLLHNMREEPVIYINGKPFVLREVERPCKNMLEYTGIDRARVERMEARLKEDILREAERYGGAIMVIHETDNGEIFDIRYGGL

SEQ ID NO: 45636 - protein, 192 aa, Sorghum bicolor
  Clone ID: SORBI-28MAY03-C9551_1.pep
MPGYYDIDDILMEDEPISVVFQVTANGVGLLDPGAESNCVEKGAKVDLPFWLAHGLLSLEQAVSINPPPCFTQKTRKEIQADAACVDLRVRCPYFYELGFKIVPLVSDKSIGLFLRYAFTSRYKEVLSKSHSSSMMTVPKFVPRLTKEETRVFESARESMAGFKKWRAGGVRLQKASILGRKRKTKLPDGPP

SEQ ID NO: 45637 - protein, 260 aa, Sorghum bicolor
  Clone ID: SORBI-28MAY03-C9620_1.pep
MACSFAAATTVSSAPTPASRPLAAAPQSVSVARSAVATAARPLRLAASRSARATRLVARAGGVDDLPLVGNKAPDFEAEAVFDQEFINVKLSDYIGKKYVILFFYPLDFTFVCPTEITAFSDRYEEFEKLNTEVLGVSIDSVFSHLAWVQTDRKSGGLGDLKYPLISDVTKSISKAFGVLIPSQGIALRGLFIIDKEGVIQHSTINNLAIGRSVDETMRTLQALQYVQENPDEVCPAGWKPGEKSMKPDPKGSKEYFAAI

SEQ ID NO: 45638 - protein, 142 aa, Sorghum bicolor
  Clone ID: SORBI-28MAY03-C933_1.pep
MADEDYNDVNMGYEDEPEPPEIEEGDEEELENNEDAPDEIIGGEGEEKEQEKTKRERKTSKYMTKYERARILGTRALQISMNAPVMVELEGETDPLEIAMKELRARKIPFTIRRYLPDGSYEDWGVDELIVEDSWKRQVGGD

SEQ ID NO: 45639 - protein, 127 aa, Sorghum bicolor
  Clone ID: LIB5051-010-A1-XP1-E2.pep
RPGWDYNDVNMRYEDEPEPPEIEEGDEEELENNEHAPDEIIGGEGEQKEQEKTKRERKTSKYMTNMNAPVMVELEGETDPLDIAMKELRARKIPFTITRHLPDGSYEDWGVDELIVYDSWKRQTGEY

SEQ ID NO: 45640 - protein, 171 aa, Sorghum bicolor
  Clone ID: SORBI-28MAY03-C8736_1.pep
MGSQAIEAHRAGAEVYTGAALCAEKSTELLSEVHLPLGLLPLADMEEVGYNRATGFVWLRQKKALTHTFRQIGRQVSYAAEVTAFVEDRRMKRMTGVKTKELLIWVTLSDMFLDKDDQSKITFKTPTGLGRTFPVSAFAKEGDAAAKPKDASAAANGNKEAVAAGKAAASK

SEQ ID NO: 45641 - protein, 248 aa, Sorghum bicolor
  Clone ID: SORBI-28MAY03-C11168_1.pep
PHELCTVAAATPLRQRRNHSLLQLTREQGYARGFFSPRSVTGFLSDVYSAAADEVGKIYLIADENVQGAVFDLPEEISKDLLAMELPPGNTLMKISKLPALQDDGPATDSYGRFSNDRGSRNRRSRGGGAARGRGGWDTDGEDRSRGGGAARGRGGWDTDSEDRFRRGGRSFRSDNDSWSDDDWSSGGRKSNRSSSFGSRSSSYGSRGSPSFGGRSSSFGGRESNRSFSGACFNCGESGHRASDCPNK

SEQ ID NO: 45642 - protein, 490 aa, Sorghum bicolor
  Clone ID: SORBI-28MAY03-C1178_1.pep
MSTASGDGADAGGDGASSAAAGASAPAGRRIPPASSMPWVRNLRRFVGTGAGLGSEALMELETKRILLEIFKERQRKSAEAGSIPSFYKKKPEEGSISSRVQRLAKYRFLKKQSELLLNADDLDAMWVCLRENCVIDDATGAEKMNYEDFCHIATVCTEQIGQKCKRFFSPSNFMKFEKDDSGRIAILPFYLYVMRTVSLTQARIDMSELDEDSDGFLQPHEMEAYIRGLIPNLAQLRDMPTAFVQMYCRIAARKFFFFCDPHRRGKACIKKVLLSNCLQELMELHQESEEEVTDTEQAENWFSLTSAQRICDMFLALDKDTNGTLSKQELKEYADGTLTEIFIERVFDEHVRRSKVGGGNSREMDFESFLDFVLALENKDTPEGLTYLFRCLDLNGRGFLTTADIHTLFRDVHQKWIEGGNYELCIEDVRDEIWDMVKPADPLRISLPDLLSCKQGGTIASMLIDVRGFWAHDNRENLLQEEEEQVEEA

SEQ ID NO: 45643 - protein, 398 aa, Sorghum bicolor
  Clone ID: SORBI-28MAY03-C11236_1.pep
MKELARICRRRRWWWRRMADVQGDKEAGLEDDDFPDDGPLVPEDPGEGGEPRSGGDEEEEDDVDGLASFLESEILSGSNDEDPIDQEQRKQEEDGGAAKNKRKQGSGSDGHGCSGSGSEGEQTKRARREDPAGQGKGKAVAPQIDAGVFSNIPPELFLQIFKFLSSEDLISCALVCRFMNAAASDETLWRRLYCMRWGLAAKAKKGASAWPHLSIPSEREATVASVRSAPTAFKGCGRPARAARRRHTAEASEVNDDQVMLGKTEAAQVPRRKSSGGLTEEADTGPASSGNTCSYTQIGDAYICEKTGRVHVCDDACREFVLDQSSGLLLCTISGHCFERWLCPDDEWEADDNRVDLQQAGVVDEAEPFMGSGRYARAIMLGYNCTDEKELEDALGLC

SEQ ID NO: 45644 - protein, 67 aa, Sorghum bicolor
  Clone ID: SORBI-28MAY03-C3439_1.pep
YRDFRLSSNDSFGSRWRRVFCSVRDSEELRRGTLEQLEKARIRLRKVGLEAPVYRSNGLAVVDRESD

SEQ ID NO: 45645 - protein, 142 aa, Sorghum bicolor
  Clone ID: SORBI-28MAY03-C3684_1.pep
MATSTAAVLSPPSVAGLRLAPSPRRAARVAFRAAPARRSVAARAELSASLVISLSTGVSLFLGRFVFFNFQRENVAKQVPAQNGKTHFDAGDERAKEFAALLKSNDPVGFNLVDVLAWGSLGHIVAYYILATSSNGYDPNFF

SEQ ID NO: 45646 - protein, 118 aa, Sorghum bicolor
  Clone ID: SORBI-28MAY03-C3424_1.pep
LRCRMAPYGPPPSHYPRPRARGPIDALHRCTNTPDSPPRAQNPSLALSIALEPPPWTTGGNLMFPRGLIAETVTQRHCGTDYAPEESDPQWVASEFVDPSGFAELSDFPSGQGADLVC

SEQ ID NO: 45647 - protein, 123 aa, Sorghum bicolor
  Clone ID: LIB3481-023-P1-K1-A12.pep
SEPRCSLPLLRSILEHRLSQLTLSSLVGLGHEPVSRHRAPPWPPWEPAHMARRPQTFSGQAADTSASARASGCSPTLSLAANKRPPAGNQVFSDILCSGIATRDFARQFEVLQGSNCTDCDSV

SEQ ID NO: 45648 - protein, 246 aa, Sorghum bicolor
  Clone ID: SORBI-28MAY03-C1256_1.pep
MSRGTGAGYDRHITIFSPEGRLYQVEYAFKAVKSAGVTSIGVRGADSVCVVTQKKVPDKLLDQTSVTHLFPITKFVGLLATGLTADARSLVSQARNEAAEFRFKWGYEMPVDVLAKWIADKAQVYTQHAYMRPLGVVAMVLGYDEEKNAQLFKCDPAGHFFGHKATSAGLKEQEAINFLEKKMKDDPKFTYDETVQIAISALQSVLQEDFKATEIEVGVVRKEDRVFRALTTEEIDQHLTAISERD

SEQ ID NO: 45649 - protein, 302 aa, Sorghum bicolor
  Clone ID: SORBI-28MAY03-C13586_1.pep
ARGLEAAVFSDGSFCYVPKDTVCPMEISTYFRINDKETGQFERTLIVADERSTVSYLEGCTAPAYDSNQLHAAVVELVCEEGAEIKYSTVQNWYSGDEEGKGGIYNFVTKRGRCKGRGSKISWTQVETGSAITWKYPSVELVGDDSVGEFYSVALTKDCQQADTGTKMIHKGKNSRSRIISKGISAGKSRNCYRGLVLMNSSAENAYNSSQCDSLLIGDNAAANTYPTIQVGCTSGRVEHEASTSKIGEDQLFYFQQRGVDHEKAVAAMIGGFCRSVFEHLPYEFAQEVDALMNLKLEGSVG

SEQ ID NO: 45650 - protein, 816 aa, Sorghum bicolor
  Clone ID: SORBI-28MAY03-C13066_1.pep
TRQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADILLFAAHRWTMSKPSLVSESKDLFDQKASNKYWIDVQLRWGDYDSHDIERYTRAKFMDYTTDNMSIYPSPTGVMIGIDLAYNLHSAFGNWFPGSKPLLQQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQRVVTRKGMLDPLEVHLLDGPNIVIKGSELQLPFQACLKIEKFGDLILKATEPQMVLYNIYDDWLKSISSYTAFSRIVLILRALHVNNEKAKMLLKPDKTIVTEPHHIWPSLNDEQWLKVECALRDLILSDYAKKNNVNTSALTQSEMRDIILGAEIAPPSQQRQQIAEIEKQSRETTQLTAVTTRTTNVHGDELIITTTSPYEQQAFASKTDWRVRAISATNLYLRVNHIYVNSDDIKETGYTYIMPKNILKKFICIADLRTQIAGFLYGLSPQDNPQVKEIRCIAIPPQHGTHQMVTLPTNLPEHEFLNDLEPLGWMHTQPNEAPQLSPQDLTSHAKILENNKQWDGEKCIILTCSFTPGSCSLTAYKLTPSGYEWGRSNKDNGSNPHGYLPTHYEKVQMLLSDRFLGFYMIPDNAPWNFNFMGVKHDPQMKYNMKLGMPRDFYHEDHRPTHFLEFSNIEEGEVAEGDREDTFT

SEQ ID NO: 45651 - protein, 642 aa, Sorghum bicolor
  Clone ID: SORBI-28MAY03-C1583_1.pep
KLKNAELQAKKDQLRIWTGFKPPVTNSKPIHDQKFTGKVVEVVSGDCIIVADDAAPYGSPSAERRVNLSSIRAPKLGNARTDVKPEPFGRESKEFLRTRLIGKQVAVEMEYSRRISTVDGQSAAPTANMADTRVLDYGSVFLGSPSQTDGDDISSAPSSASQPGVNVAELLLSRGFAKTSKHRDYEERSHYYDALLAAESRAEKAKKGVHSLKESPVMHITDLTTVSAKKAKDFLPFLQRNRRHSAIVEYVFSGHRFKLTIPKETCSIAFSLSGVRCPGKGEPYSDEAIALMRRRILQRDVEIEVEAVDRTGTFIGSLWESKTNMGSVLLEAGLAKLSSFGLDRISDAYVLQRAEQSAKQQKIKIWENYVEGENASNGSTPESKQKEILKVVVTEVLGGGKFYVQTVGDQRVASIQQQLASLKLKDAPVIGAFNPVKGEIVLAQFSLDNSWNRAMIVNGPRSVESPNDKFEVFYIDYGNQEVVTYSRLRPVDPSVSSSPALAQLCSLAFIKVPSLEDDFGQEAAEYLSECLLSSSKQYRAMIEERDASGGKSKGQGTGNVLIVTLVDAETESSINATMLEEGLARLERSKRWDTRERKTALQNLEQFQEKAKKERLRIWQYGDVESDEEEQAPAARKPGGRR

SEQ ID NO: 45652 - protein, 426 aa, Sorghum bicolor
  unsure (1)..(426): unsure at all Xaa locations
  Clone ID: SORBI-28MAY03-C13933_1.pep
MARAPSWSSPLVLVLIIVATAVAAVTASEAIRVPAVGNWTEELRGAATTRRARQRHGWRSRRRTFENGLGRTPQMGWNSWNHFGCGINENLIKQTADALVNTGLAKLGYEYVNIDDCWAESDRDYQGNFVAHRQNFPSGIKALADYVHAKGLKLGIYSDAGTRTCSQKMPGSLDHEEQDVKTFSSWGIDYLKYDNCNDAGRSVMERYTKMSNAMKTYGKNIFFSLCEWGRENPATWAGSMGNSWRTTDDIADNWGSMTSSADQNDRWASYAGPXRWNDPDMLEVGNGGMSEAEYRSHFSIWALAKAPLLIGCDVRSMSQQTKDILSNSEVIAVNQDSLGVQGKKVQSNNGLEVWAGPLSNNRKAVVLWNRQGYQATITAQWSSIGLASSTAVTARDLWAHSSFSAQGQLSASVAPHDCKMYVLTPN

SEQ ID NO: 45653 - protein, 287 aa, Sorghum bicolor
  Clone ID: SORBI-28MAY03-C2200_1.pep
MASPDLLFNLRNLFYLGAYQAAINNSDVPGLDADAAAERDAIVFRSYIALGSYQLVISEIDSSAATSLQAVKLLALYLTGDKEGAISSLKEWLSDSAIGSNPVLRLIAGIIFMHEQDYNEALKHTHSGGTLDLHALNVQIFIKMHRSDYAEKQLKIMQQIDEDHTLTQLANAWLGIAVGGSKIREAYLIFQDFAEKYPMTGMVLNGKAVCCMHMGSFEEAETLLLEALNKDAKDPETLANLIVCNLHLGKPSSRFLSQLKLSHPDHVLVKNAASSEATFERALQAVA

SEQ ID NO: 45654 - protein, 221 aa, Sorghum bicolor
  Clone ID: SORBI-28MAY03-C21293_1.pep
MSKEKHHRDWVLRRCCGSIAACILTLFALVGFIVLVIYLALHPSKPSFYLQDVQLRSIDLSDPALSLDLQVTIASRNPNDRVGVYYKTLDAFTTYRDEPVTVPVSMPSIYQGHKDVSVWSPVMSGDAVPVAQYVADAMKQDIAAGYVLLHVKVEGRVKWKVGSWVSGGYHLFVTCPALLATSGSAVAGGAFAASAASGVPAGVNTTVSLKFTHPADCTVDV

SEQ ID NO: 45655 - protein, 746 aa, Sorghum bicolor
  Clone ID: SORBI-28MAY03-C2268_1.pep
ARGTLLFSDGAKCEILLRDLDVLKPVPPILFEDAPYFYYPGQRVRIVDPSVSKSATWLCGSWRPSRDDCIVSHVDVGLVHVNWITSVTNVWGDKSSSPSNIQDPKKLTLLSCFPYANWQLGDWCALMADNNGYLWMDSGKSCILSEDHKCDSHGHMYFESYGSDCSQTYVVAKTKSTVDVLWQNGTVSLGLEPQALVPVSTLGDHDFWPGQYVLEKLTVEDAAKCQRTAIVRDVDALERTVNVKWIDPAHSDTARRGSDPAVETVSVYELVEHPDFSFCTGEVVIRSAVNIDKSEADLTNGSLASKESLVTSSGFLSCIGNVLGYKDNGIEVQWANGVISKVQHFEIIGLDRLLDNSSLESMNEEHTIGDSLGEAEQEEMHHEIALESTEDCTGSLCKATAFLFPKTAFDFLTNVAASLFGTRGSPSPSSVSVDPRYEIVKMAEMQPCVEELPKEKQIVKFVAQIEKPILSSEDAISKRFDVVTDCLDHHFVKENGHESVTRGWLKKVQQEWSILQNDLPDGIHVRVYEERMDLLRACIVGAAGTPYHDNLFFFDIFFPPDYPHEPPSVHYHSGGLRLNPNLYESGKVCLSLLKTWTGTGNEVWNAENSTVLQLLLSLQALVLNEKPYFNEAGYDKFVGKADGEKNSITYNENAFLLSCKSMMYVLHKPPKHFEKLVKEHFTCRSLHILDACEAYLGGDLVGHAHDKAYISEDGSKNCSTGFKIMLGKLLPKLVTAFYEAGITSDP

SEQ ID NO: 45656 - protein, 592 aa, Sorghum bicolor
  Clone ID: SORBI-28MAY03-C5540_1.pep
TRQEQKIVGLSDRPCSGQLFTLKHKNGNGDSEEITVYDYFVKNRGIELQYSGDLPCINVGKPKRPTYFPVELCSLLPLQRYTKALSTLQRSSLVEKSRQKPQERIGVLSDVLQRSNYDAEPMLKACGITIARSFTEVDGRILQPPKLKAGNGEDIFTRNGRWNFNNKRLIKGSSVEKWAVVNFSARCNVRDLVRDLIKCGGMKGIMVEAPFDVFEENPSMRRSPAVRRVEDMFEQVKTKLPGAPKFLLCVLAERKNSDIYGPWKKKCLAEFGIVTQCVAPTRVNDQYLTNVLLKINAKLGGMNSLLQIETSPAIPQVSKVPTIILGMDVSHGSPGHSDVPSIAAVVSSREWPLISKYRASVRTQSPKMEMIDSLFKPRETEDDGLIRECLIDFYTSSGKKKPDQVIIFRDGVSESQFNQVLNIELQQIIEACKFLDEKWNPKFTLIIAQKNHHTKFFIPGKTENVPAGTVVDNKVCHPRNFDFYMCSHAGMIGTTRPTHYHILHDEIGFNPDDLQELVHSLSYVYQRSTTAISVVAPICYAHLAAAQVGQFIKFDEMSETSSSHGGHTSAGSVPVQELPRLHEKVRSSMFFC

SEQ ID NO: 45657 - protein, 387 aa, Sorghum bicolor
  Clone ID: SORBI-28MAY03-C4961_1.pep
MKTRSSARGEPRRLGNAALLALMLCSVVALSLIRGRFAPIGDAIKSEDDAAAAAVAVSKAAAVNVDTGDGADEAAAEAAAEEKDKGGGPAEARPPTVPAAAQPEPVCYETSRRSDTCEAAGDVRVLGSSQTVYVDSLDREWKTKPYCRKHDNFALAHVKEWSLKPLPSGAAPQCTVNSSATAFVLSTGGFTGNPFHDYTDVLIPAFITAHPLRGEVQFLVSSYKSWWMNRYIQIFQQMSRHEVVDIDADDEVRCYRNVVVGPTFHRELGVDASKSPSPGYSTADFRKMLRDAFGLERATATPSGDRWDIRRRPWLLIISRRPRHGELVRRDGGRRRGRGRPRRGAVASGCQGERGRVGSYFWGLQLEFGSSPKMRAQVGGPLEFSNS

SEQ ID NO: 45658 - protein, 126 aa, Sorghum bicolor
  Clone ID: SORBI-28MAY03-C238_1.pep
MASAAVYGGLKGKLGVEDAPELQLNRIRITLSSKNVKNLEKVCADLVKGAKDKQLRVKGPVRIPTKVLHITTRKSPCGEGTNTWDRFEFRIHKRVIDLISSPDVVKQITSITIEPGVEVEVTIADV

SEQ ID NO: 45659 - protein, 194 aa, Sorghum bicolor
  Clone ID: SORBI-28MAY03-C25425_1.pep
MASRQQNTREARAEADARRAVEELARARDEHLEKAELNARSAADEIARSRADRGGAGGGGILGSVQEGARSLASAVGRTFGGAKDTAVDKTSQTAQATGEKLGEYKDYAAEKARETNDSVARKTSETAEATKNKLGEYKDTAVEKARETKDAVAQKTSETAEATKNKLGEYKDAAAGKARETVDTTAEKARQAK

SEQ ID NO: 45660 - protein, 273 aa, Sorghum bicolor
  Clone ID: SORBI-28MAY03-C25647_1.pep
RINLKCAYKYLQYVTEKTESLLRYKSRAVPIQTESSTKSAQQRRAKTKNIAERVLVQQFIIAQRHGKATSVTVYYRSTPMHGWHWKARHVAAGACAVRHAISHLPLAVHAGRSGAPSSAGLHPLVHPLLRALPHQPVLLLEAHRRRLLRRALLRRALVLAAPPDVDVPPGSRARPPHLVPDLYRPERRRPTRSPPFIGVVSAGRLPCLVGGRPPCWRRCTRPPSAWSRPWPPSPCRRWRPSSPGPSAWGRPWPASPSRRWCPRSPAPSRPPGG

SEQ ID NO: 45661 - protein, 156 aa, Sorghum bicolor
  Clone ID: SORBI-28MAY03-C286_1.pep
GRFCFNPLVIYEKDSSYSRIKSLVIEEMKQYFRPEFLNRLDEMIVFRQLTKLEVKEIAEIMLKEVFDRLKAKDINLQVTEKFKERVVDEGYNPSYGARPLRRAIMRLLEDSLAEKMLAGEVKEGDSAIVDVDSEGKVVVLNGQGGIPELSTPAITV

SEQ ID NO: 45662 - protein, 373 aa, Sorghum bicolor
  Clone ID: SORBI-28MAY03-C285_1.pep
MTPAAAISGSSGHLVVSSPRLRQPLPPSPRTARPIAANAASPVARRGVAAAAVSSPAVSAAAGKDAKQAPKDFLHINDFDKDTIMNILNRAIEVKAAIKSGDRSFQPFKGKSMAMIFAKPSMRTRVSFETGFFLLGGHAIYLGPDDIQMGKREETRDVARVLSGYNDIIMARVFAHQDILDLANYAPVPVINGLTDYNHPCQIMADALTMLEHIGRIENTKVVYVGDGNNIVHSWLLLAAVLPFHFVCACPKGFEPDAKTVEIARSAGISKIEITNDPREAVKGADVVYTDVWASMGQKEEADYRKQKFQGFTVDEALMEIAGSQAYLMHCLPAERGVEVTDGAIEAPNSIVFPQAENRMHAQNAIMLHVLGA

SEQ ID NO: 45663 - protein, 355 aa, Sorghum bicolor
  Clone ID: SORBI-28MAY03-C29622_1.pep
MASEDVVGKSRGDTAVTTIVNLAEEAKLAREGVKAPGHQILTICKSLVAGGVAGGVSRTAVAPLERLKILLQVQNPHSIKYNGTVQGLKYIWRTEGLRGLFKGNGTNCARIVPNSAVKFFSYEQAAKGILWAYRQQTGEEDAQLTPLLRLGAGACAGIIAMSATYPSARVRGRITVQTDKSPYQYRGMFHALGTVYREEGFRALYRGWLPSVIGVVPYVGLNFAVYESLKDWLLQTNPFGLANDNELHVVTRLGCGAVAGTIGQTVAYPLDVIRRRMQMVGWNHADSIITGKGKEALQYNGMIDAFRKTVRHEGAGALYKGLVPNSVKVVPSIAIAFVTYEVVKDVLGVEMRISD

SEQ ID NO: 45664 - protein, 219 aa, Sorghum bicolor
  unsure (1)..(219): unsure at all Xaa locations
  Clone ID: SORBI-28MAY03-C31561_1.pep
PCPTFGTQPEFVSPAADLLHPLAAPQSGEETTLGRAPPGAQRSRDQFRRGVRPLQPLAPAAVAPLLLVLLRHSPPWPATTTTRTAAGCTTTYKRSANVRQSTRGGTSSDAAGGSVECNICFELPQAPIVTLCRHRFWGXCLHRWRHLHLHSLNSNLGFGTWPRRWKGYVRQRLVHGLRLCWSLQYLQGLRGCGRTPRRLGWRYRSRLWIWQRWNPLSFP

SEQ ID NO: 45665 - protein, 440 aa, Sorghum bicolor
  unsure (1)..(440): unsure at all Xaa locations
  Clone ID: SORBI-28MAY03-C33577_1.pep
TRLRLHNPFARKTARLPGARSDPSVCFPATAGVLLASLVRWPATGAWSGRPFTAVNTPTAPCPVLIQYHVQQGYAVVADELAVHFISYVGECFPQVSINYKITTLSCGIIHLPCCQCTFHSVFQCGWSSHGHLWLLKYPNDLFTGPLANVDFFICRDSDGSFHDVRNVQRHXNQSLLLAVNCIMTSSXTYSGWMYGVDGTPPMAQRISGIXNFNKNDFGLFPIKVVTWGPFVLVRFDDESTEDNVYGAVGNEWLGSASDLLGTNGIDTSLPHICRXFCDNYLDGGYHVPYAHGALASGLQLQSYETLTYERVSVQRCESAPAEPDDFDRLGTKALYAFVYPNFMINRYGPWMDTNLAVPLDSTSCKVVFDYFLDKSLLDDESFIKKSLKDSEQVQIEDIALCEGVQRGLESPAYSVGRYAPSVEMAMHHFHCLIHGNLSG

SEQ ID NO: 45666 - protein, 381 aa, Sorghum bicolor
  Clone ID: SORBI-28MAY03-C8009_1.pep
RTLPLPPLPPPASPPGAAAVGDGRRRGRPRPWASLPGVHGVLSAPRGRGFVGPALPGLPGAAPRASRRRCGPAPPDVRLPGPRRPPPPRLVALLPQPGPSRRPPPPPSPPRRPLPAPLAVAVSPSPLYGRVSSDEGKSDHGGGGRKPQPMKQEVPPAVDPSNRAVYYNDSSPLSDLKRAMPVGTEAASYRLPGSAPDAPAAAAATQVPPGYVLTQMHVPQPPQQHPPPQQQQQPQQPAPQQIVSAGNQHFIHNPATGTFIPIQSYYHHPVPQQAPQTVPRPQQAPTFDPNTGMYYLPMQQNAHQPYSMPPGAQVTLPPPTLVDTTPKPTVPIPQMAVRPELQQPGVYRTTAAATPAPAPNAAPGYAGMAYHHVIQSHHHPS

SEQ ID NO: 45667 - protein, 198 aa, Sorghum bicolor
  Clone ID: SORBI-28MAY03-C81946_1.pep
MGAHVLAIGLLLAGAVVGAVVPPHDHLQLVTDTDGGLSLDFHAASCPQLEGIVRAAVQAERGQDVQVTAGLLRIFFHDCLPQGCDASILLDGEKSFGPNASLQPRALQLIESIRAKVHAVCGATVSCADIIALATRDAVSLAGGPSIAMPQGRTDSLRPATNAEVNTLPSPFSDVSTLLGTFSRRGLADPADLVALSG

SEQ ID NO: 45668 - protein, 372 aa, Sorghum bicolor
  unsure (1)..(372): unsure at all Xaa locations
  Clone ID: SORBI-28MAY03-C2584_1.pep
GYAFIEYVHTRDMKNAYKQADGRKVDNRRVLVDVERGRTVPNWRPRRLGGGLGSSRMGGADADKKDSTRGQQHGGRPRSEEPRRDDRRADRDREKSRERVHEREREERTRERSHDRTRDRDSRDEKHHHRDRERTRDRERGKDRERDHGRDRDRDRRDRDRDRGRDRERDHARSHDRHRERXGKDRGERDYERTHERERGHPAGYKRFQTSLPTSLRTSLSSRRRPPSPASTMGDYGHGGGQMRGNPDSRPRGQGQRPNVQQLKLMGQIHPTGLTPNLLKLFEPRPPLEYKPPLEKRKLPAYTGMAQYVSHFATPEDPEYAPPVPKCETRAEKKARIRNNKLEQGAAKVAEELQKYDPQSDPNAPGHPYDTV

SEQ ID NO: 45669 - protein, 112 aa, Sorghum bicolor
  Clone ID: LIB3476-019-P1-K1-F11.pep
EDREWYHARYHDRHRERGRDRGERDHGRIHERERAHMHEMDADYGNGGTKHDKNLSSYGQDYGYGQYEQHKGHDAYGYGQDGRRHETEHSKRHEHEYYRVDSYGKMEANYQM

SEQ ID NO: 45670 - protein, 233 aa, Sorghum bicolor
  Clone ID: SORBI-28MAY03-C44348_1.pep
TTPSSSSSRLPPTHTLIHHCQKLLLFSFPKPRPVVEPTLLQMSKSCSSSTSRIFPRRRRRRLFGYVTLMVPRKGVLGGGGDDPVWTWWTSLCGRAIEIFSSRSGSAWLLLAVAAGVRVDEGCVCFGAARARLPIAAEHRGSCSDRLVGGRTTCSGLLAGRLMMPSDSAGSSVGVVVPGAAAEAVVARAASSSVKRCSWSVSLKPGPGGGNGRGTDWNSMASIGPDLDGGIRCL

SEQ ID NO: 45671 - protein, 120 aa, Sorghum bicolor
  Clone ID: SORBI-28MAY03-C4533_1.pep
MFLLYEYDIFWTFLIIASLIPILVFWISGLLAPVSEGPEKLSSYESGIEPMGGAWLQFRIRYYMFALVFVVFDVETVFLYPWAMSFDVLGVSVFIEAFIFVLILVVGLVYAWRKGALEWS

SEQ ID NO: 45672 - protein, 174 aa, Sorghum bicolor
  Clone ID: SORBI-28MAY03-C467_1.pep
DAVLPTPMDLINTVRELVLSQDLTLIIEPGRSLIANTCCFVNRVTGVKSNGTKNFIVVDGSMAELIRPSLYGAYQHIELVSPPTPGAEVATFDIVGPVCESADFLGKDRELPKPDEGAGLVVHDAGAYCMSMASTYNLKLRPPEYWVEEDGSIVKIRHEEKFDDYMKFFDGLPA

SEQ ID NO: 45673 - protein, 411 aa, Sorghum bicolor
  Clone ID: SORBI-28MAY03-C46139_1.pep
MNALAATSRNFKQAAKLLGLDSKLEKSLLIPFREIKVECTIPKDDGTLASYVGFRVQHDNARGPMKGGIRYHHEVDPDEVNALAQLMTWKTAVANIPYGGAKGGIGCSPGDLSISELERLTRVFTQKIHDLIGIHTDVPAPDMGTNSQTMAWILDEYSKFHGYSPAVVTGKPVDLGGSLGRDAATGRGVLFATEALLAEHGKGISGQRFVIQGFGNVGSWAAQLINEAGGKVIAISDVGIPRPRRFLRRPPLLVKHSAENRGIKGFNGGDAIDPNSLLTEECDVLIPAALGGVINKDNANDIKAKYIIEAANHPSDPEADEILSKKGVIILPDILANSGGVTVSYFEWVQNIQGFMWDEEKVNAELRTYMTRAFGDVKEMCRSHNCDLRMGAFTLGVNRVARATVLRGWEA

SEQ ID NO: 45674 - protein, 424 aa, Sorghum bicolor
  Clone ID: SORBI-28MAY03-C4791_1.pep
MIDRERAEEMQVNNEAPLVCLKPNISQYNSPEQRGGVEGFPENNEKRNDIVAAEKIWEASPIPNQGLSRPFYRQEFYAWPYIHSDYQMVRQPLPYGFDNQFYQINRDHGFPIENRVQYLPFKMLPQGHPHDAQLQEFQYFVVIDFEATCDKVNNPFPQEIIEFPSVLVNSATGKLEECFQTYVRPTYHQFLTDFCKELTGIQQIQVDRGVPLGEALLMHDKWLEDKGIRNTNFAIVTWSNWDCRTMLESECRFKRIRKPPYFNRWINLKVPFQEVYGDVRCNLKEAVQLAGLTWEGRAHCGLDDARNTARLLALMMHRGFKFSITNSLVWQPAPQSTTCQLSPDRSPDPVQQQQKPKEMLGSPVQVNPYATSAGKDRAMYCYCGVLSRWSVVRKPGPMQGRYFFGCGNWTATRRAICPYFAWAS

SEQ ID NO: 45675 - protein, 176 aa, Sorghum bicolor
  Clone ID: SORBI-28MAY03-C46868_1.pep
HEAFANMRIVNNLLGGKAGPWTIHVPTGEKLYVYDVAMARGSEGHDMVIIAGAEYGSGSSRDSAAKGPMLLGVKSVIAKSFERIHRSNLVGMGIIPLCFKAGEDADSLGLTGRERYTIHLPTSIAEISPGQDVTVTTHDGRSFICTLRLDTQLEVTYFNHGGILPYMVRNLAAQMK

SEQ ID NO: 45676 - protein, 301 aa, Sorghum bicolor
  Clone ID: SORBI-28MAY03-C5365_1.pep
MASFFGDDGADELPRTTSHPFDSDDFGAAAADGDGAGGYGGYASFAEGGVEDVDEEITVESDGVPIRHVSGGYSPSPFSPELEPNGGDGPILPPPTEMREEGILLREWRRKNAIELEKKEQKEKELRAQIIAEAEEFKKAFFEKRIQNCASNMVNNREREKIFVASQEKFHANADKQYWKSISDLIPHEIATIEKRGKKDKDKKPSITVIQGPKPGKPTDLSRMRHILVKLKHAPPPHMLQPPPAPAAKEGAKDGAKEGAKDGAKEGAAAPANGAKQPAESQETPANGPSEAEKEQPAASE

SEQ ID NO: 45677 - protein, 376 aa, Sorghum bicolor
  Clone ID: SORBI-28MAY03-C11918_1.pep
MAEEDVQPLVCDNGTGMVKAGFAGDDAPRAVFPSIVGRPRHTGVMVGMGQKDAYVGDEAQSKRGILTLKYPIEHGIVGNWDDMEKIWHHTFYNELRVAPEEHPILLTEAPLNPKANREKMTQIMFETFNCPAMYVAIQAVLSLYASGRTTGIVLDSGDGVSHTVPIYEGYTLPHAILRLDLAGRDLTDNLMKILTHGGYSFTTTAEREIVRDIKEKLAYVALDYDQELETARTSSTVEKSYELPDGQVITIGAERFRCPEVLFQPSFIGMESPGIHEATYNSIMKCDVDIRKDLYGNVVLSGGSTMFPGIGDRMSKEITALAPSSMKVKVVAPPERKYSVWIGGSILASLSTFQQMWISKAEYDESGPGIVHMKCF

SEQ ID NO: 45678 - protein, 159 aa, Sorghum bicolor
  Clone ID: SORBI-28MAY03-C11572_1.pep
MASGAAAAPGVQTVVLKVAIHCHGCKKKVRKVLRSVEGVQNVTVDASQHKVTVVGTVDADTLIQRLYKSGKKGEPWQCHPPAKKTEPAPPEAPPAPKPDGDGGKDAAPPAAAAAVAADKKPEEAVKEPPAPKPAGDGGKDAAAAPAAADNKPEAAAKEP

SEQ ID NO: 45679 - protein, 66 aa, Sorghum bicolor
  Clone ID: LIB3478-031-P1-K1-B11.pep
MLTPRLLCSFQTVVLKVAIHCHGCKKKVRKVLRSVEGVQNVTVDASQHKVTVVGTVDADTLIQRLY

SEQ ID NO: 45680 - protein, 180 aa, Sorghum bicolor
  unsure (1)..(180): unsure at all Xaa locations
  Clone ID: SORBI-28MAY03-C15390_1.pep
ALAYDPEADAWAQLPDMAEERDEPRGLCVAGRFFLVVGGYPTQAQGRFVGSAECFDPATSAWAPVDDLVEDGVCPRTCCAAPPRXGSERMYMLSRDGHLVARDGGAAWRPVAQVPEDARTAATVSVIPDDRVVVIGSGCHGGDQTVYVLREEAGKGASWTRAAAPPEFSGHVQASCFLEI

SEQ ID NO: 45681 - protein, 326 aa, Sorghum bicolor
  Clone ID: SORBI-28MAY03-C5416_1.pep
MGSSSNTNTSGGASDKEEKKKEDKVKGKDSSEPSFKENERVLAYHGPLLYEAKVQRIENHEDEWRYFVHYLGWNKNWDEWVANDRLLALTEENMRKQQELDKNQVVDKTMKSGRSTQHKPKGSNADAKADKDDTKSLMKGKKRKSQPGTEIQEKEKRSSQSLLVLQFPLTLKKQLVDDWEFVSQMGKFVKLPRSPTVDDILKKYLEHRTKKDGKINDSYAEILKGIRCYFDKALPAMLLYKKERDQYAEEVKGDVSPSTVYGAEHLLRLFVKLPELLAFVNMEEDALNKLQMKLLDILKFIQKNQSTFFTTVYDDGRKSADGAKTK

SEQ ID NO: 45682 - protein, 38 aa, Sorghum bicolor
  Clone ID: LIB3476-008-P1-K1-E10.pep
DFIGLQFVKLPRSPTGDDILKKYLEHRTKKDGKINDSY

SEQ ID NO: 45683 - protein, 323 aa, Sorghum bicolor
  Clone ID: SORBI-28MAY03-C60672_1.pep
ARAPRPQPAGRACPSAPRARPARRSKTMQVFSFLPAATKHLFRARLDKARELRRRVKELFVPLINARREYKKRGGEPKGETTFEHSYLDTLLDIKLPEGGGRPLTDDEICIPCSEFLAAGTAARASTRRAIMAERGKNPAIQEKLYNEVKAAADNDKEGVSEEDVHKMPYLKAVILEALRKHPPAHFVLPHKAAEDMEIGGYLIPKGTTVNFMVAEMSRDEQEWKNPMEFSPERFLPGGDGEGVDVTGTKAIRMMPFGVGRRICAGLGIAMLHLEYFVANMVLEYEWKEVPGNEVDFAEKNEFTVVMKKPLRPRLVPRRSHLN

SEQ ID NO: 45684 - protein, 170 aa, Sorghum bicolor
  Clone ID: SORBI-28MAY03-C66489_1.pep
GVKEKERNIGWCTNIRIPRPTIYNVVLEMTTRMGYEVRLVRITEMVHDAYYSRLYLAKIGNDQDTISFDLKPSDAINIAFRCKVPIQVNRRIAYNNGLKVVQPKVAESYVGSDDIQITRLDRPDDQHCSEAQEFDLVRNMLIAAVEERYKDAAQYRDQLSTLRSKKKNAI

SEQ ID NO: 45685 - protein, 178 aa, Sorghum bicolor
  Clone ID: SORBI-28MAY03-C672_1.pep
ARAALPPLPRVGVVFSAERSLSHVTWYGRGPFECYPDRKAAAHVGVYESSVEELHVPYIAPVECGGRADVRWVALRDGGGLGLYASAHGGSPPMQVSASYYGAAELDRATHVHRLVKGDDIEVHLDHRHMGLGGDDSWSPCVHEQYLLPPTRYAFSLRLCPLLPTSLCHDIYRSQLPS

SEQ ID NO: 45686 - protein, 220 aa, Sorghum bicolor
  Clone ID: SORBI-28MAY03-C6879_1.pep
HEATVRSKASTRQHKRRAQSSQAPHADAEPTNQPAGSSSRFSPFAAMPRCAVVVLFAAVLLAASAAAVSGFHLGGDESGLVRGVLAALRERAEAEDAARFAVAHHNKNQGAALEFTRVLKSKRQVVTGTLHDLILEAADAGKKSLYRAKVWVKPWEDFKSVVEFRLVGDSESESESSVTSDVSSGQAIAKLSLEADIAQEEAHLHTIENDGLSGDFASSS

SEQ ID NO: 45687 - protein, 593 aa, Sorghum bicolor
  Clone ID: SORBI-28MAY03-C6823_1.pep
MESTLKGIRGSDAPCVLDMDDAATVAGGVEDTYGEDRATEEQLVTPWTVSVASGYNLLRDPRYNKGLAFTERERETHYLRGLLPPAIVSQELQERKIMNNIRQYQLPLQRYMALMDLQEGNERLFYKLLIDNVEELLPIVYTPTVGEACQKYGSIFSRPQGLYISLKEKGKILEVLKNWPERSIQVIVVTDGERILGLGDLGCQGMGIPVGKLSLYTALGGVRPSACLPITLDVGTNNEELLNDEFYIGLRQRRATGQEYTDFLQEFMSAVKQNYGEKVLIQFEDFANHNAFDLLARYGTTHLVFNDDIQGTASVVLAGLIAAQTLLGGSLADHTYLFLGAGEAGTGIAELIALEISRQTKAPIEECRKKIWLVDSKGLIVSTRKGSRQHFKKPWAHEHKPVNNLLDAVNAIKPTVLIGTSGKGQTFTKDVIEAISSFNERPIILALSNPTSQSECTAEQAYTWSKGQAVFATGSPFDPVEYNGKIHVPGQANNAYIFPGFGLGVVMSGAIRVHDDMLLAASEALAQQVTEENFEKGLIYPPFSNIRKISAHIAANVAAKAYELGLASRRPRPKDLVKFAESCMYSPIYRNYR

SEQ ID NO: 45688 - protein, 231 aa, Sorghum bicolor
  Clone ID: SORBI-28MAY03-C7127_1.pep
MASSSDPWMKEYNEASRLADDISSMIADRGSLPQSGPEIMRHTSAIRRKITILGTRLDSLESLLGRIPPKSITDKEMHKRQDMLSSLKSKAKQMATSFNMSNFANREDLLGQSKKADDMSRVAGLDNQGIVGLQRQIMKEQDEGLEKLEETVLSTKHIALAVNEELTLHTRLIDDLEDHVDITNSRLQRVQKRLAILNKRTKGGCSCMCLLLSVVAIVILAVIVWLLVKYL

SEQ ID NO: 45689 - protein, 306 aa, Sorghum bicolor
  Clone ID: SORBI-28MAY03-C74252_1.pep
MAENFQLQSRHGKSRVRVSRVWRRPAAAGGHIIVEWNVAVSIVSDCLPSYISSDNSAIVATDSIKNTVYVKAKECTEVVSMEEFAVILGRHFTSLYPQVSEATVTIVERPWDRVTVDGKPHSHGFKVGVEKHSTEVIVKKSGSLLINSGIQGYSLLKTTQSGFEGFVTDRYRLLPDTRERIVATEVTAWWRYPFEHVSQLPSKPFCFTQRYQDVKRVLTETFFGPADVGVYSPSVQNTLYLMAKEVLTRFPDISSVQLRMPNLHFLPVNLGSKETPLVKFADDVYLPTDEPHGTIEATLSRPMSKL

SEQ ID NO: 45690 - protein, 551 aa, Sorghum bicolor
  Clone ID: SORBI-28MAY03-C7697_1.pep
MALSTNAAAAAAAISGGSASASQPARRTPSSLLPLTRRRRAVVRAVHAAEPSKNPGVVVPAAAKASSPTTVAPENDAAPAPAPARAPAKWAVDSWRTKKALQLPEYPNPAELEAVLKTIEAFPPIVFAGEARHLEERLADAAMGRAFLLQGGDCAESFKEFNSNNIRDTFRVLLQMSAVLMFGAQMPVVKVGRMAGQFAKPRSDPFEVRDGVKLPSYRGDNINGEAFDEKSRVPDPQRMIRAYAQSAATLNLLRAFATGGYAAMQRVTQWNLDFTEHSEQGDRYRELAHRVDEALGFMSAAGLTPDHPLTTTTEFWTSHECLLLPYEQALTRQDSTSGLFYDCSAHMLWVGERTRQLDGAHVEFLRGIANPLGIKVSDKMNPSDLVKLIDILNPTNKPGRITVITRMGAENMRVKLPHLIRAVRQAGQIVTWITDPMHGNTIKAPCGLKTRPFDNILAEVRAFFDVHEQEGSHPGGVHLEMTGQNVTECIGGSRTVTFDDLSDRYHTHCDPRLNASQSLELAFIIAERLRKRRIRSSSGLNNILPLPPFGF

SEQ ID NO: 45691 - protein, 404 aa, Sorghum bicolor
  Clone ID: SORBI-28MAY03-C2893_1.pep
MATIPTTDSGLLLGSSALLRRTRRAASSARLPAAARRRPQLLVRASAKEIAFDQGSRASLQAGVEKLAAAVGVTLGPRGRNVVLDEFGTPKVVNDGVTIARAIELADPMENAGAALIREVASKTNDSAGDGTTTASVLAREIIKLGMLSITSGANPVSVKKGIDKTVQKLVEELEKKSRPVKGSGDIKAVAAISAGNDEFVGTMIAEAIDKVGPDGVLSIESSSSFETTVEVEEGMELDRGYISPQFVTNPEKSTVEFENARILVTDQKISSIKEIIPLLEQTTQLRAPLLIIAEDVSGEALATLVVNKLRGILNVAAIKAPGFGERRKALLQDIAIVTGAEYQSKDLGLLVENTTVEQLGIARKVTISSSSTTIIADAASKDDIQARIAQLKRELSQTDSAYD

SEQ ID NO: 45692 - protein, 629 aa, Sorghum bicolor
  unsure (1)..(629): unsure at all Xaa locations
  Clone ID: SORBI-28MAY03-C30167_1.pep
PEAPPRLPPSRPPPPPSLASLSSPLRSARLDTGQAPSRRRRRSPELGAGAAEHAPRGTIVRTGSMRRSSTLTPARASAPASTLSPAAFRPPDDRVFGAEAVVARADLYRAIFPVAEDVVAVEWLDIDQVNNNIDEIHREALVMSLIVQPNVIRAYCXFVVEHIPWVIMPFMSEGSCFRYPNVFXQGGFGVPVSGSVRGETHRAWDYLHRQGQMHGDVIVDNSTIDDLGDVGVSAFMFARGVRHRAGNTLVGTPFWVAPEVLQPGTRYNFTAYIWSSGITSLELTAVQVPFWKDPPMKVLLMTLQNAPPGLDYDRDKRFSKSFKEMVAMCLVKDQTKRPTAEKLLKHSFFKNVKPPELTVKSILTDLPPLWDRVKALQLKDAAQLALKRMPSSEQEALSMSEYQRGVSAWNFDIEDLKAQASLICDAVPPDDEPPEIKEDEDIARNIEAAKDLSSRXNHLGKSSANECNSRQRAFASTLNSDGNSPTTNEAFDFDFDFSDADTTRRADGYESNIRENDSLPSTSKRDPESNHWTNDGWQRQLTSGGSNSSATERGYGFERDAAVQMISDKQRSEMRKTASLSGPLSLPTRASANSLSAPIRSSGGYVDSSGDKSKRSVVEIKGRFSVTLV

SEQ ID NO: 45693 - protein, 112 aa, Sorghum bicolor
  Clone ID: SORBI-28MAY03-C8201_1.pep
IWPPRGHNFVACLWIFRPSLYFLRFKIFLLKFSLFSLRQKTKYIASIWCPLCYCFCVMAMIAMTSEHSSLPYFACVLAFGFTRSCFGITEEMLMSYGCSSFYIYVLYSWLRQ

SEQ ID NO: 45694 - protein, 753 aa, Sorghum bicolor
  Clone ID: SORBI-28MAY03-C8853_1.pep
HEGVARCARGLRWEAHRSRGRSLRVRCDAAVAEKPAGEEAAGEQFEYQAHVGRLMDLIVHSLYSHKEVFLRELVSNASDALDKLRFLGVTDSSLLADGGELEIRIKPDPDAGTITITDTGVGMTKDELKDCLGTIAQSGTSKFLKALKENKDLGADNGLIGQFGVGFYSAFLVAEKIVVSTKSPKSDKQYVWEAVADSSSYIIKEETDPEKMLTRGTQITLFLRSDDKYEFADPSRIQGLVKNYSQFVSFPIYTWQEKSRTVEVEEDEEPKEGEEATEGEKKKKKKTVTEKYWDWELANETKPIWMRNPKEIENTEYNEFYKKTFNEFLDPLAHTHFTTEGEVEFRSVLYVPGMAPLSNEEIMNPKTKNIRLYVKRVFISDDFDGELFPRYLSFVKGVVDSNDLPLNVSREILQESRIVRIMRKRLVRKTFDMIEEIAEKEDKEDYKKFWESFGKFIKLGCIEDTGNHKRLAPLLRFHSSKNEGDTISLDQYVESMPESQKAIYYIATDSLQSAKTAPFLEKLVQKDIEVLYLIEPIDEVAIQNLQTYKEKKFVDISKEDLELGDEEEETKETKQEFTLLCDWVKQQLGDKVAKVQISKRLSSSPCVLVSGKFGWSANMERLMKAQTLGDTSSLEFMRGRRIFEINPDHPIIKDLSAACKNEPDSTEAKRAVELLYEAALISSGYTPESPAELGGKIYEMMAIALGGRWGRSDMEETETSMSEASAESDSSEGTVTEVIEPSEVRPESDPWRD

SEQ ID NO: 45695 - protein, 521 aa, Sorghum bicolor
  Clone ID: SORBI-28MAY03-C8920_1.pep
MRPAGRLLLRVLPLLLLAAATAGSWEDGHGSILRLPSSSSSSSPRRFPRSAAVDLIRALNLHPSDASPPSSTAGVEGALASAGTLVERPIRLASFADAGDASTSVEDLGHHAGYYRLPNTHDARMFYFFFESRGQEDDPVVIWLTGGPGCSSELALFYENGPFNIADNLSLVWNDFGWDKASNLIYVDQPTGTGFSYSSDSRDTRHNEATISNDLYDFLQAFFAEHPKYAKNDFFITGESYAGHYIPAFASRVHQGNKNNEGIHINLKGFAIGNGLTDPAIQYKAYPDYALDMGLITKTQFNRINKIVPTCELAVKLCGTSGTVSCLAAYFVCNTIFSAIRTIIGNKNYYDIRKPCIGSLCYDFNNLEKFLNLKSVRESLGVGDIEFVSCSPTVYEAMLLDWMRNLEVGIPELLESDIKVLIYAGEYDLICNWLGNSRWVNSMEWSGKEAFVSSAEKPFTVDGKEAGVLKSHGPLSFLKVHDAGHMVPMDQPKAALEMLKRWTSGNLSEPSSSSQRLDFTM

SEQ ID NO: 45696 - protein, 140 aa, Sorghum bicolor
  Clone ID: SORBI-28MAY03-C9455_1.pep
MSKRGRGGTAGNKFRMSLGLPVAATVNCADNTGAKNLYIISVKGIKGRLNRLPSACVGDMVMATVKKGKPDLRKKVMPAVIVRQRKPWRRKDGVYMYFEDNAGVIVNPKGEMKGSAITGPIGKECADLWPRIASAANAIV

SEQ ID NO: 45697 - protein, 702 aa, Sorghum bicolor
  unsure (1)..(702): unsure at all Xaa locations
  Clone ID: SORBI-28MAY03-C88_1.pep
MAMGHEVLLGHITGWRGKFLDWSRQVMSALSSSSLCGGDPAMRSVVWFRRDLRVGDSPTVAAAARAGGEVVPAYVWSPEEEGPYYPGRVSRWWISQSLKHLDASLRRLGAGKLVTRRSADAVVALLQLVRDTGATHVYFNHLYDPISLVRDHRLKEMLAAEGIVVQSFNADLLYEPWEVVDDEGQPFTMFTAFWNRCLSMQYDPPAPLLPPKEGRPGDLSMCPSEDLIFEEDSERGSNALVARAWTPWCISADKALTAFLNGGRXTFAADEADVSSRSYLDRHPQSHRLMNWSQLSQSXDNRLGSGKFCAAKLTRLGFSEXNSYVDCPLNCSSIVRWDANQAAFPGGDYSCVNLIXRTCVVGYSVVGFKXVTIIDQTTKVLRILSLFFFGRYVMYVTVXHFWDTLLDADLESDALGWQYITGSLPDSRELDRIDNPQFEGYKFDPHGEYVRRWIPELVRLPTEWIHHPWDAPVSVLQAAGIELGSNYPLPIVELDAAKARLQEALSEMWQLEAASRATMNNGMEEGLGDSSEVPFPEELQMEVDRATANVVMTVRRREDQMVPTMTSSLNRAETEVSADLGNSEDTRAQVPFHAHFHPRVEREDMIQNTEGPALRINGTHQHNIFQQPQNHRREALAPSVSEASSSWTGREGAVVPVWSPPAASGHSETFAADEADVSSRSYLDRHPQSHRLMNWSQLSQSL

SEQ ID NO: 45698 - protein, 144 aa, Sorghum bicolor
  unsure (1)..(144): unsure at all Xaa locations
  Clone ID: LIB3481-006-Q6-K1-F4.pep
VRREGPGYPLVDAXGMRDLWATGWLHDRIRVVVSSFFVKVLQLPWRWGMKYFWDTLLDADLESDALGWQYITGSLPDSRELDRIDNPQFEGYKFDPHGEYVRRWIPELVRLPTEWIHHPWDAPVSVLQAAGIELGSNYXLPIVE

SEQ ID NO: 45699 - protein, 222 aa, Sorghum bicolor
  Clone ID: SORBI-28MAY03-C9519_1.pep
MGQQSLIYAFVARGTVVLAEYTEFTGNFTTIAAQCLQKLPASNNKFTYNCDGHTFNYLVEDGFTYCVVAVESVGRQIPIAFLDRVKEDFTKKYGGGKAATAAANSLNREFGSKLKEHMQYCVDHPEEVSKLAKVKAQVSEVKGVMMENIEKVLDRGEKIELLVDKTENLRSQAQDFRQQGTKVRRKMWLQNMKIKLIVLGIIIALILIIILSVCHGFKCGSK

SEQ ID NO: 45700 - protein, 280 aa, Sorghum bicolor
  Clone ID: SORBI-28MAY03-C9757_1.pep
MAMKVDMSALETNFANMTFPASDDTYFSAGAPDVPSMVLPTCDDFDGFQADTKAMVKNKKGTTTLAFIFDKGVIVAADSRASMGGYISSQTVRKIIEINPYMLGTMAGGAADCQFWHRNLGNKCRLHELSNKRRISIAGASKLLANILYSYRGMGLSIGTMIAGWDEKGPGLYYVDSEGARLVGNKFSVGSGSLYAYGVLDDGYRFNMSVEEAAELARRAIYGATFRDAASGGCVSVYHVGPDGWTKLSGDDVGELHYHYYPVQKTPVEQEMTDAPTASA

SEQ ID NO: 45701 - protein, 188 aa, Sorghum bicolor
  unsure (1)..(188): unsure at all Xaa locations
  Clone ID: SORBI-28MAY03-C92_2.pep
METASFLSVALALAALVPVSLLLLNRLLYGKLPPGPRRRPVVGNLFDVRPVRCRCYQEWARRYGPIMTVWLGTTPTVVVSTSELAKEVLKTHDQHLADRCRDRSSERFSRGGQDLIWADYGPHYIKVRKLCNLELFTQRRLEALRPIREDEVTAMVESVYKAGTAPGNEGKPFGXKNHLSMVAFNNIT

SEQ ID NO: 45702 - protein, 512 aa, Sorghum bicolor
  Clone ID: SORBI-28MAY03-C92_1.pep
MDASLLLSVALAVVLIPLSLALLNRLRLGRLPPGPRPWPVLGNLRQIKPIRCRCFQEWAERYGPVISVWFGSGLTVVVSTSELAKEVLKENDQQLADRPRNRSTQRFSRNGQDLIWADYGPHYIKVRKLCNLELFTPKRLEALRPIREDEVTAMVESVYRAATAPGNEGKPMVVRNHLSMVAFNNITRLAFGKRFMNANGDIDEQGREFKTIVNNGIKIGASLSVAEFIWYLRWLCPLNEELYKTHNERRDRLTMKIIEEHAKSLKESGAKQHFVDALFTLKQQYDLSEDTVIGLLWDMITAGMDTTVISVEWAMAELVRNPRVQKKLQEELDRVVGRDRVMLETDFQNLPYLQAVVKESLRLHPPTPLMLPHKASTNVKIGGYDIPKGANVMVNVWAVARDPKVWSNPLEYRPERFLEENIDIKGSDFRVLPFGAGRRVCPGAQLGINLVASMIGHLLHHFEWSLPEGTRPEDVNMMESPGLVTFMGTPLQAVAKPRLEKEELYNRVPVEM

SEQ ID NO: 45703 - protein, 133 aa, Sorghum bicolor
  Clone ID: SORBI-28MAY03-C3739_2.pep
MAVPLLTQKIVKKRVKQFKRPHLDRYKCLKPSWRRPKGIDSRVRRKFKGCTLMPNIGYGSDKKTRHYLPNKFKKFVVHNVSELELLMMHNRTYCAEIAHNVSTRKRKEIVERAAQLDIVVTNKLARLRSQEDE

SEQ ID NO: 45704 - protein, 133 aa, Sorghum bicolor
  Clone ID: SORBI-28MAY03-C3739_1.pep
MAVPLLTKKIVKKRVKQFKRPHLDRYKCLKPSWRRPKGIDSRVRRKFKGCTLMPNIGYGSDKSTRHYLPNKFKKFVVHNVSELELLMMHNRTYCAEIAHNVSTKKRKEIVERASQLDIVVTNKLARLRSQEDE

SEQ ID NO: 45705 - protein, 158 aa, Sorghum bicolor
  Clone ID: SORBI-28MAY03-C45982_1.pep
VSVSAGAAASGSAATSAGSASVSAGTASTAAAASTGSASLTSSVSAAGAASAASASLVSVSASAGSATASTSTSLVSVSAGTASASGSLATSVSAAGAGSSAAGLSSTTGAEASSLGVSSTAAGWTASSTTTGASSTGTAVGTWTSAVAIGAARVLWL

SEQ ID NO: 45706 - protein, 257 aa, Sorghum bicolor
  Clone ID: SORBI-28MAY03-C6034_1.pep
MPTAVAEVRPAFGFPRSGKGSGGGHEKEEAVGKRRSDGFFIEEVQEEAEEEVLTDTSSIGAPSPSGSSIGENSSSEAGEDDGEEEVESKLKDGDALGCLDALEDSLPIKKGLSSFYSGKSKSFTSLAEATSTVAAAKELLAKPENPFNKRRRILANWSRRASCSSLATATYLPPLLGPDHAVAEGDEGEEDDSDDDVEYSQLPHRGKNVRDAPALPLPPTRLGGVGMHRRNGLGSFRSPRSFSLSDLHNSSSTDGSD

SEQ ID NO: 45707 - protein, 178 aa, Sorghum bicolor
  Clone ID: SORBI-28MAY03-C66321_1.pep
SWTPTAARGSSSGYKATSDYVRQAIPRGVWANIFSKLAQPNAGLMILDPYGGARIGGVPESATPFPHRAGVLYNIQYMNFWSMAGGDGAVQTKWIRDFYAFMAPYVSSNPREAYFNYRDLDLGENVVVGNVSSYQAGMVWGHKYFKDNYRRLAMAKSQIDPDDYFRNEQSIPPLANSN

SEQ ID NO: 45708 - protein, 185 aa, Sorghum bicolor
  Clone ID: SORBI-28MAY03-C66568_1.pep
MDIINGAVLPSYHAAAPVTGAAAAASVADARVSGHLQLLRRVRVRGTGGAGLLHATTARAGVPRRFFSLSPPQQHGHGRTGWRPARCTLGGSSSDGDGAAAADFDASGEEFVDSSVMEAVELRSVSDGGFVIKMRDGKNLRCVQNNPRVLRLRDSAPHHAIVLKMEDGSDLLLPIIVMETPSIML

SEQ ID NO: 45709 - protein, 233 aa, Sorghum bicolor
  Clone ID: SORBI-28MAY03-C6916_1.pep
MAAARHLRSGLPLLRAHLASSESAAVAQVSRGFASQPAKPTGKDIKVPEALYGGTGNYASALFLTAAKANSLDKVESEIKTVVEASKKSPLFSLFIKDLSVPKETRVKAVTEIFADAGFSDVTKNFLAVLADNGRLKYIERIAERFVDLTMAHKGEVKVVVRTVIPLPAKEEKELKDTLQDILGKNKTILVEQKIDYSIMGGLVIEFGQKVFDMSIRTRAKQMEAFLRQPLEF

SEQ ID NO: 45710 - protein, 171 aa, Sorghum bicolor
  Clone ID: SORBI-28MAY03-C6463_1.pep
MEHKEAGCQQPEGPILCINNCGFFGSAATMNMCSKCHKEMIMKQEQAQLAASSIDSIVNGGDGGKGPVIAATVDAAVPQVEEKTIVVQPMHVAETSEAAAVIPKAKEGPNRCATCRKRVGLTGFNCRCGNMYCSVHRYSDKHDCQFDYRTAARDAIAKANPVVKAEKLDKI

SEQ ID NO: 45711 - protein, 263 aa, Sorghum bicolor
  Clone ID: SORBI-28MAY03-C6327_1.pep
MAVGKNKRISKGKKGGKKKTVDPFSKKDWYDIKAPSVFSVRDIGKTLVSRTQGTKIASEGLKHRVFEVSLADLQSDEDQAYRKIRLRAEDIQGRNVLTNFWGMSFTTDKLRSLVKKWQTLIEAHVDVKTTDNYMLRLFCIGFTKRRPNQVKRTCYAQASQIRQIRRKMTEIMSNQASTCDLKELVSKFIPEVIGKEIEKATSSIFPLQNVFIRKVKILKAPKFDIGKLMEVHGDYAKEDVGVKMDRPAEGDEAMGGQEVAAAE

SEQ ID NO: 45712 - protein, 625 aa, Sorghum bicolor
  Clone ID: SORBI-28MAY03-C7578_1.pep
MSPNLDSAIKSQVPALLLRRLFGASRRDEAKQLQRTPAPAPVGRRRVFVQTETGCVLGMDLDRGDNAHTVKRRLQLALNVPTGETSLTFGDRILENDLSFIRPDSPLLLTRNSINRSCSTPCLCPVSKDFEHKDCSGLVEMLGCSSSCARVKRLVDDVVTAIRSGVDPVSISSGLGGSYYFRNVLGDRVAIVKPTDEEPFAPNNPKGFVGRALGQPGLKKSVRVGETGFREVAAFLLDHDNFANVPATALVKITHSIFNINCPVNGGNLAPAHDQQQQVNSKIASFQQFIAHDFDASDHGTSSFPVAAVHRIGILDIRIFNTDRHAGNVLVRKLNGGTGRFGCQTELFPIDHGMCLPENLEDPYFEWIHWAQASIPFSEEELEYIRNLDPTKDVQMLRRELPMIREACLRVLVLCTIFLKEAAAFGLCLAEIGEMMTREFRGMEEEPSQLEVVCMEARKRVAEWEPFSATAEHGEDTDFQFSMDVLGEYNDVMRSPRFSGPGSKGSSFRSPLSKLIESVDEGSDGHEDQIESDRVFYAGWNTPNNPSSSKPIGQNGIASKSAMNRSADEQLPSSMCFVRLSDMSADEWDVFLEKFKELLKEALHESARTAAGQRMKQRLGTSCKF

SEQ ID NO: 45713 - protein, 321 aa, Sorghum bicolor
  Clone ID: SORBI-28MAY03-C7082_1.pep
MTGPMEIPVIDLSGLNGGDEQRSRTLAELHDACKDWGFFWVENHGVDAALMDDVKRFVYGHYEEHLEAKFYASDLAKNLDTATDDGEAEVEPPSDKVDWESTYFIQHHPKTNVADFPEITPACRETLDAYIAQMVSLAERLGECVSLNLGLPPGHVAGTFAPPFVGTKFAMYPSCPRPELVWGLRAHTDAGGIILLLQDDVVGGLEFLKGGTHWVPVGPTKGGRLFVNIGDQIEVLSGGAYRSIVHRVAAGDQGRRLSVATFYNPGPDAVVAPAASIRREDADAAAAYPGPYRFGDYLEYYQGTKFGDKDARFQAVKKLLG

SEQ ID NO: 45714 - protein, 162 aa, Sorghum bicolor
  unsure (1)..(162): unsure at all Xaa locations
  Clone ID: LIB3476-029-P1-K1-B4.pep
MEIPVIDLSGLNGGDEQRSRTLAELHDACKDWGFFWVSNNESYIYTYIAIDKFFLHASCSSPIXSSRAARSQVENHGVDAALMDDVKRFVYGHYEEHLEAKFYAXDLAKNLDTATDDGEAEVEPPSTRVDCGVHYFIQHHPKTNVADFPEITPACRETLDAY

SEQ ID NO: 45715 - protein, 159 aa, Sorghum bicolor
  Clone ID: SORBI-28MAY03-C7025_1.pep
MAEQTEKAFLKQPKVFLSSKKSGKGKKPGKGGNRFWKSIGLGFKTPREAIEGTYIDKKCPFTGTVSIRGRIIAGTCHSAKMNRTIIVRRNYLHFVKKYQRYEKRHSNIPAHISPCFRVKEGDHVIIGQCRPLSKTVRFNVVKVIPAGSAAAGKKAFTAA

SEQ ID NO: 45716 - protein, 127 aa, Sorghum bicolor
  unsure (1)..(127): unsure at all Xaa locations
  Clone ID: LIB5121-010-A1-PF1-D5.pep
MLPAGCGLLSCLRRDKGEAVGRTDPRVADEPASSSTIAAIGQGDDMNRTIIVRMNYLHFDNKYQRYEKRHSNIPAHISPCFRVKEGDHVIIGQCRPLSKTVRFNVXVKSIPAGSAAAVKKVFTAACI

SEQ ID NO: 45717 - protein, 296 aa, Sorghum bicolor
  Clone ID: SORBI-28MAY03-C8037_1.pep
MDGGSCGLEGVPVVTSGGNSPSSAGIPLLPEKRCGSFPETCGAAGGSAGPEGVPVVTSADNSPAHASIPLPCDSADKPCEAAAGSTAPLEAQICTGFSNSISLEVKKGLQKCATFPPTSGQAKQEDGSCCYADDGLKAAPAYERSVSLPQPTLKLIPAMKGGREKNGIASPTENRHVKWAPDVYDPPVTSVCHSVTNSYQRRSKHRKKEKNKQKKKQKGKSKKNQQSSTQNPSAPQVSDLGLKGVSTTGGQSSVDDLSKHEAGIMDYSMGSQEAKCGSSFLRESVAKMHFSIAEAS

SEQ ID NO: 45718 - protein, 268 aa, Sorghum bicolor
  Clone ID: SORBI-28MAY03-C894_1.pep
MASTIMAATSRVVAAKTPFLGQGRAAANASPLRDVAAAASGRITMGNDLWYGPDRVKYLGPFSAQTPSYLTGEFPGDYGWDTAGLSADPEAFARNRALEVIHGRWAMLGALGCITPEVLEKWVRVDFKEPVWFKAGAQIFSEGGLDYLGNPNLVHAQSILAVLGFQVILMGLVEGFRINGLDGVGEGNNLYPGGQYFDPLGLADDPVTFAELKVKEIKNGRLAMFSMFGFFVQAIVTGKGPLENLLDHLDDPVANNAWVYATKFAPGS

SEQ ID NO: 45719 - protein, 180 aa, Sorghum bicolor
  Clone ID: SORBI-28MAY03-C177_3.pep
MDWTGHGGSDGLHGYVQSLDHAVNDLKMYLKKVLAENPGLPCFCFGHSTGGGIILKAALDPEVKTLISGIVLTSPAVRVQPAHPVIAVMAPIFALIAPRYQFTASHRNGPPVSRDPEALRAKYTDQLVFTGAIRVRTGYEILRLTSYLQQHLHRIDVPLLVMHGADDLVTDPKGSRALYE

SEQ ID NO: 45720 - protein, 268 aa, Sorghum bicolor
  Clone ID: SORBI-28MAY03-C177_1.pep
AMRRAREAGREYELIPTARGETLFTQCWCVRPPSSTVKPRALVVVMHGLNEHSGRYDHLARRLNDIGIKVYGMDWTGHGGSDGLHGYVQSLDHAVNDLKMYLKKAALDPEVKTLISGIVLTSPAVRVQPAHPVIAVMAPIFALIAPRYQFTASHRNGPPVSRDPEALRAKYTDQLVFTGAIRVRTGYEILRLTSYLQQHLHRIDVPLLVMHGADDLVTDPKGSRALYEQASSADKSLKLYDGLLHDLLIEPEKDKVMDDIVAWLSPKV

SEQ ID NO: 45721 - protein, 98 aa, Sorghum bicolor
  unsure (1)..(98): unsure at all Xaa locations
  Clone ID: LIB3481-052-Q6-K1-D10.pep
VRLVSGNWNECNLNPLTRYQFTASHRNGPPVSRDPEALRAKYTDHLVTDPXGSRALYEQASCADKSLKLYDGLLHDLLIEPEKDKVMDDIVAWLSPKV

SEQ ID NO: 45722 - protein, 361 aa, Sorghum bicolor
  Clone ID: SORBI-28MAY03-C30651_1.pep
MALAISMEGIDARARELGVDLSAVDLDSITLPAGEDFGILSDDEEVLRSEDPPELEMGLSNIIVVDNLPVVPPEKFEKLENVIRKIYSQIGVIKENGLWMPVNSETKKTYGYCFIEYNTPQEAELAGEKTNGYKLDKSHIFAVNLLDDFEKYLKAPDTWTPAEIKPYTAGEILLKWLTDGQPRDHFVVRRWPTATGEHFMATDIMWDPTGRYLATAVTSVHEMENGFQIWSFNGKHLYKVSKDHFYQFIWRPRPPSLLSPEKEEEISRNLKKYSKKYEQEDQDAFNQLSEQDRKRRTQLQEEWDSWVAKWKQMHEEERAFRMELRDGEASDEEEEYEAKEVEVEEVVDVRQEVLAFDLDQE

SEQ ID NO: 45723 - protein, 172 aa, Sorghum bicolor
  Clone ID: SORBI-28MAY03-C30342_1.pep
MVDVELFYKDTSDHSISSEEEDMLIRSCSNLNVSFGYHCDSSQSFSPENDHGNGISPKNIFGTNTMIGSRNGSFTCLSGAAISANFTLANTNICNGLIGEEILPELDSPNSFRKIVSSPSMSRLDSYSTSQGSPVSTESSIFEISKNLWRSSAPTTVSSNFLTNTEVKMAGG

SEQ ID NO: 45724 - protein, 153 aa, Sorghum bicolor
  unsure (1)..(153): unsure at all Xaa locations
  Clone ID: SORBI-28MAY03-C2808_2.pep
MADVDVEPEVAAGAPKKRTFRKYSYRGVDLDALLDMSTDDLVQLFPARARRRFQRGLKRKPMALIKKLRKAKKDAPAGEKPEPVKTHLRNMIIVPEMIGSIVGVYNGKTFNQVEIKPEMIGHYLAEFSISYKPVKHGRPGIGATHSSRXIPLK

SEQ ID NO: 45725 - protein, 153 aa, Sorghum bicolor
  Clone ID: SORBI-28MAY03-C2808_1.pep
MADVEVDTEVAAAGPKKRTFRKYSYRGVDLDALLDMSTDDLVQLFPARARRRFQRGLKRKPMALIKKLRKAKKDAPAGEKPEPVKTHLRNMIIVPEMIGSIVGVYNGKTFNQVEIKPEMIGHYLAEFSISYKPVKHGRPGIGATHSSRFIPLK

SEQ ID NO: 45726 - protein, 137 aa, Sorghum bicolor
  Clone ID: LIB5050-011-R1-XP1-H1.pep
LSRRSHYASPAAAASRDLDMSTVDLVQLFPARARRRFQRGLKRKPMALIKKLRKAKKDAPAGEKPEPVKTHLRNMIIVPEMIGSIVGVYNGKTFNQVEIKPEMIGHYLAEFSISYKPVKHGRPGIGATHSSRLIPLK

SEQ ID NO: 45727 - protein, 446 aa, Sorghum bicolor
  Clone ID: SORBI-28MAY03-C33551_1.pep
MAAPPATAPATSRCLSGAKPRWAAERSSSSFAISAPAIGLRQSGSRVLSVRAKVATGVQRASIVDDGAERPWKLSDARLVLEDGSVWRAKSFGASGTQVGEVVFNTSLTGYQEILTDPSYAGQFVLMTNPHIGNTGVNPDDEESSQCFLGGLIIRNLSICTSNWRCKETLEEYLIKRNIMGIYDVDTRAITRRLREDGSLIGVLSTDQSQTDNELLEMAQKWKIVGVDLISGVTCDAPYVWSDKTDSEWEFKGDQSSETFHVVAFDFGIKHNILRRLASYGCKITVVPANWPASEVLNLKPDGVLFSNGPGDPAAVPYAVKTVQEIIGKVPVFGICMGHQLIGQALGGKTFKMKFGHHGGNHPVCDLRSGRVDISAQNHNYAVDPESLPEGAKVTHVNLNDNSCAGLQYSKMKLMSLQYHPESSPGPHDSDTAFGEFIELMKSNRL

SEQ ID NO: 45728 - protein, 374 aa, Sorghum bicolor
  Clone ID: SORBI-28MAY03-C3587_1.pep
GAAKHRRIINQAFHLEKLKRMLPAFAACCTDLVRRWEGLVADGQPCEVDVWPEMQNLTGDVISRAAFGSSYLEGRRIFQLQGEQVQLVVQAMHKLHIPGYLYLPTKTNRRMKQIASEIEALLKGSIAKRENALRTGSAASDDLLGLLLESNMEHCRGDGNGNNSKAGITTDDVIGECKLFYFAGMETTSVLLTWTMIVLSMHPEWQDRAREEVLHVFGDKTPDYDGLSRLRIVTMVLYEVLRLYTPLTSVQRQTYKPMELGGVRYPAGVMLMLPLLCIHHDKDVWGPDASEFRPQRFAEGISKASRDAPAFFPFGWGPRTCIGQSFALLEAKMGLSMVLQRFAFQLSPAYTHAPFPHGMLQPEHGAQIMLRALH

SEQ ID NO: 45729 - protein, 292 aa, Sorghum bicolor
  Clone ID: SORBI-28MAY03-C3838_1.pep
MAATSEEVIKQLSALMEQLEEPLKTTFQNVHQGNLRGTLVRFLKAREWSVPKAHKMLMDCLNWRVQNEIDSVLAKPILPSDLYRAIRDTRDRVVLPSASKKFGRQINTCLKVMDMTGLKLSALSQIKMLTMITTVDDLNYPEKTETYYIVNAPYVFSACWKVVKPLLQERTKKKIQVLYASGRDELLKVMDSESLPHFCKREGSGSSRDSLDGVDCYSYDHPFHQQLYNYMKQQSLNQYSAGPRKQGSVHVDVPSPGLEEVKIAETIKAELQNLRGSNGLTHSFNSIQIEGP

SEQ ID NO: 45730 - protein, 383 aa, Sorghum bicolor
  Clone ID: SORBI-28MAY03-C4542_1.pep
MEIVATRSPACCAAVSFSQSYSRPKASRPATTFYGESVRVNTARPLSARQSKAVSRAALTTRCEIGDSLEEFLTKATPDKNLIRLLICMGEAMRTIAFKVRTASCGGTACVNSFGDEQLAVDMLANKLLFEALEYSHVCKYACSEEVPELQDMGGPVEGGFSVAFDPLDGSSIVDTNFTVGTIFGVWPGDKLTGVTGGDQVAAAMGIYGPRTTYIVALKDCPGTHEFLLLDEGKWQHVKDTTTIGEGKMFSPGNLRATFDNPEYDKLINYYVKEKYTLRYTGGMVPDVNQIIVKEKGIFTNVTSPTAKAKLRLLFEVAPLGLLIEKAGGHSSDGKQSVLDKVINELDERTQVAYGSKNEIIRFEETLYGSSRLAAGATVGAAV

SEQ ID NO: 45731 - protein, 265 aa, Sorghum bicolor
  Clone ID: SORBI-28MAY03-C40281_1.pep
MVPIMNVGSIAVEVAGADTTSETSCKAVQKTSVALVERLKPIDENLEAKAGTMQGTATSSSSSGALSDQADRHGRQDGTRGLHCAAELRQREIDGLTGDTTSRRSALVYDCGQSLNPAVDLGQVEGAFIQGVGFFTNEDYATNSDGLVIHDGTWTYKIPTVDTIPKQFNVELINSAHDQKRVLSSKASGEPPLLLASSVHCAMREAIRAARKEFSVCTGPANSTITFQMDVPATMPIIKELCGLDVVERYLESMSAASPTATAQA

SEQ ID NO: 45732 - protein, 141 aa, Sorghum bicolor
  Clone ID: SORBI-28MAY03-C12923_1.pep
GRKSLLITSFSGMGASMLLLALSFTWKALAPYSGTLAVVGTVLYVLSFALGAGPVPALLLPEIFASRIRAKAVALSLGMHWVINFFIGLYFLSVVNKFGISNVYLGFASVCALAVLYIAGNVVETKGRSLEEIERELSVAE

SEQ ID NO: 45733 - protein, 138 aa, Sorghum bicolor
  unsure (1)..(138): unsure at all Xaa locations
  Clone ID: LIB3480-011-P1-K1-F8.pep
STSVFRSAGIASDVAASALGGAANVFGTMIASSLMDKQGRKSLLITSFSGMGASMLLLALSFTWKALAPYSGTLAVVGTVLXGPVPALLLPEIFASRIRAKAVALSLGMHWVINFFIGLYFLSVVNKFGISNVYLGIA

SEQ ID NO: 45734 - protein, 343 aa, Sorghum bicolor
  unsure (1)..(343): unsure at all Xaa locations
  Clone ID: SORBI-28MAY03-C1356_1.pep
MGQKHLLLLACFWVLSCSLLLHASSDGLLRINLNKKKLDKEALTAAKLAKESRLRRSVGAGQYLGASTDDIVPLDNYLDTQYFGEIGIGTPSQNFTVIFDTGSSNLWVPSSKCYFSIACYLHHRYKSTKSKTYKKNGESCTITYGSGQIAGFFSEDNVLVGNLVVQNQQFIETTRETSPTFIIGKFDGILGLGFPEISVGGAPPIWQSMKEQKLVAEDVFSFWLNRDPDASAGGELVFGGVDPKHYKGNHTYVPVTRKGYWQFDMGDLLIGGHSTGYCAGGCAAIVDSGTSLLAGPTTIVAQVNHAIGAEGIISTECKEVVREYGEMXPELLIAQTSPQKVCT

SEQ ID NO: 45735 - protein, 262 aa, Sorghum bicolor
  Clone ID: SORBI-28MAY03-C11258_1.pep
MKFCLLGSPMYQFCYSLCDVTLLLHAYCEFARALDFAVLWDGPAVEKKKKKQDKSSVQTSEKTVAASAPAEADGAAEKNGAVETVKNDKEKKPKKKRKADPPAAGAAPVRATGCVLHDLPRRVRQQLRSKKQGKDDDVEARLEKPELAIINKFEAAEKVNGDGNESREEEPKNQNDGADDRNGAVEKKKKKKKDKSSVETSEKTDAGSAPAEADGAKEKNGAVETVKNDNEKKAKKKRKKCNQEENVQVEGKEAAEKDSDDE

SEQ ID NO: 45736 - protein, 138 aa, Sorghum bicolor
  Clone ID: LIB3478-026-P1-K1-C12.pep
KKAKKKRKKCNQEENVQVEGKEAAEKDSVPKPDDGNKSGMDVDEEHQGKSSNENAVAGKKRKLEEVEGSIVPVTPKEDSTANQSLSNGFAEDKTNEDSNIKPSKRQKKSSEPKSVTPFQRIKVDSVTFADDRLQDNSY

SEQ ID NO: 45737 - protein, 547 aa, Sorghum bicolor
  Clone ID: SORBI-28MAY03-C6036_1.pep
ARGVIAHAGGSALWESTRNHYLKNSISPYLKVVSAMVGNDLMSFVSARPLSSWKETLALLCTFARKEEWHILCDTLASRLVNRTRGLAATLCYICAGNIDKAVEIWSRTLKSEDGGKTYVDLLQDLMEKTITLALATGHKRFSASLSKLVENYAELLASQGLLKTAMEYLKLLGSDEHSQELAILRDRIACSTEENDNARSSVSENTSTPSPYVPNQPYTTPEHPQNVYQVPQPYNVPSTYSEAYPQPTGPYGYNNAYQPPQPANMFVPPSTPANSQQQPGPSPVPVPQQTVKTFTPANPTGLKNPGQYHQPNTLGSQLYTGAANQPYSSGPSAPYPSGPPTTFHQPVSPVQYQPAAPPVSSFGPSAPVPGTPRVRMFPHSAATNSTSRFMPSNNQSFAPRPGLSPAQPSSPTQVQAQPTPPAPPPTVQTADTTKVSAELRPVIGTLTRLFDETSKALGGSQATQAKKREIEDNSRKIGALFSKLNSGDISSNVSSKLIQLCSAIDASDFATAMHLQVLLTTSDWDECNFWLAALKRMIKTRQNFRM

SEQ ID NO: 45738 - protein, 375 aa, Sorghum bicolor
  Clone ID: SORBI-28MAY03-C6597_1.pep
MMLNEDPHNIKKPSRGTRLRSSSGDPSLRRPSPCARAPGGPSAFSLQSPPNCCEMDRGQNRRDDVFRGRDPFAGFGSHRSLISGFFGGRDPFDDPFFTRPFGGQMMGGMFGPSPFGGQMMGEHDMFGPSPFGPMGGPFGDRGNHGFIDQAPPRGNSRRPVITEVDEDEGENAEHGNEQPNQDSYVQEPDDGSDGTEGGQVQLRRDLNRANSGGQPQARTFTYQSSSVTYGGINGAYYTASKTRRTGSDGITVEESKEADTTTKEATHRISRGIHDKGHSLTRKLNSDGKVDTTQTLHNLNEDELAGFEESWKGNAGHYLPGWNQNAGVPNSDNSGNRSSNGRDRRSAWGWALPGTEQGRDPRRNGKPKSRVIPIS

SEQ ID NO: 45739 - protein, 186 aa, Sorghum bicolor
  unsure (1)..(186): unsure at all Xaa locations
  Clone ID: SORBI-28MAY03-C67823_1.pep
MGELIPGLPEEVARECLVRVGFDQLPVVRRISRQWKAEVESPDYHRQRRAEGLARPVLALVQAQPTAPPADDAGPVADKHSTAAAAGSGGGPANSYRMVLLDPVEGRWAPLPPLPGPSESLPLFCQVAAVDGGQGRRKRLVVVGGWHPETWAPTDAVFVYDFLTGAWPXXXPMPGPRRSFFACAAX

SEQ ID NO: 45740 - protein, 299 aa, Sorghum bicolor
  unsure (1)..(299): unsure at all Xaa locations
  Clone ID: SORBI-28MAY03-C6920_1.pep
MDAAALMPPLVVSLLLCLLAAAAPAASAARAFFVFGDSLVDNGNNNYLLTTARADAPPYGIDSPTHQATGRFSNGLNIPDIISEHLGAEPLLPYLSPELRGEKLLVGANFASAGVGILNDTGIQIVNIIMSDVSRXSTLVMCCWMMASQFARSRLIQLSXVFPITLGGNDFVNNYYLVPMSVRSRQYALPDYVRFIISEYRKILSRLYELGARRVIVTGTGPLGCVPAELAMHSXNGECAVELTRAVNLFNPQMVDMVRGLNRDIGADVFVTANTYRMNFDYMHPLNLSTILAVDREGL

SEQ ID NO: 45741 - protein, 211 aa, Sorghum bicolor
  Clone ID: SORBI-28MAY03-C6605_1.pep
MDIGCVDLLCSEAFSYSIRETDAGRAGVSPRFASLPFHRSRALFFSHLISRRGSPEITEKMVKGVAVLAGPDVKGTIFFSQEGDGPTTVTGSISGLKPGLHGFHVHALGDTTNGCMSTGPHFNPAGKEHGAPEDENRHAGDLGNVTAGEDGVVNVNITDSQIPLTGPHSIIGRAVVVHADPDDLGKGGHELSKSTGNAGGRVACGIIGLQG

SEQ ID NO: 45742 - protein, 151 aa, Sorghum bicolor
  Clone ID: LIB5049-001-R1-XP1-G7.pep
MVKGVAVLAGPDVKGTIFFSQEGDGPTTVTGSISGLKPGLHGFHVHALGDTTNGCMSTGPHFNPAGKEHGAPEDENRHAGDLGNVTAGEDGVVNVNITDSQIPLTGPHSIIARAVVVHADPDDLGKGGHELSKSTGTAGGRVACGIIGLQG

SEQ ID NO: 45743 - protein, 102 aa, Sorghum bicolor
  Clone ID: SORBI-28MAY03-C6060_2.pep
AVNCHSFNATVRYISCSIKKKKKKKNTHELQTITLDYRRECQHDDIVDSLTYIEEGEEKSMNGSASAAPHKEERQQFLHCLRFAANGDEINRGRTVWRKLAR

SEQ ID NO: 45744 - protein, 378 aa, Sorghum bicolor
  Clone ID: SORBI-28MAY03-C6060_1.pep
MQQQMPMPPAPAAAAATAPPAAGITTEQIQKYLDENKQLILAILENQNLGKLAECAQYQAQLQKNLLYLAAIADAQPQPPQNPAGRPQMMQPGIVPGAGHYMSQVPMFPPRTPLTPQQMQEQQQQQLQQQQAQALAFPGQMVMRPATINGMQQPMQADPARAADLQQPASVPADGRVSKQDTAAGVSSEPSRDWILKDLANGEVIGRATSKWVTMNQNTRRLQRVSDDVRDEVFIHCPKTPRLAFPEENNGSLKKIPNLSDPAQYSRLGLVPRRADLDMNQHVNNVTYIGWVLESIPQDIIDTHELQTITLDYRRECQHDDIVDSLTYIEEGEEKSMNGSASAAPHKEERQQFLHCLRFAANGDEINRGRTVWRKLAR

SEQ ID NO: 45745 - protein, 210 aa, Sorghum bicolor
  Clone ID: SORBI-28MAY03-C7252_1.pep
MECVLGVVGRDFAVVAADTSAVQSILVHKTDEDKVMVLDSHKLMGASGEPGDRVQFTEFIQKNLHLYQFRNTIPLSTAAAANFTRGELATALRKNPYMVNIILGGYDKDVGASLYYIDYIATLHKIDKGAFGYGSYFCLSLMDKLYRPDMTVEEAVDLVDKCIKEIRLRLVVAPQNFVIKIVDKDGAREYARRELVGDNAPVDAAITVAA

SEQ ID NO: 45746 - protein, 149 aa, Sorghum bicolor
  Clone ID: SORBI-28MAY03-C7207_1.pep
MESTFIMIKPDGVQRGLIGEIISRFEKKGFYLKALKLVNVERSFAEKHYADLSSKPFFQGLVDYIISGPVVAMVWEGKSVVTTGRKIIGATNPLASEPGTIRGDFAVDIGRNVIHGSDSIESANKEIALWFPEGLADWQSSQHPWIYEK

SEQ ID NO: 45747 - protein, 316 aa, Sorghum bicolor
  Clone ID: SORBI-28MAY03-C2375_1.pep
MEIRAQPTSLRLAPPPASASFRRTPLRTSFLKGNVSLKVVQVRQSNVNRFKCNSIRSNLFERLTRVVRSYANSVLSSFEDPEKILEQAVLEMNDDLTKMRQATAQVLASQKRLENKYKAAEQASADWYRRAQLALQKGDEDLAREALKRRKSYADNASSLRSQLDQQKGVVENLISNTKVLESKIAEAKQKKDTLKARAQSAKTATKVSEMLGNVNTSSALSAFEKMEEKVMAMESQAEALGQLATDDLEGKFALLETSSVDDDLSQLKKELSGSSLKGELPPGRAAVSNSGAGRPFPDLEIESELNELRRKAKEY

SEQ ID NO: 45748 - protein, 806 aa, Sorghum bicolor
  Clone ID: SORBI-28MAY03-C254_1.pep
MEPAGARKEWRAVPDSSLRSNGAEDAAEHGKLGQQEDRAIYEEGAGGMEDFCAITIDGSGGLSEDILQQRLQSLARQREELQQVEIELRAQAIAHPQIIEAQQSFQAAAKEHAAAVAKIKEQLHEREHYILELEMKLNDKDRELNALKIDHQTVWANQDLIREQTKELATVRRERDNSEAERAQHLKQIHDLQELLREKESQFIALDEQHRAAQDNILYKDEQLREAHAWVSQVREMDALQSQSLQVELRERMEQFNQYWISFQQQYAEMQRSLLHTIQQLQQELAETRASGAQKDGPQVSREGSAESSHVQSIANSVASNGSATADGNQQLLKNNGSVDVSVKGNNASAVPVPSLLGIGGPAAHIAAMHSFMIHPQGIPQPLASPNSGVPQFGSFQSQSMIQPNSHWSNQQEVQNVSQPQAETNYQTSQSDQTALQQGSINTDDLSSKPSQGIHPDHHNAHAKQQQSPASAPTESTHDLTVVETNVAELVAYDEQQKALKEQDSSSNMNSHIGRVEHQEQNTESKDERAASDKQPEPVSRQHKPSNFPLSTTQIHLKNSATENPNVVNQVDTTKSVASGFGSQLPRVPKEPALLDERSLLACIVRAVPAGPEGGIRISSTLPNRLGKMLAPLHWHDYKKQYGKLDDFVASHPELFVIEGDFIHLREGAQQIISATTAAAKIAAATASSAPYSSLLPSVAVTPVAQSTRQKRGPAVDSRSSNAIPSGNGHTDQFNIIQGVSDVTISGKVRNTQDNGFLDEVRTGQPSMVTAAANGARHDKGANNIRHGYGGKQQGRSTGTTYLSRR

SEQ ID NO: 45749 - protein, 277 aa, Sorghum bicolor
  Clone ID: SORBI-28MAY03-C2425_1.pep
MAVARLRAAAAARLPPALSRGERRPLGTAAEVATTAGPGAARWELMGAREYYDYRRAIYGDITHKAILVDAAGTLLAPTEPMAQVYRTIGQKYGVDYSEDEILMRYRRAYAQPWGRSRLRYVNDGRPFWQYIVSSSTGCSDLQYFEELYQYYTTEKAWHLCDPDAGRVFEALRRAGVKTAVVSNFDTRLRPLLQALKCDGWFDAVAISAEVAAEKPNPTIFLKACELLGVKPEEAVHIGDDRRNDVWGARDAGCDAWLWGSDVYSFKEVAERIGVEV

SEQ ID NO: 45750 - protein, 801 aa, Sorghum bicolor
  Clone ID: SORBI-28MAY03-C748_1.pep
MAGTLLQSVALGTTFGGRISTQRWRSHGARRPASMLAMSLSRPVKMSAFVGLRSVHSFSVTPTVSNSRSTVASYRSSRRTRRSRFVTRAMFERFTEKAIKVIMLAQEEARRLGHNFVGTEQILLGLIGEGTGIAATGLKSMGINLKDARVEVEKIIGRGNGFVAVEIPFTPRAKRVLELSLEEARQLGHNYIGSEHLLLGLLREGEGVAARVLESLGADPSNIRTQVIRMIGETTEAVGAGVGGGSSGNKMPTLEEYGTNLTKLAEEGKLDPVVGRQPQIERVVQILGRRTKNNPCLIGEPGVGKTAIAEGLAQRISTGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIEILRGLRERYEIHHKLRYTDEALIAAAKLSYQYISDRFLPDKAIDLIDEAGSRVRLQHAQVPEEARELDKELKQITKQKNEAVRSQDFEKAGELRDREMELKAQITAFIDKSKELSKAEEESGETGPMVNEADIQHIVSSWTGIPVEKVSSDESDKLLKMEETLHTRVIGQDEAVVAISRSIRRARVGLKNPNRPIASFIFAGPTGVGKSELAKALAAYYFGSEEAMIRLDMSEFMERHTVSKLIGSPPGYVGYTEGGQLEEEDEWEPESPPSLTPSRPRRRPARTGPPPSAASDRAARTIQAHFRRFLARRSRTLRHLKELAVLRSKAAAIRGSLSGRHGGADPAAVSEAAMGLLLRLRRY

SEQ ID NO: 45751 - protein, 247 aa, Sorghum bicolor
  Clone ID: SORBI-28MAY03-C9315_1.pep
LRLARELVYVNFLRRGSDRKQASNNKAQMASSDDGGSSAPRDVPGSYGLPLVGAVRDRLDFYYFQGQDKYFESRVERYGSTVVRINVPPGPFMARDPRVVAVLDAKSFPVLFDMDKVEKKDLFTGTYMPSTSLTGGYRVCSYLDPSEPTHTKVKQMLFSLLLSRKDDVIPTFRSNFSALLATVESQLAKSGGKADFNKLNDVTSFDFIGEAYFGVRPSATDLGSGGPTKAAKWLIWQLHPLVTLGLP

SEQ ID NO: 45752 - protein, 159 aa, Sorghum bicolor
  Clone ID: SORBI-28MAY03-C8666_1.pep
MDSTAAGAGGKAKKGAAGRKAGGPRKKSVSRSVKAGLQFPVGRIGRYLKKGRYAQRVGTGAPVYLAAVLEYLAAEVLELAGNAARDNKKTRIIPRHVLLAIRNDEELGKLLSGVTIAHGGVLPNINPVLLPKKTAEKASTGGSKEAKSPKKAAKSPKKA

SEQ ID NO: 45753 - protein, 248 aa, Sorghum bicolor
  Clone ID: SORBI-28MAY03-C971_1.pep
TRNAKRRGRPPGSGKKKQFEALGHEGIAFTPHILSVKAGEDVASKIMTFSQQGPRTVCILSANGAISNVTLRQPATSGGLVTYEGRFEIISLSGSFLLAEDGDTRSRTGGLSVALAGSDGRVLGGCVAGMLMAATPVQVVVASFIAEGKKSKPAEARKVEPMAAPPPQMATFVPAPVATSPPSEGTSSASSDDSGSPINHSAMPFNHSSQHQHPHQHQHMPPAYASGGWSLSVHQQNRHDSDMKMMSN

SEQ ID NO: 45754 - protein, 703 aa, Sorghum bicolor
  Clone ID: SORBI-28MAY03-C10496_1.pep
MAAMDLLSGKLVRSLRLHSSLLPSAPSSSRAVPTSRRLRRRRHAPLHCRLTTSSSPSTTTTTEVEQDGKSQDLSSLLTSSDPSAPAGAGTKKKRSGGSSSGASSIPSGVRLEGITKSYKGVTVLKDVSWEVQRGEKVGLVGVNGAGKTTQLRIIAGLEQPDGGAVVKAKDNMKIAFLSQEFEVSASRTVREEFFSAFGEEMEVKRRLEQVQAALEGATEDMDLMGRLLDELDLLQRRSQDVDLDMVDVKVQKLMPELGFLPEDADRLVASFSGGWKMRMSLGKILLQDPDLLLLDEPTNHVDLDTVEWLESYLKTQEVPMVIISHDRAFLDQLCTKIVETEFGVSKTYKGNYSEYILAKAVAVQAQYAAWEKQQKEIEQTKELINRLGAGVNAGRASSEQKKLEKLEKEGLIEKPFQRKQLKIRFPERGRSGRTVLAINNLQFGFEDKTLFNNANLIVERGEKIAIIGPNGCGKSTLLKLILGMEKPQGGEVLLGDHNVLPNYFEQNQAEALDLEKTVLDTVSEAAEDWTLDDIKGLLGRCNFRDDMLDRKVQFLSGGEKARLAFCKFMVTPSTLLILDEPTNHLDIPSKEMLEEAISEYTGTVITVSHDRYFIKQIVNRVIEVKDQTIQDYQGDYNYYLERNLEARERELAREEELEEKAPKVKAKSKMSKAEKAVRKKQKMQAFQQSKQKSKSLKNSKRWN

SEQ ID NO: 45755 - protein, 281 aa, Sorghum bicolor
  Clone ID: SORBI-28MAY03-C1080_1.pep
MATDVAETPAPLAEAAPEAPAEAPAAPAAEAKPAKAKKAAAPRKKTNPTHPPYAEMISEAITSLKERTGSSQYAIAKFVEDKHKDKLPPNFRKLLLVQLKKLVAAGKLTKVKNSYKLPAARAPAATKPKPKPKAAPKKPKTGAKKPKAAAKPKAKAPAKAKPAAKPKAPAKAKPAAKPKAAAAKPKAAAKPKAAAKPKAKPAAAKPKPKPKAVAAKPKPAAKKAGRPAKAAKTSAKDTPGKKAPAAKKPAAAAKKSAAKKAAPAKKSAAPARKVPARKAKK

SEQ ID NO: 45756 - protein, 316 aa, Sorghum bicolor
  Clone ID: SORBI-28MAY03-C948_1.pep
MDPALLDDVIRRLLEVKNLKPGKNAQLSESEIKQLCAAAKEIFLSQPNLLELEAPIKICGDVHGQYSDLLRLFDYGGYPPHANYLFLGDYVDRGKQSLETICLLLAYKVKYPENFFLLRGNHECASVNRIYGFYDECKRRFSVKLWKTFTDCFNCLPVSALIDEKILCMHGGLSPELNKLEQILNLNRPTDVPDTGLLCDLLWSDPSNEATGWAMNDRGVSFTFGPDKVNEFLEKHDLDLICRAHQVVEDGYEFFANRQLVTIFSAPNYCGEFDNAGAMMSVDETLMCSFQILKPARKMLGGSTNNKSGFKSLRGW

SEQ ID NO: 45757 - protein, 125 aa, Sorghum bicolor
  Clone ID: LIB3476-022-P1-K1-F10.pep
MDPALLDDVIRRLLEVKNLKPGKNAQLSESEIKQLCAAAKEIFLSQPNLLELEAPIKICGDVHGQYSDLLRLFDYGGYPPHANYLFLGDYVDRGKQSLETICLLLAYKVKYPENFFLLRGNHECA

SEQ ID NO: 45758 - protein, 372 aa, Sorghum bicolor
  Clone ID: SORBI-28MAY03-C13316_1.pep
MAKDGGPDWNGLFKWSIAHGDGTKPPRALSEEDRKWFMEAMQANTIDVVKRMKEITQVMKTPEDVLQSQGVTPENIEDMLDELQEHVESIDMANDLHSIGGLDPLLGYLKNSNAGIRAKAAEVVSTIVQNNPKSQQLVMESNGLEPLLTNFKSDPSTNARTKALGAISSLIRHNQPGISAFRLGNGYAGLKDALGSDDARLQRKALNLIQYLLHNNKADRSVATELGLPKLMMHLASSDDSLVREAALSGLLELAQDKTSGNVLPDQDKLKDILKSRIEGISVMDSDDLHAAREERQLVDSLWKECYNEPSSLREKGLVVLPGEDAPQQLPPDVAGKMFEPPLRAWAAARPAQEDDSDSGSGKKDPPLMLKF

SEQ ID NO: 45759 - protein, 207 aa, Sorghum bicolor
  Clone ID: SORBI-28MAY03-C436_1.pep
TIIADAASKDDIQARIAQLKRELSQTDSAYDSEKLAERIAKLSGGVAVIKVGASTEAELEDRKLRIEDAKNATFAAIEEGIVPGGGAAYVHLSTFVPAIKETLDDPEERLGADIIQKALVAPAALIAHNAGVEGEVIVDKIRESEWEFGYNAMADKHENLVEAGVIDPAKVTRCALQNAASVAGMVLTTQAIVVEKPQKAPAAAAAP

SEQ ID NO: 45760 - protein, 305 aa, Sorghum bicolor
  Clone ID: SORBI-28MAY03-C55592_1.pep
DGEMVIHVAVPALLVRERRGGAEEGREAGEPVAGVGAAARPDLRGGELRIENAGPCAADDDVRRRLERPAVVVGSVDDALRLVDGACPFVAVDVAIEGEVDLVLLPELLQRFPPHELLGRAKTSLEKCERETYNLVDQQKHQLALSSDVIALIFEDCILVLDSRSPQHCGTRNPRLSNDIAKRARRISADLNVDEKHRVGEYYTHTATVMGAVQENRTRRLHVSRVGLGDDLQHASVAGQRLPPGAATTSGCWRGRHGADVHPSEQELPAHDHAARPVRCGVPDGAVLLLHLVWPQNYAGATTTT

SEQ ID NO: 45761 - protein, 56 aa, Sorghum bicolor; identical to SEQ ID NO: 37079
  Clone ID: SORBI-28MAY03-C4402_4.pep

SEQ ID NO: 45762 - protein, 56 aa, Sorghum bicolor; identical to SEQ ID NO: 37079
  Clone ID: SORBI-28MAY03-C4402_3.pep

SEQ ID NO: 45763 - protein, 56 aa, Sorghum bicolor; identical to SEQ ID NO: 37079
  Clone ID: SORBI-28MAY03-C4402_2.pep

SEQ ID NO: 45764 - protein, 56 aa, Sorghum bicolor; identical to SEQ ID NO: 37079
  Clone ID: SORBI-28MAY03-C4402_1.pep

SEQ ID NO: 45765 - protein, 168 aa, Sorghum bicolor
  Clone ID: SORBI-28MAY03-C13936_1.pep
MAAASSATSVHDFTVKDASGKDVDLSTYKGKVLLIVNVASQCGLTNSNYTELAQLYEKYKDQGFEILAFPCNQFGGQEPGTNEEIVQFACTRFKAEYPIFDKVDVNGNNAAPIYKFLKSSKGGLFGDSIKWNFSKFLVDKEGRVVDRYAPTTSPLSIEKDIKKLLGSS

SEQ ID NO: 45766 - protein, 408 aa, Sorghum bicolor
  Clone ID: SORBI-28MAY03-C1480_1.pep
MASAGVAPSGFKNSSSASIGVEKLQDQMNEIKIRDDKEVEATIINGKGTETGHIIVTTTGGKNGQPKQTVSYMAERIVGQGSFGIVFQAKCLETGETVAIKKVLQDKRYKNRELQTMRLLDHPNVVALKHCFFSTTEKDELYLNLVLEYVPETVHRVVKHHNKMNQRMPLIYVKLYMYQICRALAYIHGTIGVCHRDIKPQNLLVNPHTHQLKLCDFGSAKVLVKGEPNISYICSRYYRAPELIFGATEYTTAIDIWSAGCVLAELMLGQPLFPGESGVDQLVEIIKVLGTPTREEIKCMNPNYTEFKFPQIKAHPWHKVFHKRMPPEAVDLVSRLLQYSPNLRCTAVEALVHPFFDELRDPNTRLPNGRFLPPLFNFKAHELKGVPADIVAKLIPEHAKKQCSYVGL

SEQ ID NO: 45767 - protein, 328 aa, Sorghum bicolor
  Clone ID: SORBI-28MAY03-C17233_1.pep
MRAVVITRGGGGPEVLEAQEVEEPAPLGDGEVLLQVAAAGVNRADTLQRHGRHPPPPGAPPYPGLECSGTILALGPNVPPRWSVGDKVCALLSGGGYAEKVVVPAGQLLPVPEGVSLTDAAGLPEVACTVWSTVFMTSHLSPGESFLIHGGSSGIGTFAIQIAKHLGIKVFITAGSEEKLAACKDLGADVCINYKTEDFVERVKQETDGKGVDVILDNIGGPYLQRNLNSLGVDGRLFIIGFQGGAVTEVNLQAVLARRLTIQAAGLRNRSLANKAEIVGEVEKNVWPAVAAGKVKPVIYKTFPLSEAAEAHRLMEASTHIGKILLLP

SEQ ID NO: 45768 - protein, 389 aa, Sorghum bicolor
  unsure (1)..(389): unsure at all Xaa locations
  Clone ID: SORBI-28MAY03-C14215_1.pep
MAAAAASSADGQEVPNKRVILKRYVSGFPSEDDMEVVTGTARLAVPPGTAAMVVKNLYVSCDPYMRGRMTKHDRPSYVPDFVVGEALVNFGVCKVIASGHPDFKVGDLVWGMTGWEEYTFVPKPESFFKINHPELPLSYYTGVLGMPGLTAWAGFFDVGKPKNGDYVFVSAASGAVGQLVGQFAKLTGCYVVGSAGSDEKVSLLKSAASGAVGQLVGQFAKLTGGXGGGGGGPDERARHPPAPVAFDEGLNNDKKPGINVLXNRYFPEGIDIYFENVGGRTLEAVLSNMRNHGRIPTCGMISQYNLEEPEGVHNLFQIVAKRLRMEGFIVMDYYGQYHKFEQEMAGYLKEGKITYVEDIADGLEKAPAALIGLFTGRNVGKQLVAVARE

SEQ ID NO: 45769 - protein, 82 aa, Sorghum bicolor
  Clone ID: LIB3480-014-P1-K1-F12.pep
NYKHYSRLQTISSQHIELQRYGIILNSPGRHISRPHRHTHSRATATSCLPTLRPVKSPMSAAGAFSSPSASSYYIYMWLGEQ

SEQ ID NO: 45770 - protein, 800 aa, Sorghum bicolor
  Clone ID: SORBI-28MAY03-C1637_1.pep
ARPLGYSGAMGVAAVVSHLLMQLQSKAAAFTVLPHPACALPLERMYPLLDVARRGVAALLRAVAMSKIKELQRQIQLEAGQTKGQLMLLKQQVIGLKAKEEEAAKKEVEVERKLKKLKEFEVEVLELRRKNKELLYEKRDLIVKLDAAEGKITESDVVANAREEINKLRHTNEDLTKQVEGLQMNRFSEVEELVYLRWVNACLRFELRNYQTPSGKVSARDLNRTLSPKSQERAKQLMLEYAGSERGHGDTDLESVSSMPPAPGSEDFDNISIDSSSSRYSFLSKRSNLMQKIKKWGRSKDDSSGLASPISGSPLRKPKGPLEALMLKNAGDGTAITTYGKRDPNDVLDDENVASSFQLMSKTVEGFADEKYPAYKDRHKLATEREKVIKEKAGQARAQRFGGGHSSALISSPKGALPPKLAQIKERSPAANAESSEQSSDNQNNTLVVSQMKLANIEKRATRVPRPPPPRSTTASGATNTASGAQTPRAPGAPPPPPPPPGKAGGPPPPPPPPGALPRNLGGGDKVHRAPEIVEFYQSLMKREAKRETSLGSMSSNVSDARSNMIGEIENRSTFLLAVKADVETQGEFVESLANEVRAASFVNIDDVVAFVNWLDEELSFLVDERAVLKHFDWPESKTDAIREAAFEYHDLMKLQSKVSSFTDDPQLACEEALKKMYSLLEKVEQSVYALLRTRDMTVSRYKEYGIPFDWLSDSGVVGKIKLASVQLANKYMKRVASELDALEGTEKEPNREFLLLQGVRFAFRVHQFAGGFDAESMKAFEELRSKMTTQSSAPQISEG

SEQ ID NO: 45771 - protein, 216 aa, Sorghum bicolor
  unsure (1)..(216): unsure at all Xaa locations
  Clone ID: SORBI-28MAY03-C17829_1.pep
RPGRDLGMDVYKIDRACTXFGMPMGPFRLADLVGFGVAVATGMQYLENFSERVYKSMLLPLMMEDNRAGEATQKGFYKYEGKRKATPDPEIMKYIEKSRSMAGVAPDPELLKLSEKDIVEMVFFPVINEACRVLDEGIAVKASDLDIASIFGMGFPPYRGGVIYWADSIGANYIHGKLEEWTKRYGGFFKPCSYLAERAAKGIPLSAPAKKAQARL

SEQ ID NO: 45772 - protein, 217 aa, Sorghum bicolor
  Clone ID: SORBI-28MAY03-C21122_1.pep
MVVATEEMAVYCFDTLVAHYTGEQPPPPAFEDGNHPLFVTWKKVANGSEPRLRGCIGTLEPRQIVSGFKDYSLTSALRDRRFPPIQSKELPTLECTVSILTDYEIAEGYLDWEVGKHGLIIEFTDPEYNIRRSATYLPEVAGHEGWTHAETIDSLMRKAGYQGTITESLRKKIKVTRYQSTLCTMHYGEYVAYLKKNRGAAPSISGVPAVNGFKPGH

SEQ ID NO: 45773 - protein, 381 aa, Sorghum bicolor
  Clone ID: SORBI-28MAY03-C6405_1.pep
MTRMEEIVAHSARRIHPSPLPLFPLVAARAAAMAMASTYAPGGSAGALAPGKGRVRGPAGLGFLSPSKVGGLPRPLALAKRSPVAARLRCAASSSSPAAPAARPVTAPRFIQHKKEAFWFYRFLSIVYDHVINPGHWTEDMRDDALEPAELYSRHLKVVDVGGGTGFTTLGIVKHVNPEKVTLLDQSPHQLEKARQKEALKGVTIMEGDAEDLPFPTDSFDRYISAGSIEYWPDPQRGIKEAYRVLRFGGLACVIGPVYPTFWLSRFFADMWMLFPKEEEYIEWFTKAGFKDVKLKRIGPKWYRGVRRHGLIMGCSVTGVKRQSGDSPLELGPKAEDVSKPVNPITFFFRFLVGTICAAYYVLVPIYMWIKDQIVPKGMPI

SEQ ID NO: 45774 - protein, 373 aa, Sorghum bicolor
  Clone ID: SORBI-28MAY03-C8056_1.pep
MALAFDEFGRPFIILREQEKKTRLRGLDAQKANIAAGKAVARILRTSLGPKGMDKMLQSPDGDVIITNDGATILEQMDVDNQIAKLMVELSRSQDYEIGDGTTGVVVMAGALLEQAEKLLERGIHPIRVAEGYEMASRVAFDHLERISQKFEFTADNIEPLVQTCMTTLSSKIVNRCKRALAEIAVKAVLAVADLERKDVNLDLIKVEGKVGGKLEDTELVYGIIVDKDMSHPQMPKRIEDAKIAILTCPFEPPKPKTKHKVDIDTVEKFQTLREQEQKYFDEMVQKCKDAGATLVICQWGFDDEANHLLMHRNLPAVRWVGGVELELIAIATGGRIVPRFQELSPEKLGKAGLVREKAFGTTKDRMLYIEQC

SEQ ID NO: 45775 - protein, 402 aa, Sorghum bicolor
  Clone ID: SORBI-28MAY03-C9349_1.pep
MSSWSSPSAAAAANTGARFGPFPCRALRLAPYPSLARGAPASPPLVLRSHPHPGGRGHGLLARTGGSSPSSRCRAVAAEVEGLNIADNVTQLIGKTPMVYLNNVVKGSVANVAAKLEIMEPCCSVKDRIGYSMINDAEERGLITPGKSVLVEATSGNTGIGLAFIAASKGYKLILTMPSSMSMERRVLLRAFGAELVLTDAAKGMKGAVDKATEILNKTPNSYMLQQFDNPANPKVHYETTGPEIWEDSKGKVDIFIGGIGTGGTISGAGRFLKEKNPGIKVIGIEPSESNILSGGKPGPHKIQGIGAGFVPRNLDSDILDEVIEISSDEAVETAKQLAVQEGLLVGISSGAAAAAAIKVAKRPENAGKLIVVVFPSFGERYLSTVLYQSIREECENMQPEP

SEQ ID NO: 45776 - protein, 530 aa, Sorghum bicolor
  Clone ID: SORBI-28MAY03-C29482_1.pep
MDRAVMAPPLLVLLLLLLSRCSAAAPRHGAEGWWEEGEGEWRPAEEEEQGKGRGLFVLDRLEKVVESEGGQVRVVRGQPWPPAAAFACRDGLMHIGFITMEPKTLFVPQYLDSSITLFVQRGEVKVGYIHKDELVERKLKMGDVLHIDAGSTFYLVNTGKGQRLQIICSIDASDSLGFFGPPYQAFYLGGAGHPASVIAGFGPKTLTHAFNATYDELASILLAKTGGPIVHYTADVEPEGGGGEEERGQGGNDVLDRGTRCEGARAGAGAGAWRPVGRGDEGDECGSDDDARRPTWSWRKLVNRFIGGGAGGGDTAETNKKGKKKGGATEPYNLYDSEPGFRNSYGWTVSVDKHQYEPLKHPDIGVYLVNLTAGSLLAPHVNPRATEYGVVLGGEGTIQVVFPNGSLAMSEVVRPGDVFWIPRYFPFCQVASRGGPFEFFGFTTSARRNRPQFLVGASSVLRTLLGPEIAAAFGAREEEFSKLVRAQREALIMPSFHASGKEEEEEKHGKKKGRREREEAPVPLVVEQVV

SEQ ID NO: 45777 - protein, 374 aa, Sorghum bicolor
  Clone ID: SORBI-28MAY03-C35159_1.pep
MSGGGMDGAPVAEFRPTVTHNGRFLQYNIFGNLFEITHKYQPPIMPIGRGAYGIVCSVMNFETREMVAIKKIANAFDNHMDAKRTLREIKLLRHLDHENIIGIRDVIPPPIPQAFNDVYIGTELMDTDLHHIIRSNQELSEEHCQYFLYQILRGLKYIHSANVSPRDRSPSSLLRSAMSFLTSGVVAIKNIAYACDMMTEYVVTRWYRAPELLLNSTDYSAAIDVWSVGCIFMELTNRQPLFPGRDHMHQMRLITEVIGTPTDDELGFIRNEDARKYMRHLPQFPRRPFASLFPKVQPVALDLIERMLTFNPLQRITVEEALEHPYLERLHDIADEPICTEPFSFDFEQQALTEDQMKQLIFNEAIEMNPNFRY

SEQ ID NO: 45778 - protein, 301 aa, Sorghum bicolor
  Clone ID: SORBI-28MAY03-C392_1.pep
MRGWREEVEVVALSLRGYGYGNEEDDRPEKPRRYGVTEMRSPFYSFRPANQALQEILDSLGPFVDGLKFSGGCHSLMGKDLVREITDLAHKHDIYVSTGDWAEHLLRQGPSSFKQYVEECKALGFDTIELNPGSLNLPEEALLRLVRLIKSSGLRAKPMFSVKFDSSDIPASGDRAFGAYIAPVKEKTSERVEDVDLLIRRAERCLEAGADMIMIDADDVCQHAESLRTDIIAKIVGRLGLDKTMFEASNPKTSEWFVRRYGPRVNLFVDHSDVMNLERLRGFNMLRSNLGSHVASPFFLM

SEQ ID NO: 45779 - protein, 288 aa, Sorghum bicolor
  unsure (1)..(288): unsure at all Xaa locations
  Clone ID: SORBI-28MAY03-C3680_1.pep
SRANPSPPPPPRTHANAPAHLPSSNXSSSFQMLRVSPSPAAATGLNQLAGAAXPPAPAPVPVRVAAPRGGVSPSAAAACRAAGKGKEVLSGVVFQPFEEIKGELALVPQTPDKSLARHKFVDECEAALNEQINVEYNASYAYHSLFAYFDRDNVALKGFAKFFKESSDEEREHAEKLMEYQNKRGGRVRLQSIVTPLTEFDHPEKGDALYAMELALALEKLVNEKLHNLHGVATRCNDPHLTDFIESEFLEEQVEAINKISKYVAQLRRVGKGHGVWHFDQMLLEEEA

SEQ ID NO: 45780 - protein, 77 aa, Sorghum bicolor
  unsure (1)..(77): unsure at all Xaa locations
  Clone ID: LIB3481-039-P1-K1-G3.pep
VLITMCKPVLMRTREHIHHHALFEQPNPHKGVTCLKSGNPKLTAPIRPHIILSFSAANMFYVKRRXXGGGGATLLYN

SEQ ID NO: 45781 - protein, 377 aa, Sorghum bicolor
  Clone ID: SORBI-28MAY03-C41_1.pep
MDSSGGGGGGGGGGAQIKGMATHGGRYVLYNVYGNLFEVSSKYAPPIRPIGRGAYGIVCAAVNSQTGEEVAIKKVGNAFDNHIDAKRTLREIKLLRHMDHENILALKDVIRPPTRENFNDVYIVTELMDTDLHQIIRSNQPLTDDHCQYFLYQLLRGLKYVHSANILHRDLKPSNLFLNANCDLKIADFGLARTTSETDLMTEYVVTRWYRAPELLLNCSQYTAAIDVWSVGCILGEIVTRQPLFPGRDYIQQLKLITELIGSPDDASLGFLRSDNAKRYMKQLPQFPRQDFRLRFRNMSPGAVDLLERMLVFDPSRRITVDEALHHPYLASLHDINEEPTCPAPFSFDFEQPSFTEAHIKELIWRESLAFNPDPPY

SEQ ID NO: 45782 - protein, 507 aa, Sorghum bicolor
  Clone ID: SORBI-28MAY03-C4143_1.pep
MASSISAAAKASTAFAHKKELAAPAPAQHRAGSSRRTKPCRVRAVASPARAPRAPSSTGSVKSAMTMTEKILARASERAALEPGENVWVDVDVLMTHDVCGPGTIGIFKKEFGEDAKVWDREKVVIIPDHYIFTTDERANRNVDILRDFCLEQNIKYFYDIKDLSNFKANPDYKGVCHVALAQEGHCRPGEVLLGTDSHTCNAGAFGQFATGIGNTDAGFVLGTGKALLKVPPTIRFVLDGEMPPYLLAKDLILQIIGEISVSGATYKSMEFVGSTVESLTMEERMTLCNMVIEAGGKNGVVPADETTFKYLEGKTSVDYEPVYSDAQARFFSDYRFDVSKLEPVVAKPHSPDNRALARECKDVKVDRVYIGSCTGGKTEDFLAAAKVFLASGKKVKVPTFLVPATQKVWMDVYSLPVPGSGGKTCSQIFEEAGCDTPASPSCGACLGGPRDTYARMNEPMVCVSTTNRNFPGRMGHKEGQIYLASPYTAAASALTGYVTDPRDFLM

SEQ ID NO: 45783 - protein, 332 aa, Sorghum bicolor
  Clone ID: SORBI-28MAY03-C3713_1.pep
MASPGPAGAASAAASPSPPMQLPSPFAELVKAPSGLEKIVLRGARNCCAEIYLYGGQVTSWKNDNGEELLFLSSKAIFKPPKAIRGGIPVCFPQFGTHGNLEQHGFARNRFWTIDNNPPPLPVNPAIKAFVDLILKPSEEDLKIWPHSFEFRLRVALGPSGDLSLTSRIRNTYSGGSPFSFSCASHPFFSGSDLRGLRGPGRVATDYLDNLKAKERSTEQGGSLVSESEVDKVYLAAPSKIAIIDHEKKRTFVVTKEGLPDAVVWNPWDKKAKAMQDFGDAEYKSMLCVEPAAVERPITLKPGEEWKGRLVLSAVPSSYCSGQLDPLKVLQG

SEQ ID NO: 45784 - protein, 159 aa, Sorghum bicolor
  Clone ID: LIB3481-027-P1-K1-F5.pep
SGFEFRLRVALGPSGDLSLTSRIRNTNTDGRPFSYTFAYHTYFSVSDISEVRVEGLETMDYLDNLKAKERFTEQGDAIVFESEVDKVYLAAPSKIAIIDHEKKRTFVVTKEGLPDAVVWNPWDKKAKAMHDFGDAEYKSMLCVEPAAVERPITLKPGRE

SEQ ID NO: 45785 - protein, 287 aa, Sorghum bicolor
  unsure (1)..(287): unsure at all Xaa locations
  Clone ID: SORBI-28MAY03-C2380_1.pep
RPPTRTGELNPLQDAAGGKKISINDLVIKAATXALRKVPQCNSSWMNDFIRQYHDVNINVAVQTEHGLFVPVIRDADKKGLGTIAEEVKQLAQKAPGNSLKPADYEGGTFTVSNLGGPFGIKQFCAIINPPQSAILAIGSAEKRRDARSHKKRGAEARRTNSQPPARSDLDLTGGASAAEMMEPEMLRLAPEQMRRMSPVATARMQQQLMSNPNLMRMASESMKNMKPEDLRRAAEQLNQTRPEDIRHLTEKITNTCPEEFAGMKTQADANNSYDRSGAKVLKTWFR

SEQ ID NO: 45786 - protein, 372 aa, Sorghum bicolor
  Clone ID: SORBI-28MAY03-C1830_1.pep
MARAVALAAAVLLAAALALLAAAPAPASAVEFGAEDLASEEALWALYERWRGRHAVARDLGDKARRFNVFKENVRLIHDFNQRDEPYKLRLNRFGDMTADEFRRHYAGSRVAHHRMFRGDRQGSASSFMYAGARDLPTSVDWRQKGAVTDVKDQGQCGSCWAFSTIAAVEGINAIKTKNLTSLSEQQLVDCDTKGNAGCDGGLMDYAFQYIAKHGGVAAEDAYPYKARQASCKKSPAPAVTIDGYEDVPANDESALKKAVAHQPVSVAIEASGSHFQFYSEGVFAGRCGTELDHGVTAVGYGVAADGTKYWVVKNSWGPEWGEKGYIRMARDVAAKEGHCGIAMEASYPVKTSPNPKVRAVVVGDDDSHDEL

SEQ ID NO: 45787 - protein, 214 aa, Sorghum bicolor
  Clone ID: SORBI-28MAY03-C15636_1.pep
MSIKYCDQHKDCERQRLYRRFCAALVGIILLLLLIVLIVWLVLRPTKPRFFLNDVSIVCINVSSASYLTVTMQATLASRNTNDRVGIYYDRADVYAEYRAMQITVPTSLPPFFQPPNDATVWAPFLSASNVPLPAYLATALTQDETAGYLLVTIRVDGWIRWKAGAFITSHYHLRVRCPALLTVNDGQGSYGSNAGGGLGYFKFQRAAPCIVDV

SEQ ID NO: 45788 - protein, 445 aa, Sorghum bicolor
  Clone ID: SORBI-28MAY03-C44665_1.pep
MASELTYRGGGPSAAASAGAGGYSPKPSKPLAWLPRAARYAVAHEGPLFALAGMLIAAAVISIASPSASSTSTTGSAAAVSSYSNNNNNNPLARFSVEPAHHRDVATRHFVGGKVPLGLKRKALRVLVTGGAGFVGSHLVDRLLERGDSVIVVDNFFTGRKDNVLHHLNDPNFEMIRHDVVEPILLEVDQIYHLACPASPVHYKYNPIKTIKTNVVGTLNMLGLAKRINAKFLLTSTSEVYGDPLQHPQVETYWGNVNPIGVRSCYDEGKRTAETLTMDYHRGANLEVRIARIFNTYGPRMCIDDGRVVSNFVAQALRKEPLTVYGDGKQTRSFQYVSDLVEGLMKLMEGDHVGPFNLGNPGEFTMLELAKVVQDTIDPNAQIEFRQNTQDDPHKRKPDISRAKELLGWEPKIPLREGLPLMVSDFRKRIFGDQDAAATTGNQQG

SEQ ID NO: 45789 - protein, 220 aa, Sorghum bicolor
  Clone ID: SORBI-28MAY03-C56131_1.pep
MSVVAAVGPGAAAAAAAAAGAYGHGQPLCGGGGGGARKRKDVGVVQDQEAGLRGSHVGAAAPRRGAGLFVLETVEEEAEADMWSSRAAVPVAVVVDGVQGDPARPSSSTTKGAALASMDMDALDDALPIKRGLSNFFSGKSRSFANLQDAASAVTSARDLAKPENPFNKRRRVLRCCSIRRVASTSLTELPPFFLPPTTDPGSTGDDDDGCGAGGRRHSG

SEQ ID NO: 45790 - protein, 274 aa, Sorghum bicolor
  Clone ID: SORBI-28MAY03-C4359_1.pep
MAERGGERGGERGGFGRGFGRGGRGDRGGRRGGRRGPRQEEEKWVPVTKLGRLVKESKINKIEEIYLHSLPVKEHQIIETLVPGLKDEVMKITPVQKQTRAGQRTRFKAFVVVGDGDGHVGLGVKCAKEVATAIRGAIILAKLSVVPVRRGYWGNKIGQPHTVPCKVTGKCGSVTVRMVPAPRGSGIVAARVPKKVLQFAGIEDVFTSSRGSTKTLGNFVKATFDCLMKTYGFLTPEFWTQTKFSMTPFQQFTDLLGKPTKGLVLEAPTETAEA

SEQ ID NO: 45791 - protein, 111 aa, Sorghum bicolor
  Clone ID: LIB3476-015-P1-K1-E7.pep
MAERGGERGGDRGGRRGGRRGPRQEEEKWVPVTKLGRLVKESKINKIEEIYLHSLPVKEHQIIETLVPGLKDEVMKITPVQKQTRAGQRTRFKAFVVVGDGDGHVGPGVKC

SEQ ID NO: 45792 - protein, 227 aa, Sorghum bicolor
  Clone ID: SORBI-28MAY03-C5772_1.pep
LHEAERPPRRPYERHSGTGRGFEMKREGSGRGNWGTTTDEFIARETEEGLKLEEKAPVPEKQGALEDTPQAEENKENKDATANEEEEKEEDKEMTLEEFEKIREEKRKSLLALKTEERKVEVDRDLQSMQPLANKKGNDEIFVKLGSDKDALKKKENAERDERAKKSVSINEFLKPAEGERYYGGRGRGRGRGDRGGFRGGYGGGYHAPPAAPAIQDQSQFPSLGGK

SEQ ID NO: 45793 - protein, 173 aa, Sorghum bicolor
  Clone ID: SORBI-28MAY03-C515_1.pep
MASILVTTTTATAILLCVLFCAAAANTTVANDPNLPDYVIQGRVYCDTCRAGFVTNVTEYMAGAKVRLECKHFGTGEVERAIDGVTDATGTYTIELKDSHEEDICQVVLVQSPRKDCDQTQPLRDRAGVLLTRNVGIADSLRPANPLGYFKDVPLPVCAALLKQLDSDNDDDQ

SEQ ID NO: 45794 - protein, 60 aa, Sorghum bicolor
  Clone ID: LIB3480-042-P1-K1-D12.pep
RFTTVKKKKKKKKKKKKKKKKRGAARDLERAIDGVTDATGTYTIELKDSHEEDICQVVLV

SEQ ID NO: 45795 - protein, 93 aa, Sorghum bicolor
  Clone ID: LIB3480-007-P1-K1-H7.pep
RRPPPPPSSYASSSVPRRLTPPSPTTPQSKKTPRKDCDQTQPLRDRAGVLLTRNVGIADSLRPANPLGYFKDVPLPVCAALLKQLDSDNDDDQ

SEQ ID NO: 45796 - protein, 146 aa, Sorghum bicolor
  Clone ID: LIB3480-038-P1-K1-E5.pep
GGRSGEDATASAGRRNPSGRSGCTGSRGRGTGTPPCRSSRRQHRPSILVTTTTATAILLCVLFCAAAANTTVANDPNLPDYVIQGRVYCDTCRAGFVTNVTEYMAGAKVRLECKHFGTGEVERAIYGVTDATGTYTNELKDSHEED

SEQ ID NO: 45797 - protein, 248 aa, Sorghum bicolor
  Clone ID: SORBI-28MAY03-C5818_1.pep
KLHFSLRNLPKAKASLTAARTAANAIYVPPAQQGTIDLQSGILHAEEKDYKTAYSYFFEAFEAFSALEDPKAIFSLKYMLLCKIMVNQADDVAGIISSKAGLKYLGPDVDAMKAVADAYSKRSLKYFETALRDYKAQLEEDPIVHRHLSSLYDTLLEQNLCRLIEPYSRVEIAHIAEMIELPINHVEKKLSQMILDKKFAGTLDQGAGCLIIFEDSKTEEIFPATLETITNVGKVVDSLYMRSAKIMA

SEQ ID NO: 45798 - protein, 541 aa, Sorghum bicolor
  unsure (1)..(541): unsure at all Xaa locations
  Clone ID: SORBI-28MAY03-C5825_1.pep
MAGHRNSHGKRHSDYTENGGGKRRNPGDDTYAPGPDDTVYRYLCASRKIGSIIGRGGEIAKQLRTETQAKIRIGESVPGCDERVIAISSSSWKTTTIDDAVDTLSPLPDAHLPRHXKFGPCLLVCLPKPHDQESPXLEALIKRTYVDAIDHLIXSHYITHVFLWAYVFSPAVNXRTPSCAMGAVEPPRISWFEAGVRKALHQVSSRLHDNPSKSQHHLASSLTQPYPGSTTHLGGSSTAPVVGITPVIPPYGGYKGDAAGERAALYQPRRDESSAKEFSLRLLCAAANVGGVIGTDAWVIKQIRQESGALIKVASSNSDPDDDCIITVSAKEFFEDPVSPTIDAAVRLQPRCSEKSDSESAEQSYTTRLLVSTSRIGCLIGKGGSIITEIRRTSRANIRILSKENVPKVAAEDEEMVQISGGLDVARHALVQIATRLKANFFEREGSLSAFPSVIPYHPLPSGASDEPKYLSRDTKPVGHYLYSSAFRTSDDMIPSDSYAGYGGSQALGGGYGAYSGYSARSSGSGLSGHSSLHYGKRHGY

SEQ ID NO: 45799 - protein, 117 aa, Sorghum bicolor
  Clone ID: LIB3480-016-P1-K1-C10.pep
CKENQVVYGIHIGPLNNSLQNGLSWSSGLGRGTNKQAPNFNVLAVFSTGGEKGGAKVKRTGPSDSRAALSSNLNPNNHDAFHSEENYDQITHYQRSEHCIRCKPHILLQVPGSHHNL

SEQ ID NO: 45800 - protein, 359 aa, Sorghum bicolor
  Clone ID: SORBI-28MAY03-C7079_1.pep
PGGSSFPEALGFRSPPPHPSRSLPPHPSPPRPRRRRRERAPDPDPGDMPRYDDRYGNTRLYVGRLAPRTRSRDLEYLFSKYGRIREVELKRDYAFIEFSDPHDADEAQYNLDGREVDGSRIIVEFAKGVPRGSGGSREYMGRGPPPGTGRCFNCGIDGHWARDCKAGDWKNKCYRCGERGHIERNCQNSPRILRRERSYSRSPSPRRGRGRSRSYSRSRSYSRSRSPSGSPRGGRRERDERRSRSLSYSRSASPRRSVSPAKEKERSRTPDGSRSPRSPSPRDDVSPPPKDNGAHNGSDREDSPGARENSKRSRSPSDGYRSPAANGRSPSPRDDRSPSPKGNNGDDERRGSPRGSQSP

SEQ ID NO: 45801 - protein, 299 aa, Sorghum bicolor
  Clone ID: SORBI-28MAY03-C7480_1.pep
MSSKKIELDHKDIVHDSAIDYYGKRLATASSDSTVKIVNIGAANAPSQVLATLSGHCGPVWRVAWAHPKYGAILASCSYDGRVIIWKEDARGNWSQAHVFSDQKASVNSIAWAPYEVGLCLACASSGGRISILTMRADGGWDTSTIERAHPVGATAISWAPATASLAGAGELVYKLVSGGFDSVVKVWGFNDGSWKLEGALISDMHTDCVRDVAWAPVLGLAKSTIASGSQDGKVVIWTKAKDGDKWEGKLMRDFGAPVWRVSWSLTGNILSIAAGENNITLWKEGSDGQWEEVMKVEP

SEQ ID NO: 45802 - protein, 231 aa, Sorghum bicolor
  Clone ID: SORBI-28MAY03-C37047_1.pep
MPACHHWRGLELGRAEHGVSDMAALWLSRASTQLARRAARRLPAGRGSGEPTTSPWFLGAVPPPALGSTAAVETSRRRGFCSVRRFAGESSAAAATVVDEEEPENGFVAGDQQAVHFPGGKVSFVAEMNFLPDSMKERINCYRVLDDDGRTISGSRFQEVSKELAVKMYSEMVTLQIMDTIFYEAQRQGRISFYLTSNGEEAINIASAAALSMDDIVLPQYREPGVLLWRG

SEQ ID NO: 45803 - protein, 463 aa, Sorghum bicolor
  Clone ID: SORBI-28MAY03-C41856_1.pep
MAGDPPTAAEKETLVSSFLEIAAGQTPETATQFLQMTSWHLEEALQLFYIDGESALGAAHPAVPPPAAAAASASALAAAAGVEEAMRFAPPPAAALGDAMSHGFGVGEDDDVRAPLPVKRETLYGEGIVSVMRPNASAAFRNFEQEARQSAVWDSDQNATSSSGVLPASLCRPPGAVMFNGPFDKAKLEASSLDKWLLINLQSTEEFSSHMLNRAPGGNEAVAQLIRSNFIFWQVYYDTSEGRKVCTYYHLVSMPAILLIDPVTGQKMHAWNGMVHPDRLLEDLLPYLDKGPKEHHAAQPQKRPRKVDQEASTGKQGKIAVEDEDEELARAVAASLEEGKEIIEASDASDDMAEAEPQVDNEPSLNIKPDYPPLPEEPTGSRDRLCRVAIRLPNNRRIQRNFLHTDPIKLLWSFCAPQVEDGEKRAFHFVQAIPGASQKLEFRSDQTFKEAGLANSMINLLWD

SEQ ID NO: 45804 - protein, 495 aa, Sorghum bicolor
  unsure (1)..(495): unsure at all Xaa locations
  Clone ID: SORBI-28MAY03-C6179_2.pep
NENTMIDLAPTKTNPLPDKKYSTLVSLSGHLFDKFLINEALDIIETGGGSFHLVRCQVGQSMDDMSYSELEVGADDTATLDKIIDSLTSLANEHGGDHDAGKETELALKIGKVNECETDATVDKGGPKVLILGAGRVCRPAAEFLASYPNICTYGVDGPRTDQIHVIVASLYQKDAEETVDGIENTTATQLDVSDIGSLSDLVSQVEVVISLLPTSFHAAIARVCIELKKHMVTASYVDESMSNLSQAAKGAGVTILCEMGLDPGIDHLMSMKMIDEAHARKGKIKTFTSYCGGLPSPAAANNPLAYKHRTSPXFSWNPAGALRAGKNPAVYKFLGETIHVDGPNLFESAQVLGAPELPATALERRPKGSTQEHGALAGPPSATSTFCFRGVRYEGSSAVRATVTQNGLEEAADQGLGHGRNRPTSEGPLVITQTSTLLPLPRSLKIPARIASDTSSIPSSLVSPSLYFDSNTDIAAREPEPIVAKGRVSVEPCG

SEQ ID NO: 45805 - protein, 160 aa, Sorghum bicolor
  Clone ID: SORBI-28MAY03-C6179_1.pep
RPGRVIARLSKLGCCRDKEIAAKTVKTIKFLGLHEETQIPKGCSSAFDVICQRKEQRMAYGHNEQDMVLLHHEVEVEYPDGQPTEKHQATLLEFGKVENGRSTTAMALTVGIPAAVGALLLLQNKVQTKGVIRPLQPEIYIPALEILESSGIKLIESVEI

SEQ ID NO: 45806 - protein, 172 aa, Sorghum bicolor
  unsure (1)..(172): unsure at all Xaa locations
  Clone ID: LIB5049-005-R1-XP1-E1.pep
MTGSMDLPAKGGFSFDLCRRNNMLEKNGLKLPGFRKTGTTIVGLVFQDGVVLGADTRATEGPIVADKNCEKIHFMAPNIYCCGAGTAADTEAVTDMVSSQLQLHRYATGRESRVVTALTLLKSHLFRYQSHVSAALXVLGGVDCTGPLLHTVXYPHGSTDTLPFAPKGFWIP

SEQ ID NO: 45807 - protein, 135 aa, Sorghum bicolor
  Clone ID: SORBI-28MAY03-C9446_1.pep
MTFKRRNGGRNKHGRGHVKYIRCSNCAKCCPKDKAIKRFQVRNIVEQAAIRDVQEACVHDGYVLPKLYAKVHHCVSCAIHAHIVRVRSREKRRDRKPPERFRRREDRPAGGQGGPRPGPGPAGAAPAPAPVAARP

SEQ ID NO: 45808 - protein, 119 aa, Sorghum bicolor
  Clone ID: SORBI-28MAY03-C10614_2.pep
GRRRRSGEKERDETLAHSSARLLHHHSFGSQPQGSRRRRCTTRRQPRRCPISSTCRGATRRRAASTPASSRRCAASAATRPASAASTASAAAATSLTSGSRGGSTCRSMEIASVSLLPT

SEQ ID NO: 45809 - protein, 127 aa, Sorghum bicolor
  Clone ID: SORBI-28MAY03-C10614_1.pep
SAGRAGSAVHKVGRQLKQKQRSVNTCCCFTTVPEEERRSQPGSEPRCITRRRRRRTCPTTSTARSATRRRAASTDASSRRCAASAATRPASAASTASAAAATSLTSGSRGGSTCRSMEIASVSLLPT

SEQ ID NO: 45810 - protein, 262 aa, Sorghum bicolor
  unsure (1)..(262): unsure at all Xaa locations
  Clone ID: SORBI-28MAY03-C1077_1.pep
MRECISVHIGQAGIQVGNACWELYCLEHGIQPDGQVPGDKTAGHHDDAFSTFFSQTGAGKHVPRAIFVDLEPTVIDEVRTGTYRQLFHPEQLISGKEDAANNFARGHYTIGKEIVDLCLDRIRXAPCRLLCRGDVVPKDVNAAVAIIKTKRTIQFVDWCPTGFKCGINYQAPTVVPGADLAKVQRAVCMISNSTSVVEVFSRINSKFDLMYAKRAFVHWYVGEGMEEGEFSEAREDLAALEKDYEEVAAEGGGDDGEEDEEY

SEQ ID NO: 45811 - protein, 321 aa, Sorghum bicolor
  unsure (1)..(321): unsure at all Xaa locations
  Clone ID: SORBI-28MAY03-C10671_1.pep
RHVPRALFVDLEPTVIDEVKTGAYRQLGDPEQLISHKEDAANNFARGHYTVGREVVDLCLDRIRKLADNCTGLQGFLVFNAVGGGTGSGLGSLLLERLSVDYGRKSKLGFTIYPSPQISTAVVEPYNSVLSTHSLIEHEDGAGLFGPQASSLPFPASELPRLHNLIQRQSEXREEGREMREIISIHIGQAGIQVGNSCWELYCLEHGIQPDGLMPSDNSVGVAREAGNTFLSETSVPRRVLAKVQRAVCMISNNTAVAEVFSRIDRKFDLMYAKRAFVHWYVGEGMEEGEFSEAREDLAALEKDYEEVGAEVEDDDEEAEY

SEQ ID NO: 45812 - protein, 897 aa, Sorghum bicolor
  unsure (1)..(897): unsure at all Xaa locations
  Clone ID: SORBI-28MAY03-C1107_1.pep
MSGHDSKYFSTTKKGEIPELKEELNSQYKDKRKDAVKKVIAAMTVGKDVSSLFTDVVNCMQTENLELKKLVYLYLINYAKSQPDLAILAVNTFVKDSQDPNPLIRALAVRTMGCIRVDKITEYLCDPLQRCLKDDDPYVRKTAAICVAKLYDINAELVEDRGFLEALKDLISDNNPMVVANAVAALAEIQDSSVRPIFEITSHTLSKLLTALNECTEWGQVFILDSLSRYKAADAREAENIVERVTPRLQHANCAVVLSAVKIILLQMELITSTDAGRNLCKKMAPPLVTLLSAEPEIQYVALRNINLIVQKRPTILAHEIKVFFCKYNDPIYVKMEKLEIMIKLASDRNIDQVLLEFKEYATEVDVDFVRKAVRAIGRCAIKLERAAERCISVLLELIKIKVNYVVQEAIIVIKDIFRRYPNTYESIIATLCESLDTLDEPEAKASMIWIIGEYAERIDNADELLESFLETFPEEPALVQLQLLTATVKLFLKKPTEGPQQMIQAVLNNATVETDNPDLRDRAYIYWRLLSTDPEAAKDVVLAEKPVISDDSNQLDSSLLDELLANISTLSSVYHKPXESFVTSVKAAPRADDEEFADTAETGYSESPSQGVDGASPSSSAGTSSNVPVKQPAAGSPPPAAMPDLLGDLMGMDNAIVPVDEPAAPSGPALPVLLPSTTGQGLQISAQLTRRDGQIYYDISFENGTQGVLDGFMIQFNKNTFGLAAGEALQVTPLQPGQSTRTLLQMIPFQNISPGAPNSLLQVAVKNNQQPVWYFNDKIPLHVFFGEDGKMERAGFLEAWKSLPDDNEFTKEFPGSIISSIDATVERLAASNVFFIAKRKNANMDVLYLSAKMPRGIPFLIEVTASVGVPGVKCAVKTPNREMVPLFFEAMEALTK

SEQ ID NO: 45813 - protein, 221 aa, Sorghum bicolor
  Clone ID: SORBI-28MAY03-C866_1.pep
MSRRGDWVYENNGGTCVAIAGADYCVVAADTRLSVGYSILTRDHSKICDLADKCVLASSGFQGDIKALHKNLAARELLYQHQHNKRMSCPAMAQLLSNTLYYKRFFPYYAFNVLGGLDSEGKGCVFTYDAVGSYERTGYSAQGTGSTLMMPVLDNQLKSPSPLLLPARDAVTPLSESEAIDLVKDVFASATERDIYTGDKLEIVVINKAGTKREYIELRKD

SEQ ID NO: 45814 - protein, 239 aa, Sorghum bicolor
  Clone ID: LIB5049-008-R1-XP1-H9.pep
MSRRGDWVYENNGGTCVAIAGADYCVVAADTRLSVGYSILTRDHSKICDLSLFVCRADKCVLASSGFQGDIKALHKNLAARESLYQHQHNKRMSCPAMAQLLSNTLYYKRFFPYYAFNVLGGLDSEGKGCVFTYDAVGSYERTGYSAQGTGSTLMMPVLDNQLKSPSPLLLPARDAVTPLSESEAIDLVKDVFASATERDIYTGDKLENVVINKAGTKREYIELRKTKPRFSNAAAAIC

SEQ ID NO: 45815 - protein, 388 aa, Sorghum bicolor
  Clone ID: SORBI-28MAY03-C12337_1.pep
MEQQQVRGRRRRNGVLQVQDGSEIRSLVENKEAFTRFVDDRFQKLDADGDGRLSVRELQPAVADIGAAIGLPARGSSPQADHIYAEVLNEFTQGKQDSVSKPEFQRVLSDILLGMAAGLKRDPIVILRINGEDLNEFVESPRDEPEALAIFSQVGVAVGAGAPPPAPPKLAQRRRAALGQPTVDHGMPPASDSWVMENVVEPALQELSANQLDQPVSQEVFFQEFRKFLGIMALRLQQHPVIVAHTENTFDGSGIRRLLSNKFELDKLLDSVWRDVPKEHKDKTSKEYLRIALDRIADSASLPPFGAVDQVDAVVNEAFKMAKADEMKAVDEAEFKKLLTEILGAIMLQLDGNPIGVSTNTVVHEPMSTSSALLSPTPLSPMVSSPSE

SEQ ID NO: 45816 - protein, 115 aa, Sorghum bicolor
  Clone ID: SORBI-28MAY03-C6324_3.pep
MSTVSRASLDQKLALAKRCSREATMAGFKAAAVATVASAVPTLASVRMLPWAKANINPTGQALIISTVAGMAYFIAADKKILSLARRHSFENAPEHLKNTSYQGTGRPHPAFFRP

SEQ ID NO: 45817 - protein, 117 aa, Sorghum bicolor
  Clone ID: SORBI-28MAY03-C6324_2.pep
MPNTTVTSASVDQNLALAKQCSREAAIAGFKAAAIGTVASGIPTLVSVRMLPWAKANINPAGQALIISTVAGMAYFIAADKKILALARQHSYENAPDHLKDTSLEGTGRPHPGFFRP

SEQ ID NO: 45818 - protein, 115 aa, Sorghum bicolor
  Clone ID: SORBI-28MAY03-C6324_1.pep
MSTVSRASLDQKLALAKRCSREATLAGAKAAAVATIASAIPTLASVRMLPWAKANINPTGQALIISTVAGMAYFIAADKKILSLARRHSFEEAPEHLRNTSFQGTGRPHPAFFRP

SEQ ID NO: 45819 - protein, 115 aa, Sorghum bicolor
  Clone ID: LIB5121-011-A1-PF1-D11.pep
MSTVTRASLDQKLALAKRCSREATLAGAKAAAVATIASAIPTLASVRMLPWAKANINPTGQALIISTVAGMAYFIAADKKILSLARRHSFEGAPEHLRNTSFQGTGRPHPAFFRP

SEQ ID NO: 45820 - protein, 206 aa, Sorghum bicolor
  Clone ID: SORBI-28MAY03-C8064_1.pep
MASRRRTLLKVIILGDSGVGKTSLMNQYVNKKFSNQYKATIGADFLTKEVQFEDRLFTLQIWDTAGQERFQSLGVAFYRGADCCVLVYDVNSMKSFDNLNNWREEFLIQASPSDPDNFPFVLLGNKVDVDGGNSRVVSEKKAKAWCASKGNIPYFETSAKDGTNVEDAFQCIVKNALKNEPEEELYVPDTVDVVGGNRAQRSSGCC

SEQ ID NO: 45821 - protein, 249 aa, Sorghum bicolor
  Clone ID: SORBI-28MAY03-C8069_1.pep
MARYDRAITVFSPDGHLFQVEYALEAVRKGNAAVGVRGVDTVVLGVEKKSTPKLQDSRSVRKIASLDTHIALACAGLKADARVLINRARVECQSHRLTVEDPVTVEYITRYIAGLQQKYTQSGGVRPFGLSTLIVGFDPYTQKPALYQTDPSGTFSAWKANATGRNSNSMREFLEKNYKETSGKETIKLAIKALLEVVESGGKNIEIAVMTHKDGLRELEEAEIDEYVAEIEAEKAAAEAAKKGAPREN

SEQ ID NO: 45822 - protein, 325 aa, Sorghum bicolor
  Clone ID: SORBI-28MAY03-C69248_1.pep
MATFTCRSMAFLSLAAAVLVALLTAGAADAQKLSPNFYSKTCPNVATIVRQQMASAVAAEKRMGASILRMFFHDCFVNGCDGSILLDDTSTFTGEKGAGPNANSVRGFEVIDAIKTKVEASCKATVSCADILALAARDGVNLLGGPTWSVPLGRKDSRTASQSLANSNLPGPGSSLATLIRMFGNQGLSARDMTALSGAHTIGRSQCQFFRSRIYTESNINASFAALRQKTCPRSGGDATLAPFDVQTPDGFDNAYYQNLVAQKGLLHSDQELFNGGSQDALVRQYSTNANQFSADFVSAMIKMGNLMPSSGTPTEVRLNCRKTN

SEQ ID NO: 45823 - protein, 490 aa, Sorghum bicolor
  unsure (1)..(490): unsure at all Xaa locations
  Clone ID: SORBI-28MAY03-C6146_1.pep
SHSPPRPPAPFASFRHPRTPSSRSPHRRFALPGDPGPSRRSRRGDEEYDVIVXGTRGLKECILSGLLSVDGLKVLHMDRNDYYGGDSTSLNLNQLWKRFRGEDKPPAHLGASRDYNVDMVPKFMMANGTLVRTLIHTDVTKYLSFKAVDGSYVFSKGKIHKVPATDMEALKGLFMERCARRCARYVLVYVQDDHEADQGTHLTIXHTKITTRELISKHGQSDDTXHALALHRDDRYLDEPALDTVKRMKLYAESLARFSGAFSRSHPXIYPLYGLGXRPPACSRLSAVYGGTYMLNKPECKVEFDMEXGKVCGVTSEGETAKCKKVVCDPSYLPSKVRKIGKVARAIAIMSHPIPNTNESHSIQIILPQKQLGRKSDMYVFCCSYTHNVAPKGKFIAFVSAEAETNNPQSELKPGIDLLGQVDELFFDMYDRYEPVNEPSLDNCFVSTSYDATTHFETTVTDVLSMYTAITGKTVDLSVDLSAASAAEEY

SEQ ID NO: 45824 - protein, 100 aa, Sorghum bicolor
  Clone ID: SORBI-28MAY03-C981_1.pep
MSRGGSAGGGQSSLGYLFGSGEPPKPAVAPPAACAPPAEKPSAAKPDATKQVAAGVTSQTNNYHRADGQNTGNFLTDRPSTKVHAAPGGGSSLGYLFGGN

SEQ ID NO: 45825 - protein, 148 aa, Sorghum bicolor
  Clone ID: SORBI-28MAY03-C10043_1.pep
AQEPQEGRRWRASDHHQHQHAGGDEEGPVDGRGGRAAGLRRTGKSCRLRWVNYLHPGLRRGRITADEERRIVELHAQWGSRWSRIARSLPGRTDNEIKNFWRTRTRKKALEQAVSPCCFFFFFLSSFFLSIDRSSIQAWSLFLSLEEV

SEQ ID NO: 45826 - protein, 90 aa, Sorghum bicolor
  Clone ID: LIB3478-009-P1-K1-E6.pep
MSSSLLCRRRNHKKDGDGEHQIIISTSTPAAMRKGPWTDEEDEQLVRFVRLFGERRWDFLAKVSGLRGGGCVDRSIHACPAICNSACMRA

SEQ ID NO: 45827 - protein, 378 aa, Sorghum bicolor
  Clone ID: SORBI-28MAY03-C11023_1.pep
MASSTSAMPEAKEKLKRSGSLGSNDTYVRADKIDLTSLDIQLEKQLTKTWGKANLKSQGPKEEWEIDLAKLEIRYVIAQGTYGTVYRGTYDGQDVAVKLLDWGEDGFATEAETAALRTSFKTEVAVWHKLSHPNVTKFVGASMGTTDLKIPANNSNGGARTNFPARACCVVVEYLAGGTLKQYLIKNSRRKLAYKVVVQLALDLARGLSYLHSRKIVHRDVKSENMLLTPQRNLKIADFGVARVEAQNPKDMTGATGTLGYMAPEVLDGKPYNRKCDVYSFGICLWEIYCCDMPYPDLSFADVSSAVVHQNLRPDIPRCCPSAFANVMRKCWDANPDKRPDMDEVVQLLEALDTSKGGGMIPDGQSSGCLCFTKARGP

SEQ ID NO: 45828 - protein, 146 aa, Sorghum bicolor
  Clone ID: SORBI-28MAY03-C6741_1.pep
MATVPGDLIWQVVRKNNSFLVKQFGNGNAKVQFTKEPNNLYNVHSYKHSGLANKKTVTIQPAAGKDSAVVLSTTKTKKQNTPAKLSHKSVMRKEFRKMAKAVKNQVSDNYYRPDLTKPALARLSSVYRSLQVAKSGVKKKNRQPKH

SEQ ID NO: 45829 - protein, 48 aa, Sorghum bicolor
  unsure (1)..(48): unsure at all Xaa locations
  Clone ID: LIB5050-003-R1-XP1-A7.pep
MATVPGDLIWQVVRKNNSFLVKQFGNGNAKVQFTXGAQTNLYNVPLPT

SEQ ID NO: 45830 - protein, 418 aa, Sorghum bicolor
  Clone ID: SORBI-28MAY03-C15691_1.pep
ARGVAVIGGGLMGSGIATSLLVSNISVLLEEVNPQFLQRGEKMIAGNLEGLVKRGSLTKDRMHKAMSLLKGALDYSDFKDVDMVIEAVIEKIPLKQSIFSDIEKICPKHCILATNTSTIDLNVVGEKTNSQDRIIGAHFFSPAHIMPLLEIVRTEKTSPQAILDLITVGKIIKKVPVVVGNCTGFAVNRTFFPYTQGSHLLVSLGIDVFRIDRVISSFGMPMGPFQLQDVAGYGVALAVKGIYADAFGERNLNSNLVDLMVKDGRQGKVNGKGYYIYEKGGKPKPDPSVKHVLEEYQKQANTMPGGKPVTLTDQDILEMIFFPVVNEACRVMDENVVIRASDLDIASVLGMGFPKYRGGLVFWADTVGAPYIHSKLSKWAEIYGPFFKPSSYLEQRAKSGVPLSAKGASQQGSARSRM

SEQ ID NO: 45831 - protein, 429 aa, Sorghum bicolor
  Clone ID: SORBI-28MAY03-C14480_1.pep
MAGAVSALFLLDIKGRVLVWRDYRGDVSALQAERFFTKLLDKEGDSEVHSPVVYDDAGVTYMFIQHNNVFLLTAARQNCNAASILLFLHRVVDVFKHYFEELEEESLRDNFVVVYELLDEMMDFGYPQYTEAKILSEFIKTDAYRMEVTQRPPMAVTNAVSWRSEGIRYKKNEVFLDVVESVNILVNSNGQIVRSDVVGALKMRTYLSGMPECKLGLNDRVLLEAQGRATKGKAIDLDDIKFHQCVRLARFENDRTISFIPPDGSFDLMTYRLSTQVKPLIWVEAQIEKHSRSRIELMVKARSQFKERSTATNVEIEVPVPSDATNPNIRTSMGSAAYAPERDAMVWKVKSFPGGKEYMCRAEFSLPSITAEEGAPEKKAPIRVKFEIPYFTVSGIQVRYLKIIEKSGYQALPWVRYITMAGEYELRLI

SEQ ID NO: 45832 - protein, 380 aa, Sorghum bicolor
  Clone ID: SORBI-28MAY03-C20018_1.pep
MGTNDRAAISLVFLFLVCMASRSSCSLGSSEVQRRSVVPSIYVFGDSLVDVGNNNFLPPPAPRALSPYGIDSSLTGRFTNGYNLADLVARRLGFTKSPPAYLSLTPSSKLDLLTCRVGASYASGGSGILNTTGNGTLTMQKQIMLFSKTKARMWCGRKLNYMISKSFFLISAGGNDFSAFSEMGMSPQDAPAYISSMVSTYVEHINALYTLGARRLGILDVPAIGCTPGSRVPMANGGCNDAANSMAQNFNKLLRVEVAKAVETSMPDMKYSIASTYNFLTDLMDNHLVAGIRVIERACCGSGKLNAAVMCSRPNTTYCLDRNDYMFWDMLHPTQATYERGVVAIFYGPQEYADPINFAGLVGIATEINTTMAPGVYAAI

SEQ ID NO: 45833 - protein, 199 aa, Sorghum bicolor
  Clone ID: SORBI-28MAY03-C56095_1.pep
RLPIRTLAWHPHIHTTIQLGACSWAAVGAPELGAAAAAHDGLLFLFLVGLLVGLVLEAAAAAAVPVVASGAVCVRLLLAAGLFVGFLVGLVAVVGASAMVVHCHRVVSLHGIVVEAAAVVGWGRAAVDLLERLLVDNVVLQDDAGPLGDLGDVLAGVGAVVVRGGVLLAVAIAIAIAIAGAPEHGCWLLVGTWIDRYLV

SEQ ID NO: 45834 - protein, 380 aa, Sorghum bicolor
  Clone ID: SORBI-28MAY03-C4856_1.pep
ARGRALTLGMARPAAEALIAKLLKEASEECLISSSQMMKGFYRVAESLDDLILDIPSAKSEFQLLVSKAISEGWLDSSYVKSGVNGSVEDDEHEKLARYKREAVSIIHEYFLSDDTTEVIRSVKELGYPEYNPIFIKKLITTAMDRKNREKEMASVLLSSLSMELFSSEDIAKGFIMLLESAEDTALDILDASDELGLFLARAVIDDVLAPLNLDEISSKLPPNCSGAETLNMARSLVSARHAGERLLRCWGGGTGWAVEDAKDKITKLLEEYESGGDLGEACNCIRELGMSFFNHEVVKKALVMAMEKKNERTLSLLQECFGEGIITINQMTKGFSRVRDGLDDLALDIPDAREKFISYVEHAKKSGWLLPGFGVASSV

SEQ ID NO: 45835 - protein, 454 aa, Sorghum bicolor
  unsure (1)..(454): unsure at all Xaa locations
  Clone ID: SORBI-28MAY03-C56158_1.pep
SEAQCTPDQTPAECHRCLERMLEATLEAFNGSIGGRVLGVDCTYRYETAPFYNGQAMVRLATTKLXRAPAPAPALQPTAAGEGGRKHRVSWVVLAVVLPTLAAMNLVACLYLRRRRRLLIGQAKHQKPPMYYTEAEDTEMVDSMMMDVSTLRAATGDFNESNKLGEGGFGAVYKGVLPHGEEIAVKRLSSSSSQGVEELKNELALVAKLKHRNLVRLIGVCLEQQERLLVYEFVPNRSLDLILFGTDNREQQLSWEQRYKIINGIARGLQYLHEDSQLKVVHRDLKASNILLDESMNPKISDFGMARIFGQEQTQAVTSRVVGTYGYMAPEYMMRGNYSVKSDAFSFGVMVLEIVTGRKNSNEGCNLLTTVWMHWEARKMAELVEPSMGNSFPEGDVLRCVHIGLLCVQADPAARPVMSSVVMMLGSDTVTLQVPSKPGFFARNNSANTAASTV

SEQ ID NO: 45836 - protein, 804 aa, Sorghum bicolor
  unsure (1)..(804): unsure at all Xaa locations
  Clone ID: SORBI-28MAY03-C5626_1.pep
MAAASAAVRMLPDGGADDEERWLAEGIAGVQQNAFYMHRALDSNNLKDALKYSAQMLSELRTSRLSPHKYYELYMRAFDEMKKLEMFFREETRRGSCSVVDLYELVQHAGNVLPRLYLLCTVGSVYIKSKEAPGTRVLKDLVEMCRGIQHPLRGLFLRSYLSQISRDKLPDIGSEYEGDAESINDAVEFVLQNFIEMNKLWVRMQHQGPVREKEKRGKERNELRDLVGKNLHVLSQIEGVDLDMYKETVLPRILEQVVNCKDDLAQFYLMDCIIQVFPDEYHLQTLETLLSAFPQLQPSVDIKTVLSQLMDRLSNYAASSPEVLPEFLQVEAFAKFSSAIGKVIEAQPDAPGVGAVTLYVSLLTFTLRVHPDRLDYVDQVLGACVKKLSGKAKLEDSRAARRIVALLSAPLXEKYSNIVTALELSNYPRVMDYLDNATTKVMAVVIIQSIMKNTTCISTSDKIESLFDLIKGLIKDMDGAQDDELDEEDFKEEQNSVARLIHMLHNDDPEEMLKILCTVQKHILQGGPKRLTFTVPSLVFSALKLVRRLQGQDGDVTGEDVPATPKKIFQILHQTIEALSCVPSPELALRLYLQCAEAANDCDLEPVAYEFFTQAFILYEEEIADSKAQITAIHLIIGTLQRMNIFGVENRDTLTHKTTGYSAKLLKKPDQCRAVYACSHLFWTDDQDGIMDGERVLLCLKRALRIANAAQQMASATRGSSGSVTLFIEILNKYLYFFEKGIPQITNTVIQDLIELIRTEKQSDNSVADPSTEAFFSSTLRYIEFQKQKGGSIGEKYEQIKTSS

SEQ ID NO: 45837 - protein, 410 aa, Sorghum bicolor
  unsure (1)..(410): unsure at all Xaa locations
  Clone ID: SORBI-28MAY03-C6038_1.pep
WKLLEICVRVKRWLRVGVCFIYNNSSWRLNYCGVKKMLLRVMQRMTEXKKKVKTKLLRLRLRVQQLVVSGCTLLLSLIEYKTLVISGELNRGNDGLSSIPRKEYDSVSRVLERRXMWEEALERGTDSYDKFDMALHRGXLEIQKWVATGVQSETKLTRRAEFEMSNGYFEXAEKCPLYAMQRCGLXRCSLLLRVPASRSSSHFDSVTYERXNGSFLCFFMRXKLEECLQLLIESNRIPEAALMARSYLPSKVPEIVALWKKDLQKVNPKAAESLADPNEYPNLFEDWQIALNVEAVVAPKRGIYPPAEEYMIHAERSNESLVEAFKNMHVHEEMVPDDNEDTVHEVIEDGGVEESQEDAVEGDAEDDGVEEESQDEAVEVEAEGSTDGAVLVNGNSSEEQWGTKNEEPSA

SEQ ID NO: 45838 - protein, 184 aa, Sorghum bicolor
  Clone ID: SORBI-28MAY03-C2473_1.pep
VRSGIPRSSPSRKGQLTGACVPRIDAIDFTIKQDDGAQPNNLNRADIVLAGVSRTGKTPLSIYLAQKGYKVANVPIVMGVNLPKALFELSQHKVFGRTMKPGVLQAIRKTRAKALGFADGQSNYAEMDHVRQELLHANQIFAQNPMWPVIAVTGKAIEETAAVVVRISLDRKHKYSMPRISKRY

SEQ ID NO: 45839 - protein, 147 aa, Sorghum bicolor
  Clone ID: LIB3480-030-P1-K1-B11.pep
RRVGLDRAALSSASAPPVTKPSRPEDAAVAVEDGEDDDDDVCEAERDDAAGKAIYIVSDGTGWTAEHSVNAALGQFENCIADRGCAVNTHLIPLIDSMDQLLDVIKQAAKEGALVLYTLADPSMAEAAKKACDFLGVPSTDVLRPTV

SEQ ID NO: 45840 - protein, 87 aa, Sorghum bicolor
  unsure (1)..(87): unsure at all Xaa locations
  Clone ID: LIB3480-016-P1-K1-H8.pep
GFTMTGNRSAACHAYQNGTSIVFYPFYYTLYCVHVLISSVSSTTAFFFYFFVGPPSWWRLYLKDNLKFCTAETNVYCVYDQXKKINL

SEQ ID NO: 45841 - protein, 99 aa, Sorghum bicolor
  Clone ID: LIB3478-033-P1-K1-H8.pep
VNPVVLQAIRKTRAKALGFGDGYQSHYAEMEHVRQELLHANQIFAQNPTWPVIGITGKAIEETAAVIVRIYHDRKQKCSMPRISKRVAPVLVYNFMSVG

SEQ ID NO: 45842 - protein, 124 aa, Sorghum bicolor
  Clone ID: SORBI-28MAY03-C7155_1.pep
MAARAALILAVSLVLAAVASATYCPPPPAPKPPTPTPSGHHCPRDSLKLGVCANVLGLVKAKIGSPPYQPCCSLLDGLVDLEAAVCLCTAIKANILGINLNLPIDLSLILNNCGKNCPNDFHCA

SEQ ID NO: 45843 - protein, 492 aa, Sorghum bicolor
  Clone ID: SORBI-28MAY03-C65_1.pep
MDLADIPQQQRLMAGLALVVATVIFLKLLLSFRSGGGKKRLPPTIPGAPVVGGLVKFMRGPIPMIREQYAALGSVFTVPIITRRITFLIGPEVSAHFFKGNEAEMSQQEVYRFNVPTFGPGVVFDVDYSVRQEQFRFFTEALRANKLRSYVDQMVAEAEEYFSKWGESGTVDLKYELEHLIILTASRCLLGREVREKLFDDVSALFHDLDNGMQPISVLFPYLPIPAHKRRDKARARLAEIFATIIKSRKASGQSEEDMLQCFIDSKYKNGRPTTEGEVTGLLIAALFAGQHTSSITSTWTGAYMLRFKQYFAEAVEEQKDVMKRHGDKIDHDILAEMDVLYRCIKEALRLHPPLIMLLRQSHSDFTVTTKEGKEYDIPKGHIVATSPSFANRLPHIYKNPDSYDPDRFGPGREEDKAAGAFSYISFGGGRHGCLGEPFAYLQIKAIWTHLLRNFEFELVSPFPENDWNAMVVGIKGEVMVNYKRRKLVVDN

SEQ ID NO: 45844 - protein, 449 aa, Sorghum bicolor
  Clone ID: SORBI-28MAY03-C3782_1.pep
RTKLSRRRKKEPKRRRRKILWLSRTCTPNCFLLLCPLRQCLAWAALHLRWVEWACLQWVEWVCRQWALVRCPELGVLYARSPPELFMEHMKLFSTRRNIPKLIRACDEQQHWKELTYLYIQYDEFDNAATTIMNHSADAWDHMQFKDVCVKVANVELYYKAVHFYLQEHPDLINDMLNVLALRLDHTRVVDIMRKAGQLHLVKPYMVAVQSNNVSAVNEALNELYVEEEDYERLRESVDMHDNFDQIGLAQKLEKHELLEMRRIAAYIYKKAGRWKQSIALSKKDNMYKDCMETCSQSGDRELSEDLLVYFIEQGKKECFASCLFICYDLIRPDVALELAWMNNMLDFAFPYLLQFIREYTSKVDDLVKDKIESQKEERAKEKEEKDLVAQQNMYAQLLPLALPAPPMPGMGGPPPMGGMGMPPMGGMGMPPMGPGPMPAFGMPPMGSY

SEQ ID NO: 45845 - protein, 304 aa, Sorghum bicolor
  Clone ID: SORBI-28MAY03-C3835_1.pep
HEGALVPYYLEEEANWSLDFVNIRKTVAEARSKGITVRAMVIINPGNPTGQCLSEPNIKEVLQFCYHENLVLLADEVYQQNVFQDERPFISSRKVMFDMGPPLSRELQLVSFHTVSKGNWGECGQRGGYFEMTNLPPKTVDEIYKVASIALSPNVPGQIFMGVMVNPPKPGDISYPKFAAESKSVHESLRRRARMMTDGFNSCRNVVCNFTEGAMYSFPQIRLPPRAIEAAKRAGKAADVFYCLKLLEATGISTVPGSGFGQKEGVFHLRTTILPAEEDFPAIMSSFKKFNDSFMEQYEGYSRM

SEQ ID NO: 45846 - protein, 129 aa, Sorghum bicolor
  Clone ID: SORBI-28MAY03-C37958_1.pep
GTDYNTKDGTGVRDYIHVVDLADGHIAALRKLYEDSDKIGCEVYNLGTGKGTSVLEMVAAFEKVSGKKIPLVFAGRRPGDAEIVYAATAKAEKDLKWKAKYGIEEMCRDLWNWASKNPYGYAGSQDNGK

SEQ ID NO: 45847 - protein, 448 aa, Sorghum bicolor
  Clone ID: SORBI-28MAY03-C8171_1.pep
MGLAAAARAVLLLLAVAGVFLRPAAAEIKQESFKDDSRPSILFEKFGFGLKGMVSISVTGAKASSTLAKPDPVQLGFFLLSDESLFEAIYDQPAPTDLNPEPESSPTCVLSSPYVSPLFTFADLDDKGHYNKTFPITHPDEYSLFFANCAPETSVTMEVRTDMYNTNPDGTKDYLSVGMSSVPGIYAFFAVCYVVFLAGWLYVTLYRNRLSAHRIHHLMSGLLVARMLYCISAAEDQHYIRTAGTSHGWDVMFYLFQLVKGVILFAVIALIGTGWSFLKPFLQDKEKKVLMVVIPLQVAANIAAAVVGETGPFLQGWVTWNQIFLFVDVACCCAVLFPVVWSMRSLRESSKTDGKAARTLAKLTLFRQFYVVVIGYLYFTRIIVYALKTITNYKYRWVSVAAEEVATMAFYMFMFYMFRPAERNQYFALDEDDEEAAEMALREEEFEL

SEQ ID NO: 45848 - protein, 280 aa, Sorghum bicolor
  Clone ID: SORBI-28MAY03-C8612_1.pep
MAEALCNGVVASPYGGGDVGVAGRARGAAKAALAESLPVGGYATKSSFSAGRMSVSDRKPRPLSRNLEAAAAPGQMNLSFPKAMRWWEKGLHPNMREIESAQDLADSLLNAGDKLVVVDFFSPGCGGCRALHPKIAQFAEKNPDVLFLQVNYETHKSMCYSLHVHVLPFFRFYRGAEGRVSSFSCTNATIKKFKDALAKHGADRCSLGPARGLDESELMALAANRDLQFTYQKPGLVPLAEAIAKEAAAPGGPWLPLPASATQQLLGHHGSDNSLLSSGR

SEQ ID NO: 45849 - protein, 719 aa, Sorghum bicolor
  Clone ID: SORBI-28MAY03-C869_1.pep
MAGSMVDRATSDHLIGPDWAKNMEICDICNRDPGQSKDVVKALKKRIGHKNPKVQLLALTLLETVIKNCGDILHMHVAERDILHEMVKIVKKKSDPRVKEKVLVLIDTWQEAFGGPRARYPQYYAAYHELVRAGAEFPKRPEKPAPLFNGQSQAARNMRSPDQQDEAESSAANDFPALSMSEIQNARGIMDVLAEMLNALDPGNREGLRQEVIVELVDQCRTYKQRVVQLVNSTTDEELMSQGLALNDDLQRVLAKHDAIAAGIAVRVEKKPKSLQALVETEDSANQDSKKEQGLIARGEPTSQDAAKEPNQSTSDQSPFEQLALPAPPVSNGAATSAPNPRVRIDLLSWDDTPAPATAQNSLALVPVTDPLADSTSSNQNALAIVDTFSQNSTANSNAQPADPFGLNPSSVIPGSQPYNTPTQQPFQSQQPPQQAALYTNGGAVNPGTSYDQASQFNNVSSGWNGQTANPAASPPEQTLNYDDQSGNLPPPPWEAQSAASNEVPNGHLGGMQPLTGPGQIGGMQQPLQPQVNHMGVPQSQPMYSNQPGVGLPQQAMQPGQVAATQMQPGFANQQFGSLPPTSMMGVQFGGMQPPQMYGGSQPVMMYPQQMPVAQYGAMPQQQPMYGGRLAGYMQHPAVAAAHYYNNQGTAGMYGYPGANGLSQSMYGLTVQDNSSIGMTSLYQTTTAPTPAGQPMKPTKPEDKLFGDLLSIAKTKKAS

SEQ ID NO: 45850 - protein, 381 aa, Sorghum bicolor
  Clone ID: SORBI-28MAY03-C12164_1.pep
MGGRGAMLAVLAVVLLAAAGGGAAAESSEASAKGMYHALFNFGDSLADAGNLIQNGTPEILATARLPYGQTYFGKPTGRCSDGRLVIDHLAQEFGLPLLPPSKAKNASFAHGANFAITGATALDTPYFEAKGLGAVIWNSGALMTQIQWFRDLKPFFCNTTEACKKFFAKALFVVGEFGGNDYNAPLFAGMGIPEAYKFMPDVIQGISDGIEALIAEGAVDMIVPGVMPTGCFPVYLNMLDVPEEGKGSRSGCVRQYNTFSWVHNAHLKAMLKKLRAKHPNVRIIYGDYYTPVIQFMLQPEKFGFAKQLPRACCGAPSTPERAAYNFNVTAKCGEPGATACPDPTTHWSWDGIHLTEAAYRHIAKGWLYGPFADQPIIQSS

SEQ ID NO: 45851 - protein, 293 aa, Sorghum bicolor
  Clone ID: SORBI-28MAY03-C12662_1.pep
MDERIPPPSLLQYSQSPVHSSPHPLNSMRYSSSERERYLAELLAERQKLAPFVQVLPFCTRLLNQEILRASSMAPNHNFVDPERIEHGSPLRLPGHPVNGQPMDLEGWTGIQTEASQHMGVLQASSMGWNGAPVLAATPVVKKVMRLDVPVDKYPNYNFVGRLLGPRGNSLKRVEASTQCRVYIRGRGSVKDSVKEDKLRDKPGYEHLNEQLHVLVEAEFPVDMVDARLNQAVSILEDLLKPIDESMDFYKKQQLRELAILNGTLREESPSPHLSPSVSPFNSTGMKRAKTGR

SEQ ID NO: 45852 - protein, 171 aa, Sorghum bicolor
  Clone ID: SORBI-28MAY03-C11015_1.pep
MGGGAWPFLVGGAICLEEIKRQGEIEKNKLALERKKRQAEKQAAKAAARAQKEAEKKLKKEEKKAKKKSGAADTDEPSESDAKSDEAIEAPAEQEVILASTTVKKEQKESARHRNVVSRSKAPPPKAILKRKKAQSYWSWAGPAAIVAAVLVALLAVLGYYQYYLPANVSN

SEQ ID NO: 45853 - protein, 469 aa, Sorghum bicolor
  Clone ID: SORBI-28MAY03-C13314_1.pep
MATALARRGAAALARWRGMCSSSAAAGRAAALSSEELMRMERDCSAHNYHPIPMVFSKGEGSHIVDPEGNKYIDFLSAYSAVNQGHCHPKVLRALIEQAERLTLSSRAFYNDKFPIFAEYLTSMFGYDMMLPMNTGAEGVETAIKLARKWGYEKKRIPKNEALLVSCCGCFHGRTLGVISMSCDNDATRGFGPLVPGHLKVDFGDIDGLKKIFEEHGDRICGFLFEPIQGEAGVVIPPDGYLKGVRDLCSKHNILMIADEIQTGIARTGKMLACDWENIRPDMVILGKALGAGVVPVSAVLADKDVMLCIRPGEHGSTFGGNPLASAVAVASLKVVRDEGLVERAAKLGQEFRDQLQKVQQKFPQIIREVRGRGLLNAVDLNNDALSPASAYDICIKLKERGILAKPTHDTIIRLAPPLSISPEELAEASKALSDVLEHDLPQLQKQIKKPESEAEKPVCDRCGRDLYG

SEQ ID NO: 45854 - protein, 139 aa, Sorghum bicolor
  Clone ID: SORBI-28MAY03-C1292_1.pep
MANAASGMAVDDDCKRRFLELKAKRTHRFIIYKIDEKKKMVVVEQVGEPVLNYDDFAASLPANECRYAIFDYDFVTEENCQKSKIFFIAWSPDTARVRSKMIYASSKERFKRELDGIQVELQATDSAEVGLDVIQGRAN

SEQ ID NO: 45855 - protein, 324 aa, Sorghum bicolor
  Clone ID: SORBI-28MAY03-C7822_1.pep
MMHAKSESDMTSLAASSPPRSPKRGGGGGVAGGAGNGGYYVQSPSRESHDGGYKSSSMQATPVYNSPNESPSHPSYGRHSRSSSVSRFSGNLRKGGGGDRKVLNDKGWPECNVIEEEGPYEDLAGDSGLSRRCQIILGFLTFVLLFTTFCLIIWGAARPYEPEVVVKSLVMDDFYAGEGTDHSGVPTKLVTTNCSLHIAVYNPATMFGIHVTSGPIHLIYSEISIAVGQVRRYYQPRKSHRTVTAVIHGEKVPLYGAGGSLMLSTSTGGTVHLTLDFDLTSRGYVIGKLVRVTHKVHVTCPVVVDAKKTKPVRFSKKACAVYKA

SEQ ID NO: 45856 - protein, 292 aa, Sorghum bicolor
  Clone ID: SORBI-28MAY03-C7151_1.pep
MMGGWGVSDGYEGSKRPRMMMESNPYFAVNAGSPLDVSKRSRMVEPGPYFGAMGSNAGGASGGFYQPFNSNLAGAGASTGIQNFPGVRLRGLPFDCNDIDICKFFVGLDIVDCLLVNKNGRFTGEAFVVFPTAMQAEFALHRNRQNMGRRYVEVFRCKKQEYYCAIANEVSQGGYFESEYRRSPPPPRSKKPAEDKGSMEYTEVLKLRGLPYSATTEDIIKFFLEYELTEENVHIAYRSDGKATGEAFVEFPTAEVAKTAMCKDKMTIGTRYVELFPSTPEEASRARTRGRH

SEQ ID NO: 45857 - protein, 414 aa, Sorghum bicolor
  unsure (1)..(414): unsure at all Xaa locations
  Clone ID: SORBI-28MAY03-C9330_1.pep
NLCFSKLGIDSSSSRWKLLEELQKVLPPTVMVPERRLENLVEQALTVQRDACYFYNSVDGLSLFTEHHCGKDPIPSRTLQVLHAHYDEVLFIQFSTFGQYLVTRAQSTAXNWIPTSPSWIAITGDYHAGPIWGAKKASLKRKDVGSSHCNSNGFHSNGNAHGNGFVHQCNGNSTKXIGQGNVSPWMVXLASVNPPFFCIWDLDGNEVDCWKGQRSTRTSDFAVAKDGNLIISMSRESTILLFDRETKQERLIEEGSTITSFSLSEDGDFLLVNLISEEIHLWNIRNDPVRVNRYKGHKRNRFVIRSCFGGSEQAFIASGSEDSQVYIWHRATGDLIETLAGHSGTVNCVSWNPTNPHMLASASDDHTVRIWGAKKASLKRKDVGSSNCNSNGFHSNGNAHGNGFVHQCNGNSTK

SEQ ID NO: 45858 - protein, 479 aa, Sorghum bicolor
  Clone ID: SORBI-28MAY03-C2189_1.pep
MATTAAADGPPVEPQSLKKLSLRSLKRSLDLFAPAHALLFTPDAESKRIRTGCKVRAEYGAVKDLPPEQGRGGQGKGSAPTSSTALALPGTQDTKDGHREGTSNAIVPVPLMLPKAPESTIPGKNTTMSIPGSSDRFSTSALMERIPSRWPRPTWHAPWKNYRVISGHLGWVRSIAFDPGNEWFCTGSADRTIKIWDLASGTLKLTLTGHIEQIRGLAVSQRHTYLFSAGDDKQVKCWDLEQNKVIRSYHGHLSGVYCLALHPTIVRLLTGGRDSVCRVWDIRTKAHVSALTGHDNTVCSVFARPTDPQVVTGSHDTTIKFWDLVAGRTMCTLTHHKKSVRAMALHPKEKAFASASADNIKKFSLPRGEFLHNMLSQQKTIINSMAVNEDGVLATGGDNGSLWFWDWKSGHNFQQDQTIVQPGSLESEACIYALAYDASGSRLVTCEADKTIKMWKEDLTATPETHPINFKPPKDIRRY

SEQ ID NO: 45859 - protein, 488 aa, Sorghum bicolor
  Clone ID: SORBI-28MAY03-C2324_1.pep
MATQAAFLAGLSQLAAQPGRDRAVAPARVAVAAVGVGSAKVGVRVGVKAGTAEAKAVAQRRGVRCRASLIEPDGGRLVDLVAPEEGGRRAALRREAAELPHRLRLSRVDKEWVHVLSEGWASPLQGFMREHEFLQALHFNAIRGADGRMVNMSVPIVLSLGDAQRRAIQADGATRVALVDQRDRPIAVLSDIEIYKHNKEERIARTWGTTAPGLPYVEEAITNAGDWLIGGDLEVIEPIKYNDGLDQYRLSPAQLREEFARRNADAVFAFQLRNPVHNGHALLMTDTRKRLLEMGYKNPVLLLHPLGGFTKADDVPLSWRMKQHEKVLEEGVLNPESTVVAIFPSPMHYAGPTEVQWHAKARINAGANFYIVGRDPAGMSHPTEKRDLYDADHGKKVLSMAPGLERLNILPFKVAAYDTKQKKMDFFDPSRKDDFLFISGTKMRTLAKNRENPPDGFMCPGGWKVLVEYYDSLVPSEGSSKLREPVAA

SEQ ID NO: 45860 - protein, 207 aa, Sorghum bicolor
  Clone ID: SORBI-28MAY03-C2040_2.pep
VCAYDVSDYQNDITRGTGMSYCVYHAPMGEGTQVAVLSSYDYRPQGQKTYSFDNMMDGFYISKSFMDKLVVHLSKNFMSLPNIKVPLILGIWGGKGQGKSFQCELVFSKMGIIPIMMSAGELESGNAGEPAKLIRQRYREAADLISKGKMSCLFINDLDAGAGRMGGTTQYTVNNQMGNATLMNIGDNPTNVQLPGMYHKGDNPRVP

SEQ ID NO: 45861 - protein, 428 aa, Sorghum bicolor
  unsure (1)..(428): unsure at all Xaa locations
  Clone ID: SORBI-28MAY03-C2040_1.pep
MAAAFSSTSVVVAVPVTTSTAANSFLGSNNNNKQKLTVSSIRKKKQHQQGGRGLIIIRAMAAVNKQEVDETKQTEQDRWRGLAYDTSDDQQDITRGKGRVDPLFQAPMGDGTHVAVLSSYDYISQGLRQYNTMDRHYIAPACMDNLVLPMTTAACSRRSIRVPRILGIWGGTCPRRRSATPPTFYGKAAQQVHVPVLVXRGALIPGPATSTLSPEATTAAASITELMQETMDIVVDPESNNSSYLANIFVTCLKLLLSYAXLIIYAIIDLSHVTNYYSMQNKLLLSPPGRMEKFYWAPTREDRIGVCKGIFRTDGVDEEHVVQLVDTFPGQSIDFFGALRARVYDDEVRRWVAETGVENIAKKLVNSKEGPPTFEQPKMTIEKLLEYGHMLVAEQENVKRVQLADKYLNEAALGAANEDAMKTGNFFK

SEQ ID NO: 45862 - protein, 370 aa, Sorghum bicolor
  Clone ID: SORBI-28MAY03-C25597_1.pep
PRLQRGPARAPRAPGGAQRRPLRPRLQPRHGAPRPPAPPPPRPRPPPRAPPPLARPLPPPLPLLPPPRRPRPRPPGPPPPRPRPRRRGPARPAPRPPPPPPRRPPPPRPRLGRPPGPPPGRPGRPPAPPRRAAQPAHPPRPRPRPAPRPRGRHPPAGGPPPAPARRAHRGHAGAGHDGTWAAHPGLIPAVRLRPAGHLGGRPNQIIIGDGAAAGGHEHEGASVREEDLIQPPRGARTVDALRLNVRVGVQYLAAWLGGSGSVPLYNLMEDAATAEISRVQNWQWLHHGAALDAGGVEVRATPDLLARVVEEEMARVEAEVGHERFRKGRYEEAGRIFSRQCTAPELDDFLTLDAYNLIVAHHPGASPCKL

SEQ ID NO: 45863 - protein, 148 aa, Sorghum bicolor
  Clone ID: SORBI-28MAY03-C214_1.pep
MASKRILKELKDLQKDPPTSCSAGPVAEDMFHWQATIMGPSDSPYSGGVFLVSIHFPPDYPFKPPKVAFKTKVFHPNINSNGSICLDILKEQWSPALTVSKVLLSICSLLTDPNPDDPLVPEIAHMYKTDRVKYESTARSWTQKYAMG

SEQ ID NO: 45864 - protein, 93 aa, Sorghum bicolor
  unsure (1)..(93): unsure at all Xaa locations
  Clone ID: LIB3481-036-P1-K1-D11.pep
PRSGLCLSSSRNCSLQRTTSPLGSNAQRLMLLNQQKKVKIRTLLQAIAHVLPKSTILRNVRLQSTKMCCYCRGCCAXTGGCVASAIMFQQVEI

SEQ ID NO: 45865 - protein, 157 aa, Sorghum bicolor
  Clone ID: SORBI-28MAY03-C2951_1.pep
MSSSSLSPAGTGRTSGSSDGDSASAADTHRREKRRLSNRESARRSRLRKQQHLDELVQEVARLQAENARVAARAADIASQYARVDQENTVLRARAAELGDRLRSVNDVLRVVEDFSGVAMDIQDEMMPADDPLLRPWQLPGYPAAAMPIGAPHMLHY

SEQ ID NO: 45866 - protein, 469 aa, Sorghum bicolor
  Clone ID: SORBI-28MAY03-C3411_1.pep
MHLAAFPSSSTTTTTLATPATLPWHEMPLINSSATTSSLLLRRSLCASLRRISHMASYAASPTSAPAATASTENGAAKATEQRPVQVAKRLEKFKTTIFTQMSMLAIKHGAINLGQGFPNFDGPDFVKEAAIQAINAGKNQYARGFGVPELNSAIAERFLKDSGLQVDPDKEVTVTSGCTEAIASTILGLINPGDEVILFAPFYDSYEATLSMAGANVKAITLRAPDFAVPLEELEAAVSKNTKAIMINTPHNPTGKMFTREELEFIATLCKENDVLLFSDEVYDKLSFEADHISMASIPGMYERTVTMNSLGKTFSLTGWKIGWAIAPPHLTWGLRQAHSFLTFATCTPMQAAAAAALRAPDSYYEELKRDYSAKKAILLEGLEAAGFIVYPSSGTYFIMVDHTPFGFDNDIEFCEYLIREVGVAAIPPSVFYLNPEEGKNLVRFTFCKDEDTLRGAVERMKTRLRKK

SEQ ID NO: 45867 - protein, 266 aa, Sorghum bicolor
  Clone ID: SORBI-28MAY03-C34339_1.pep
MSTGARPGRRFTVGRSEDATHPDTIRAAISEFIATAIFVFAAEGSVLSLGKMYYHDTASTASGLVTVALAHALALAVAVAVAVNVSGGHVNPAVTFGALVGGRISLVRAVFYWVAQLLGAVAATLLLRLATGGARPPGFALASGVGDWHAVLLEAAMTFGLMYAYYATVVDPKRGHVGTIAPLAVGFMLGANVLAGGPFDGAGMNPARVFGPALVGWRWRHHWVYWLGPFLGAGLAGLVYEYLVIPSADAAPPHSTHHQPLAPEDY

SEQ ID NO: 45868 - protein, 594 aa, Sorghum bicolor
  Clone ID: SORBI-28MAY03-C1439_1.pep
MPTVSVGRDRLFAALGRTYTQEEFEALCFEFGIELDDVTTEKAIIRKEKHLEDDGEVDDDDEVIYKIEVAANRYDLLCLEGLARALRVFTGTEASPVFQVSSIPRGSILQMHVKPETSKIRPYVVCAVLRGVTFDEARYNSFIDLQDKLHQNICRKRTLVAIGTHDLDTLQGPFSYEALPPHEINFVPLKQEKSFRADKLMEFYKSDMKLKKFLHIIENSPVYPVIYDSNRTVLSLPPIINGAHSAITLATRNVFIECTATDLTKANIVLNTMVTMFSEYCETKFEAEPVEVVHPDGRKTVYPDLSCYKMDVSLSDILGPIGISQDEKQVVCLLNKMQLQAESHSLKGEPRISVSVPPTRSDILHARDLSEDVAIAYGFNNVPKSTPKCMTIGGRQPLNRFSDKIRAEVARAGYMEVLTFILSSHEENFDMLNRADDKSKAVIIANPRTSEFEVVRTSLMSCLLKTLKHNIDHPRPIKIFQVGDVVMLDSSRDVGASNNRRLAALYCNRVSGFEEIMGLVDSIVKVVRAPHVNFGKNYYVPTDEPEFFPKRQCKIVTSDGKQVGYLGIVHAEVLRKFGIPDPCTFVEMDLEALL

SEQ ID NO: 45869 - protein, 45 aa, Sorghum bicolor
  Clone ID: LIB3478-018-P1-K1-H5.pep
LWQNTIPTDEPEFFPKRQCKIVTSDGKQVGYLGIVHAEVLTLPCF

SEQ ID NO: 45870 - protein, 265 aa, Sorghum bicolor
  Clone ID: SORBI-28MAY03-C17300_1.pep
MSSIGTGYDLSVTTFSPDGRVFQVEYATKAVDNSGTVVGIKCKDGIVLGVEKLVASKMMLEGSNRRIHSVHRHSGLAVAGLAADGRQIVSRTKLEAASYEKVYGEAISVKELADRVASYVHLCTLYWWLRPFGGWQILGVYDRCTGQLYMIEPSGVSYKYFGAALGKGRQAAKTEIEKLKLSELTCREGIVEVAKIIYGVHDEAKDKALVLVLSWFWEGSTRPRPKLPSGRWARAVAAPRAALGGFHAACGTRPLPLPSLLIPLE

SEQ ID NO: 45871 - protein, 280 aa, Sorghum bicolor
  Clone ID: SORBI-28MAY03-C3873_1.pep
MSFQDLEAGHVRGAPLGGGRRNGRGPAGGAGASQAVASGVFQINTAVATFQRLVNTLGTPKDTPDLRDRIHKTRQHITQLVKDTSDKLKQASEADHRVEVSATKKIADAKLAKDFQAVLKEFQKAQRLAVEREAAYAPFISQAGLPQSYNSSEVNNGADKLAEQRTQLLESRRQELVFLDNEIVFNEAIIEERDQGIQELVRQITEVNEIFKDLAVLVHDQGAMIDDIDSHIENAVVATSQAKGQLSKAAKTQKSNSSLICLLLVIFGVVLLIVIIVLAA

SEQ ID NO: 45872 - protein, 321 aa, Sorghum bicolor
  unsure (1)..(321): unsure at all Xaa locations
  Clone ID: SORBI-28MAY03-C4569_1.pep
MCGGAILAELIPSTPARRGGGGGGAAWPGGKGSQRKADDFEAAFREFHEDSDEDEEMTEVVESKPAFIFSAPSSPATKPRAARQEQPIRRRKAAQQYRGVRRRPWGKWAAEIRDPVKGVRVWLGTFPSAEAAALAYDHAGPHVRGPRELPHLXAAAAGAPASRKRARASDAAFIDLVDQEEQEQLTAAATTALKHEAAEEAAGESSGALPDFSWQGVLSAYDESPAVDVEAGQSGDKKRPRTEPESTEDEASPRASSGSEPDALFDALLFGDQFAFFDAGAYESLDSLFSADAVQSNAAADQGMPLWSFDDGCLVEDNLSF

SEQ ID NO: 45873 - protein, 174 aa, Sorghum bicolor
  Clone ID: SORBI-28MAY03-C2898_1.pep
APVVLLSPPTRWPKPLPYPLPSPLLPCVAACLSFLSSLPPLLSSPVWISQRMVSSPVVSSALGRVDLSCIANYMRAFVCVRRGGGSSVYCPVGVPISRLGMSFSSLLRFLAECASAVPSSPSSHLRAWAFHYLALLASYSVFRSDQVCFLSRSVLHYFSCVAIRFVAASRFCVS

SEQ ID NO: 45874 - protein, 87 aa, Sorghum bicolor
  Clone ID: LIB3481-015-P1-K1-E12.pep
AHFMITIRLNFKLVSAKPIFTKKLIHDFCLFWFRIGLKNLQIQGKSNGQWNRDGLWRRHQWLEILSQLLFVASAQTSKSYWFKEVTG

SEQ ID NO: 45875 - protein, 267 aa, Sorghum bicolor
  Clone ID: SORBI-28MAY03-C5487_1.pep
MAALGRGIGLLFLGVLLLAVAGAASAAPGGMSIISYNEEHGARGLERTEAEVRAMYELWLVEHGRRVSNVLGEHDSRFRVFWDNLRFVDAHNERAGEHGFRLGMNQFADLTNDEFRAAYLGARIPAARSGNAVGEMYRHDGAEELPESVDWREKGAVAPVKNQGQCGSCWAFSAVSSVESINQIVTGEMVTLSEQELVECSTDGGNSGCNGGLMDAAFNFIIKNGGIDTEDDYPYKAVDGKCDINRRNAKVVSIDAFEDVPENDEKS

SEQ ID NO: 45876 - protein, 165 aa, Sorghum bicolor
  Clone ID: SORBI-28MAY03-C575_1.pep
WQREAASLRQPGWDNLLAVIPGGSSVPLLPKHICDDVLMDYDALKAVTSGLGTAAVIVMDKSTDVVDAIARLSYFYKHESCGQCTPCREGTPWLWMIMERLKVGNAKLEEIDMLQEVTKQIEGHTICALGDAAAWPVQGLIRHFRPELERRIRERAERELLAASA

SEQ ID NO: 45877 - protein, 330 aa, Sorghum bicolor
  Clone ID: SORBI-28MAY03-C58145_1.pep
MASVLAATALLIGALALASIPTAVQSIGVCYGTQGDGLPSAADVVQLYQSKGIGAMRIYSPDATILQALRGSGIDVIVDETNLDALISDAGSWVQANVQPYIGDVKFKYIAVGNEVEGSDTQKILPAMQSLAGALSAAGFGDIKVSTAVKMSVLATSSPPSSGAFKDSSVMGPVVRFLAGSGAPLLANVYPYFAYRDAGGSIDLGFSLFEQSSTTVNDDGHVYTNLFDAMADAIYSAMEKEGESGVPIVVSESGWPSDGGGLGASVDNAQTYNQNLINHVGNGTPKRSGPLETYIFAMFNENKKQGDETEKHFGLFNGQDKSPVYPISFS

SEQ ID NO: 45878 - protein, 184 aa, Sorghum bicolor
  Clone ID: SORBI-28MAY03-C5444_1.pep
MIIPKKNRNEICKYLFKEGVLYAKKDYNLAKHPQIDVPNLQVIKLMQSFKSKEYVRETFSWQYYYWYLTNDGIEHLRNYLNLPSEIVPATLKKSARPPGRPFGSGPPGDRPPRGPGRFEGDRPRFGDRDGYRGGPRGAPGDFGGDKGGAPAEFQPSFRSSGGRPGFGRGGGSGFGAGPTSSSME

SEQ ID NO: 45879 - protein, 41 aa, Sorghum bicolor
  Clone ID: LIB3476-012-P1-K1-E9.pep
SRHGNSSVKQNLIVLIVQRSTEKTRPLRAAFEKLSIESMRL

SEQ ID NO: 45880 - protein, 328 aa, Sorghum bicolor
  Clone ID: SORBI-28MAY03-C6698_1.pep
MQYKNLGRSGLRVSQLSYGSWVTFGNQLDVKEAKALLQACRDAGVNFFDNAEVYANGRAEEIMGQAIRDLGWRRSDVVISTKLFWGGPGPNDKGLSRKHIVEGLRGSLRRLDMDYVDVVYCHRPDASTPVEETVRAMNWVIDQGWAFYWGTSEWSAQQITEAWAVANRLDLVGPIVEQPEYNLFSRHKVESEFLPLYSTYGIGLTTWSPLASGVLTGKYGKGNVPADSRFALDNYKNLANRSLVDDTLRKVNGLKPIADELGVTLAQLSIAWCASNPNVSSVITGATKESQIVENMKALDVIPLLTPEVLDRIEAVVQSKPKRADSYR

SEQ ID NO: 45881 - protein, 213 aa, Sorghum bicolor
  Clone ID: SORBI-28MAY03-C21422_1.pep
MSRAPTLAAAAAVAAVVLICSSSTATAADGNARQPPLAPGLSFDFYKRSCPKAESIVRSFVQDAVRRDVGLAAGLLRLHFHDCFVQGCDASVLLDGSATGPGEQQAPPNLTLRPTAFKAINDIHDRLHKECGGTVVSCSDVLALAARDSVVVSGGPSYKVPLGRRDSASFATQQDVLSGLPPPTAAVPALLAVLSKINLDATDLVALSGGHTI

SEQ ID NO: 45882 - protein, 249 aa, Sorghum bicolor
  Clone ID: SORBI-28MAY03-C207_1.pep
MGGRRTIVLSLILGLLAAANAVPFDFFYLILMWPGAYCEDSDNGCCVPKYGYPAEDFFVEFFQTFDVSINKPIVRCRNGSPFDAKKLDKIENNINHYWTRLKCPPTDGVNAWKSAWDNYGVCSGLKQLDYFKAALSLRKQADILGALADQGILPDYKLYNTARIKAAVAAKLGVEPGLQCRDGPFGKKQLYQVYLCVDTDAKTFIKCPKLPATLICPASVVFHPFYTWMLNSTPTFDSKILLPTQTMLN

SEQ ID NO: 45883 - protein, 191 aa, Sorghum bicolor
  Clone ID: LIB3481-051-Q6-K1-E4.pep
VRFFQTFDVSINKPIVRCRNGSPFDAKKLDKIENNINHYWTRLKCPPTDGVNAWKSAWDNYGVCSGLKQLDYFKAALSLRKQADILGALADQGILPDYKLYNTARIKAAVAAKLGVEPGLQCRDGPFGKKQLYQVYLCVDTDAKTFIKCPKLPATLSCPASVVFHPFYTWMLNSTATFDSKILLPTQTMLN

SEQ ID NO: 45884 - protein, 472 aa, Sorghum bicolor
  Clone ID: SORBI-28MAY03-C1867_1.pep
LGSIIRNGGHRRRDRQTPVHPLLHHQRHLRRGLLGGARRAGPVPQRRRLRAARHRHHEPRELRGGRQGGRPRAPGPPCESDHVAGRDHYKDGLLKPVRRSERTRARSRSLAHKERGGPCTATNPIDQCWRVRGGWARNRKRLARCGMGFGHRTTGGLAGRIYVVTDPSEEPANLVVPRKGTLRYAVIQDRPLWITFARDMVINLCRELLVTSDKTIDGRGAQVHVVGAQITLQNVRNVILHNLHIHDAAPRGGGVIRDSKHHWGLRGESDGDGVSVMGSSDIWIDHVSMRSCADGLVDVVDGSTAVTISNGHFTRHDHVMLFGASDAAVKDKAMQVTVAFNHFGKGLVQRMPRCRHGFFHVVNNDYTHWLMYAIGGSQNPTIISQGNRFRAVDDGRFKEVTKREYTPYSEYKDWVWKSQDDLFLNGAFFNQSGGENERRFDRLDLIQAKGGQYAELLTRYAGALNCRVGKKC

SEQ ID NO: 45885 - protein, 135 aa, Sorghum bicolor
  Clone ID: LIB3480-017-P1-K1-C6.pep
PRVRFGRGLVQRMPRCRWGFFHVVNNDYTHWLMYAIGGSKAPTIISQGNRYIAPPNLAAKLVTKHHDAPESEWKNWVWHSENDLFMEGANFTVSGGQKINRNFHKKDLIKPKNGSYVTRLTRYAGALACRPGKPC

SEQ ID NO: 45886 - protein, 467 aa, Sorghum bicolor
  unsure (1)..(467): unsure at all Xaa locations
  Clone ID: SORBI-28MAY03-C662_1.pep
MPLLSIQAHLPKKQVAHGWLYKYDLQYNIAVIETRFFPGLRAINLEHQLQGGPHAWGLAAARGLWPAGLAAPCRPLTHDPSGVYRKELMVSTCEITMIGVRGPLIDLDGNYVGMNFYAKKRTPFLPRSTIXNYWVISRYTGLGNSSREDENERESSSSSYSEENPIENDPFFPELASPFLPVADGDEFGKFLIKKLTSQGYPLPAVLDGGMRLVNTFENEFPDDIWSKLTKKVAANMSRIVVSLASFNGEERIFACTGIFVGNQSDTRILTSASLVRISDDENKINDNLKIVVHLPNKQQTVGTLQHYHLHYNVAIVSIKGFRCLRTEEFHDPGQIKRKEVLSVGRIFKSGKLMATGGILIDKPSKLDCKELMVSTCRISKAGIGGPLIDCDGNFIGMNFYGRKETPYLPRDTIMKLLNYFDGKGDVSPEIMDNQNRNRWPVPKLRWHYPTFSRHRKIEPRGQYIKY

SEQ ID NO: 45887 - protein, 50 aa, Sorghum bicolor
  Clone ID: LIB3480-029-P1-K1-B12.pep
MNKGKIFKLAKGFRGRAKNCIRIARERVEKALQYSYRDRRNKKRDMRSLW

SEQ ID NO: 45888 - protein, 126 aa, Sorghum bicolor
  Clone ID: SORBI-28MAY03-C990_1.pep
MATTEAAAATPVAPAEGSVIAIHSLDEWSIQIEEANSAKKLVVIDFTATWCPPCRMIAPVFAELAKKHPNVVFLKVDVDEMKTIAEQFSVEAMPTFLFMREGDVKDRVVGAAKEELANKLQLQMAQ

SEQ ID NO: 45889 - protein, 238 aa, Sorghum bicolor
  Clone ID: SORBI-28MAY03-C8168_1.pep
ICVPVLEGQASSAAPLFSFKNLSSGQNAFTGLTGTGFSSTSFSFGSASKDGSSSAPLFGLKADGSSFPSFNLGAANNGSSATALATSAEAPKKFAMTEGPVETGEENEKAVFTADSALYEYLDGGWKERGKGELKLNVPVSGSERARLVMRTKGNYRLVLNASLYNDMSLKDMDKKGVTFACMNSIGESPSSLATFALKFKDTATREEFKDAVEFRKTSKAPDVLLKTPENSPNAAEV

SEQ ID NO: 45890 - protein, 114 aa, Sorghum bicolor
  Clone ID: SORBI-28MAY03-C13536_1.pep
LRLSEQRALEEANGDILVFTSSFNPMKNSISKRQEKTVMKLVVDAETDRVLGASMCGPDAPEIIQGIAIALKCGATKANFDSTVGIHPSAAEEFVTMRTVTRRVSPTSKPKTNL

SEQ ID NO: 45891 - protein, 642 aa, Sorghum bicolor
  Clone ID: SORBI-28MAY03-C1452_1.pep
PTLISSYQSLKDTGRGTQIVSSIISTARQCNLRTDAPLPQQGEELPPSERDLVVGKVYSKIMEIESRLLPCGLHVIGEPPSAIEAVATLVNIAALDRPEDGIISLPGILAATVGREIEDVYRGSDKGILADVELLRQITEASRGAITAFVEKTTNSKGQVVTGKLICQISVGRFQRSNNNELRSPPSLRGAGTEKLRVLFGFLGECLKLVVQDNELGSLKLALEGSYVEPGPGGDPIRNPKVLPTGKNIHALDPQAIPTTAALKSAKIVVDRLLERQKADNGGKYPETVALVLWGTDNIKTYGESLAQVLWMIGVRPVADTFGRVNRVEPVSLEELGRPRIDVVVNCSGVFRDLFINQMNLLDRAVKMVAELEEPAEMNYVRKHAQEQAEELGVSLREAATRVFSNASGSYSSNVNLAVENASWTDEKQLQDMYLSRKSFAFDSDAPGAGMKEKRKAFELALATADATFQNLDSSEISLTDVSHYFDSDPTKLVQGLRKDGRAPSSYIADTTTANAQVRTLSETVRLDARTKLLNPKWYEGMMKSGYEGVREIEKRLTNTVGWSATSGQVDNWVYEEANSTFIEDEAMRKRLMETNPNSFRKLVQTFLEASGRGYWETSEENLDRLRELYSEVEDKIEGIDR

SEQ ID NO: 45892 - protein, 182 aa, Sorghum bicolor
  Clone ID: SORBI-28MAY03-C10148_1.pep
GNTGPAKLCGDGGSVKVDERASCMNYRSDLYRCTLYHVGVMDMLRFHKFTIGRAWTCDFGCSDNEEEFHWLIKYSPLHNVRRPWEKEKWAAATGGGQYPATMLLTADHDDRVVPSHTLKFLATMQHVLRAGAEGGSPQTNPIIARIERNSGHCCGRSTQKIIDEAADRYAFAAKMMGVSWID

SEQ ID NO: 45893 - protein, 114 aa, Sorghum bicolor
  Clone ID: LIB3478-055-Q6-K1-D11.pep
HHDDAGSLTRNFDEVNKKKKKRQAICTCHAILVKCPVTIQTDNLAYLAIRARISHREKTAADFTPRGGYSYQSIQETPIIFAANAYRSAASSMIFCVDRPQQWPLLRSIRAMMG

SEQ ID NO: 45894 - protein, 268 aa, Sorghum bicolor
  Clone ID: SORBI-28MAY03-C16227_1.pep
MAAPMSAIESAWQVLIANFTEFQLATVVTFLLHETVFFLSGLPSLLFERFGLFAKYKIQKKSNTPAYQNRCVLRLILYHVCVNLPVMIFSYPAFRFMGLRSSLPLPHWTVVVSQVLFYFVLEDFIFYWGHRALHTKWLYKHVHSVHHEYATPFGLTSEYAHPAEILFLGFATVVGPALTGPHLFTLWLWMVLRILETVEAHSGYHFPWSPSNFLPLYGGSDFHDYHHRVLYTKSGNYASTFVYMDWLFGTDKDYRKAKTIEEKEGKNL

SEQ ID NO: 45895 - protein, 160 aa, Sorghum bicolor
  Clone ID: SORBI-28MAY03-C16460_1.pep
MMMAEVANHSKRNHTDSYFSGTAAAAAPPPSPPEEFASMSSKKPRNTSPRIAPVSPKEKKDKIGERVAALQQLVSPFGKTDTASVLQEASGYIKFLHQQLEVLSSPYMRAPPAPGAVPEDPEHYSLRNRGLCLVPVDLTLQLTQSNGADLWAPANTTRRR

SEQ ID NO: 45896 - protein, 176 aa, Sorghum bicolor
  Clone ID: SORBI-28MAY03-C4980_1.pep
MAPSSSSSSAAAVLLLAVAVAAMLAASSTPVLADLTHANCAKNKKVTVQNLCSHDVTLTLEPLANSPALFAGAYTLHPHSHAEFPVCWWTGRLRAGADAAVVEFHVGVDGGSFYLAPNAQPGQRVPVSVTPHGSPLQGRCPAVGCAVQGRCSVHQVPSGDCRNVQEMKIIYCNPHV

SEQ ID NO: 45897 - protein, 428 aa, Sorghum bicolor
  Clone ID: SORBI-28MAY03-C46679_1.pep
MSSSAPAPAAMAVDDAEDDQLASMSTEEIIRASRLLDNEIRVHKDELQRSNLELESIKEKTKENQEKIKLNKQLPYLVGNIVEILEMNPEDEAEEDGANIDLDSQRKGKCVVLKTSTRQTIFLPVIGLVDPDKLKPGDLVGVNKDSYLILDTLPSEYDSRVKAMEVDEKPTEDYNDIGGLEKQIQELVEAIVLPMTHKDRFQKLGIRPPKGVLLYGPPGTGKTLMARACAAQTNATFLKLAGPQLVQMFIGDGAKLVRDAFQLAKEKAPCIIFIDEIDAIGTKRFDSEVSGDREVQRTMLELLNQLDGFSSDERIKVIAATNRADILDPALMRSGRLDRKIEFPHPSEEARARILQIHSRKMNVNPDVNFEELARSTDDFNGAQLKAVCVEAGMLALRRDATEVTHEDFNEGIIQVQAKKKSSLNYYA

SEQ ID NO: 45898 - protein, 176 aa, Sorghum bicolor
  Clone ID: SORBI-28MAY03-C16888_1.pep
MASPAASWVLFLLAAMTGCASAATFTIKNNCPYTVWPAATPVGGGTQLNPGQTWTINVPAGTKSGRVWGRTGCSFNSGGRGHCATGDCGGALSCTLSGQPPLTLAEFTIGYTNGANDYYDISVIDGYNLAMDFSCSTGVNLHCGRPRCPDAYLYPTDDTKTHGCRGNSNYKVTFCP

SEQ ID NO: 45899 - protein, 189 aa, Sorghum bicolor
  Clone ID: SORBI-28MAY03-C17480_1.pep
MVSAVLRTILVTGGAGYIGSHTVLQLLQQGFRVVVVDNLDNASEVALVRVAELAGHNGANLVFHKVDLRDRHALEEIFSSHRFEAVIHFAGLKAVGESVHKPLLYYDNNLIGTITLLEVMAANGCKKLVFSSSATVYGWPKEVPCTEEFPLCATNPYGRTKLVIEDICRDVHRSDPDWKIILLRYFNPV

SEQ ID NO: 45900 - protein, 261 aa, Sorghum bicolor
  Clone ID: SORBI-28MAY03-C18990_1.pep
MATTATEAAKAAPAEQANGNANGEQKTRHSEVGHKSLLKSDDLYQYILDTSVYPREPESMKELREITAKHPWNLMTTSADEGQFLNMLIKLIGAKKTMEIGVYTGYSLLATALALPEDGTILAMDINRENYELGLPCIEKAGVAHKIDFREGPALPVLDDLIADEKNHGSFDFVFVDADKDNYLNYHDRLLKLVKLGGLIGYDNTLWNGSVVLPDDAPMRKYIRFYRDFVLVLNKALAADERVEICQLPVGDGVTLCRRVK

SEQ ID NO: 45901 - protein, 78 aa, Sorghum bicolor
  Clone ID: SORBI-28MAY03-C17002_3.pep
PAGPGRLQSQTPHHPQKKTHTHTHTHISSSTQHYVRTSAMAASNNKSGVSMPALLFVALMLTTAPASSVRAQQSPSCL

SEQ ID NO: 45902 - protein, 78 aa, Sorghum bicolor; identical to SEQ ID NO: 45901
  Clone ID: SORBI-28MAY03-C17002_2.pep

SEQ ID NO: 45903 - protein, 77 aa, Sorghum bicolor
  Clone ID: SORBI-28MAY03-C17002_1.pep
AGRAGTPSITNTTSSTEKNTHTHTHISSSTQHYVRTSAMAASNNKSGVSMPALLFVALMLTTAPASSVRAQQSPSCL

SEQ ID NO: 45904 - protein, 217 aa, Sorghum bicolor
  Clone ID: SORBI-28MAY03-C19823_1.pep
MGSETKTITFEGIPFPAEITAAGNPLSLLATGITDIEIHFLQIKYNAIGVYLHSNDDSDLLTTHLGAWKGKTAEDLLADAAFWSALVSSPVEKLLRVVVIKEIKGSQYGVQLESSVRDRLAAVDLYEDDEEEALEKVAEFFQAKYFKPGSVITFHFPATPGPADITFVTEGKADAKITVENEHVAGMIQKWYLGGDNAVSPTTVRSLADRFAALLAA

SEQ ID NO: 45905 - protein, 269 aa, Sorghum bicolor
  Clone ID: SORBI-28MAY03-C19921_1.pep
MEHIARFFFGVSGNVIALFLFLSPVVTFWRIIRKRSTEDFSGVPYNMTLLNCLLSAWYGLPFVSPNNILVSTINGTGSVIEAIYVVIFLIFAVDRRARLRMLGLLSIVVSIFATVVLVSLLALHGNARKVFCGLAATIFSICMYASPLSIMRLVIKTKSVEYMPFLLSLAVFLCGTSWFIYGLLGRDPFIIIPNGCGSFLGLVQLILYFIYRKNKGPAVPAGKGEAAAAADVEDAKKVAAAVEMADATTTNKAAADTVVGDGKVVASQV

SEQ ID NO: 45906 - protein, 275 aa, Sorghum bicolor
  Clone ID: SORBI-28MAY03-C2073_1.pep
MLMLHETVPFVRPSSCRDLKLSEKSASAFHCKLGCSAVCSSAEGHHVQKPHIVHSHKVNFTRTSHLLCKSLNKRTTRHWLHRFHVNASPDDEFRSSRNIAISLFKRYKKIIDRGGGGENLKEFVSAGVTAYALGCTDEGLRKELMDLEDSGLEIEGLGSLGGTSSKFKVHSFEIRECIMWLSIVFITILCTPQLTVTRWSTNPPVSADVLHQWKGFCAIIANAYYVKGMAWLPVKTLQLEQMAVTGNSEEPSVVASRMQLVFSTLEVVSPQWPRV

SEQ ID NO: 45907 - protein, 343 aa, Sorghum bicolor
  Clone ID: SORBI-28MAY03-C23536_1.pep
MAQRKVAMAAAAFFALLAVASLLCAPAAAGLVRMEHPAKNDGSLSLLVVGDWGRKGTYNQSRVAYQMGKVGEQLNIDFVISTGDNFYENGLTGTDDQGFEQSFTDIYTAKSLQKPWYLVLGNHDYRGDALAQLSPVLRKIDSRFICMKSFIVNAEIVDFFFVDTTPFQLKYWTHPKDDHYDWRGVAPREKYINILLKDLDEAMKKSTAAWKIAVGHHTMRSVSDHGDTKELLQLLLPVLQANGVDFYINGHDHCLEHISSRDSPIQYFTSGGGSKAWRGVQNTNEDDLKFFYDGQGFMSLQLDHSEAHFTFYDVDGEALYHYTRPSLRKTAGHLQASGYVNEE

SEQ ID NO: 45908 - protein, 235 aa, Sorghum bicolor
  Clone ID: SORBI-28MAY03-C10267_1.pep
MAASARPGERATSFTVACSLLSRFVRQNGAAAAELGLGIKGEVEQQRTPATISLLPGAEGEEAERTKETMELFPQSAGFGVKDAAAPSEQENKEKPKQLTIFYGGKVLVFDDFPADKAKDLMQLASKGSLVVQNVVLPQPSAPAAVTDKAVPAPVISLSAAQADAKKPARTNASDMPIMRKASLHRFLEKRKDRLNAKTPYQTSPSDAAPVKKEPESQAWLGLGPNAVKSNLSLS

SEQ ID NO: 45909 - protein, 279 aa, Sorghum bicolor
  Clone ID: SORBI-28MAY03-C10013_1.pep
MAACRGFFECLLRLLNFILTVAGLAMVGYGIYLLVEWTKISEDGSGGGLTAEVLVSARPLLGAVALGDSFLDDLPKAWFIYLFIGVGAIVFLVSLFGCIGAGTRNTCCLCFYAFLVILLILAEAGAAAFIFFDQSWKDVIPVDKTHNFDVMYDFLKENWEIARWVALGVVVLEAVLFLLALVVRAMNKPAEYDSDDEIIAIGRSPTMRQPLIHAQNVPATGVPVPTLDQRASRNDAWSQRMREKYGLDTSQFTYNPSDPSRYQQNGTPQAEERSRCTIM

SEQ ID NO: 45910 - protein, 157 aa, Sorghum bicolor
  Clone ID: SORBI-28MAY03-C7122_3.pep
MDGGGAKAKKAAAGRKLGGGGPKKKPVSRSVKAGLQFPVGRIGRYLKKGRYAQRVGTGAPVYLAAVLEYLAAEVLELAGNAARDNKKNRIIPRHVLLAIRNDEELGKLLAGVTIAHGGVLPNINSVLLPKKAPEKAEKAASATKSPQKAAAAKSPKK

SEQ ID NO: 45911 - protein, 189 aa, Sorghum bicolor
  Clone ID: SORBI-28MAY03-C7122_2.pep
MRSPVTTIPTTQLLAPRAPKFFSTRPQQQQAAMDASGAGGKAKKGAAGRKAGGPRKKSVSRSVKAGLQFPVGRIGRYLKKGRYAQRVGTGAPVYLAAVLEYLAAEVLELAGNAARDNKKTRIIPRHVLLAIRNDEELGKLLAGVTIAHGGVLPNINPVLLPKKVAEKAASGGSKEAKSPKKAAKSPKKA

SEQ ID NO: 45912 - protein, 159 aa, Sorghum bicolor
  Clone ID: SORBI-28MAY03-C7122_1.pep
MDVSGAGSGGKAKKGAGGRKTGGGPRKKSVTRSVKAGLQFPVGRIGRYLKKGRYAQRVGTGAPVYLAAVLEYLAAEVLELAGNAARDNKKTPIIPRHVLLAIRNDEELGKLLAGATVAHGGVLNNIHILLLPKEVAESGAGAANEPKSPKKPAPSTKKT

SEQ ID NO: 45913 - protein, 53 aa, Sorghum bicolor
  Clone ID: LIB5050-011-R1-XP1-G8.pep
PDEELGKLLVGVTIAHGGVLPNIHSVLLPKKVAEKAAKEPKSPKKAAKSPKKA

SEQ ID NO: 45914 - protein, 517 aa, Sorghum bicolor
  Clone ID: SORBI-28MAY03-C2601_1.pep
MACGGCSCEAAVGATASEAYLEGEPVREARELVAELCRHFYAQGWVTGTGGSITVKVNDPAVPLADRLIVMSPSGVQKERMVAEDMYVMAADGKVLSAPVAKPWPNKPPKCTDCAPLFMKAYLMRGAGAVIHSHGMETCIATMLNPGAKEFRMTHMEMIKGIKGHGYRDELVIPIVENTPYEYELTDSLSEAIAAYPKATAVLVRNHGIYVWGDSWINAKTQAECYHYLLDACIKLYQLGIDWTTPEHGPINNAKRQRSILSSEIPNGCRAADSSKCVVLDIEGTTTPISFVTDVMFPVRRDNVREHLTSTFDSEETKDDIKLLRIQIEDDLRNGISGAVPVPPDEAGKEEVINSLVANVESMIKADRKITPLKQLQGHIWRTGFEKKELQGVVFEDVPVALKNWHSSGIKVYIYSSGSREAQRLLFGNTTYGDLRKFLCGYFDTTTGNKRETRSYFEVSQSLGVDSPSQILFITDVFQEAVAAKNTGFEVIISIRPGNAPLPDNHGFRTIKSFSEI

SEQ ID NO: 45915 - protein, 100 aa, Sorghum bicolor
  Clone ID: SORBI-28MAY03-C28860_1.pep
IVRHWTHSSDLSAAAASGAGAASAGAVSSVAAAAGASSCAAGGAASVTAAAAGATASSSSSLASSAGTGTATSASTGAAAASASAYLVSVSAGAAASGSA

SEQ ID NO: 45916 - protein, 468 aa, Sorghum bicolor
  Clone ID: SORBI-28MAY03-C3396_1.pep
TRLGSCTMKLNATVEMMPVTYPRGANLHPFAPTDQAAGYHEMFDDLGNLLCTITGFDSFSLQPNAGAAGEYAGLMVIRAYLNSRGEHHRDVCIIPVSAHGTNPASAAMVGMKIVAVGTDSKGNINIEELRKAAEANKDNLAALMVTYPSTHGVYEEGIDEICRIIHENGGQVYMDGANMNAQVGLTSPGFIGADVCHLNLHKTFCIPHGGGGPGMGPIGVKKHLAPFLPSHPVIPTGGFPLPEKTDPLGTISAAPWGSALILPISYAYIAMMGSQGLTDASKIAILNANYMAKRLEKHYPVLFRGVNGTVAHEFIIDLRGFKTTAGIEPEDVAKRLMDYGFHSPTMSWPVPGTLMIEPTESESKAELDRFCDALISIREEIAEIENGKADVLNNVLKGAPHPPQLLMGDTWSKPYSREYAAFPAAWLRGAKFWPTTGRVDNVYGDRNLICTLQQASQVTEEAAAAATA

SEQ ID NO: 45917 - protein, 350 aa, Sorghum bicolor
  Clone ID: SORBI-28MAY03-C32714_1.pep
MAFKLGTKAAAAASPAAAHRGGLARGPQGASRVAFGPAASRTKGLRAANNSVTPMRGALARGPQGASRVAFGPAASRTQGLRAANNSATPMAKEERVDRSETLTLDSIRQVLIRLEDSIIFGLLERAQFCYNAETYDSNAFHMDGFEGSLVEYMVRETEKLHAQVGRYNSPDEYPFFPEDLPEPRLPPIQYPRVLHPIADSININKEIWKMYFDELLPRLVKEGSDGNAGSSAVCDTTCLQALSKRIHYGMFVAEAKFQEAPESYMPAIIAQDPDQLMHLLTYETVERAIEHRVEAKAKIFGQEVNIGAEDSGSPPVYKMRPSLVAELYSYRIMPLTKDVQVAYLLRRLD

SEQ ID NO: 45918 - protein, 519 aa, Sorghum bicolor
  Clone ID: SORBI-28MAY03-C2418_1.pep
MARGDGELELSVGVRGAGGRAAAADHVAPISLGRLILAGMVAAGVQYGWALQLSLLTPYVQTLGLSHALTSFMWLCGPIAGLVVQPLVGLYSDRCTARWGRRRPFILTGCVLICIAVIVVGFSSDIGAALGDTKEHCSLYHGPRWHAAIVYVLGFWLLDFSNNTVQGPARAMMADLCGHHGPSAANSIFCSWMALGNILGYSSGSTNNWHKWFPFLKTNACCEACANLKGAFLVAVVFLVICLAITLVFAKEVPYRGNENLPTKANGEVEAEPTGPLAVLKGFKNLPRGMPSVLLVTGLTWLSWFPFILYDTDWMGREIYHGDPKGTNAQISAFNEGVRIGAFGLLLNSIVLGFSSFLIEPMCRKVGPRVVWVTSNFMVCVAMAATALISFWSLKDYHGYVQNAITASTSIKAVCLVLFAFLGVPLAILYSVPFAVTAQLAASMGGGQGLCTGVLNISIVIPQVIIAVGAGPWDALFGKGNIPAFGVASGFALIGGVVGMFLLPRISKRQFRAVSAGGH

SEQ ID NO: 45919 - protein, 98 aa, Sorghum bicolor
  Clone ID: LIB3478-054-Q6-K1-C12.pep
AASWACSCCPGSPSASSGPSARAATDRARRHKPNRARSSCMLKVEQNKKQAKRETIVCFCCVWLIGVARWSGGEAVKVSIQHQLVTKVWSGLCASAIS

SEQ ID NO: 45920 - protein, 387 aa, Sorghum bicolor
  Clone ID: SORBI-28MAY03-C45575_1.pep
MTGGANGRSQQSSRGKAMLLALGKGFPDQVLPQEKVVESYLQDSSCDDPATRAKLERLCTTTTVRTRYTVMSKELLDKHPELKMEGTPTLTPRLDICNAAVIDLGAAAARAALDDWGRPAADITHLIYISSSELRLPGGDVHLAARLGLSPNTVRTSLLFLGCSGGAAALRTAKDIAENNPGSRVLVTAAETTVLGFRPPSYDRPYDLVGAALFGDGASAVIIGAGPMAPAEDPFLELEFSTQEFLPGTDKVIDGKIAEEGINFKLGRDLPEKIESRIEGFCRTLMNQVGIKDFNDVFWAVHPGGPAILNRLEFCLELQPEKLKISRKALKNYGNVSSNTIFYVLEYLRDELKKGAISEEWGLILAFGPGITFEGLLVRGVKKTFTS

SEQ ID NO: 45921 - protein, 300 aa, Sorghum bicolor
  Clone ID: SORBI-28MAY03-C45699_1.pep
MAAPGSLGLLHAPSFAAAKCQPVASRASARRAPRALFAVRASAADAANKDAVLKAFRENRALKIISGLQNFDRSSVASVVTAADKGGATHVDIACDKDLVKLAMDLTNLPICVSSVDPSAFHSAVEAGAKMVEIGNYDSFYEMGIEFSSEQVLKLTRETRKMLPEITLSVTVPHTLSLPDQMRLAELLEEEGADIIQTEGGKCSSPTKPGVLGLIEKATPTLAAAYSISRAVSIPVMCSSGLSSVTAPMAVTAGAAGVGVGSAINKLNDVVAMIAEVRSIAQAMGLAPRIVSENLRTVRH

SEQ ID NO: 45922 - protein, 431 aa, Sorghum bicolor
  unsure (1)..(431): unsure at all Xaa locations
  Clone ID: SORBI-28MAY03-C3727_1.pep
MAPLTPRLVVPIDVKKQPWEQKVPLHNRWHPDIPPVADVTEGELFRVEMVDWSGGRVRDDNSADDLKFIECSAARRNRRPRPTAGSGGGPASPGGLRAVEICNLGPLPGDEWGYTAILERENGGGFLTDHFPSTRKAIWYFEGIYAYSPHIPXWNEREKRLAETRPDTLKLCEVLHQRPLANLPTPENCLLGKIQEGTAEWHKMANEAARTIPGRENGGNCDIKNLSSGSKVYLPVFVEGANLSTGDMHFSQGDGEVSFCGAIEMSGFLELKCEIIRGGMKEYLPPVGPTPLHVNPIFEIGPVEPRFSDWLXVFEGISVDESGRQHFLDASVAYKRAVLNAIEYLSRFGYSKEQVYLLLSCCPCEGRISGIVDSPNAVATLAIPTAIFDQDIRPKHLRGRLRPKLIRLPDLLSCSNNGLPVTQDQSSTRAP

SEQ ID NO: 45923 - protein, 219 aa, Sorghum bicolor
  Clone ID: SORBI-28MAY03-C16150_1.pep
MDLLERNIKKGDTTEEEKARKEDERKEEEEVGERKTKTQDQEPQPQGQVLSLSLANGSARSGMLPMANPSANPAQLTIFYGGSVCVYDSVPPEKAQAIMLIAAAAAAAAATKGSAATAVKPPMMPAATVAPAAVVSPVLTRSPSLQSTSVANGQPQVVADPSSICKLQADLPIARRHSLQRFLEKRRDRIVSKAPYSPAKSSDGMESPGMEVTAEGKTQ

SEQ ID NO: 45924 - protein, 216 aa, Sorghum bicolor
  Clone ID: SORBI-28MAY03-C17581_2.pep
MASGRMLLGVCAVLLAVAVANAADGQVASVVVGLARCADCTRKNMKSEAAFKGLQVAIKCKNTNGEYETKAVSELQSTGAFSVPLAADLHGAECHAQLHSAANAPCPGQEPSRIAPMSGGTFVAIPGKTHYNPSAECASAFLCSPIKKHFLDHFHKAPVPEHKPVPEHKPVPEHHPTPEYHPPTPEYHPSTPEYHSPTPVYGQPKPTPIYHPPAEH

SEQ ID NO: 45925 - protein, 246 aa, Sorghum bicolor
  Clone ID: SORBI-28MAY03-C17581_1.pep
MGAVLRFVRSYKSHGAAGRAGTHTSHIHTHKLASRTMASGRMLLGVCAVLMAVAVANAADGQVASVVVGLARCADCTRKNMKSEAAFKGLQVAIKCKNTNGEYETKAVSELQSTGAFSVPLAADLHGAECHAQLHSAANAPCPGQEPSRIAPMSGGTFVAIPGKTHYNPSAECASAFLCSPIKKHFLDHFHKAPVPEHKPVPEHHPTPEYHPPTPEYHPPTPEYHSPTPVYGQPKPTPIYHPPAEH

SEQ ID NO: 45926 - protein, 535 aa, Sorghum bicolor
  unsure (1)..(535): unsure at all Xaa locations
  Clone ID: SORBI-28MAY03-C2045_1.pep
MSAAMSAAAASAAASXPKWVMLERFVFRMDEAFPDEDKLPIRASGITRWEAPFDIAFELAEPPAISRLYARLPGFPDPLKQVPLAILASHQHLVLFRVCIEDDTFDLRQELFIYSASDADDPSKLKALPACMDYPLHGGGRGGRRRRRRRPPPSQDQRPRPTAVRSMGILCRDQQEFVVAELRLFRPGRCPDPKVCAPEVFADIFWLHKLAVPTGAIEGKWNSCRVPIRSFCKKPDGNGILGFENPDPDDTWQLCIWQTDTVIPVGRWLCWIDYYRGILFCDVFGDPTPTVSFLRFPLDEFPIRGKPSSWLYRGASDVGGRKLKFVDIARHDGVGYGALKTSVGGFTITCHTLSLESMEWKKDYTVTSKELWSANAPKDLPRHILMFPQVDIYRPHVVHFLCCDYEYVMMKMWVVTIDMSTRIVESCSQYLNGLADLHTDKIELTQVKSAFPLPFLSSEFSKFLSSARPWAPAARVLTRASVTAPSAASFKTHGLVDVLVCSGRPCTPALRVLTRGLFAAPSSASFTPRGLVEVL

SEQ ID NO: 45927 - protein, 391 aa, Sorghum bicolor
  Clone ID: SORBI-28MAY03-C2674_1.pep
MVKDTRYYDVLGVDPSATESEIKKAYYVKARLVHPDKNPNDPQAAEKFQELGEAYQVLSDPTQRQAYDSHGKDGISTEGIIDPAAIFAMLFGSELFEDYIGQLAMASMASLDNFGEDEQIDAKKLQERMQAVQKEREEKLAESLKNRLHIYVQGNRDEFIQHAEAEVSKPSESAYGIVMLNTIGYVYSRQAAKELGKKAMFLGVPFIAEWFRDKGHFIKSQETAATGAIALMQLQEDLRKYMSAEGQYTEEELELYMRNHKKIMVDSLWKLNVADIEATLSHVCQMVLQDSSARKEELRLRAKGLKTLGRIFQRVVKLNPSEGETSQVKNIDNMDDNDGSSPDSSPKREAQFTPNQPPVPSPYVEAPHVNGVYCPFPMPAAPPGAQRDRIP

SEQ ID NO: 45928 - protein, 259 aa, Sorghum bicolor
  Clone ID: SORBI-28MAY03-C18987_1.pep
MGSKQQIGVVVVLSCFIAISALAFRPCAAWSDAGATWYGPANGAGSDGGACGYQGAVHQPPFSSMITAGSNSIYQDGKGCGTCYQVKCTGHQSCSGSPVTVVLTDQCPGACQSEPVHFDLSGTAFGAMAKPGQADQLRNVGRLPVQYTRVPCNWNGVDVAFRVDAGSNANYLAMAIEYEAGDGDLRAVELQNGAAAWAPMERSWGAVWRYQSSGSSLQAAPLSVRLTSGSGKTLVASGVIPAGWQPGNTYRSVVNFGGN

SEQ ID NO: 45929 - protein, 627 aa, Sorghum bicolor
  Clone ID: SORBI-28MAY03-C219_1.pep
QTTTRDLEKLFDERRKMLRDHILAGASAVALTSDIWSGNAKEDYITVVAHYVTDDWVLQKKVIGFRLIDCKHTGDNIAERIGAVIQEFGLIDKVFAITLDNASSNSKAMKKLNVLFGGYLGADPVSDDDDAENFLDAIYNLAHQRCVCHIINLIVKSGLKRFKPYLEDLRTAITFLNSSNHRIALFKNLCIAKGIKPRKFGVDMDVRWNSTYLMLQHLCEEPYPGVFKTFINANFGSEDLLTTRHFTIAKQILQFLEVFYESTVILSGVYYPTSPLVMHQLLEIAIHLQAADEDINLYTIVYPMKQKYLKYWKQIPMLFSIAFVLDPRAKMIGLYNTLTLLKDFAGCDYSSYYADVRSELEKLFAKYEKKYGTARVVREQPPSIIGKRKNATWDRIFGGAGSVVQPGVVCNSAMSELSSYLDSDRLTEYDDSFDILLWWKDHKLTFPVLSILARDVLSVPASTVSSESCFSLTGRILEERRRRLLPEHVEMLVCIKDWELGDAREQHSLVTEHKELAERFDKISIVDGAQGTTADAGGVPAPAGVASQGATPSSVQGRGPGASAGRGGRGAAAAAGNRGGRGVAAAGRGQPAAGRGTAAGTGRGTAAARRGASAGVRAFGLRGTRRG

SEQ ID NO: 45930 - protein, 138 aa, Sorghum bicolor
  Clone ID: SORBI-28MAY03-C23950_1.pep
MDTKKKSAPAAAGAAAPPPASGYFSTVFSASPAGSANDAKQSDLYTMLNKQSSRGQNGSSITDGKSHGRPTYKDGKQSYPNESSESPYFGSSVHYGGREFYSSTLQKQPANEPHTNYKEDNPDGSATRGDWWQGSLYY

SEQ ID NO: 45931 - protein, 381 aa, Sorghum bicolor
  Clone ID: SORBI-28MAY03-C24563_1.pep
MASSTQGQVITCKAAVAYEPNKPLVIEDVQVAPPQAGEVRVKILFTALCHTDHYTWSGKDPEGLFPCILGHEAAGVVESVGEGVTEVQPGDHVIPCYQAECKECKFCKSGKTNLCGKVRSATGVGVMMNDMKSRFSVNGKPIYHFMGTSTFSQYTVVHDVSVAKINPQAPLDKVCLLGCGVPTGLGAVWNTAKVEAGSIVAVFGLGTVGLAVAEGAKAAGASRIIGIDIDNKKFDVAKNFGVTEFVNPKDHDKPIQQVLVDLTDGGVDYSFECIGNVSVMRAALECCHKGWGTSVIVGVAASGQEIATRPFQLVTGRVWKGTAFGGFKSRTQVPWLVDKYMNKEIKVDEYITHNMNLADINDAFHLLHEGGCLRCVLAMQI

SEQ ID NO: 45932 - protein, 216 aa, Sorghum bicolor
  unsure (1)..(216): unsure at all Xaa locations
  Clone ID: SORBI-28MAY03-C25591_1.pep
MASPQAHPASDHAGETEARAEEKTGQVMGAAQAKRREAKHKMSAAADRAMGAVLDAREATREKARDAADRTMGMGHDAREATRDRACRAKHAASDSSTAAXEWAAEARDRARDGAQQTGSYVAQTAEAARQKAAGAAQYAKETVVAGKDKTGALLQQAGEKVMNTAVGAKDTVVSTAVGAKDAVMNSLGMAGENNDGTTTTNAGKDTSTRKPGRDY

SEQ ID NO: 45933 - protein, 172 aa, Sorghum bicolor
  Clone ID: SORBI-28MAY03-C34739_1.pep
ARCGKAVPLPPPSPPSRPLPSTCLHPGTASLLRCRPFLLTETRALVLYAGDHSCEFLLPRLHQLQRFSSTLESVIEDCHALRHTAIVLLLRSLLIFRLALRHTAIVLFLSSLLIFTLILLYRNFAMCSIAVCVISSCLVPVQFHCDDGHATIALSAFLTSSSGHRFFSDDLF

SEQ ID NO: 45934 - protein, 169 aa, Sorghum bicolor
  Clone ID: SORBI-28MAY03-C1773_2.pep
MAATTSQASLLLQKQLRDLAKHPVDGFSAGLVDDSNVFEWQVTIIGPPDTLYDGGYFNAIMSFPQNYPNSPPSVRFTSEMWHPNVYPDGRVCISILHPPGEDPNGYELASERWTPVHTVESIVLSIISMLSSPNDESPANIEAAKEWREKREDFKKKVRRIVRKSQEMF

SEQ ID NO: 45935 - protein, 180 aa, Sorghum bicolor
  Clone ID: SORBI-28MAY03-C1773_1.pep
KNTKLIGVYIVSSIYIPIKNDCCTRLASDDDHRLELNATQQKIEVHASSCRRGAGLLAIVAEHLVLLFVASLVACSGDLRRFHHVVLVALLLADLHRRRSDALLLGALALALDPPVQHQVGALGELTGLLADNEVHPLPALAERGAEAVLDLLRLRRLAGGGHALCRFLLLCLCCEWGGH

SEQ ID NO: 45936 - protein, 111 aa, Sorghum bicolor
  Clone ID: LIB5047-002-R1-XP1-H6.pep
KNTKLIGVYIVSSIYIPIKNDCCTRLASDDDHRLELNATQQKIEVHASSCRRGAGLLAIVAEHLVLLFVASLVACSGDLRRFHHVVLVALLLADLHRRRSDAMVVFIFSIA

SEQ ID NO: 45937 - protein, 79 aa, Sorghum bicolor
  Clone ID: LIB3478-047-P1-K1-F12.pep
GNLCWGGQGCEDPNGYELASERWTPVHTVESIVLSIISMLSSPNDESPANIEAAKEWREKREDFKKKVRRIVRKSQEMF

SEQ ID NO: 45938 - protein, 132 aa, Sorghum bicolor
  Clone ID: LIB3480-035-P1-K1-A9.pep
VHASSCRRGAGLLAIVAEHLVLLFVASLVACSGDLRRFHHVVLVALLLADLHRRRSDALLLGALALADNEVHPLPALAERGAEAVLDLLRLRRLAGGGHALCRFLLLCLCCECSQDSLQTMRSMVVFIFSIA

SEQ ID NO: 45939 - protein, 120 aa, Sorghum bicolor
  Clone ID: LIB3480-014-P1-K1-D3.pep
GMEGEEGGLQEKGAAHCAEITGNVLKKMKTTMASAALLLVLALALVSAPLTAEAKKKKPAESVAAAGEAAEAKKVQDSFCATLCQGRKGMDLIVCKESCELSQRSNLVLYRADPVQGASA

SEQ ID NO: 45940 - protein, 101 aa, Sorghum bicolor
  Clone ID: LIB3480-036-P1-K1-E12.pep
STRLERWESSQDSLQTMRSIPFLPWQSVAQKLSWTFFASAASPAAATLSAGFFFFASAVSGADTSARASTNSSAADAMVVFIFSIASSSSRAAARDLELVA

SEQ ID NO: 45941 - protein, 332 aa, Sorghum bicolor
  Clone ID: SORBI-28MAY03-C3550_1.pep
MSKARVYADVNVLRPKEYWDYEALTVQWGEQDDYEVVRKVGRGKYSEVFEGINVNNNEKCIIKILKPVKKKKIKREIKILQNLCGGPNIVKLLDIVRDQHSKTPSLIFEYVNNTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDGLNAYLNKYRIELDPQLEALVGRHSRKPWSKFINADNQHLVSPEAIDFLDKLLRYDHQDRLTAREAMAHPYFQQVRAAENSRTRA

SEQ ID NO: 45942 - protein, 450 aa, Sorghum bicolor
  Clone ID: SORBI-28MAY03-C6107_1.pep
MREIISIHIGQAGIQVGNACWELYCLEHGIEPDGTMPSDTSVGVAHDAFNTFFSETGSGKHVPRAIFVDLEPTVIDEVRTGSYRQLFHPEQLISGKEDAANNFARGHYTVGKEIVDLCLDRVRKLADNCTGLQGFLVFNAVGGGTGSGLGSLLLERLSVDYGKKSKLGFTIYPSPQVSTAVVEPYNSVLSTHSLLEHTDVAVLLDNEAIYDICRRSLDIERPTYTNLNRLISQIISSLTTSLRFDGAINVDVTEFQTNLVPYPRIHFMLSSYAPVISAEKAYHEQLPLPRCPGALSQPSSMMAKCDPRHGKYMACCLMYRGDVVPKDVNAAVATIKTKRTVQFVDWCPTGFKCGINYQPPSVVPGGDLAKVQRAVCMISNNTAVAEVFSRIDHKFALMYAKRAFVHWYVGEGMEEGEFSEAREDLAALEKDYEEVGAEGADDEGDEGDDY

SEQ ID NO: 45943 - protein, 587 aa, Sorghum bicolor
  Clone ID: SORBI-28MAY03-C5207_1.pep
MAMIDEPLYPIAVLIDELKNEDIQLRLNSIRKLSTIARALGEERTRKELIPFLSENNDDEDEVLLAMAEELGVFIPYVGGVEHAHVLLPPLETLCTVEETCVRDKAVESLCRIGAQMKENDIVDWFAPVVKRLAAGEWFTARVSSCGLFHIAYPSASEQLKAELRTIYGQLCQDDMPMVRRAAASNLGKFAATVEQSHLKTEIMSIFDDLTQDDQDSVRLLAVEGCAALGKLLEPQDCAAHILPVIVNFSQDKSWRVRYMVANQLYELCEAGGTEPTRGDLVSAYVRLLCDNEAEVRIAAAGKVTKFCKILNPQIAIEHILPCVKELSTDSSQHVRSALASVIMGMAPVLGKDATIEQLLPIFLALLKDEFPDVRLNIISKLDQVNQVIGIDLLSQSLLPAIVELAEDRHWRVRLAIIEYIPLLASQLGVGFFDDKLGALCMQWLEDKVFSIRDAAANNLKRLAEEFGPEWAMQHIIPQVLEKINNPHYLYRMTTLQAISLLAPVMGPDITCQQLLPVVIASSKDRVPNMKFNVAKVLQSLVPILDQSVVEKAVKPCLVELSEDPDVDVRYYAHQALRACDQMVISS

SEQ ID NO: 45944 - protein, 402 aa, Sorghum bicolor
  Clone ID: SORBI-28MAY03-C10703_1.pep
MADYVYGPGRNHLFVPGPVNIPDPVIRAMNRQNEDYRSPAIPALTKVLLEDVKRIFKTTTGTPFLIPTTGTGAWESALTNTLSPGDRIVSFLIGQFSLLWIDQQQRLGFDVDVVESDWGHGADLDALERKLRDDTLHTIKAVAIVHNETATGVTNDLAAVRTLLDAYAHPALLLVDGVSSICALDFRMDEWGVDVALTGSQKALSMPTGMGIVCASSKALEASKAARSVRVFFDWKDYLRFYEMGTYWPYTPSIQLLYGLRTALDLIFEEGLDNVVKRHNRLGTATRFAVEAWGLKNCCQKEECFSDTVTAVVVPPYIDSAEIVKHAWKRYNLSLGLGLNKVAGKVFRIGHLGNLNELQLLGCLSGVEMVLKDVGYPVKLGSGVAAAAAYLSNSTPLIPSRI

SEQ ID NO: 45945 - protein, 160 aa, Sorghum bicolor
  unsure (1)..(160): unsure at all Xaa locations
  Clone ID: SORBI-28MAY03-C13074_1.pep
PSILFSPFSFYGLFVREATTFKDFDQLEASFFCPVADRWWGIVDTKYXPRGRAPFGFSGENQDGFTELNRGPRSGGFKHQKQFGPTVTIAVKGQALPSAGKQNSALPDKGQFNQEGFPLAYKDAKFFVIKSYSEDDVHKSIKYNVWASTPNGNKKLDAGY

SEQ ID NO: 45946 - protein, 182 aa, Sorghum bicolor
  Clone ID: SORBI-28MAY03-C873_2.pep
MASEKKQSNPMREIKVQKLVLNISVGESGDRLTRAAKVLEQLSGQSPVFSKARYTVRSFGIRRNEKIACYVTVRGEKAMQLLESGLKVKEYGLLRRNFSETGCFGFGIQEHIDLGIKYDPSTGIYGMDFYVVLERAGYRVARRRRCKSRVGIQHRVTKEDAMKWFQVKYEGVILNKAQANTS

SEQ ID NO: 45947 - protein, 186 aa, Sorghum bicolor
  Clone ID: SORBI-28MAY03-C873_1.pep
MASEKKQSNPMREIKVQKLVLNISVGESGDRLTRAAKVLEQLSGQTPVFSKARYTVRSFGIRRNEKIACYVTVRGEKAMQLLESGLKVKEYELLRRNFSDTGCFGFGIQEHIDLGIKYDPSTGIYGMDFYVVLERAGYRVARRTTCRARVGIQHRVTKQDWMQWFRVKYGRVILNKAQANTTQGSL

SEQ ID NO: 45948 - protein, 130 aa, Sorghum bicolor
  Clone ID: SORBI-28MAY03-C1331_1.pep
MASKAVLFLALNLLFFTVANACGSCPTPTPPPPPPPATTPPPPSSGKCPLNALKFGVCANVLGLVKGEVGKVPAEPCCTLLDGLVDFEAAVCLCTAIKANVLGIVIDVPVKLSALVNYCGKCVPKGYICA

SEQ ID NO: 45949 - protein, 115 aa, Sorghum bicolor
  Clone ID: SORBI-28MAY03-C12309_3.pep
MPCLNVSTNVNLEGVDTSVILAEASKSVANIIGKPEAYVMVVLKGSVPMAFGGTQEPAAYGELVSIGGLNPDVNKKLSAGIASILESKLSVPKSRFYLKFYDSKRSDFGWNGSTF

SEQ ID NO: 45950 - protein, 121 aa, Sorghum bicolor
  Clone ID: SORBI-28MAY03-C12309_2.pep
MPCLNVSTNVNLEGVDTSVILAEASKSVANIIGKPEAYVMVVLKGSVPMAFGGTQEPAAYGELVSIGGLNPDVNKKLSAGIASILESKLSVPKSRFYLKFYDSKAHPAQEHAQCLHALHQE

SEQ ID NO: 45951 - protein, 115 aa, Sorghum bicolor
  Clone ID: SORBI-28MAY03-C12309_1.pep
MPCLNVSTNVNLEGVDTSAILAEASKSVADIIGKPEAYVMVVLKGSVPMAFGGTQEPAAYGELVSIGGLSPNVNKKLSAGIASILESKLSVPKSRFYLKFYDSKGSDFGWNGSTF

SEQ ID NO: 45952 - protein, 68 aa, Sorghum bicolor
  Clone ID: LIB5047-011-R1-XP1-H4.pep
HKHAMWHSTQVWVPVPVPHNSYRFSVQHQLTLLLTGNSHGIMHHEFPLLKIRASSLEGGAIPTEVRAL

SEQ ID NO: 45953 - protein, 391 aa, Sorghum bicolor
  Clone ID: SORBI-28MAY03-C14877_1.pep
MKVSVKTLKGSSFQIEVEPTDKVADVKKVIESIQENASYPADQQVLIHQGKVLKDDTTLEENQVVENNFLVIMLRQNKGSSSAAPAKATANQAPPTQTVPATPTQMSAAPAAPAPIVPVSAPAATATALAAPAVAVSTEADSYGQAASNLVAGSNLEGTIQSILEMGGGTWDRDTVLRALRAAYNNPEPPGEYLYSGIPEQMEAPAPPPSSQPANPVQAAQTAQAVVPSSGPNANPLDLFPQSLPNASANAGAGNLDVLRNNAQFQNLLGLVQANPQILQPLLQELGKQNPQVMQLIQENQAEFMRLINEPLEGDEENEMMLDQMADAAETIAVTPEENEAILRLEGMGFDRALVLEVFFACNKNEQLAANYLLDHMHEFDNDDGLGGPPL

SEQ ID NO: 45954 - protein, 390 aa, Sorghum bicolor
  Clone ID: SORBI-28MAY03-C16864_1.pep
MAAAALLRRIPAARAPATAFMAARPISDSTAALTIETSVPFTSHLVDPPSRDVTTTPAELVTFFRDMSLMRRMEIAADSLYKAKLIRGFCHLYDGQEAVAVGMEAAITRSDSIITAYRDHCTYLARGGDLVSAFSELMGREGGCSRGKGGSMHFYKKDANFYGGHGIVGAQVPLGCGLAFAQKYKKEDTATFALYGDGAANQGQLFEALNISALWKLPAILVCENNHYGMGTAEWRAAKSPAYYKRGDYVPGLKVDGMDVLAVKQACKFAKDHAVANGPIVLEMDTYRYHGHSMSDPGSTYRTRDEISGVRQERDPIERVRKLLLTHDLATAAELKDMEKEIRKQVDDAIAKAKESSMPDTSELFTNVYKKGFGVESFGPDRKELRASLP

SEQ ID NO: 45955 - protein, 72 aa, Sorghum bicolor
  Clone ID: SORBI-28MAY03-C1360_2.pep
MGKMPVRMKAVVYALSPFQQKVMPGLWKDITTKIHHKVTENWISATLLVTPVVGTYQYAMWYKEQEKLSHRY

SEQ ID NO: 45956 - protein, 172 aa, Sorghum bicolor
  Clone ID: SORBI-28MAY03-C1360_1.pep
WVAGWVASPPPGRLSTLLYRSGRRQDAMEKLKATQQVAPSAAFRVAAWEALMGLHMEAGQEMSYLISPDDLVDLSIKDDSRWSDQDHLKFRVNAIRGLVALLNGETESAAQLFDDWSRDFSGGENQTQNAAISYGEYLHCVGDFQMAAQVYEKIHEAFCMDDVSGNLLAAGN

SEQ ID NO: 45957 - protein, 72 aa, Sorghum bicolor
  Clone ID: LIB5051-002-A1-XP1-B9.pep
MGKVPVRMKAVVYALSPFQQKVMPGLWKDITTKIHHKVTENWISATLLVTPVVGTYQYAMWYKEQEKLSHRY

SEQ ID NO: 45958 - protein, 159 aa, Sorghum bicolor
  unsure (1)..(159): unsure at all Xaa locations
  Clone ID: SORBI-28MAY03-C12917_2.pep
MKGAVIGASTVLVVAVVATICVVSLRGSGDGDSREEGEMSTSVKSIKSFCQPVDYRETCEKALRAAAGNATSPTDLAKAIFKVTSDRIEKAVRESAVLNELKNDPRTKGALDNCRELLDYAIDDLKTTFDRLGGFXMTNFKSAVDDLPTWLNFALTYQE

SEQ ID NO: 45959 - protein, 458 aa, Sorghum bicolor
  Clone ID: SORBI-28MAY03-C12917_1.pep
GRVDAHSVEPSIGVIGGYKYLPKGIPLYCFKRRVHDLRTWLSSALTYQETCLDGFENTTTAAAGKMRGVLNSSQELTENILALVDEFSETLANLGIPSFHRRLLADHAGGVPSWMPDAKRRLRKVSPGDKGFKPDVTVAKDGSGDFRTINAALAKVPVKSAATYVMYVKAGTYREYVSVPRNVTNLVMVGDGATKTVITGDKSFMMNITTKDTATMEALGNGFLMRGIGVENTAGAKNHQAVALRVQSDMSAFYECRFDGYQDTLYTHTSRQYYRECVITGTIDFIFGNAQVVFQNCLIQVRKCMDNQQNIVTAQGRKERRSAGGTVIHNCTIEPHPEFEKSAGDGKLRTFLGRPWKEHSRTLYIQSEIGGFIDPKGWLPWLGDFGLSTCYYAEVENRGAGADTSKRVKWRGVKNITYQHALQKYTVESFIQGQHWLPQLGVPFIPGLLPQNQSGRIH

SEQ ID NO: 45960 - protein, 240 aa, Sorghum bicolor
  Clone ID: SORBI-28MAY03-C13_1.pep
MRVAATRLAAAPPPIRFLFLLVLLGSAIGAAMAGHVLGGVKENPAAANSAESDGLGRFAVDEHNKRENALLEFVRVVEAKEQVVAGTLHHLTLEAIEAGKKKLYEAKVWVKPWLNFKELQDFSHKGEATTFTNADLGAKKGEHEPGWREVPIEDPVVKDAAHHAVKSIQERSNSLFPYELLEIVRAKAQVVEDFAKFDILMKLKRGSKEEKIKAEVHKSLEGAFVLNKHQPAEHEESSSQ

SEQ ID NO: 45961 - protein, 242 aa, Sorghum bicolor
  Clone ID: SORBI-28MAY03-C2154_1.pep
FIIVIGLFLFTKGARGSKGAETKAKAAAEPSKEAETKAKAAAEPAKEADTKAKAAAEPAKKAAAAPPAAAANDKDEAKKSDKPKDGAGKQAEPAAGTTTERSLPSPPAPAPKHAYEQEYRQPYYSPQPVVSYHASHPSSSVSYTYFAPQAQPAYSMQQAHPQQAYYSTHQPQPSYSYSVQPQPQPEKQWSPSYLYMPYPHSAAPEPYYQQQDHYSPPGMHASPMHDSYRIFDDENPNSCSVM

SEQ ID NO: 45962 - protein, 148 aa, Sorghum bicolor
  Clone ID: SORBI-28MAY03-C2172_1.pep
MASKRILKELKDLQKDPPTSCSAGPAGEDMFHWQATIMGPPDSPYAGGVFLVNIHFPPDYPFKPPKVSFKTKVFHPNINSNGSICLDILKEQWSPALTISKVLLSICSLLTDPNPDDPLVPEIAHMYKTDRPKYEATARSWTQKYAMG

SEQ ID NO: 45963 - protein, 117 aa, Sorghum bicolor
  Clone ID: LIB3480-001-P1-K1-C3.pep
MASKRILKELKDLQKDPPTSCSAGPAGEDMFHWQATIMGPPDSPYAGGVFLVNIHFPPDYPFKPPKVSFKTKVFHPNINSNGSICLDILNEQWSPALTISKGLLSICSLLTDPNPID

SEQ ID NO: 45964 - protein, 112 aa, Sorghum bicolor
  Clone ID: SORBI-28MAY03-C26799_1.pep
SHSHSWGETRTPESEIVDNDPFPELDSFPAFQDPAAAMMMVPKKEQVDDGSAAANAAKSSDLFVDLSYDDIQGMYSGLDMLPPPGEDFFSSLFASPRVKGNQPAGAAGLGPF

SEQ ID NO: 45965 - protein, 208 aa, Sorghum bicolor
  Clone ID: SORBI-28MAY03-C2715_1.pep
MSKMAEQKAAAVDGLGGAGAADAAPAGEAAAARVRPVETLLRAAPLGLCVAAMTVMLRDQQSNEYGTVAYSDLGGFKYLVYANGLCAAYSLVSAFYTAVPRPATVSRSWVVFLLDQVFTYLILAAGAAAAELLYLAYNGDKEVTWSEACGVFGSFCRQARTSVAITFGTVLCFILLSLISSYRLFSAYEAPPSSALGSKGVEIAAYPR

SEQ ID NO: 45966 - protein, 253 aa, Sorghum bicolor
  Clone ID: SORBI-28MAY03-C34_1.pep
MSREENVYMAKLAEQAERYEEMVEYMEKVAKTVDVEELTVEERNLLSVAYKNVIGARRASWRIVSSIEQKEESRKNEEHVAQIKEYRGKIEAELSNICDGILKLLDSHLVPSSTAAESKVFYLKMKGDYHRYLAEFKTGAERKESAESTMVAYKAAQDIALAELAPTHPIRLGLALNFSVFYYEILNSPDKACNLAKQAFDEAISELDTLGEESYKDSTLIMQLLRDNLTLWTSDITEEGTEEGKEASKGDAE

SEQ ID NO: 45967 - protein, 258 aa, Sorghum bicolor
  Clone ID: SORBI-28MAY03-C3663_1.pep
MAEEQPNPQPQQAEESEVVVEQQPRRAPKLRYLDFVQVAAAQAVVCLAGLYGLAKDHAGPLRPGVDAVESTVKGVAGPVYARFGGLPLDVLAFVDRKVDDTVHEVDKHLPGALKAASARAYAVARGVPEVARELVAEAQQSGVKGAARAALARAEPVARDVYGRVEPVARDLYVRYEPAAEHLAVSAWRSLNGLPVFPHVAQIVVPTAAHWAEKYNRAVVAAAERGYAGAKYLPAIPTERIAKVFSSPDAEPLAAESQ

SEQ ID NO: 45968 - protein, 165 aa, Sorghum bicolor
  Clone ID: SORBI-28MAY03-C4423_1.pep
MSTVAAMASSSLNPNAPLFIPAAYRQVEDFSPEWWELVKTTAWFRDHWFRQHQLHEAAYDAAFAADAADDFDVAALLPDDSVDLLDMVDTDDLFYAPDVHHHQAAKPAPAPGYDLDVLRALSVSSPRAAATVVAAPSPQQQRYADKPAYHAGGRGAARRAIHQPR

SEQ ID NO: 45969 - protein, 147 aa, Sorghum bicolor
  Clone ID: SORBI-28MAY03-C45276_1.pep
YEDFFASCEYHLAEHGLLVLQSIACPEELYDKMRTRPEFLKEYIFPGGCLPSLARITSAMSNASRLCVHHVENIGYHYYPTLIHWRDNFVANREKVLALGFDEKFIRTWEYYLNYCAAMFKSHMGLDYQIVFARPGDSKMPSYVAIA

SEQ ID NO: 45970 - protein, 387 aa, Sorghum bicolor
  Clone ID: SORBI-28MAY03-C28656_1.pep
MIPSVRLSPGPAAFSGSSLRSKLPSIPSISSLKPSKYVVSSLKPLYLAPLDGPRTAELKSRRQPLEFRCAASAADDKESKTKAVPVQSEGTQRLKISIYFATWWALNVIFNIYNKKVLNAFPYPWLTSTLSLACGSAMMLFSWATRLVEAPKTDLDFWKVLFPVAVAHTIGHVAATVSMSKVAVSFTHIIKSAEPAFSVLVSRFILGETFPVPVYLSLLPIIGGCALAAVTELNFNMVGFMGAMISNLAFVFRNIFSKRGMKGKSVSGMNYYACLSIMSLVILTPFAIAMEGPQMWAAGWQKALAEVGPNVIWWIAAQSVFYHLYNQVSYMSLDQISPLTFSIGNTMKRISVIVSSIIIFHTPVRPVNALGAAIAILGTFLYSQAKA

SEQ ID NO: 45971 - protein, 230 aa, Sorghum bicolor
  Clone ID: SORBI-28MAY03-C2908_1.pep
MAGKRERIAIRRIDNLAARQVTFSKRRRGLFKKAEELSILCDAEVGLVVFSATGKLFHFASTSMKQVIDRYDSHSKNLQKSEAPSQLQSHIDDGTCARLKQELAETSLKLRQMRGEELQRLSVQQLQELEKTLESGLGSVLKTKSQKILDEISGLERKRMELIEENSRLKEQVTRMARMETQLGVDSEIVYEEGQSSESVTNTSYPRPSTDTDDCSDTSLRLGLPFFSSK

SEQ ID NO: 45972 - protein, 127 aa, Sorghum bicolor
  unsure (1)..(127): unsure at all Xaa locations
  Clone ID: LIB3481-015-P1-K1-F10.pep
MKQVIDRYDSHSKNLQKSEAPSQLQSHXMRGEELQRLSVQQLQELEKTLESGLGSVLKTKSQKILDEISGLERKRMETQLGVDSEIVYEEGQSSESVTNTSYPRPSTDTDDCSDTSLRLGLPFFSPK

SEQ ID NO: 45973 - protein, 112 aa, Sorghum bicolor
  Clone ID: SORBI-28MAY03-C2596_2.pep
MVKGRTGQRVRLYVRGTVLGYKRSKSNQYETTSLVQIEGVNTKEDVAWYCGKRMAYIYKAKTKSSGTHYRCIWGKVTRPHGNSGVVRAKFRSNLPPESMGRKVRVFMYPSSI

SEQ ID NO: 45974 - protein, 127 aa, Sorghum bicolor
  Clone ID: SORBI-28MAY03-C2596_1.pep
MSGGGSEAEGSKAATMVKGRTGQRVRLYVRGTILGYKRSKSNQYETTSLVQIEGVNTKEDVAWYAGKRMAYIYKAKTKSSETRYRCIWGKVTRPHGNSGVVRAKFKSNLPPESMGRKVRVFMYPSSI

SEQ ID NO: 45975 - protein, 112 aa, Sorghum bicolor
  Clone ID: LIB5052-003-A1-XP1-G11.pep
MVKGRTGQRVRLYVRGTILGYKRSKSNQYETTSLVQIEGVNTKEDVAWYAGKRMAYIYKAKTKSSETRYRCIWGKVTRPHGNSGVVRAKFKSNLPPESMGRKVRVFMYPSSI

SEQ ID NO: 45976 - protein, 317 aa, Sorghum bicolor
  Clone ID: SORBI-28MAY03-C7022_1.pep
MAAAWAVLAVLLVAAQVASAAPVTAPAFLWAPKNYGFRSDDAKEVVHYQTISPKSLAKSVLEEGGWSNFMCSREDTQKSIDVAVVFIGSKLQSSDISKDKQDDLTLADTLKLSFTDSEFSMAFPYVSTSDDEKLENSLLSSFAENCNSGFGRNRITYTDTCTVSGQDVKKYTNMDAIDDLVRYGVGSRRINPSEQTDIIVFCSGGFENFFTPKSEGELLSQLVLLLEQSGAKYTILYASQPSGLLENPSSLPLGRYLAEKTKGTKTGEGKCDGECLVKSTLLEGTFVGIVLLIILISGLMCMMGIDTPSRFEAPQES

SEQ ID NO: 45977 - protein, 214 aa, Sorghum bicolor
  Clone ID: SORBI-28MAY03-C6091_2.pep
NLIKHPKFITDTKAAIAETYNQTDSEFLKADSSQTRDAGSTASTAIIVGDRLLVANVGDSRAVICKGGQAIAVSRDHKPDQTDERQRIEDAGGFVMWAGTWRVGGVLAVSRAFGDKLLKQYVVADPEIKEEVVDSSLEFLILASDGLWDVVTNEEAVAMVKPIQDPQEAANKLLEEASRRGSSDNITVVIVRFLDGTTGDKSGEDKETTNDQNS

SEQ ID NO: 45978 - protein, 125 aa, Sorghum bicolor
  unsure (1)..(125): unsure at all Xaa locations
  Clone ID: SORBI-28MAY03-C6091_1.pep
MARPTRALLLPLPLLMLLALAALARASSGDVPAAASLGWDLGVVGAGEDEEFGFPSGGDSVARRVLQGGGYLSYGALQXIAGGCGALRRDNVPCSVRLALYYNCRPGGQANPYSRGCSAITRCRG

SEQ ID NO: 45979 - protein, 67 aa, Sorghum bicolor
  Clone ID: LIB3480-009-P1-K1-D9.pep
MGLAGDGSADTAQHLSNSENGRFSYGVASSPGKRASMEDFYEARIDDVDGEKVEMVGVYDGHGGVRA

SEQ ID NO: 45980 - protein, 232 aa, Sorghum bicolor
  Clone ID: SORBI-28MAY03-C9700_1.pep
ARGDDMSDLVSVGSCVLVVLLHGTDLCILNLGDSRAVLASMPYVQNGALKATQLTETHSLENPLEYQRLLADHPDDSSVVRGNKIKGKLKVTRAFGVGYLKQRKFNDALMGILRVRDLSSPPYVYTNPHTLSHKVTDDDLFVVLGSDGLFDFFSNDEVVWLVYQFMRDNPMGDPAKYLIEQLILKAAKEAALTAEELMRIPVGSRRKYHDDVTVIVIILGNAQRTMTASTSL

SEQ ID NO: 45981 - protein, 530 aa, Sorghum bicolor
  Clone ID: SORBI-28MAY03-C9131_1.pep
MSLRPSEREQMRKGNYKQTVDAEESRRRREGQMVDIRKAKREESLQKKRRDGFPASAAGAVPPMGHSTALQQKLDGLPAMVQAVLSNDPTVQLDATTQFRKLLSIERSPPIEEVISTGVVPRFIEFLTREDHPQLQFEAAWALTNIASGTSENTKVVVESGAVPIFVKLLNSHSEDVREQAVWALGNVAGDSPKCRDLVLGHGGLFPLLQQLNEHAKLSMLRNATWTLSNFCRGKPQPNFDQVKPALPALQRLIHSQDEEVLTDACWALSYLSDGTNDKIQAVIESGVFPRLVELLMHPSASVLIPALRTVGNIVTGDDMQTQCVIDNQALPCLLNLLTTNHKKSIKKEACWTISNITAGNREQIQAVINANIIAPLVQLLQTAEFDIKKEAAWAISNATSGGTHDQIKYLVAQGCIKPLCDLLVCPDPRIVTVCLEGLENILKVGEAEKNLGGGDVNVYAQMIDDAEGLDKIENLQSHDNTEIYEKAVKMLESYWLEEEDDAMPSGDNPQNGFNFGNQPSVPSGGFNFG

SEQ ID NO: 45982 - protein, 259 aa, Sorghum bicolor
  unsure (1)..(259): unsure at all Xaa locations
  Clone ID: SORBI-28MAY03-C7943_2.pep
MNQGTGSSSSASLSLLLFLAVRFLLPDPSLASRFMAMWRAAARQLVDRALGSSAAHTSAGSKKIVGVFYKAGEYADKNPNFVGCVEGALGIRGWLESQGHQYIVTDDKEGPNCELEKHIEDMHVLITTPFHPAYVTAERIKKAKNLELLLTAGIGSDHIDLPAAAAAGLTVAEVTGSNTVSVAEDELLRILILLRNFLPGYQQVVQGEWNVAGIAHRAYDLEGKTVGTVGAGRIGRLLLQRLKXPFNCNLLSHDRLQID

SEQ ID NO: 45983 - protein, 230 aa, Sorghum bicolor
  Clone ID: SORBI-28MAY03-C7943_1.pep
MAMRRAAQQAARFAMGPHVPHTAPAARSLHASAGSKKIVGVFYKGGEYADRNPNFVGCAEHALGIRGWLESQGHQYIVTDDKDGPNCELEKHIADAHVLITTPFHPAYVTADRIARAKNLELLLTAGIGSDHVDLPAAAAAGLTVAEVTGSNTVSVAEDQLLRLLGLLRNFLPGHHQAIRRGVGIAHRAYDLEGKTVGTVGAGRIGRLLLQRLKPFNCNLLYHDRLQIDP

SEQ ID NO: 45984 - protein, 168 aa, Sorghum bicolor
  Clone ID: SORBI-28MAY03-C12312_1.pep
PENKMPLARTAMYAKGIQIYCAPTADASPTWVASMTHIALEGGCFVVSANQFCRRKDYPPPPEYTFGGLDEEPSPETVVCPGGSVIVSPSGTVLAGPNFEGEGLVTADLDLGEIVRAKFDFDVVGHYSRREVLSLVVKTDPKSAVSFTASADGERAPAGKKGDDSVYK

SEQ ID NO: 45985 - protein, 637 aa, Sorghum bicolor
  Clone ID: SORBI-28MAY03-C12717_1.pep
GGGGPLGARVGLAAAAAAGSWWAVVLAVAVLLRPGRVVANTEGDALYSLRQSLKDANNVLQSARPTLVNPCTWFHVTCNNDNSVIRVDLGNAQLSGVLVPQLGQLKNLQYLELYSNNISGTIPPELGNLTNLVSLDLYMNNFSGSIPDSLGNLLKLRFLRLNNNSLVGQIPVSLTNISTLQVLDLSNNNLSGQVPSTGSFSLFTPISFANNPGLCGPGTTKPCPGAPPFSPPPPFNPPSPPTQSTGASSTGAIAGGVAAGAALVFAVPAIAFAMWRRRKPEEHFFDVPAEEDPEVHLGQLKKFSLRELQVATDNFSNKNILGRGGFGKVYKGRLADGSLVAVKRLKEERTPGGELQFQTEVEMISMAVHRNLLRLRGFCMTPTERLLVYPYMANGSVASRLRERQQSEPPLKWETRRRIALGSARGLSYLHDHCDPKIIHRDVKAANILLDEDFEAVVGDFGLAKLMDYKDTHVTTAVRGTIGHIAPEYLAAGKSSEKTDVFGYGIMLLELITGQRAFDLARLANDDDVMLLDWVKGLLKEKKVEMLVDPDLQNAYEEIEVENLIQVALLCTQGSPLDRPKMSEVVRMLEGDGLAERWDEWQKVEVVRQEAESAPLRNDWIVDSTYNLRAVELSGPR

SEQ ID NO: 45986 - protein, 374 aa, Sorghum bicolor
  Clone ID: SORBI-28MAY03-C12916_1.pep
MTVVDAVSTDAAGAAPAAAAAPVVVAQPGNGQTVCVTGAAGYIASWLVKMLLEKGYTVKGTVRNPDDPKNAHLKALDGAAERLILCKADLLDYDAICRAVQGCQGVFHTASPVTDDPEQVVEPAVRGTEYVINAAAEAGTVRRVVFTSSIGAVTMDPSRGPDVVVDESCWSDLEFCKKTRNWYCYGKAVAEQAAWDAARQRGVDLVVVNPVLVVGPLLQPTVNASIAHVLKYLDGSARTFANAVQAYVDVRDVADAHLRVFESPAASGRYLCAERVLHREDVVRILAKLFPEYPVPTRCSDEVNPRKQPYKFSNQKLRDLGLEFRPVSQSLYDTVKNLQEKGHLPVLGEQTTEADKEEANAAAEVQQGGIAIRA

SEQ ID NO: 45987 - protein, 412 aa, Sorghum bicolor
  Clone ID: SORBI-28MAY03-C12458_1.pep
MASVGVARSSSSLGFQNGTSSSSDADRLPNELGNMSIRDDKDVEDIVVNGNGAEPGHIIVTSIDGRNGQAKQTISYMAERVVGHGSFGTVFQAKCLETGETVAIKKVLQDKRYKNRELQTMRVLDHPNVVALKHCFFSKTEKEELYLNLVLEYVPETAHRVIKHYNKMNQRMPLIYAKLYMYQICRALAYIHNSIGVCHRDIKPQNLLVNPHTHQLKLCDFGSAKVLVKGEPNISYICSRYYRAPELIFGATEYTTAIDVWSAGCVLAELLLGQPLFPGESGVDQLVEIIKVLGTPTREEIKCMNPNYTEFKFPQIKAHPWHKIFHKRMPAEAVDLVSRLLQYSPKLRSTALEALIHPFFDELRDPNTRLPNGRFLPPLFNFKPHELKSVPMDFLVKLIPEHARKQCAFVGW

SEQ ID NO: 45988 - protein, 314 aa, Sorghum bicolor
  Clone ID: SORBI-28MAY03-C5842_1.pep
MLRSTHPPSPTSGSGSSAAPASSSSSDAAMVGGGAAAAGSGAGAGGPSGAKLLQILNVRVVGTGDRVVVLSHGFGTDQSAWSRVLPYLTRDHRVVLYDLVCAGSVNPEHFDFRRYDTLDSYVDDLLAILDALRIPRCAFVGHSVSAMIGILASIRRPELFAKLVLIGASPRFLNDNDYHGGFELPEIQQVFVAMAANYSAWAVGYAPLAVGADVPAAVQEFSRTLFNMRPDISLHVCRTVFNTDLRGVLGMVRSPCVVVQTTRDVSVPASVAAYLRDHLGGRTTVEFLQTEGHLPHLSAPGLLAQVLRRALARY

SEQ ID NO: 45989 - protein, 308 aa, Sorghum bicolor
  Clone ID: SORBI-28MAY03-C14537_1.pep
MADAKQQPQQTAAAAAATTGVWKTVKPFVNGGASGMLATCVIQPIDMVKVRIQLGEGSAGQVTRNMLANEGVRSFYKGLSAGLLRQATYTTARLGSFRVLTNKAVEKNEGKPLPLIQKAFIGLTAGAIGACVGSPADLALIRMQADSTLPAAQRRNYKNAFHALYRITADEGVLALWKGAGPTVVRAMALNMGMLASYDQSVELFRDKLGAGEISTVVGASAISGFFASACSLPFDYVKTQIQKMQPDANGKYPYTGSLDCAMKTFKSGGPFKFYTGFPVYCVRIAPHVMMTWIFLNQIQKLEKKIGI

SEQ ID NO: 45990 - protein, 155 aa, Sorghum bicolor
  Clone ID: SORBI-28MAY03-C15349_1.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGRVN

SEQ ID NO: 45991 - protein, 483 aa, Sorghum bicolor
  Clone ID: SORBI-28MAY03-C16619_1.pep
MTTAARPRRLLHPLGCLCFLVVAAFAASISSAAGRVVTSLPGFDGDLPFHLETGYVEVDEDAGVELFYYFVRSESESESGDAPFLFWLTGGDRCSVFSGLAYEIGPIRFVVEPYNGTLPRLRYNQNSWSKVSHILFVDSPVGAGFSFSRDPKGYDVGDISSTQQLRDFLIKWFDDHPESLANPFYIGGDSYAGKIVPFIGQMISEGIEAGRRPFPNLKGYLVGNAATGESIDTTSRVPYAHGVGIISAQLYETILGHCQGEDYTNPANTLCAQALYTFNNLIDEVQHAHILLDRCVYASPAPNVVSRMDGSDNRRILRAEMGRGMLNHPPARPPFGCLTYRYYLSYFWANDKRTREALGIKKGTVDEWVRCHDGDLPYTKDLKSSIKYHRNLTSRGYRALVYSGDHDLLVPHLGTQAWVRSLNFPIVDDWRAWHLGGQAAGFTISYSNNMTFATIKGGGHTAPEYEPERCFAMFTRWILNNPL

SEQ ID NO: 45992 - protein, 164 aa, Sorghum bicolor
  Clone ID: SORBI-28MAY03-C1894_1.pep
TWCINEFVKLRKRTKKRRQRSVESEHAHASECARVLGSAQPCLLPFVSSSSSSSSLWARPAGSLNVVGEEGGHGGPECGADGGCDGGGAAGGGRSRSLRGERHGGRGGEEDGAGDLLHLHPWMRRRLSNRRDGAAERRRGRRRRARRASWLLLAAASWLCAPLV

SEQ ID NO: 45993 - protein, 292 aa, Sorghum bicolor
  unsure (1)..(292): unsure at all Xaa locations
  Clone ID: SORBI-28MAY03-C16681_1.pep
MAAGGRSVACCAAVLLAAALLLSAPTTTEAYDSLDPTGNITIKWDIMQWTPDGYVAVVTMYNFQQFRHIGAPGWQLGWTWAKKEVIWSMVGAQTTEQGDCSKFKGNTPHCCKKDPTIVDLLPGTPYNMQIANCCKAGVINTFNQDPANAASSFQISVGLAGTTNKTVKVPKNFTLKTPGPGYTXYNPLTPYGGGINDTAMFWGVKFYNDLLMQAGKLGNVQSELLLRKDSRTFTFDKGWAFPRRVYFNGDNCVMPSPENYPWLPNASPLTRQPLTLPLLVFWVALAALLAYA

SEQ ID NO: 45994 - protein, 199 aa, Sorghum bicolor
  unsure (1)..(199): unsure at all Xaa locations
  Clone ID: LIB3481-057-Q6-K1-A9.pep
RSRGLAXTTNXTVKVPKNFTLKTPGPGYTCGRAIVGRPTKFWSADGRRATQALMTWNVTCAYSQFLAQKTPSCCVSLSSFYNDTIVNCPTCSCGCQNPSGSNCVNEDSPNLQAAIEGPGKWTGQPLVQCTSHMCPIRIHWHVKLNYKEYWGVKITITNFNFRMSYTQWNLVAQHPNFDNITQVFSFNYKPLTXPYGGGI

SEQ ID NO: 45995 - protein, 384 aa, Sorghum bicolor
  unsure (1)..(384): unsure at all Xaa locations
  Clone ID: SORBI-28MAY03-C23_1.pep
MGGAGEGDAWADQEQGNGGGSRGVGGGGGGEAKRSEIYTYEAAWHIYAMNWSVRRDKKYRLAIASLLEQVTNRVEVVQLDEASGDIAPVLTFDHQYPPTKTMFMPDPHALRPDLLATSAAHLRIXELPVQRRRRRRRGHCGPLTSFDWNDADPRRIGTSSIDTTCTIWDVEREAVDTQLIAHDKEVYDIAWGGAGVFASVSADGSVRVFDLRDKEHSTIIYESGSGGGGGGSNSGAGDGGTASPTPLVRLGWNKQDPRYMATIIMDSPKVVVLDIRYPTLPVVELHRHHAPVNAIAWAPHSSCHICTAGDDMQALIWDLSSMGTGSNGSGNGNGNAAAAAAAEGGLDPILAYTAGAEIEQLQWSATQPDWVAIAFANKLQILRV

SEQ ID NO: 45996 - protein, 457 aa, Sorghum bicolor
  Clone ID: SORBI-28MAY03-C2544_1.pep
MGTKNLTRNRPASMATASTTLLLSLALLAFAWAASPSPDAEAISRFQEYLRIDTAQPAPDYAAAVAFLRNQASEAGLEARTLELVAGKPLLLLRWPGRRPSLPSVLLNSHTDVVPSEPSKWDHPPFSAALDEASGRIYARGSQDMKCVGMQYLEAIRRLRSSGFIPDRTIHVIFVPDEEIGGHDGVELFVSSKEFKDMNVGLVLDEGLPSPGEEYRVFYAERSPWWLTIKAKGAPGHGAKLYDGSAMENLMKSVEAIRRFRTSQFDLVKSGQKAEGDVVSVNFAYLKAGTPTPTGFVMNLQPSEAQVGLDIRMPPDVHTEALERRLIEEWAPSSRNMTFEFKQRGSVLDNFGKPAFTPADSSNPWWPVLGEAVKKAGGKLGKPEVFPASTDARYFRKIGLPAFGFSPMANTPVLLHDHNEFLSKDEYIKGIGVYESIIRELATHNDEARDEESRAEL

SEQ ID NO: 45997 - protein, 656 aa, Sorghum bicolor
  Clone ID: SORBI-28MAY03-C26795_1.pep
MDLKQSFSTTIFCVLLLFCVGCRCRPLEIEATQTATLKVDATPQLARKIPETLFGIFFEEINHAGAGGIWAELVNNRGFEAGGPHTPSNIDPWSIIGDDSSIFVATDRTSCFSRNIVALRMEVLCNDCPAGGVGVYNPGFWGMNIEDGKAYNLVMYVKSPETTDLTVSLTSSDGLQNLASATITVSGASNWTKVEQKLVAKGTNRTSRLQIKTNKKGVVWLDQVSLMPEDTYKGHGFRTELISMLLDLTPRFLRFPGGCFVEGEWLRNAFRWRESIGPWEERPRRFGDVWHYWTDDGLGYYEFLQLAEDLGAAPIWVFNNGISHNDEVDTVAIAPFVKDVLDSLEFARGSADSTWGSVRAAMGHPEPFPVKHVAIGNEDCGKKFYRGNYLKFYNAIREAYPDIQMISNCDGSSRPLDHPADLYDFHVYTDSKTLFNMRSQFDRTSRSGPKAFVSEYAVWRSDAGRGSLLASLAEAAFLTGLEKNSDIVQMASYAPLFVNNNDQTWNPDAIVFNSWQHYGTPSYWMQTLFRESSGAMIHPINMSSRYSSSLAASAITWQDSENSFLRVKVVNFGSDTVSLTISTSGLQASVNSLGSTATVLTSGNVMDENSFSNPNKVAPVKSQLSNAGEQMQVTLAPHSFTTFDLALAQSKLVAEM

SEQ ID NO: 45998 - protein, 250 aa, Sorghum bicolor
  Clone ID: SORBI-28MAY03-C133_1.pep
MYKLGRGNRDKVQQFMTITGASEKVALQALKASDWHLEGAFDFFYSQPQISAVNTRHLEDIFNRYKEPDGDMIMVEGISQLCNDLQVDPQDIVMLVISWHMKAATMCEFTRQEFIGGLQSIGVDSIEKFRGKLPSLRAELKDDNKFRDIYNFAFTWAREKGQKSLSLETAIGMWQLLFAERNWPLLEHWCQFLQVRHNKAISRDTWAQLLEFVKTIDPQLSNYDDEGAWPYLIDEFVEYLTENGLVQRKR

SEQ ID NO: 45999 - protein, 306 aa, Sorghum bicolor
  Clone ID: SORBI-28MAY03-C0_1.pep
MASSTAAQPPAPAPPGLKEGIAGLYDESSGLWENIWGDHMHHGFYDSGEAASMADHRRAQIRMIEEALAFAAVPSPDDPEKAPKTIVDVGCGIGGSSRYLAKKYGAQCKGITLSPVQAERGNALATAQGLSDQVTLQVADALEQPFPDGQFDLVWSMESGEHMPDKRKFVSELARVAAPGGTIIIVTWCHRNLEPSETSLKPDELSLLKRICDAYYLPDWCSPSDYVNIAKSLSLEDIKAADWSENVAPFWPAVIKSALTWKGLTSLLTSGWKTIRGAMVMPLMIQGYKKGLIKFTIITCRKPGAA

SEQ ID NO: 46000 - protein, 151 aa, Sorghum bicolor
  Clone ID: SORBI-28MAY03-C370_1.pep
MAGVNSSVVGLKPAAAVPQAAAAAASSQAKRVQLVAPEGRRAALLGLAAVFAVTATTGSAKAGIIDEYLEKSKANKELNDKKRLATSGANFARAYTVEFGSCTFPYNFTGCQDLAKQKKVPFITDDLEIECEGKEKFKCGSNVFWKWGEAK

SEQ ID NO: 46001 - protein, 451 aa, Sorghum bicolor
  Clone ID: SORBI-28MAY03-C40276_1.pep
YYAQTAFLLYNIRSLLYDQHRPINRVLSAQHLGSERCNELATGSPRAALGLGAIEYEEFLKTGDPEFNWKPPKDEWQSIALGYTSGTTSSPKGVVLHHRGAYLMALSVAIVWGMPEGAVYLWTLPMFHCNGWCYTWALAAFCGTSICLRQVSTKAIYEGITKQGVTHFCAAPVVLNNLINAPASETFLPLPHVVNVNVAGAAPTPSLLAALSIRGFRVTHTYGLSETYGPSTVCAWKPEWDELPLEERSRLHCRQGIRYIAMEGLDVVDPKTMAPVPADGKSYGEIVLRGNAVMKGYLKNPKANAEAFAGGWYHSGDLGVKHPDGYVEVRDRMKDVIISGGENISSLEVEKVVCTHPAVLEASVVARADERWGESPCAFVTLKDGAADGSDEAALANDIMRFCRERMPGYWVPKSVIFGPLPKTATGKIKKHELRAKAKELGPVIVKKSRM

SEQ ID NO: 46002 - protein, 81 aa, Sorghum bicolor
  Clone ID: SORBI-28MAY03-C1240_1.pep
MQNEEGKMVDLYVPRKCSATNRIITAKDHASVQINIGHVDANGLYDGHFTTFALSGFVRAQGDADSSLDRLWQKKKAEIKQ

SEQ ID NO: 46003 - protein, 73 aa, Sorghum bicolor
  Clone ID: LIB5052-010-A1-XP1-F8.pep
MQNEEGKMVDLYVPRKCSATNRIITAKDHASVQINIGHVDANGLYDGHFTTFALSGFVRAQVIVQDMLIALCL

SEQ ID NO: 46004 - protein, 81 aa, Sorghum bicolor; identical to SEQ ID NO: 46002
  Clone ID: LIB5047-008-R1-XP1-B11.pep

SEQ ID NO: 46005 - protein, 358 aa, Sorghum bicolor
  Clone ID: SORBI-28MAY03-C4261_1.pep
MDLPVVDLAPYLRAAAGDAAPAGEEELRTLCATVSASLRDTGALLVMDPRCSAADNDRFLDVVERYFARSADAKRLQERPHLHYQVGVTPEGVEVPRSLVDKNMQEKIRSMPEEFQPATPKGPDPKWRYMWRVGPRPANTRFKELNSEPVIPEGLPEWKETMDSWGSKMISAIEVVAEMAAIGFGLSKDAFTSLMKEGPHLLAPTGSDLQRHGSEGTVFAGFHYDLNFLTIHGRSRFPGLNIWLRNGKKMEVKVPVGCLLIQSGKQLEWLTGGDCLAGMHEVVVSKRTLDAIALAKEQNRSLWRVSSTLFAHIASDAILKPLGHFAEAPDAHSYPPICAGDYVEQELSVINLKGKDGV

SEQ ID NO: 46006 - protein, 522 aa, Sorghum bicolor
  Clone ID: SORBI-28MAY03-C2930_1.pep
MDGDVVAAPAALPSPWSLLQGLLAMLIAWGSYQAAETFWLRPRRLNRALRAQGLSGTEYLFPAGDLKENDRLNDEARSRSMPLSHDIVPRVMPHLFNTVKEHGNISITWFGPIPRVIITEAELIRDVLSNKSGHFEKFISNKRLIKMLALGIASHDGEKWAKHRRILNPAFHLEKLKRMLPAFSTCSTELIDRWENKLAASDGSYELDICPPELHPTPGGMIPPPSRGSSLLGGRTLCLRRGQPAGRLIAALHLFFPPGFFFPPPHNRRTRGRKRRLRGMIEKRERAIENGETSGNDLLGLLLQSNMDSGKGSLRMSTEDVIEECKLFYFAGMETTSVLLTWTLVILGMHPEWQDRAREEVLSVFGRDKQPNFDGLGRLKTVTMILYEVLRLYPPAVSLNRRTFKDMTIGGISYPAGVILELPTIVVHHSTDVWGKDAHEFKPERFAEGISKATKDRPAFFPFGWGPRICIGQNFALLEAKMALSMILQRFEFQLSPSYTHAPYTVLTLHPQHGAPIIFKRI

SEQ ID NO: 46007 - protein, 103 aa, Sorghum bicolor
  unsure (1)..(103): unsure at all Xaa locations
  Clone ID: LIB3481-015-P1-K1-H2.pep
RPTTSVLLTWTLVILGMHPEWQDRAREEVLSVFGRDKQPNFDGLGRLKTASVSLLQYHVYMFAPSLYYLLTLSIPKXIQVTMILYEVLKLYPPAVTLNRRTFK

SEQ ID NO: 46008 - protein, 461 aa, Sorghum bicolor
  Clone ID: SORBI-28MAY03-C43548_1.pep
MGSKDQGGGAASSGGGFFSSFAAGMRSWGTAVHKSVNGLLGYEGLEVINPDGGTDDAEEEALRGRWKQEDRDSYWKMMHKYIGSDVTSLVTLPVIIFEPMTMLQKMAELMEYCELLDKADECEDPYMRMVYASTWAVSVYFAYQRTWKPFNPILGETYEMVNHQGITFLAEQVSHHPPMGVAHCENEHFTYDITSKLRTKFLGNSVEIYPVGRTRVTLKKSGVVLDLVPPLTKVNNLIFGRTWVDTPGEMVMTNLTTGDKVVLYFQPCGWFGAGRYEVDGYVYSAAEEPKIMITGKWNKSLSYQPCDQEGDPLPGTELKEIWRVAPAPQGDKYQYTHFAHKINSFDTAPKKLLASDSRLRPDRYALEKGDMSKSGAEKSRLEEQQRAEKRTRDAKGEQFTPRWFNMTDVVAPTPWGDLEIYEYNGKYTEYRAAIDSSSVTGETDVTSTEFNPWQYGSSSSQ

SEQ ID NO: 46009 - protein, 498 aa, Sorghum bicolor
  unsure (1)..(498): unsure at all Xaa locations
  Clone ID: SORBI-28MAY03-C4343_1.pep
APAPAPSSSTSTAHAPSTPLLLLPILFPPAPPHRLSPPAPAPRATYTLGRELGRGQFGVTSLAPVRETGQRFACKSIATRKPVRRDGIGDLRRVLQRMHHLPRQRTIAELRGARARRASRGRGARGREGPPRCGGSHAKVISARPPAARQGRRRGAARVRLLPQGGSPGQRMKEIFWAVDNKPAATLTAAXLVTLRDRQGRWYVVPLFXSPCQVDFQVIASLFAVRADRGSSGVCGDNNLSLIRTRAAALSAESSLFLXRRHIDFTSDPWPSISNGAKDFVKQARRPDPKERLTAAEILNHPWIREDGEAPDKPLDITVIGRMKQFRAMNKLKKVALKVVAENLSDEEIMRLKEMFRSLDTDNSGTITLEELRSGLPKLGTKISESEIKQLMEAADVDGNGTIDYGEFISATMHLNRLEKEDHILKAFEYFDKDHSGYITVDELEEALKKYDMGDDKTIKEIIAEVDSDHDGRINYQEFVAMMRNNSPEIVPNRRRMF

SEQ ID NO: 46010 - protein, 192 aa, Sorghum bicolor
  unsure (1)..(192): unsure at all Xaa locations
  Clone ID: LIB3481-038-P1-K1-D9.pep
VRETPWFNKPSIAKPVKASGAGGAEPPAEPVCSVKDGGDKDEPPETLNAFHLISLSAGFDLSPLFDVEGGPARCHNREGGMRFATRESASGVVSRLEEVAARGGGRMRVTKSGARGVRLEGAERGGRKGRLAVAADIFSLSPSVLVVDVKKDGGDTLEYRSFCNEELXRPAAKDIVWAADPKPAGTGTAVVV

SEQ ID NO: 46011 - protein, 219 aa, Sorghum bicolor
  Clone ID: SORBI-28MAY03-C4942_1.pep
MAPLKLYGMPLSPNVVRVATVLNEKGLEFEIIPVDLTTGAHKQPDFLALNPFGQIPALVDGDEVLYESRAINRYIATKYASSGAALLPATASAKLEVWLEVESHHFYPNASPLVFQLLFRPLFGGAPDPLVVDKHAHELAKVLDVYEAHLASNKYLAGDEFTLADANHASYLLYLTKTPKAGLVNDRPHVKAWWEEIAKRPAFQKTVAAIPFPPPPSSA

SEQ ID NO: 46012 - protein, 741 aa, Sorghum bicolor
  unsure (1)..(741): unsure at all Xaa locations
  Clone ID: SORBI-28MAY03-C45363_1.pep
MMRVAVVGGGLSGLVAAHELARSGGARVTVYEKEEHLGGAKTVAVNGGSSGPVLVDVDFMVFNRVTYPNMMEWFERLGVEMETSDMSFSASLRLNKGNGFEWGSRNGISSVLVQKSNFLSPRFWLMINEIFKFKNHALKYLEDHARNPDQNETLGQFIQSHRYSQLFQDAYLIPMCACIWSCPSQNVFGFPAGFVLSFFCDNHLLELFSPLQWLNVKGGSGSYVNKVREELESMGCQIKTGCKVRSVSRLKGGYRILEADGSEEIYERIIFCVHPPDALKVLGTEATPDEQRLLEAFQYIYSDLYFHCDESFMPHNSSAWSARNFLGTTSSGVCVTYWLNILQNTESARPFLATLNPPRVPDHVLLKWHTSHPIPSMAAAKATLELNNIQGKRGIWFCVPYQGYGNHEDSVKAGKAVASGLLGKKCDFLVNPKPMVPSWTEAGARFLVAKNMGKYITIGNFSILEEGGTTLSFGKTCERCQLKCVIRVHNPQFYWKIATEGDPGFAYSYINGYISFVDKKEGLQNIVEITLANRGERKRLSSSHANNKSSYIKKGWWTPLLRNXGVTLAKYVLHEVLRRNTISKARKNISAHYDLSNEFFALFLDPTMTYSCGIFKVEDESLEAAQLRKLDNLINKAKVEPGHHVLDIGCGWGSLAIRLVKRTGCKCTGITLSEEQLKYGKRKVKEFGLEDRITLLLCDYRQIANGQKFDRIISCGMLEHVGHEFYEDFFASCEYHLAEHG

SEQ ID NO: 46013 - protein, 256 aa, Sorghum bicolor
  Clone ID: SORBI-28MAY03-C5522_1.pep
MSREENVYMAKLAEQAERYEEMVEYMEKVAKTVDVEELTVEERNLLSVAYKNVIGARRASWRIVSSIEQKEESRKNEEHVNLIKEYRGKIEAELSNICDGILKLLDSHLVPSSTAAESKVFYLKMKGDYHRYLAEFKTGAERKESAESTMVAYKAAQDIALAELAPTHPIRLGLALNFSVFYYEILNSPDKACNLAKQAFDEAISELDTLGEESYKDSTLIMQLLRDNLTLWTSDLTEDGADECKEASKGDAGEGQ

SEQ ID NO: 46014 - protein, 156 aa, Sorghum bicolor
  Clone ID: SORBI-28MAY03-C4718_1.pep
GLCVFDGAHSLSNPIESVVEKQNRGSDLFCTACEMAVVWIQNQLRENKTKELILNYANQLCERLPSPNGESTVDCDQISEMPNLAFTIANKTFTLTPEQYIVKLEQAGQTICISGFMAYDVPPPRGPLWILGDVFMGAYHTVFDFGENRIGFAKPA

SEQ ID NO: 46015 - protein, 422 aa, Sorghum bicolor
  Clone ID: SORBI-28MAY03-C5565_1.pep
MATVAMDISKPTPAASGDEAAAAAKGRSGAGGEGLRQYYLQHIHDLQLQIRQKTHNLNRLEAQRNDLNSRVRMLREELQLLQEPGSYVGEVVKVMGKSKVLVKVHPEGKYVVDLDKSIDITKITPSTRVALRNDSYMLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNEDSRFDILKIHSRKMNLMRGIDLKKIAEKMNGASGAELKAVCTEAGMFALRERRVHVTQEDFEMAVAKVMKKDTEKNMSLRKLWK

SEQ ID NO: 46016 - protein, 214 aa, Sorghum bicolor
  Clone ID: SORBI-28MAY03-C5993_1.pep
TRLFGAFVSRAGVTVVDVLSPKVFIGLIVGAMLPYWFSAMTMKSVGSAALKMVEEVRRQFNTIPGLMEGTAKPDYATCVKISTDASIKEMIPPGALVMLTPLIVGTLFGVETLSGVLAGALVSGVQIAISASNTGGAWDNAKKYIEAGASEHARTLGPKGSDCHKAAVIGDTIGDPLKDTSGPSLNILIKLMAVESLVFAPFFATQGGILFKYL

SEQ ID NO: 46017 - protein, 340 aa, Sorghum bicolor
  Clone ID: SORBI-28MAY03-C5486_1.pep
MRPSLLKSSAELLRRSRGYASAANPERKVAILGAAGGIGQPLSLLMKLNPLVSSLSLYDIAGTPGVAADVSHINSPALVKGFMGDDQLGEALEGSDVVIIPAGVPRKPGMTRDDLFNINAGIVKGLCTAIAKHCPNALVNMISNPVNSTVPIAAEVFKKAGTYDKKKLFGVTTLDVVRAKTFYAGKAGVPVTEVNVPVVGGHAGITILPLFSQATPASNSLSQEDIEALTKRTQDGGTEVVEAKAGKGSATLSMAYAGAVFADACLKGLNGVPDVVECSFVQSTVTELPFFASKVRLGKNGVEEVLGLGELNDFEKKGLENLKGELMSSIEKGVKFAHSN

SEQ ID NO: 46018 - protein, 138 aa, Sorghum bicolor
  unsure (1)..(138): unsure at all Xaa locations
  Clone ID: LIB3476-058-P1-K1-H3.pep
GPKHAYNTIKDKALGNEKVESLFSIPSRLRTRGLDSPVNSLQSVFFRMDELIEQSDEWREKVNPGGCTSCLKNGVWPFNQWAINTEYGSEGSTACVVLIRDNEIMVGNVGDSQCLLXVNGQTMVLTSVMYHVIVMKVR

SEQ ID NO: 46019 - protein, 1135 aa, Sorghum bicolor
  Clone ID: SORBI-28MAY03-C71_1.pep
MSSPLNNRGTCSRSSSARSRHSARVVAQTPVDAQLHAEFESSQRNFDYSSSVSAAIRPSVSTSTVSTYHQTMQRGLYIQPFGCLLAVHPDTFTLLAYSENAPEMLDLTPHAVPTIDQRDALAVGADVRTLFRSQSSVALHKAATFGEVNLLNPILVHARTSGKPFYAILHRIDVGLVIDLEPVNPVDVPVTAAGALKSYKLAAKAISRLQSLPSGNLSLLCDVLVREVSELTGYDRVMAYKFHEDEHGEVISECRRSDLEPYLGLHYPATDIPQASRFLFMKNKVRMICDCSATLVKIIQDDSLAQPLSLCGSTLRASHGCHAQYMANMGSVASLVMSVTISNDEEEDVDTGSDQQPKGRKLWGLVVCHHTSPRFVPFPLRYACEFLLQVFGIQLNKEVELAAQAKERHILRTQTLLCDMLLRDAPVGIFTQSPNVMDLVKCDGAALYYQNQLLLLGSTPSESEIKSIATWLQENHDGSTGLSTDSLVEAGYPGAAALREVVCGMAAIKISSKDFIFWFRSHTTKEIKWGGAKHEPVDADDNGRKMHPRSSFKAFLEVVKWRSVPWEDVEMDAIHSLQLILRGSLQDEDANRNNVRSIVKAPPDDTKKIQGLLELRTVTNEMVRLIETATAPVLAVDIAGNINGWNNKAAELTGLPVMEAIGRPLIDLVVVDSIEVVKRILDSALQGIEEQNLEIKLKAFHEQECNGPIILMVNSCCSRDLSEKVIGVCFVGQDLTTQKMIMDKYTRIQGDYVAIVKNPSELIPPIFMINDLGSCLEWNKAMQKITGIQREDVIDKLLIGEVFTLHDYGCRVKDHATLTKLSILMNAVISGQDPEKLLFGFFDTDGKYIESLLTVNKRINAEGKITGAICFLHVASPELQHALQVQKMSEQAATNSFKELTYIHQELRNPLNGMQFTCNLLEPSELTEEQRKLLSSNILCQDQLKKILHDTDLESIEQCYMEMNTVEFNLEEALNTVLMQGIPLGKEKRISIERDWPVEISRMYLYGDNLRLQQVLADYLACALQFTQPAEGPIVLQVIPKKENIGSGMQIAHLEFRIVHPAPGVPEALIQEMFRHNPEVSREGLGLYICQKLVKTMSGTVQYLREADTSSFIILIEFPVAQLSSKRSKPSTSKF

SEQ ID NO: 46020 - protein, 91 aa, Sorghum bicolor
  Clone ID: SORBI-28MAY03-C6058_1.pep
MALRALYNEIRGMKVREVPAYLKPRLTWDNVKKSADQAVDRYIEKYIDTSSPDPLFHVCFGGMVFSYLVNLPWERAHLAHLEEMERTGGKH

SEQ ID NO: 46021 - protein, 91 aa, Sorghum bicolor; identical to SEQ ID NO: 46020
  Clone ID: LIB5048-012-R1-XP1-E10.pep

SEQ ID NO: 46022 - protein, 881 aa, Sorghum bicolor
  Clone ID: SORBI-28MAY03-C8018_1.pep
MAAEPEQTAEQFRGQARLPHFATPRRYDLRLTPDLAACAFAGSVSVSLGVTAPTRFLVLNAAELDVAPAGVSFAPQGSDQVLQPLEVTNVSEDEILIIRFSEVLPLGEGTLTIAFQGTLNDKMHGFYRSVYELNGEKKNMAVTQFEPADARRCFPCWDEPAFKAVFKITLEVPSETIALSNMPATEEKINGPTKIVYFQESPIMSTYLVAVIVGIFDYVEDFTTDGTRVRVYTQVGKSAQGKFALEVALKTLVLFKEYFAVPYPLPKMDMIAIPDFAAGAMENYGLVTYRETALLFDEKHSAAANKQRVAVVVAHELAHQWFGNLVTMEWWTHLWLNEGFATWVSYLAADQFFPEWNVWTQFLEESTTGFKLDALAGSHPIEVDINHVDEIDEIFDAISYRKGASVIRMLQSYLGAEVFQKSLAAYIRRFAYSNAKTEDLWAALEEGSGEPVRTLMHSWTKQQGYPVVSVKVKDGKVQLEQTQFLSSGSTGDGQWVVPVTLCCCAYSRQEKFLFHGKQEDFDLSGLGLTECQKKCSFWIKLNVNQTSFYRVSYDDELASRLRYAIETNKLSAADRYGVLDDAYALCMAGKQKLVSLLQLISVYQDETEYTVLAQVITTSLHIAEMMAVAAPEELVNLKKFLIDFLEPFALKLGWDAKSSEGHLNALLRGTLLTALAELGHETTINEAVRRFNVFLEDRETPLLPPDVRKAAYVALMQTVSKSNKTGYESLLKIYRETDLSQEKVRVLGSLASSPDPDVVREALDFILSPEVRNQDAIFLLRGVSSGAHEVAWQWLKDNWDYILGAYSGTLLTYFVNITVSPLATDEHGDEAEEFFKSRTKPNIARTVKQSIERVRINAQWVKNIKAEADLGSVLEKLAHKH

SEQ ID NO: 46023 - protein, 466 aa, Sorghum bicolor
  Clone ID: SORBI-28MAY03-C804_1.pep
KIMATNGVVHQTVSDDLEGVSAILKWLSYVPPYVGGPLPIMKPLDPPERPVAYFPENACDARAAICGIQDGEGKWLGGMFDRETFVETLEGWAKTVITGRAKLGGIPVGVIAVETQTVMQVIPADPGQLDSAERVVPQAGQVWFPDSAAKTAQALMDFNREELPLFILANWRGFSGGQRDLFEGILQAGSTIVENLRTYKQPAFVYIPMGGELRGGAWVVVDSKINPDHIEMYAERTAKGNVLEAEGLVEIKFRPKELEDCMLRLDPELIGLNARLKDMKKQNASISEMETIRRSMTIRMKQLMPIYTQVATRFAELHDTSARMAAKGVIGKVVDWEESRAFFYRRLRRRVAEDALAKEVKEAAGEQLSHRSALDSIKKWYLVSKGTEGGSEMWNDDESFFAWKDDSKNYENYLEELKAERVSNWFSHLAESSDVKALPNGLSLLLNKMNPLKREQVIDGLRQLLG

SEQ ID NO: 46024 - protein, 151 aa, Sorghum bicolor
  Clone ID: SORBI-28MAY03-C8290_1.pep
AGVIWLWGVPERALHLALRGARPPVRNNSIVYGGGSAEISCSIAVETAADRHPGVEQYAIRSFADALDAVPLALAENSGLSPIDTLTAVKAQQVKESNPHCGIDCNDVGTNDMKEQNVFETLIGKQQQILLATQVVKMILKIDDVISPSEY

SEQ ID NO: 46025 - protein, 287 aa, Sorghum bicolor
  Clone ID: SORBI-28MAY03-C9529_1.pep
MGNLCCCVQVDQSTVAIREQFGKFDGVLEPGCHCMPWFVGKRVAGHLTLRLQQLDVRCETKTKDNVFVNVVASIQYRALAGKASDAFYKLSNTRSQIQAYVFDVIRASVPKLHLDDAFEQKDEIAKAVEEELEKAMSAYGFEIVQTLIVDIEPDEHVKRAMNEINAAARLRAAANEKAEAEKIVQIKRAEGEAEAKYLSGLGIARQRQAIVDGLRDSVLGFSVNVPGTTAKDVMDMVLITQYFDTMKEIGASSKASSVFIPHGPGAVRDIATQIRDGLLQGSSVTQH

SEQ ID NO: 46026 - protein, 195 aa, Sorghum bicolor
  Clone ID: SORBI-28MAY03-C1029_1.pep
MVHVSFYRNYGKTFKKPRRPYEKERLDAELKLVGEYGLRCKRELWRVQYALSRIRNAARHLLTLDEKNPRRIFEGEALLRRMNRYGLLAEGQNKLDYVLALTAENFLARRLQTLVFKAGMAKSIHHARVLIKQRHIRVGRQIVNVPSFMVRVESEKHIDFSLSSPFGGGPPGRVKRKNLKKASGGGGDGGDEDEE

SEQ ID NO: 46027 - protein, 208 aa, Sorghum bicolor
  Clone ID: SORBI-28MAY03-C17302_1.pep
MTSVWKTKVLPGLNKIFDKDGKKAAAVGFLKSFNKEEIGKEIEDKKTELEPKVVETYEASPPEVKALFKDKKPVKISKKNSAAVTKFLDELAKIDFPGAKVVSEAVAKSGTTPLSPAITFILDKVAPFIPEEPKVEPAAEVEATSREVAVEEKKEEAEPAAAEEAAPAPAETPAAEEKKEEEEEKKEEEAKPAAEEAAPPAAAATEEK

SEQ ID NO: 46028 - protein, 384 aa, Sorghum bicolor
  Clone ID: SORBI-28MAY03-C1734_1.pep
MEEEGGRAKMRRVALLLLLVCALARAAAVVTDGLLPNGNFEDGPPKSALVNGTVVSGANAIPRWETSGFVEYIESGHKQGDMLLVVPQGAHAVRLGNEASIRQRLAVARGAYYAITFSAARTCAQAEALNVSVSPEWGVLPMQTIYGSNGWDSYAWAFKAKLSTVTLVIHNPGVEEDPACGPLIDGVAIRALYPPTLARGNMLKNGGFEEGPYFLPNASWGVLVPPNIEDDHSPLPGWMIASSKAVKYVDAAHFAVPQGARAVELVGGRESALVQEVRTVPGWSYRLAFAVGDSGDGCTGSMVAEAYAARATVKVPYESKGTGGYKRAVLDFTAVANRTRVVFQSTFYHMKADGTLCGPLVDDASVVGLRKKPAAAGRRLLQFL

SEQ ID NO: 46029 - protein, 302 aa, Sorghum bicolor
  Clone ID: SORBI-28MAY03-C21613_1.pep
MSLISPFPAVDISKMDPPTLTLLGAAGCVMLTLHFTVQLVSQHLFYWKNPKEQKAILIIVLMAPLYAISSFVGLLDIQGSKTFFTFLDAVKECYEALVIAKFMALMYSYLNISISKNIVPDEIKGRELHHSFPVSLFLPRKVRLEHKTLMLLKYWTWQFVIVRPVCSILIIALQLLGLYPSWVCPSLSIILNFSVSMALYALVLFYHLFAKELAPHKPLAKFLCIKGIVFFSFWQGFALDILTEAGVIKSHHFWLDVEHIQEAIQNVLIILEMVVFAVIQQYAYHVAPYSGADRAKFEKKNE

SEQ ID NO: 46030 - protein, 154 aa, Sorghum bicolor
  Clone ID: SORBI-28MAY03-C21119_1.pep
RAARRRGARSSVTAPLPGPAMADCIVHGYYVPSGTRVIVNAWALGRDPESWQEKPEEFMPERFVDGGSAAAGVDFKGNHFQFLPFGAGRRICPGLNCGMATVEIRCANPVYCFDWQLPSDMDDMRVVLFGAGGLIVHAHEMGIVVVEITLATLM

SEQ ID NO: 46031 - protein, 63 aa, Sorghum bicolor
  Clone ID: LIB5051-001-Q1-XP2-D1.pep
VILYTRSIRWFGVENYVHTLHTMVGVSTQCILYGYKSCTNNNSIWNLIKINRIMEKKKKKRPL

SEQ ID NO: 46032 - protein, 68 aa, Sorghum bicolor
  Clone ID: SORBI-28MAY03-C24552_1.pep
RRDSKLSTKYYVTIYCSYLQDHIKQKRLFIHVYGTLLKEIRPSHDSLLNTGSACPNNGAPQLEGSTTL

SEQ ID NO: 46033 - protein, 439 aa, Sorghum bicolor
  Clone ID: SORBI-28MAY03-C34040_1.pep
MASAAATQVGTYFLRNYYNLLQQTPDVVHQFYSDASTMVRVDDLTGTTAAANNMMDIHSLIMSLNFTQIEIKTANFVNSWGDGVLVMVSGLVQTKEYSHQRKFIQMFFLAPQEKGYFVLNDYFHFVDQEHVQPAPVIGQEDYESNLAPNTVVETAPEYIHEEETQQIAPEGHDLVDNYTYSEPQQQVVSSDNWGEEPLPEEPPSFSNEMTVAPEEPVQPPPVPPPHVEEPVGGTRKKTYASILKTAKAPPAFPVAQQVPVSKPSHPTTESIQTQHSVMASSTGAEKPRSDVYGEGAAHDDEESKSVYVGNVPANVNEADLESEFKKFGRLIPDGVAIRSRKETGGYYAFVEFEELSGVHNALKASPIEINGRQIYVEERKPNSGIRGGRRGGRGRFSGGGRGYARGGGDEYNGNRSRSNGYGRVPHQERGILGSHTARN

SEQ ID NO: 46034 - protein, 244 aa, Sorghum bicolor
  Clone ID: SORBI-28MAY03-C3736_1.pep
LLSCFWYQRHFLIWSPITQAKRRRGRTPTPGKYLGTKSSRGRRYSPSYSPVRRDRYSSRYSPDRRDRYSSRYRRDRYSSRYSPERDLSYSPDGRGRSYSPYDRRRSYSPHGRHGSYSPDDRRRSYSPYYRNRYRSRSPYRYRRRRSPSVSPYYSRHRYRSVSKSPSVSPTRTRERSYSHSLSPQRSYSRSHSPESERSTSYSPKKGSRREPSCSRYSGKRRRSRESYSHSRSSYSGSVSRERSA

SEQ ID NO: 46035 - protein, 152 aa, Sorghum bicolor
  Clone ID: SORBI-28MAY03-C2646_1.pep
MASKQTRRVLVLAAVAACLLLLPAASVATSVDYCSKKNYPVKVSGVEIVPDPVEPGNPATFKISASTDKTIEKGKLQIDVKYFFFYVHSETRDICGETSCPATGDFVLSHQQTLPGFTPPGSYTIYMKILGDENEELSCISFGFSIGFVASS

SEQ ID NO: 46036 - protein, 342 aa, Sorghum bicolor
  Clone ID: SORBI-28MAY03-C4003_1.pep
MGLDVGEIGMGLDLGLDLRLFAARTAGGMAAAAAKGAPAGIESCIRSLEEERKKIEVFRRELPLCARLLADVIDELKEEAAKRGGGDADAKADDGDKRKWMSTAQLWVDSDAKSDESDKEHQSEITSPEPKLLGGAPMPIRAVAAVPPLPPPFFRREDSSAGTCLSLVSPASKAPISPVATSDNASGRFCPTMPPSGSSGVTLHSQAQQQASRKARRCWSPELHRQFVAALHQLGGPQVATPKQIREVMQVDGLTNDEVKSHLQKYRLHNRRSPGVAPVSQPIMLVGGLWAPQEQSSSGSPQGPLQFSGSGVAISTATVGGDSSGSSSDEDDKSEGYSRKCV

SEQ ID NO: 46037 - protein, 181 aa, Sorghum bicolor
  Clone ID: SORBI-28MAY03-C40715_1.pep
GRNNGWAISTPTTEQFRSDGVVIRGQAYGIRGIRVDGNDALAVYSAVHAAREMAITEGRPILVEALTYRVGHHSTSDDSTKYRPVDEIEHWRTARDPISRYRKWVQGNDWWSDAEESELRSRVRKELLQAIQVAERMPKPPVADLFTDVYDKIPSNLCEQEQLLRDTIMKHPADYPTDVPV

SEQ ID NO: 46038 - protein, 547 aa, Sorghum bicolor
  Clone ID: SORBI-28MAY03-C5420_1.pep
MSSEPPPAASSATGAEELSADLSAATLSKKQQKKDARKAEKAEKAAQRQQQQQQPVDAEDPFAANYGDVPVEEIQSKVISGRSWTQIGDLDDSAAGRSVLIRGAAQAFRPVSKKMAFVVLRQRMSTVQCVLVASADAGVSTQMVRFATALSKESIVDVEGVVSLPKEPLKATTQQVEIQVRKIYCINRAIPTLPINLEDAARSEADFEKAELAGEKLVRVGQDTRLNYRAIDLRTPSNQAVFRIQCQVENKFREFLLSKDFVGIHTPKLISGSSEGGAAVFKLLYNGQPACLAQSPQLYKQMAICGGFERVFEVGPVFRAENSNTHRHLCEFVGLDAEMEIKEHYFEVCDIIDGLFVSIFKHLTENCKKELETINRQYPFEPLKYLDKTLKLTYEEGIQMLKEAGTEIEPMGDLNTEAEKKLGRLVREKYNTDFFILYRYPLAVRPFYTMPCYDNPAYTNSFDVFIRGEEIISGAQRIHTPELLAKRATECGIDVSTISAYIESFSYGAPPHGGFGVGLERVVMLFCALNNIRKTSMFPRDPQRLVP

SEQ ID NO: 46039 - protein, 422 aa, Sorghum bicolor
  Clone ID: SORBI-28MAY03-C6426_1.pep
MVRGSLGKLASRALSVAGRWQHQQLRRLNIHEYQGAELMGKYGINVPRGAAAGSVQEVKDALKNMFPSEKEIVVKSQILAGGRGLGTFKSGLQGGVHIVKAEEAESIASKMLGQILVTKQTGPEGKIVSKVYLCEKLSLTNEMYFAITLDRKTAGPLIIACSKGGTSIEDLAEKYPDMIIKVPIDVFKGITDEDAAKVVDGLALKAADRQSSIEQIKKLYELFCKCDCTLLEINPLAETADNKLVAADAKLNFDDNAAFRQKEIFALRDTTQEDPREVAAAKADLNYIGLDGEIGCMVNGAGLAMATMDIIKLHGGTPANFLDVGGSASEGQVVEAFKILTSDDRVKAILVNIFGGIMKCDVIASGIVNAAKQVALKVPVVVRLEGPNVAQGKRILKESGMTLITAEDLDDAAEKAVKASVK

SEQ ID NO: 46040 - protein, 146 aa, Sorghum bicolor
  Clone ID: SORBI-28MAY03-C44620_1.pep
CSTRSCRASSTPSRRTGRLFQQLPPQRRCDPASAGVSQARTAPHRSRGPARPPARQGTVPAAATPPPPGPPPRRARACPPRARTLGPPRRGRSTRQRQALTTRTLRARATACSPRGTAPARVPAPARFEERDARQRRGLACVTVSG

SEQ ID NO: 46041 - protein, 510 aa, Sorghum bicolor
  Clone ID: SORBI-28MAY03-C26689_1.pep
MASADLAEAIEPTKKSNVKYASICAILASMASVILGYDIGVMSGAAMYIKKDLKITDVQLEIMIGILSVYSLIGSFAGARTSDRIGRRLTVVFAAVIFFVGALLMGFAVNYGMLMVGRFVAGVGVGFGGMIAPVYTAEISPAASRGFLTSFPEVFINIGILLGYLSNFTFARLPLHLGWRVMLGIGAAPSALLALMVFCMPESPRWLVMKGRLADARAVLEKTSASPEEAAERLADIKVAAGIPKDLDGDVVTVPKERNGGEMQVWKALIFSPIPAIRRILLSGVGLHFFQQASGSDSVVLYSPSVFKSAGITDDNKLLGVTCAVGVSKTLFILVATFLLDRVGRRPLLLTSAGGMIVALIGLGTGLTVVGHHPDAKIPSAVALCIASTLAYVAFFSIGLGPITGVYNSEIFPLQVRALGFAVGMACNRVTSAVISMTFLSLSKGITIGGSFFLYSGIAAVGWVFFFTCLPETRGRTLEEMGKLFGMPDIDMAQADDTAAKEKVVEMPTM

SEQ ID NO: 46042 - protein, 161 aa, Sorghum bicolor
  Clone ID: SORBI-28MAY03-C1893_2.pep
MSDSEEHHFESKADAGASKTYPQQAGTIRKNGYIVIKNRPCKVVEVSTSKTGKHGHAKCHFVGIDIFTGKKLEDIVPSSHNCDVPHVNRVEYQLIDISEDGFVSLLTESGNTKDDTKLPSDEALQAQIKSGYDEGKDILLTVMSAMGEEQICAVKEIGGKN

SEQ ID NO: 46043 - protein, 230 aa, Sorghum bicolor
  Clone ID: SORBI-28MAY03-C1893_1.pep
MSDSEEHHFESKADAGASKTYPQQAGTIRKNGYIVIKNRPCRASQPLGRSPPSPTFLRAALTRGFGRPWKMSDSEEHHFESKADAGASKTYPQQAGTVRKNGYIVIKNRPCKVVEVSTSKTGKHGHAKCHFVAIDIFNGKKLEDIVPSSHNCDIPHVNRTDYQLIDISEDGFVSLLTESGGTKDDLKLPTDETLLTQIKDGFSEGKDLIVSVMSAMGEEQICALKDIGPK

SEQ ID NO: 46044 - protein, 159 aa, Sorghum bicolor
  Clone ID: SORBI-28MAY03-C6013_2.pep
AAGFGSRTPRFAAPPPLPSPPAAKMPFKRFVEIGRVALVNYGKEYGRLVVIVDVVDQNRALVDAPDMVRCQMNFKRLSLTDIKIDIKRVPKKTTLIKAMEEADVKTKWENSSWGKKLIVQKRRASLNDFDRFKIMLAKIKRGGAIRQELAKLKKVAAAA

SEQ ID NO: 46045 - protein, 134 aa, Sorghum bicolor
  Clone ID: SORBI-28MAY03-C6013_1.pep
MPFKRFVEIGRVALVNYGKDYGRLVVIVDVVDQNRALVDAPDMIRCQINFKRLSLTDIKIDIKRVPKKTTLIKAMEEADVKTKWENSSWGKKLIVQKRRAALNDFDRFKVMLAKIKRGGAIRQELAKLKKASTA

SEQ ID NO: 46046 - protein, 408 aa, Sorghum bicolor
  Clone ID: SORBI-28MAY03-C6923_1.pep
MKLNVKTLKGTNFEIEASPDASVAEVKRIIETTQGQSTYPADQQMLIYQGKILKDETTLEGNGVAENSFLVIMLSKAKASSSGASTATAAKAPATPAQPAAPVAPVAPATSVARAPTQAPVATAETTPPSAQPQAAPAATVAASGDADVYSQAASNLVSGNNLEQTIQQILDMGGGTWERDTVVRALRAAYNNPERAIDYLYSGIPENVEAPPVARAPAAGQQTNQQAPSPAQPAVAPPVQPSAASAGPNANPLNLFPQGVPSGGANPGVVPGAGSGALDALRQLPQFQALLQLVQANPQILQPMLQELGKQNPQILRLIQENQAEFLRLVNETPEGGPGGNILGQLAAAMPQTLTVTPEEREAIQRLEGMGFNRELVLEVFFACNKDEELAANYLLDHGHEFDEQQQ

SEQ ID NO: 46047 - protein, 800 aa, Sorghum bicolor
  unsure (1)..(800): unsure at all Xaa locations
  Clone ID: SORBI-28MAY03-C6434_1.pep
RARGPGGAEEGRPTGALSAEFAQAYPFYDFNAGRARDVVVVPASYGAKGAEEAKHEIHKEIFSRAIRLVTAGDTSTAVTFDCNSWVHSKFHYANRRIFCSLXAYLPSEMTMDLGELVVHXISAAAXFGSGQSKRSVREHDKTVYYDLGDPDKHPTHQRPILGGSKRFPYPRRCRTGRPRTKSDPQTEKRDGRHHYVPRDEQFSEVKQLTFGATTLRSGLHALLPAIRPLLQNRKELRFPHFPSIDGLYSDGIPLPALAGVVACPRGAPRGGELDPDELFYFQARGINTETATDALLYFFGAHVIKRIPFKPVSERALLLCEVPLASSRHAAVYRPAGSAFTXVVPVWRVDGASSGDQAVAAGRLFILVFHGGFLPYVRLLMQFXATGLFVSGTVFFLTDLGTLMPLAIELTRPKSPTKPQWKRVFTHGPDATDAWLWKLAKAHVLTHDTGYHQLVSHWLRTHCCVEPYIIAANRQLSRLHPVYRLLHPHFRYTMEINALAREALINADGIIEESFWPGKYAVELSSVAYGATWQFDTEALPNDLVKRGLAVRRDGDGDGELELTIKDYPYAHDGLMIWNSIKQWVTDYVGVYYKSDEAVAGDAELKAFWDEVRNVGHGDKKDEPWWPVLNTRDSLVETLTTIMWVTSGHHSAVNFGQYHYGGYFPNRPTTIRKNMPVEEGRDEEMRKFLSQPETTLLDMMPTQMQAIRIMTTLDILSSHSPDEEYMGEFAEPSWLVEPMVKAAFEKFSGRMKEIEGFIDECNNNPENKNRFGAGIVPYELLKPFSKPGVTGRGIPYSISI

SEQ ID NO: 46048 - protein, 167 aa, Sorghum bicolor
  Clone ID: SORBI-28MAY03-C594_2.pep
GGRFEARVVSSGPTYKKKAGPSRLEGKFRSRRRRGPRVRGPSVRPGKEQEPGGEDDRGGAERPAGEEGAGEVQRGRHHRRPQEAGGGADGDAPGEDPHPEVVQHLQGPHHPQGLRDPRRHGPRALLQLAAAAAAASSPLLSGWSEFRSHGCNSSCSLLSSHIYKQPQ

SEQ ID NO: 46049 - protein, 73 aa, Sorghum bicolor
  Clone ID: SORBI-28MAY03-C594_1.pep
MIEVVLNDRLGKKVRVKCNEDDTIGDLKKLVAAQTGTRPEKIRIQKWYNIYKDHITLKDYEIHDGMGLELYYN

SEQ ID NO: 46050 - protein, 76 aa, Sorghum bicolor
  Clone ID: LIB5051-001-Q1-XP2-B11.pep
GAFFFFFFTEAQDRDYHDQPVLFKVRSASSSTLILQVHPCHMTIYARLSIVIGNLQQPCMYYIAHSSCLYVCELIR

SEQ ID NO: 46051 - protein, 423 aa, Sorghum bicolor
  unsure (1)..(423): unsure at all Xaa locations
  Clone ID: SORBI-28MAY03-C6635_1.pep
MQMAATTTDSQAAVPPHHPHAHPHVPPQHGHPHHHMPPQPRWVVIPYPPPPPMVAAPPPPPPQFAKHFAAGPPPPPQAAAGRRTPTPPAAGSGGNGCEENKTIWVGDLQYWMDENYLHSCFGPSGEVVTIKVIRNRQTGQSEGYGFVEFFSHASAEKALQNFTGHVMPNTDRAFKLNWASYSMGEKRSEVASDHSIFVGDLAADVTDEMLLELFSSKYRSVKGAKVIIDANTGRSRGYGFVRFGDDNDKTHAMSEMNGVYCSTRTRVXQFVNRADAXRSSARVDWSHSDGDSSNRTVYVGGLDPNVSEDELRKAFAKYGDLASVKIPLGKQCGFVQFASRTDAEEALQGLNGSLIGKQAVRLSWGRSPSHKQSRGDSGNRRNNMYYGTPFYGGYGYASPVPHPNMYAAAYGAYPMYGNQQLVS

SEQ ID NO: 46052 - protein, 312 aa, Sorghum bicolor
  Clone ID: SORBI-28MAY03-C187_1.pep
MELLPTDQICSGHENIDMLQVGNQYSSENAIQGIEDKKFSIASTSQLSSSQNLLNQRHHLNSSSPSNITSESYAEKFGPSSGSFAQRNSKAQKKTLNMQPRQPTNDNDINRHPQTLTRRASYPCENYETERKGLGKRTLGDPQVTMGTSMVVDGSFVSSVSSDNSVEESSFRQLQDAVSQLDVQTKLCIRDGLYRLARSAQHRQVFPNMMNNNGDSQDVKDLQNAETSHKFVDPRSIETQTNPIDRSIALLLFHQSSDQAAVAVDDASSLKSPAGNKQHPGPASNQGLMPASSVYSPGGQGTPKDVQSLDKY

SEQ ID NO: 46053 - protein, 274 aa, Sorghum bicolor
  Clone ID: SORBI-28MAY03-C1956_1.pep
MATPSSSLCSSFASLRTASIGHRRGLTSSTPRKGFQARASARVDKFSKSDIIVSPSILSANFAKLGDQVKAVEVAGCDWIHVDVMDGRFVPNITIGPLVVDALRPVTDLPLDVHLMIVEPEQRVPDFIKAGADIVSVHCEQTSTIHLHRTVNQIKSLGAKAGVVLNPATPLAAIDYVLDVVDLVLIMSVNPGFGGQSFIESQVKKIAELRRLCAEKGVNPWIEVDGGVGPTNAYKVIEAGANAIVAGSAVFGAPDYAEAIKGIKTSQRPVAVPA

SEQ ID NO: 46054 - protein, 148 aa, Sorghum bicolor
  Clone ID: SORBI-28MAY03-C204_1.pep
MAATAYSVALLGGARLPAAPRSALLPRRSVCQLRLQDAPRLSLLRAKAASEDTSASGDELIEDLKAKWDAIEDKPTVLLYGGGAIVALWLTSVVVGAINAVPLLPKILELVGLGYTGWFVYRYLLFKESRKELAADIETLKKKIAGTE

SEQ ID NO: 46055 - protein, 212 aa, Sorghum bicolor
  Clone ID: SORBI-28MAY03-C3009_1.pep
RIFHVESLEKTAQDDYQKLASAVYLQVSTISQALIFVTRSRSWSFVERPGFLLVFAFLVAQLIATLIVVYANWGFTSIKGIGWGWAGVVWLYNLVFYFPLDILKFLIRYAMSGKAWDLVVEQRIAFTRKKNFGKEERALKWAHAQRTLHGLQPPDAKLFPERVHELNQMAEEAKRRAEIARLRELHTLKGHVESVVKLKGLDIDTIQQSYTV

SEQ ID NO: 46056 - protein, 215 aa, Sorghum bicolor
  Clone ID: SORBI-28MAY03-C3866_1.pep
MSLFGLGRNQKTFRPKKSAPSGSKGAQLRKHIDATLGSGNLREAVRLPPGEDINEWLAVNTVDFFNQVNLLYGTLTEFCTPESCPTMTAGPKYEYRWADGVQIKKPIEVSAPKYVEYLMDWIEGQLDDESIFPQKLGTPFPQNFKEVVKTIFKRLFRVYAHIYHSHFQKIVSLKEEAHLNTCFKHFILFTNEFGLIDKKELAPLQELIESIIVPY

SEQ ID NO: 46057 - protein, 372 aa, Sorghum bicolor
  unsure (1)..(372): unsure at all Xaa locations
  Clone ID: SORBI-28MAY03-C40957_1.pep
TCGTPDPETGLAPPSLWPLGSGRQLLQXGRPLKVARHRKSKRPNTDDDKNVINVRLLPNCVVGLQDKVSPKDNNQGKRVGVDSNXPRFRCFHNYKLSXSIIIMSGLEKPIVTYKDVWGCQXLFAVMREVIELPTLHPEKFVKLGIDPPKGVLCYGPPGTGKTLLARAVANRTDACFIRVIGSELVQKYVGEGARMVRELFQMARSKKACIVFFDEVDAIGGARFDDGVGGDNEVQRTMLEIVNQLDGFDARGNIKVLMATNRPDTLDPALLRPGRLDRKVEFGLPDLEGRTQIFKIHTRTMNCERDIRFELLARLCPNSTGADIRSVCTEAGMYAIRARRKTVTEKDFLDAVNKVIKGYQKFSATPKYMVYN

SEQ ID NO: 46058 - protein, 182 aa, Sorghum bicolor
  Clone ID: SORBI-28MAY03-C3741_2.pep
VPNHKFTVSILRNNTQRTHWRIKTYLAISHMDAGKIGTIVADMRKVLAKNPHIEQQKLHRRVFFEKIDPKNQALMILVSCFVKTSHFEEFLNVQETVMLDLLRIVGHHKARLATQIRTVQKSYGNADFDNIPFGEDMYSRVRGRPLLIDTSARISDDKPKPRPVSSREEHKVKTNGSVEIKS

SEQ ID NO: 46059 - protein, 278 aa, Sorghum bicolor
  Clone ID: SORBI-28MAY03-C3741_1.pep
ARGLLTLAGREIFTNFLSSVMINATRPFVVNEWIDVKIDGVDVSGIVEHVGLWSPTIIRGVDREAIYVPNHKFTVSILRNNTQRTHWRIKTYLAISHMDAGKIGTIVADMRKVLAKNPHIEQQKRTRESSYRPMLYTPRRYRSLGFRSCALPVPLKEIPLVKNASLALTRSCDTLLANPATSLVVPAIGIIVFALWGFLPLVRDIRNRFDHGSNWKKSPTYLISSSYLQPLLLWTGATLICRGLDPVVLPSAASQAVKKRLITFTEKYATVRCSGEVL

SEQ ID NO: 46060 - protein, 423 aa, Sorghum bicolor
  Clone ID: SORBI-28MAY03-C21820_1.pep
MGRGGAGAEVEVEDAGSGWESSKPTLLQRWSSSVWAISGSGHLLWAGNEAWRAHVGMAFVQVAYGGYHVLTKSVLNVGMNQIVFCVYRDLVALALLAPIAFLRERSVRARRPVTPRLLASFALLGFTGIFGNQLLFLLGLSYTNASYAAAFQPAIPVFTFLLAAIVGVEVVNTFTKDGVVKVLGTAVCVFGAVLMVFYQGPSLIGMGGATAADAAALAGTWSSNAYSPQWLTATAMLRNGLDAWSLGVVCLIGNCFLMGAYLVIQAPVLIKYPASLSLTAYSYSFATLFMVVTGVFATNRLHEWALTTTEIIAVVYAGIVASCLNYAIMTWANKILGPSLVALYNPLQPACSTLLSTIFLGTPIYVGSVIGGLFIIAGLYLVTWARYNEAQRVLTTRYLQPLLVEDLPTTKAEGSSFRGSIDP

SEQ ID NO: 46061 - protein, 215 aa, Sorghum bicolor
  Clone ID: LIB5048-007-R1-XP2-E9.pep
MGGDRRAAAALQRHWCPSWSVSERWRAHAGMVLVMLAYSGYHVLTKSVLNVGMNQVVFCVYRDLLAFAVLAPVAFLRERRVRPPVTPQLLASFALLGFTGLYGNPLLFLVGLRYTNASYAAAFQPSIPVLTFLLAAIVGVEAINIFTKDGVLKVIGTVVCVSGAILMALYRGSSLIGLTRSMPNAWASTSYPAGPHWLTSTVVPHRAKTLALGVL

SEQ ID NO: 46062 - protein, 502 aa, Sorghum bicolor
  Clone ID: SORBI-28MAY03-C44098_1.pep
MSSSTSSALVVVVAAVLLALTLAQHGSLAATVGPRVIVVGAGMSGISAAKRLSDAGITDLLILEATDHIGGRMHKKNFAGINVEVGANWVEGVNSNRGKMNPIWPIVNSTLKLRNFRSDFDYLAQNVYKEDGGLYDEDYVQKRIDRADSVEELGEKLSGTLHASGRDDMSILAMQRLYDHQPNGPATPVDMVVDYYKYDYEFAEPPRVTSLQNVVPLPTFSDFGDDVYFVADQRGYEAVVYYLAGQFLKTDRSGKIVDPRLQLNKVVREINYSPGGVTVKTEDNSVYRADYVMVSASLGVLQSALIQFKPQLPAWKVTAIYQFDMAVYTKIFLKFPKKFWPEGKGREFFLYASSRRGYYGVWQEFEKQYPGANVLLVTVTDEESRRIEQQSDNQTKAEIMQVLRKMFPGKDVPDATDILVPRWWSDRFYKGTFSNWPIGVNRYEYDQLRAPVGRVYFTGEHTSEHYNGYVHGAYLSGIDSAEILINCAQKKMCKYHVQGKYD

SEQ ID NO: 46063 - protein, 309 aa, Sorghum bicolor
  Clone ID: SORBI-28MAY03-C458_1.pep
MTMTPSSALALAHHAAASPLPASTPRASSRSSSLSLVGPGAAGLGPRRLVAAAPPRAFFSSSPYYQPPPQQQPEGFSPHREYGLVPMVIETTSRGERAYDIFSRLLKERIVCIHGPIADDTASLVVAQLLFLESENPLKPVHLYINSPGGVVTAGLAIYDTMQYIRCPVTTLCIGQAASMGSLLLAAGAPGERRALPNARVMIHQPSGGAQGQATDIAIQAKEILKMRDRLNKIYQKHTRQPIDKIEQCMERDLFMDPEEARDWGLIDEVIENRPASLMPDGIGGGLDVPSLGVGPGGRGRDAVEPSAV

SEQ ID NO: 46064 - protein, 613 aa, Sorghum bicolor
  unsure (1)..(613): unsure at all Xaa locations
  Clone ID: SORBI-28MAY03-C4825_1.pep
MGDLKEVFRSLQELFPQVDHRILKAIAIEHRKDVDSAVVAVLDEVMPSMTGSAGALSTHREGLPSMDDSVGNLFANRSTCEVGSSSSAGHDIHIDEIDVSVHSAQHTSSGEVKTCKQENINIEYVGRVASIEGVSEQLNLHSDPIPNDGQHDLIPNLDVLSSNTNPEKQLANTDNEVGYGGLSSECFSQPPTGEDGGDIPQSHDQDPNKIIPVGDYAPRNTSMKFFSGYEDINFDDDLLPLGSNDQISSGILGTEKDSFAPVLDVPGRDKEESSVGTSGFIEQKDTSSVADMLPDLNLNHFASTASTHSSXLLVESLEDSVADARSNKNDLLPSLELVTKMIEDAGLLEEKAKVAKHEASVAGTGILTKVEELREMLTHAKEANDMHAGEVFGEKAILTTEARELQSRLQRLSDERNKYLVIIEEIRQTLDERLAAAQQEIAAAEKEKIEKEAAAQALLDEQEKTMNSIVEESRKLQIAAEENLKLKEFLVERGQIVDMLQGEMAVICEDVSLLKRVVDERLSLSKLQRSAMSSLSSSLHSSQHKSWTSSDRTTEAMESPDKRTLVEPASPVCKDLDGDDDECTVEVSYGNDTGKGILKRVNSKEDGDGWELC

SEQ ID NO: 46065 - protein, 484 aa, Sorghum bicolor
  Clone ID: SORBI-28MAY03-C5118_1.pep
YALDNVTARMYIDSRCVYFQKPLLESGTLGAKCNTQMVIPHLTENYGASRDPPEKQAPMCTVHSFPHNIDHCLTWARSEFEGLLEKTPTEVNAFLSNPGGYATAARTAGDAQARDQLERVIECLETDKCETFQDCITWARLKFEDYFSNRVKQLTFTFPEDAMTSSGAPFWSAPKRFPRPLEFSSSDSSHLNFLLAASILRAETFGIPIPDWAKNPTKLAEAVDKVIVPDFQPKQGVKIETDEKATSLSSAGVDDAAVIEELIAKLETISKTLPPGFHMNPIQFEKDDDTNFHMDLIAGFANMRARNYSIPEVDKLKAKFIAGRIIPAIATSTAMATGLVCLELYKVLAGGHKVEDYRNTFANLAIPLFSMAEPVPPKTIKHQDMSWTVWDRWTVTGNITLRELLEWLKEKGLNAYSISCGTSLLYNSMFPRHKDRLDKKVVDVAREVAKVEVPSYRRHLDVVVACEDDDDNDVDIPLVSIYFR

SEQ ID NO: 46066 - protein, 200 aa, Sorghum bicolor
  Clone ID: SORBI-28MAY03-C4585_1.pep
MALLPRTARLALLSTPRAYSAAAAAGASSTSPAPYGGAPPPAMSKTAEFVVSKVDDLMNWARKGSIWPMTFGLACCAVEMMHAGASRYDFDRFGVIFRPSPRQSDCMIVAGTLTNKMAPALRKVYDQMPEPRWVISMGSCANGGGYYHYSYSVVRGCDRIVPVDIYVPGCPPTAEALLYGVLQLQKKINRRKDFLHWWTK

SEQ ID NO: 46067 - protein, 235 aa, Sorghum bicolor
  Clone ID: SORBI-28MAY03-C6845_1.pep
MAGADVDVGTELRLGLPGGGAEAAKAAKRGFEDTIDLKLKLPTAGMEEAAAAKPEPAAEKAKRPAEAPAADAEKPPAPKAQAVGWPPVRSYRRNVMTVQSVKSKKEEEPEKQQSAAANASGNSSAFVKVSMDGAPYLRKVDLKMYNSYKDLSIALKKMFSTFTTSGNNMNEGKLVDPVSGADVVTTYEDKDGDWMLVGDVPWEMFVESCKRLRIMKSSEAIGLAPRTKDKCKNKS

SEQ ID NO: 46068 - protein, 319 aa, Sorghum bicolor
  Clone ID: SORBI-28MAY03-C9257_1.pep
MMESQPLQDPTATAPAPGSAEPAGAPPAVTPGKEFTRTCKGLVVVLIGGYVLLQLLPSSLNYLAIIPSKTIPYVWTVFTAGYIEQVLPGAIGSSLGLLFCGKDIEPAWGRKEFLKFIILINSICGILAFCFAIGLYYVTGKESFLVTPLSGFHGCLAGFLVALKQLLPNLELPMCFFWKIKAKWMPFFVVCFSSIMAFIVPDSINFLPTLVSGMYVSWLYLRYFQRNPLTGLKGDPSDDFSFPSLFPAAMRPVTDPVANLFDRMLCARSRPSEVALPISDPAKASRRRERGERVLEERLAADNAGDTEATPHGHGTAED

SEQ ID NO: 46069 - protein, 149 aa, Sorghum bicolor
  Clone ID: SORBI-28MAY03-C6299_2.pep
MAAVLQRPAAGTVQCFGRKKTAVAVAYTKPGRGLIKVNGVPIELIRPEMLRLKAFEPILLAGRSRFKDIDMRIRVRGGGKTSQIYAIRQAVAKGLVAYYQKYVDEAAKKEVKDIFARYDRTLLVADPRRCEPKKFGGRGARARFQKSYR

SEQ ID NO: 46070 - protein, 148 aa, Sorghum bicolor
  Clone ID: SORBI-28MAY03-C6299_1.pep
MSVLSRPTPGTVQCFGRKKTAVAVAYTKPGRGLIKVNGVPIELIRPEMLRLKAFEPILLAGRSRFKDIDMRIRVRGGGKTSQIYAIRQAVAKGLVAYYQKYVDEAAKKEVKDIFSRYDRTLLVADPRRCEPKKFGGRGARARFQKSYR

SEQ ID NO: 46071 - protein, 290 aa, Sorghum bicolor
  Clone ID: SORBI-28MAY03-C10801_1.pep
HSKQPRESGETSERGQRTESEERGNREVASDGGEMLAVFDPTVAKCPEGLRSPPVAGSAAAAAGGAGAGALMKGFSDSHDGAVTVSLGPSGALAYSAANQNPLVPRLFGAVNDIFCLFQGHIENIANLKQHYGLSKTANEVTILIEAYRTLRDRGPVPASQVVRDLSGKFAFILYDTLSKSTFVAADADGSIPFFWGVDSENHLVFSDDAGLLKTGCGNSYAPFPKGCFYTTSGGLQSFEHPLHEVKAVPRVDSQGQMCGSTFKVDSESKKKQDASIPRVGSAADWSNQF

SEQ ID NO: 46072 - protein, 108 aa, Sorghum bicolor
  Clone ID: SORBI-28MAY03-C10098_2.pep
MDHAADAHRTDLMTITRHVLNEQSRNPESRGDFTILLSHIVLGCKFVASAVNKAGLAQLIGLAGETNVQGEEQKKLDVLSNEVFVKALVSSGRTCVLVSERTRNTSGP

SEQ ID NO: 46073 - protein, 191 aa, Sorghum bicolor
  Clone ID: SORBI-28MAY03-C10098_1.pep
MNQTAGAQRTDLMTMTRHVLHEQSRHPESRGDCTILLSHIVLGCKVVASVVNKIGAAKRIGLAGETNVQGEEQKKLDVLSNEVFVKALVSSGRTCVLVSEENEAAPARVPALRGKYCVCFDPLDGSSNIDCGVSIGTIFGIYMIKDKDNVTLEDVLQPGTNMLAAGYGMYGSSCTLVLSTGNGVNGFTLDP

SEQ ID NO: 46074 - protein, 64 aa, Sorghum bicolor
  Clone ID: LIB3480-019-P1-K1-F11.pep
VCNFFRRTLVACEAVPGPHTIYYTECYKLTTTPREEMSESGRFTPHLGSLIKPSLTLPARHTRL

SEQ ID NO: 46075 - protein, 555 aa, Sorghum bicolor
  Clone ID: SORBI-28MAY03-C11110_1.pep
MGNACGGSLRSKYLHSFKHAASQRHDSEYSATSTVDDSPRKQPTTPPATTDAHAQPPPASAAAAAMRRGGAGATPDLGSVLGHPTPNLRDLYALGRKLGQGQFGTTYLCTELATGVDYACKSISKRKLITKEDIDDVRREIQIMHHLSGHKNVVAIKGAYEDQVYVHIVMELCAGGELFDRMHEGGHYSERKAAELTRIIVGVVEACHSLGVMHRDPKPENFLLANKDDDLSLKAIDFGLSVFFKPGQVFTDVVGSPYYVAPEVLLKSYGPAADVWTAGVILYILLSGVPPFWAETQQGIFDAVLKGVIDFDSDPWPVISDSAKDLIRRMLNPRAAERLTAHEVLCHPWIRDHGVAPDRPLDPAVLSRIKQFSAMNKLKKMALRVIAESLSEEEIAGLKEMFQTMDTDNSGAITYDELKEGLRKYGSTLKDTEIRDLMDAADIDNSGTIDYIEFIAATLHLNKLEREEHLVAAFSYFDKDGSGYITVDELQEACKEHNMPDAFLDDVINEADQDNDGRIDYGEFVAMMTKGNMGVGRRTMRNSLNISMRDAPGAF

SEQ ID NO: 46076 - protein, 247 aa, Sorghum bicolor
  Clone ID: SORBI-28MAY03-C12043_1.pep
MGSKAPLCLTLLLLLLVAACGPAAEARRLVLPAAQANDAVELPDHGSTLKEQISSMKTPVHLKSSGQICLACENFMSEAVNYLSEKQTQDKVMEFLHDACSKSFSFEEKCVELMDSYATLLFAKITEIEPEAFCKQYGLCRNTALFSGVRSNSTCVFCHHLLDEIMSKLKDPDAEIEIIEILIKECNKIEGHVQQCKRLVLQYIPLILVNGEKFLEKNDVCALVQACPASQKKTFSSVLQGALLSDA

SEQ ID NO: 46077 - protein, 536 aa, Sorghum bicolor
  Clone ID: SORBI-28MAY03-C16496_1.pep
MPDMESVAALMDSTSSKIQQLQEAFAELESQSAVSMNLKWKQLEDHFRGLEQSLKKKFDELKEQEEEFQEIVAKSDLMLEQREAAVVAKELTSLERLQEKRDAALAMIFSKSRLSLPVPAINPMNKALDNLGVKWPKPASEESVHLQDGNAAVRPRSELASLCEEMNVKGLHKFISDNRKNLAAIREEIPSALKKTSDPYGLVLDSLEDFYSGDNLVLDGKKDGDLLGVRRTCLMLMESLGQLQTNNITCFSLEGHMLTTNIVERARGIAFEWKSKLDNLDIDASNGNCLEAHAFLQLLATFGISAEYNEDDLCKLLPYVSRRRQTPELCRLLGLSQKMPGVIEVLVESGRPIDAINLAYVFELTEQFEPVQLLKAYLRDVKKVSHARNVKGSPGAQNEMNERELSALKSVIKCIEEHKLEEQYPVDPLQKRVLQLEKAKADKRRAVEAAKPQSKRPRANGSAFAHRATGFADKSFYPAAATPERHPSNPYERQFVYGAEAHLPPMVSSASYTMQPAHGPYYGNGYPVQYQVPYIH

SEQ ID NO: 46078 - protein, 150 aa, Sorghum bicolor
  Clone ID: SORBI-28MAY03-C12865_1.pep
MAEQTFIMIKPDGVQRGLIGDIISRFEKKGFYLKGMKFMNVERSFAQQHYADLSDKPFFPGLVEYIISGPVVAMVWEGKDVVLTGRRIIGATRPWEAAPGTIRGDYAVEVGRNVIHGSDSVENGKKEIALWFPEGVAEWKSNLHPWIYES

SEQ ID NO: 46079 - protein, 249 aa, Sorghum bicolor
  unsure (1)..(249): unsure at all Xaa locations
  Clone ID: SORBI-28MAY03-C2843_1.pep
YWVSRLLSPSLSPSAPAPLFPSLRLGLARQQPRPRESSFNSDTDPAAMATAVLRSHDALNNRMHLDAYTPSPAKPRRRRSPKPAAASSPPARAAAPIASTKPAAVQKAVTPAKAPVAPGRRSPPARPAASSRKQPSPTKEKMVSAPAASSAAVYAGPAFSAAAPEPSSXSPCPPSSSGARSPRPPGASGASSASASSPDTADVLSTSLCLLLRSPLRLRLFYSSSLVSGGSLIYGWLAPDGRLLDPMES

SEQ ID NO: 46080 - protein, 240 aa, Sorghum bicolor
  Clone ID: SORBI-28MAY03-C1833_2.pep
EQEGSSSVTIESDFFIASGILFRNDAPEPELKRDNQGKIGEVTSATMAPALRVAGSKATFYKCTVDGGHGALYDHKGLHYYKSCTINGTFDFIFGNARSFYEDCNIVSKSATDYLGDLPVAKPPLTLSPAAADGGFSFKTCTITGQSFIFLGRAGWPVVYSYTNIGYDLFPLIVSGSDDSQAGAKFQFNREFAPFLFISYKNYGVPSGAVGINKTDVAPFLGTQFVSGDNWILSIPPATE

SEQ ID NO: 46081 - protein, 229 aa, Sorghum bicolor
  Clone ID: SORBI-28MAY03-C1833_1.pep
MTTRVRTMMTLTEVRSPSDEPALVVLMEDEAVDLAIHSHLMLVDHEDRANTNQISKQSSCQQLVRHLFHRADVKSRHACGMIKMVRTMSSKKECPPHQHDPSLSSKIRPVSLQLTRWLGVRRPRTRHVPSFRDSSLFSSLAGDQGAGGGASAMGGGNGQKSKMARERNAEKNKGSKGSQLETNKKAMNIQCKICMQTFICTTSEAKCKEHAEARHPKNDLYQCFPHLKN

SEQ ID NO: 46082 - protein, 102 aa, Sorghum bicolor
  Clone ID: LIB5047-005-R1-XP1-G9.pep
MVVGGDSSLFSSLAGDQGAGGGASAMGGGNGQKSKMARERNAEKNKGSKGSQLETNKKAMNIQCKICMQTFICTTSEAKCKEHAEARHPKNDLYQCFPHLKN

SEQ ID NO: 46083 - protein, 88 aa, Sorghum bicolor
  Clone ID: LIB3480-031-P1-K1-D2.pep
HIVYGNQSLMKTTVLGGLHYYKSCTINGTFDFIFGNARSFYEDCNIVSKSATDYLGDLPVAKPPLTLSPAAADGGFSFKTCTITGQSF

SEQ ID NO: 46084 - protein, 311 aa, Sorghum bicolor
  Clone ID: SORBI-28MAY03-C2702_1.pep
RPLDKTRLSPPSTRLAFPGCPSPLTPASTAPGLHPIPSPRIKIRFQRLEDAAHHHLRARSSASSRTRTVAMASGLPVSSKEVLPSPLTSASEPPPLFDGTTKLYVAYYCPFAQRAWIARNYKGLQDKIKIVAIDLADRPAWYKEKVYPENKVPSLEHNNQVKGESLDLVKYIDSNFEGPSLLPEDPAKKQFAEELLAYTDAFNKALYSSLLSKEDVSEETVAALDKIEDALGKFNDGPFFLGQFSLVDIAYVPFIERFQIFYSNIKNYDITKGRPNLQKFIEEVNKIDAYTQTKLDPDFLLEQTKKRLGIA

SEQ ID NO: 46085 - protein, 148 aa, Sorghum bicolor
  Clone ID: SORBI-28MAY03-C2793_1.pep
MTLGSSGAGSSVVVPRNFRLLEELERGEKGIGDGTVSYGMDDADDIYMRSWTGTIIGPHNTVHEGRIYQLKLFCDKDYPEKPPSVRFHSRINMTCVNHETGVVDPKKFGLLANWQRDYTMENILTQLKKEMAASQNRKLVQPPEGTFF

SEQ ID NO: 46086 - protein, 342 aa, Sorghum bicolor
  Clone ID: SORBI-28MAY03-C2100_1.pep
MALANKLGGLLKKATSSNPSVYQAIRCMSSKLFVGGLSYGTDDHSLRDEFAKYGEVIEARIILDRESGRSRGFGFVTYTSSEEASAAITAMDGKTLDGRSIRVNHANERTGGFRGSGGGGYGGGGFGGGGYGGGGGGYGGGGGGYGGGYGGNYGNRGGGGYGGGVGDYGAAGGAGGNFAAGGSNSFASSNFGADSGFGGNPAGSFGGGSTGAEKEYGRRWGMEMKWKKVDRFVVFKIDERSRAVLVDKVGGPGEGYEELVAALPGDDCRYAVFDFDFVTVDNCQKSKIFFIAWSPAASRIRAKILYATSKQGLRRLLDGVHYEVQATDPSEMGFDVIRGRAQ

SEQ ID NO: 46087 - protein, 110 aa, Sorghum bicolor
  unsure (1)..(110): unsure at all Xaa locations
  Clone ID: LIB3481-003-Q6-K1-F2.pep
MEDMFKDDEPDSFADKVGGPGEGYEELVAALPGDDCRYAVFDFDFVTVDNCQKSKIFFIAWSPAASRIRAKILYATSKQGLRRLLDXVHYEVQATDPSEMGFDVIRGRAQ

SEQ ID NO: 46088 - protein, 88 aa, Sorghum bicolor
  Clone ID: SORBI-28MAY03-C2983_1.pep
MSYYGQQPPVGVPPQQGYPGKDGYPPAGYPPAGYPPPAQGYPPQGYPQQGYPPQYAQPPPQQQQSSGPSFMEGCLAALCCCCLLDACF

SEQ ID NO: 46089 - protein, 118 aa, Sorghum bicolor
  Clone ID: SORBI-28MAY03-C3265_1.pep
MASEEGVVIACHTKAEFDAQMAKAKEAGKLVVIDFTASWCGPCRAIAPLFVEHAKKYTQAVFLKVDVDELKEVTAEYKIEAMPTFHFIKNGETVETIVGARKDELLALIQKHTASASA

SEQ ID NO: 46090 - protein, 376 aa, Sorghum bicolor
  Clone ID: SORBI-28MAY03-C3560_1.pep
MADEDIQPIVCDNGTGMVKAGFAGDDAPRAVFPSIVGRPRHTGVMVGMGQKDAYVGDEAQAKRGILTLKYPIEHGIVNNWDDMEKIWHHTFYNELRVAPEDHPVLLTEAPLNPKANREKMTQIMFETFECPAMYVAIQAVLSLYASGRTTGIVMDSGDGVSHTVPIYEGYTLPHAILRLDLAGRDLTDHLMKILTERGYSLTTSAEREIVRDIKEKLAYVALDYEQELETARSSSSVEKSYEMPDGQVITIGSERFRCPEVLFQPSLVGMESPGVHEATYNSIMKCDVDIRKDLYGNVVLSGGSTMFPGIADRMSKEITSLAPSSMKIKVIAPPERKYSVWIGGSILASLSTFQQMWISKAEYDETGPGIVHMKCF

SEQ ID NO: 46091 - protein, 533 aa, Sorghum bicolor
  Clone ID: SORBI-28MAY03-C37126_1.pep
MEAAAEMALRLRAAANDRLAGYEPLALVAAPLLALLVARTLHAAANAVADRGLVAIAIAAVKLLPGVSGYIAAEKKKVVDKMQSGGAKNDRRADLPTIGLGEQVIEELETLKAKDVDWQGKCSGTVYIAGSESEGHFELINKAVSMFSHTNPLHQDVFKSVANMEAEVVAMTAALLGSKEKSSGGQICGNMTSGGTESILLAVKTTRDYMRSKKGITKPEIIMAESAHSAYDKAAEYFNIKVRRVPVNKEFLADVKGFKRCINGNTIMMIGSAPGFPHGLIDPIEELGELASRYDICLHIDLCLGGFVLPFARKLGYPIPPFDFSVKGVTSISSDVHKYGLAPKGTSIVLYRNHEIRKHQFVAVTEWTGGLYVSPTMAGSRPGGLIAGAWAAMMSLGLNGYLDNTRCVMEVSKKIQRGIGEIPGLFVIGKPDMTIVAFGSDVVDIFEVNDIMSSKGWHLNALQRPNSLHICVTLQHTTIYDQFLKDLQDSVDTVKANPGPISGGMAPIYGAAGKMPDRGTVRELLVEFMDSSC

SEQ ID NO: 46092 - protein, 104 aa, Sorghum bicolor
  Clone ID: SORBI-28MAY03-C44198_1.pep
MAAASRASLVLFLVVATSAVVASMLAVAPGAGAATTACVPTQLTPCAPAIVGNAAPTAACCARLKAHPASCFCQYKKNPNMQRYVNSPNGKKVFAACKVPLPKC

SEQ ID NO: 46093 - protein, 217 aa, Sorghum bicolor
  Clone ID: SORBI-28MAY03-C6476_1.pep
MESTKLSALLVLAMLALSSSPLALAWEKAEPECHSCESGSPPSTGVPLPPISIPSVPLPPVSIPSVPLPPVSIPSVPIPKLPVPPVTLPPVSGLPPVSLPPIPIIGGSPTKKGHRKACPPPPSPPTPTPTPTPSSDKCPIDALKLGACVDVLGNEVHIGDANVKCCPLVKGIAGLSAAACLCTAIKAKVLDISVYVPIALEVLVNCGCAVPPGYKCT

SEQ ID NO: 46094 - protein, 139 aa, Sorghum bicolor
  Clone ID: SORBI-28MAY03-C624_1.pep
MANARSGVAVNDECMLKFGELQSKRLHRFITYKMDDKFKEIVVDQVGDRATSYEDFTNSLPENDCRYAIYDFDFVTAEDVQKSRIFYILWSPDSAKVKSKMLYASSNQKFKSGLNGIQVELQATDASEISIDQIKDRAR

SEQ ID NO: 46095 - protein, 284 aa, Sorghum bicolor
  Clone ID: SORBI-28MAY03-C11151_1.pep
MAAISSLPFAALRGASEWRPSSTAAAVSGAVVLSARSRRGSRSVVRCVATAGDVPPTVAETKLNFLKSYKRPIPSIYSTVLQELLVQQHLMRYKRTYQYDPVFGLGFVTVYDQLMEGYPSNEDRDSIFRAYITALNEDPTQYRADALKMEEWARSQNASSLVDFSSRDGEIEAILKDISERAKGKGNFSYSRFFAVGLFRLLELANATEPTVLDKLCTALNVSKRSVDRDLDVYRNILSKLVQAKELLKEYVDREKKKREERSETPKPNEAVTKFDGNLYSMRH

SEQ ID NO: 46096 - protein, 486 aa, Sorghum bicolor
  Clone ID: SORBI-28MAY03-C4929_1.pep
MVSSEITSVTAVRAQGPKLFRGKILLPGGPPDVVPSENVEFDFSDVFGPSAVQTHTEVSILTPDSPAPVAESNDEVYDDPDVIVKRSHSLVGPSSLVSQSLPFSKLTLHKTESSLDLSECPYKEKQINQGSLSDDEFDDVKKENEGVGLDDFEVLKLVGQGAFGKVYQVRKKGPAEIYAMKVMRKDKVVEKNHAEYMKAERDILTKVDHPFVVQLRYSFQTKYRLYLVLDFINGGHLFFQLYHQGLFREELACIYTAEIVSAVAHLHANGIMHRDLKPENILLDADGHAMLTDFGVAKEFDENTRSNSMCGTVEYMAPEIVQGRGHDKAADWWSVGILLFEMLTGKPPFIGGNRDKIQQKIVKEKIKLPTYLSSEVHSLLKGLLHKEAGRRLGSGPGGSDEIKNHKWFKSVNWKRLEARQIQPSFRPNVAGKTCIANFDECWTNMPVLDSPVASPVAANSNFVGFSYVRPAPFLQKPSPLAEERLP

SEQ ID NO: 46097 - protein, 416 aa, Sorghum bicolor
  Clone ID: SORBI-28MAY03-C8407_1.pep
MAGLSLRCGDCGAQLRSVEEAQAHAEATNHANFVESTEAVLNLVCSDCGKPCRSQTEVDLHTKRTGHTEFADKTAEAAKPIDLEAPLKPASEDAMDVDASASASAEPQEMVVPEVNKEMLTDLEGMGFSTARATRALHFSGNSTIEGAINWLSEHQEDADIDEMPLVPANSKTEANKPSLTPEEMKIKAQELRERARKKKEEEERRMEREREKERIRIGKELLEAKRIEEQNERKRMIELRRLEKEEEKRAREKIRQKLEEDKAERRRKLGLPPEDPAAAKPSAPPPVEEKKSALPVRPATKAERMRDCLRNLKQQNKDDDAKVKRAFQTLLTYIGNVAKNPDEEKFRKIRLTNATFQERVGNLHGGIEFLELCGFEKLEGNEFLFLAREKVDKAILNTAGAELNSAITNPFFGVL

SEQ ID NO: 46098 - protein, 516 aa, Sorghum bicolor
  Clone ID: SORBI-28MAY03-C1385_1.pep
MAGRRRRTDHQLLLPAGSSTSTACLWALSCVLLLLLRASAHSDGGLLRVGLSKRGLDQHALQAAKVARQEDSLQHGRLRASSTGDDVPLVDYLNTQYYGVVGLGTPPQNFTVIFDTGSSNLWVPSSKCYFSIACYLHPRYKSAKSSTYKKDGETCKITYGSGSIAGFFSYDDVLVGDLTVKSQKVIETTREPSITFIIGKFDGILGLGYPDISVGKAPPIWQSMQEQNLLAEDVFSFWLNRNAGAESGGELVFGGVDPDHFKGNHTYVPVSTKGYWQFNMGDLLIDGQSTGFCAKGCAAIVDSGTSLLGGPTTIIAQVNEAIGAAGIISQECKEVVSQYGEMILELLIAQTDPERVCSQVGLCLFDGAQSVSKGIESVVGKENLGSDVMCSACEMAVVWIENQLRENKTKELILQYANQLCERLPSPSGESTVSCEDISTMPNLAFTIANKTFTLTPEQYIVKLEQGGQTVCISGFMAYDVPPPRGPLWILGDVFMGAYHTVFDFGNDRIGFAESA

SEQ ID NO: 46099 - protein, 223 aa, Sorghum bicolor
  unsure (1)..(223): unsure at all Xaa locations
  Clone ID: SORBI-28MAY03-C1061_2.pep
AWSQLALEEGKDIPSAAHVGKSILHGAADHVLRKVLYWAKEEDKMEKMKARLIELYYENLFKLDTPVEGLREWLDAVQTAGIPCAVASSLDRRCMIEALDRMALSKYFKAIVTDEDDMDSIANRFLSAAMKLDRKPSKCVVFEDDPXGVTAAHNCTMMAVALIGAHPAYELVQADLAIAKYSELSVINLRRLFANKGISFMDLQKQIIEKSPPKRRLTVDTIF

SEQ ID NO: 46100 - protein, 363 aa, Sorghum bicolor
  unsure (1)..(363): unsure at all Xaa locations
  Clone ID: SORBI-28MAY03-C1061_1.pep
MESCSFRAATAPSPFPSAPSSSSSSSPRARSLILRFPRPRKGRKIGVRRRASGFDAFPPLPGKVFVDEAIGAEYGEGFETFRMDGPLKVDVDYLNEKLQECFLQRIRHAMKPDEAFGLIFSWDNVIADTDSLKLNAWSQLALEEGKDIPSAAHVRKSILHGAADHVLRKVLYWAKEEDKMEKMKARLIELYYENLFKLDTPVEGLREWLDAVQTAGIPCPDLVSXLLFLSSRPSLXSVVYKIVLILVXSAVSLLVNAMXSIANRFLSAAMQLDRKPSKCVVFEDDPRGVTAAHNCTMMAVALIGAHPAYELVQADLAIAKYSELSVINLRRLFANKGISFMDLQKQIIEKSPPKRRLTVDTIF

SEQ ID NO: 46101 - protein, 215 aa, Sorghum bicolor
  Clone ID: SORBI-28MAY03-C7520_1.pep
MAAAGAKAKAAGALALALVLALAGANSEGDALSALRRSLRDPGGVLQSWDPTLVNPCTWFHVTCDRDNRVTRLDLGNLNLSGHLVPELGKLEHLQYLELYKNSIQGTIPSELGNLKNLISLDLYKNNISGTIPPTLGKLKSLVFLRLNGNRLTGPIPRELAGISSLKVVDVSSNDLCGTIPASGPFEHIPLSNFEKNPRLEGPELQGLAIYDTNC

SEQ ID NO: 46102 - protein, 216 aa, Sorghum bicolor
  unsure (1)..(216): unsure at all Xaa locations
  Clone ID: LIB5049-005-R1-XP1-E12.pep
MAGAAAVALMVAAAAVLSPAYVALASNSEGDALYALRRALADPRGVLQSWDPTLVNPCTWFHVTCNRDSRVTRVDLGNSNLSGNLVPELGHLEHLQYLELYKNNIQGTVPAELGNLKSLISLDLYNNNITGTIPKELGKLKSLVFLRLNDNRLTGPVPRELTKISNLKVIDVSNNDLCGTIPTSXLFEHIPLSNFDNNPRMEGPELPGLVTYDTNC

SEQ ID NO: 46103 - protein, 399 aa, Sorghum bicolor
  Clone ID: SORBI-28MAY03-C1018_1.pep
MAATRRLSSCCLLLAVLLGAVAATATAFFVDEAAAAGVGLGHGGRFARKHGRAAAELPQPEPQPKPEPQPQPQPLPQPEPKPEPKPEPKPRPEPKTEPHPEPSPKPEPKPEPQPKPITKPEPKPKPEPMPKPMPEPKPKPKKPEPKPKPEPKPEPKPEPEPKPEPLPKPEPKPEPKPKPEPKPEPKPEPKPEPMPKPKPEPKPEPKPEPKPEPMPKPEPKPEPKPKPKPEPKPEPKPEPKPEPLPPKPEPKPEPKPEPKPEPKPEPKPEPLPKPEPKPEPKPEPKPKPLPKPEPKPEPLPKPEPKPEPKPEPKPEPLPKPEPKPEPKPKPEPKPEPKPEPKPEPLPKPEPKPKPEPKPEPKPKPEPKPEPKPEPKPKPEPKPEPKPKPNPPHIPPAADN

SEQ ID NO: 46104 - protein, 187 aa, Sorghum bicolor
  Clone ID: SORBI-28MAY03-C1522_1.pep
YCTLLVWYSSRSIGTIPIRTCGQRPGSPETPARQRSKTDLGEERTEDWIGGGHARPASLHLHLGPQSSRCITLAVLPWPWTWSSRSRPPRHPAGCRFDGSLPPAAPADADMPTRGSCSCSAASRASARRVASSGHLLLVVLSRPVLMAAAAAAAPYAVALAHTHARTHASNDSLGYLLCCCCRTTCR

SEQ ID NO: 46105 - protein, 107 aa, Sorghum bicolor
  Clone ID: LIB3481-027-P1-K1-A11.pep
RPLARWTAQALLAGADMMKLGYVSRVNPRDHYNHSVLTVMGYKPRDFAAQINLNTANMWGIVKSIVDICMKFEEGKYVFVKDPAKPQVRIYEVPSDAFENDYVEYTL

SEQ ID NO: 46106 - protein, 194 aa, Sorghum bicolor
  Clone ID: SORBI-28MAY03-C243_1.pep
MLPRPSQRSIFHIGEEGGDESDDHRSADEPVKNTDTTRILAGRRDHGRQLRKQDSAVDAVGVGLQILVQTNLHHTRAPPHSHIVLKQVVVLPPTTTVARRHRRGPCSSFLSACSRCRKELSSKDVYMYRGDQGFCSEECRCQQILADEATEREAMIKKERMRRGLPRHLHHGPRSAMGAAAIGGASRRLVAIAY

SEQ ID NO: 46107 - protein, 344 aa, Sorghum bicolor
  Clone ID: SORBI-28MAY03-C21554_1.pep
MSSSAGNKKTMKTACVTGGSGYIGSALIKLLLEKGYAVKTTVRNPDDMEKNSHLKDLQKLGPLTVFRADMDEEGSFDDAVAGCDYVFLVAAPLHFEAQDPEKEQIEPAIQGTLNTMRSCVKAGTVRRVIRTSSASAVYLVYIRLDVGGEHVLLDEDSWSDVDFSRAKPPTWSHCVSKVLLEKEAGRFAEEHGISMLTILPLIVVGAAAPAPKVRTSIVDSLSLPAGDAARAMLRAIQKTSGEVQLVHVDDLCRAELFLAENATANGRYICSRYHPTLVELATFLAQKYPQYGVKPTDFDDEERPRVTMSLEKLIREGFEYKHNTLEEIYDNVVEYGKALGILPY

SEQ ID NO: 46108 - protein, 66 aa, Sorghum bicolor
  Clone ID: LIB5048-011-R1-XP1-H5.pep
MSSSARNTTKLKTACVTGGNGYIGSALIKMLLEEGYAVKTTVRNPDDMEKNSHLKGLQELGPLTAL

SEQ ID NO: 46109 - protein, 314 aa, Sorghum bicolor
  Clone ID: SORBI-28MAY03-C4442_1.pep
MATLTVPSSVPAVAEDAEQLHKAFEGWGTNEKLIISILAHRNAAQRRAIRRAYAEAYGKELLRALGDEIHGKFERTVILWTLDPAERDAVLANEEAKKWHPGGRALVEIACARTPAQLFAAKQAYHDRFKRSLEEALPARVTGDFRKLLVPLVSAYRYDGPEVNTSLAHSEAKILHEKIDKKAYSDEEIIRILTTRSKAQLLATFNNYKDQFGHAINKDLKADPKDEFLSTLRAIIRCFTCPDRYFEKVIRLALGGVGTDEDALTRVITTRAEVDLKLIGEAYQKRNSVPLDRAVAKDTTRDYEDILLALLGAE

SEQ ID NO: 46110 - protein, 80 aa, Sorghum bicolor
  Clone ID: SORBI-28MAY03-C2193_2.pep
MNTPVYEGREELLEQHLKDDLHSIVDFTGHGALYLQEDDGGVVSDEGCSFDLPDAMFTAGVTHHGAEEAQLANWTSWFWN

SEQ ID NO: 46111 - protein, 150 aa, Sorghum bicolor
  unsure (1)..(150): unsure at all Xaa locations
  Clone ID: SORBI-28MAY03-C2193_1.pep
MDPSAVSFDSGGARRGGGGGGAQMLLFGGGGSANSNGFFRVVPMAVLGMDDATRVGKRPFFTTHEELLEEEYYDEQAPEKKRRLTAEQVQLLERSFEEENKLEPERKTELARRLGMAPRQVAVWFQNRRARWMTXQLETDYDLCAAXYDA

SEQ ID NO: 46112 - protein, 365 aa, Sorghum bicolor
  Clone ID: SORBI-28MAY03-C33_1.pep
MRRWFCCTQFNASYREHENERPISPEEKEGNGFAVKSDPIKVPPSIEVPELSFEELKEKTDNFGSKALIGEGSYGRVYYAILDSEKHVAVKKLDASTDPELDNEFLTQVSIASKLKHDNFVEMLGYCVEGNQRLVAYEFATMGSLHDILHGRKGVPGAQPGPALDWMQRVKIAIDAAKGLEYLHEKVQPSIVHRDIRSSNVLLFEDYKAKIADFNLSNQSPDMAARLHSTRVLGTFGYHAPEYAMTGQLTQKSDVYSFGVVLLELLTGRKPVDHTMPRGQQSLVTWATPRLTEDTVKQCVDPRLKGEYPPKGVAKLAAVAALCVQYESEFRPSMSIVVKALSPLLQHKPQPPPATTPDATAPSDA

SEQ ID NO: 46113 - protein, 605 aa, Sorghum bicolor
  unsure (1)..(605): unsure at all Xaa locations
  Clone ID: SORBI-28MAY03-C23128_1.pep
MCGILAVLGEASHGKNKRGRVLELSRRLKHRGPDWSGLRQMGDCYLSHQRLAIIDPASGDQPLYNEDQSVVVAVNGEVYNHQDLRSRLSTAGHRFRTGSDCEVIAHLYEEHGEEFVDMLDGVFSFVLLDTRHGHGDRASSFMAARDAIGVTPLYIGWGIDGSVWISSEMKALNDECEHFEIFPPGHLYSSNNKTGGGFSRWYNPRWFDEAITPSVPYNPLALRKAFEKAVVKRLMTDVPFGVLLSGGLDSSLVAAVAVRHLAGTEAATRWGTKLHSFCVGLEGSPDLKAAREVADYLGTLHHEFHFTVQDGIDAIEDVIYHTETYDVTTIRASTPMFLMSRKIKSLGVKMVISGEGSDELFGGYLYFHKAPNKEEFHQETCRKVKALHQYDCQRANKARTARGHTRYLXCMMQCCLQEVDGTFKISLQSRIDMGRGEQRVLRQAFDAEGQPFLPKHILYRQKEQFSDGVGYSWIDGLKAHAASNVTDKMLSNAKFIFPHNTPTTKEAYYYRMIFERFFPQKPAILTVPGGPSVACSTAKAIEWDAQWSENLDPSGRAALGVHLAAYEHEQDPKHVPDTIAAGGSKKPRTIRVAAAPPPPGVAIEG

SEQ ID NO: 46114 - protein, 128 aa, Sorghum bicolor
  Clone ID: LIB5121-004-A1-PF1-E7.pep
LYQVISVLPDPTARLCGRHAHTPQLVAIVNGRAIAHGREARGGGGRRKGRGLLLLRPPAVGGAAPAGPAVAGVRVRHVPGPSATSRRVPAACSASRVRRRRLSQPAEAVRARGALLRSGVPGRAPLWP

SEQ ID NO: 46115 - protein, 369 aa, Sorghum bicolor
  unsure (1)..(369): unsure at all Xaa locations
  Clone ID: SORBI-28MAY03-C360_1.pep
MEGYDREFWQFSDTLRLQTAAFSGLSLGDSIWSPATGGAPAGADRPNNSTTDLFSASPSPSHTTAATNVATVGPTLNLNDGGAGHIGSAKLAFGCTKADRYDNLPATPEKTAPPSGXKKNLNVNAGNAKNNNNNNGSALAFNTMGIYGYNTNDGNISNNSSSGEVKSYFNICIVRVSSNNSHGHGHAGGKKGGEYGNKKKHGKNEGNNGGGGAGATDKRFKTLPASEALPRGQAIGGYIFVCNNDTMDENLRRELFGLPSRYRDSVRAIRPGLPLFLYNYSTHQLHGIFEAVSFGGTNIDPTAWEDKKCPGESRFPAQVRVATRKIYDPLEEDAFRPILHHYDGPKFRLELSVTEALALLDIFADKDDA

SEQ ID NO: 46116 - protein, 160 aa, Sorghum bicolor
  Clone ID: SORBI-28MAY03-C32730_1.pep
SPANNGEDVLGQPLPEPDLEALLPEGFLERTRDRGLVLKSWAPQVDVLGHRATGAFVTHCGWNSTLEGIMAGLPLLCWPLYAEQRMNKVFIVEEMKLGVEMNGYDEGMVKAEEVETKVKWVMESQGGRALRDTMVEVKDRAVKALKEGGSSHDAFVEFVK

SEQ ID NO: 46117 - protein, 212 aa, Sorghum bicolor
  Clone ID: SORBI-28MAY03-C3254_1.pep
RLFFSQADKDLQTWIARDDEQGQKMWRVNQRIVKLIAELMRNHDSPEALVILASASDLLLRATDGMLVDGEACTLPQLELLEVTARAVHLIIEWGDSGLSVADGLCNLLKCRLSTTIRCLSHPSAHVRALSMSVLRDILNNGSMNPSKIIQGEQQRNGIQNPSYRCLAAGIINWQADVERCIEWEAHSRRATGLTLAFLSAAAKELGCPLPC

SEQ ID NO: 46118 - protein, 124 aa, Sorghum bicolor
  Clone ID: LIB3476-057-P1-K1-A8.pep
LKPSSVGTSWSYSSNEIVAAAMVAAHVSELFRRSRPCLTSLSAMMRCKRDAEISTRASSLYHLIDLHGKTVSSIVNKAEPLEAHLTLTPVKKDNQHRCEENNTSSIDSVSWKTRWFNIHKKNGL

SEQ ID NO: 46119 - protein, 117 aa, Sorghum bicolor
  unsure (1)..(117): unsure at all Xaa locations
  Clone ID: LIB3476-011-P1-K1-C6.pep
PRVRKNGFSRPLLKCAEEVLLNGDVASTSGKSIASLQVEASDLANFLTMDRNGGYRGSQTLLRSVLSEKQELCFSVVSLLWQKLIASPEMQMSAESTSAHQXNWRKVVDATFVMRFS

SEQ ID NO: 46120 - protein, 429 aa, Sorghum bicolor
  Clone ID: SORBI-28MAY03-C4209_1.pep
MMGEAKENDVYEEELLDYEEDDDKTVDGSAAKPTGEVAKKGYVGIHSSGFRDFLLKPELLRAIQDCGFEHPSEVQHECIPQAILGMDVICQAKSGMGKTAVFVLSSLQQIDPVAGQVAALVLCHTRELAYQICHEFERFSKYLPEVKVAVFYGGVHIRKHKDLLKNECPHIVVGTPGRILALARDKDLSLKNVRHFILDECDKMLESLDMRRDVQEIFKMTPHDKQVMMFSATLSKEIRPVCKKFMQDPMEIYVDDEAKLTLHGLVQHYIKLSEAEKNRKLNDLLDALDFNQVVIFVKSVSRAAELNKLLCECNFPSICIHSGMTQEERLTRYKNFKEGHKRILVATDLVGRGIDIERVNIVINYDMPDSADTYLHRVGRAGRFGTKGLAITFVSSASDSDVLNQVQERFEVDIKELPEQIDTSTYMPS

SEQ ID NO: 46121 - protein, 256 aa, Sorghum bicolor
  Clone ID: SORBI-28MAY03-C5525_1.pep
MADPAEENVASPPPTPAAPAEGVSDPPLQPAADGASTEKVSAPAPEVRSRGFRLLGEDNSVHKALGGGKTADVLLWKDKKTSAVVIGGATVIWVLFEVLDYHLLTLISHALIGVLAILFLWSKATTFIRKSPPDIPVVQIPEDLVVNVSRALCNDINRALHLFHEIAMGHDLKKFLFVIVGLWVNSVFGSSCDFLTLIYIAVLLLHTVPILYDKYQDKVDHFAGRAHTEALKQYEVLDAKVLSKIPRGPVKSKKQN

SEQ ID NO: 46122 - protein, 248 aa, Sorghum bicolor
  Clone ID: SORBI-28MAY03-C55634_1.pep
MSGNIAFGRFDDSFSAASLKAYVAEFISTLVFVFAGVGSAIAYTKLTGGAPLDPAGLIAVAVCHGFGLFVAVAIGANISGGHVNPAVTFGLALGGQITILTGIFYWIAQLLGAIVGAVLVQYSTGVATPTHGLSGIGAFEGVVMEIIVTFGLVYTVYATAADPKKGSLGTIAPIAIGFIVGANILVAGPFSGGSMNPARSFGPAVASGDFTNIWIYWVGPLVGGGLAGIVYRYIYMCGDHAPVASSGF

SEQ ID NO: 46123 - protein, 146 aa, Sorghum bicolor
  Clone ID: SORBI-28MAY03-C5513_2.pep
MTTSLKKNRKKRGHVSAGHGRIGKHRKHPGGRGNAGGMHHHRILFDKYHPGYFGKVGMRYFHKLRNKFYCPSVNVERLWSMVPADKVAEAAGGDKAPLLDVTQFGYFKVLGKGMLPPKPIVVKAKLISKVAEKKIKAAGGAVLLTA

SEQ ID NO: 46124 - protein, 145 aa, Sorghum bicolor
  Clone ID: SORBI-28MAY03-C5513_1.pep
MTTRFKKNRKKRGHVSAGHGRIGKHRKHPGGRGNAGGMHHHRILFDKYHPGYFGKVGMRYFHKLRNKFYCPAVNIERLWSMVPADKAAEAGGDKAPQIDVTQFGYFKVLGKGVLPPKPIVVKAKLISKVAEKKIKAAGGAVVLTA

SEQ ID NO: 46125 - protein, 492 aa, Sorghum bicolor
  Clone ID: SORBI-28MAY03-C164_1.pep
MDPYKHRPSSTFNAPYWTTNSGAPVWNNDNSLTVGARGPILLEDYHLVEKLANFDRERIPERVVHARGASAKGFFEVTHDITHLSCADFLRAPGVQTPVIVRFSTVIHERGSPETLRDPRGFAVKFYTREGNWDLVGNNFPVFFIRDGMKFPDMVHSLKPNPKTHIQENWRILDFFSHHPESLHMFTFLFDDVGIPADYRHMDGSGVHTYTLINRAGKATYVKFHWRPTCGVRSLLDDEAVAVGGANHSHATKDLTDAIAAGNFPEWTLYIQTMDPEHEDRFDFDPLDVTKTWPEDVFPLQPVGRMVLNRNIDNFFAENEQLAFCPGLIVPGIYYSDDKLLQTRIFSYSDTQRHRLGPNYLLLPANAPKCAHHNNHYDGFMNFMHRDEEVDYFPSRYDPAKNAPRYPIPAVHITGRRDKTVIAKENNFKQPGERYRAMDPARQERFIKRWVDALSDPRLTHEIRSIWLSNWSQADRSLGQKLASRLSAKPSM

SEQ ID NO: 46126 - protein, 192 aa, Sorghum bicolor
  Clone ID: SORBI-28MAY03-C1983_1.pep
MALRIPTISSSHGLASSPAPTCRPAVFLAVGSSSSWAAGAQQKRSLLLATTTTTASETRGAGVLAPVRSSGIETSTSVGAEAVTGQVTEVNKDTFWPIVEAAGDKVVVLDMYTEWCGPCKVMAPKFQEMSEKNLDVVFLKLDCNQDNKPLAKELGIKVVPTFKILKGGKVVKEVTGAKIEELAHAIDTLKSG

SEQ ID NO: 46127 - protein, 610 aa, Sorghum bicolor
  Clone ID: SORBI-28MAY03-C6040_1.pep
APFGSPPPPPLPAAWTSRTCPCSPPSLPPAMAHEATAQGNAAFSAGRFEEAARHFTDAIALAPGNHVLYSNRSAALASLHRYSDALADAHKTVELKPDWAKGYSRLGAAHLGLRDAACAVAAHVPPRALVPGCAGRGAGLVGAWMAAAAPPARGPSGPDGLGQMFQGPELWSKIASDPTTRAYLSEPDFMQMLREVQRNPSSISMYLSDPRMMQVLSLMLNVKIQRPEASEAPRSTPSQPPPQQQQTPPPETKAREVEPEPEPEPMDLTDEEKDRKEKKAAAQKEKELGNTAYKKKDFETAIQHYTKALELDDEDISYLTNRAAVYIEMGKYDECIKDCDKAVERGRELRADFKMISRALTRKGTALVKLAKTSKDFDIAIETFQKALTEHRNPDTLKKLNEAERAKKDLEQQEYYDPKLADEEREKGNEFFKEQKYPEAIKHYTEALRRNPKDPRVYSNRAACYTKLGAMPEGLKDAEKCLDLDPTFTKGYTRKGAIQFFMKEYDKAMETYQAGLKHDPNNPELLDGVRRCIEQINKANRGEISQDELQERQNKAMQDPEIQNILTDPIMRQVLIDFQENPRAAQEHLKNPGVMQKIQKLVSAGIVQMR

SEQ ID NO: 46128 - protein, 85 aa, Sorghum bicolor
  unsure (1)..(85): unsure at all Xaa locations
  Clone ID: SORBI-28MAY03-C809_2.pep
RPRSCSAPSASCCWHAPPKVKPPPSSTPCPPPPYSPSTPTGKCPVNTLKLLACVDAFNGLVHAVIGPRPAXTCCRCLGWRLTRLA

SEQ ID NO: 46129 - protein, 148 aa, Sorghum bicolor
  Clone ID: SORBI-28MAY03-C809_1.pep
MATTTNNRRIVALLLATLLAQAAACPYCPTPTPPPPPPPPKVKPPPSSTPCPPPPYSPSTPTGKCPVNTLKLLACVDALNGLVHAVIGTKASDTCCPLLSGVADLDAALCLCTTIKAKALSVSVVLPVAISVLVNECGKHVPSSFTCP

SEQ ID NO: 46130 - protein, 619 aa, Sorghum bicolor
  Clone ID: SORBI-28MAY03-C1297_1.pep
MPKHYRPAGKKKEGNAAKYITRTKAVNYLQVSLAIFRKLCILKGVFPRQPKKKVEGNHKTYYHTKDIAFLAHDPLIEKFREIKVHRRKVKKAVAKKNRDLADRLLNRPPTYKLDRLVLERYPTFVDALRDLDDCLTMVHLFAALPAVDGERVEVKRIHNCRRLSHEWQAYISRTHSLRKTFISVKGIYFQAEVQGQKITWLTPHALQQVLTDDVDFNVMLSFLEFYETLLGFVNFKLYHSINVNYPPILDPRLEALAAELYALCRYMSAGSRRMIGNSQSDEVMEDKDEKSKADGITEEEKDVKNKASSKADESELRLAQLQHQLPTNEPGALMNLVEESTADDADDDDTKECKGLFKNLKFYLSREVPRESLLFIIPAFGGTVSWEGEGAPFKEVDEDITHQIVDRPTQSHVFLSREYVQPQWVFDCVNARIILPTEGYLVGRVPPPHLSPFVDNDAEGYIPEYAETIKRLQAAARNEVLPLPGIGDEDLDNSLVAAMMDRTESNEAAEKKRKLEMLEKQYHDELKMEIDGVAFSSLSNKEANKSPDAKDDTQSDHEADAIKQEEKDDDDIGTALMSRKQQGLYKAMKMGKEKKKEKIELLKKRKKNADSSASSKKRH

SEQ ID NO: 46131 - protein, 595 aa, Sorghum bicolor
  Clone ID: SORBI-28MAY03-C14281_1.pep
MVSEASKKKAAQKKAAAAAKRGGKAAVASSSSSSAAAAADKAANGVAALKLSDRTCTGVLASHPLSRDIHIESLSLTFHGHDLIVDSELELNYGRRYGLLGLNGCGKSTLLTAIGCRELPIPEHMDIYHLSHEIEASDMSALQAVVTCDEERVKLEKEAEILAAQDDGGGEALDRVYERLDAMDAGTAEKRAAEILFGLGFNKEMQAKKTKDFSGGWRMRIALARALFMNPTILLLDEPTNHLDLEACVWLEETLKKFDRILVVISHSQDFLNGVCTNIIHMQSKKLKLYTGNYDQYVQTRSELEENQMKQYKWEQEQIASMKEYIARFGHGSAKLARQAQSKEKTLAKMERGGLTEKVVRDRVLVFRFTDVGKLPPPVLQFVEVKFGYTPDNLIYKSLDFGVDLDSRIALVGPNGAGKSTLLKLMTGDLVPLDGMVRRHNHLRIAQYHQHLAEKLDLDMPALAYMMKEYPGTEEEKMRAAVGRFGLSGKAQVMPMKNLSDGQRSRVIFAWLAYRQPQLLLLDEPTNHLDIETIDSLAEALNEWDGGLVLVSHDFRLINQVAQEIWVCENQAVTRWEGDIMDFKAHLKSKAGLSD

SEQ ID NO: 46132 - protein, 540 aa, Sorghum bicolor
  Clone ID: SORBI-28MAY03-C15279_1.pep
MALATNSAAAAAAAAAVSGGASSQPRRAAVFLPLKRRTISAIHAADPSKNNGPAVPAAAAAKSSASAVATPEKKPAAPGKWAVDSWKSKKALQLPEYPNQEELDTVLKTIETFPPVVFAGEARHLEERMAEAAMGRAFVLQGGDCAESFKEFHANNIRDTFRILLQMGAVLMFGGQVPVVKVGRMAGQFAKPRSEPFEERDGVKLPSYRGDNVNGDDFTEKSRVPDPQRMIRAYAQSVATLNLLRAFATGGYAAMQRVTQWNLDFMDHSEQGDRYRELAHRVDEALGFMTAAGLTVDHPIMTTTDFWTSHECLLLPYEQALTREDSTSGLFYDCSAHMLWVGERTRQLDGAHVEFLRGVANPLGIKVSDKMNPSDLVKLIEILNPSCCPGRCSPCTRMGAENMRVKLPHLIRAVRNAGLIVTWITDPMHGNTIKAPCGLKTRPFDSILAEVRAFFDVHDQEGSHPGGIHLEMTGQNVTECIGGSRTVTFDDLSDRYHTHCDPRLNASQSLELAFIIAERLRKRRMRSGLNNSLPLPPLAF

SEQ ID NO: 46133 - protein, 176 aa, Sorghum bicolor
  Clone ID: SORBI-28MAY03-C1124_2.pep
MAANAGNKIRNAKLVLLGDVGAGKSSLVLRFVKGQFVEFQESTIGAAFFSQTLAVNDETVKFEIWDTAGQERYHSLAPMYYRGAAAAIVVYDITNPASFTRAKKWVQELQAQGNPNTIVALAGNKADMLDARQVPAEEAKTYAQENGLFFMETSAKSAINVNDIFYEIAKRLLSGQ

SEQ ID NO: 46134 - protein, 216 aa, Sorghum bicolor
  Clone ID: SORBI-28MAY03-C1124_1.pep
MIVTTSKPEPNESIRIIVQNEQEFAPPLFTVFIPARKPHSVYRSAPGQPVAAADLPQQPQLWQQWQSVNGETVKFEIWDTAGQERYHSLAPMYYRGAAAAIVVYDITNPASFTRAKKWVQELQAQGNPNTIVALAGNKADMLDARQVPAEEAKTYAQENGLFFMETSAKSAINVNDIFYEIAKRLLQGQQAPSPQAGMVLNQRPNERMVSSSSCCS

SEQ ID NO: 46135 - protein, 330 aa, Sorghum bicolor
  Clone ID: SORBI-28MAY03-C17676_1.pep
MASPRSCFRGLQKNTSHVALVLVSVLLLSSARLSVAGRSLLELYKPPASALLTYHNGAVLQGRIPVSILWYGRFTPAQKAVVTDFLQSLTTASPTTPSPSVSQWWNTINQLYLSKARTRGNGARSGGGSAQVALVGQTTDEGCSLGKRLTLAQLPRLAARAGTKKGGIALVLTAQDVAVDGFCMSRCGLHGSDARAGTAYIWVGNSATQCPGQCAWPFHQPLYGPQTPALVPPSGDVGVDGMVINIASMVAGTVTNPFRDGFYQGDKDAPLEAATACTGVYGSGAYPGFAGNLAVDRTSGASYNANGANGRKYLLPALFDPATSTCSTLV

SEQ ID NO: 46136 - protein, 373 aa, Sorghum bicolor
  unsure (1)..(373): unsure at all Xaa locations
  Clone ID: SORBI-28MAY03-C19699_1.pep
MGTTRRDLRRASATKPSYARRAATAAAAAQSLCLGADPAARRFAAEMPAFTGTDAALSVPSATCAPGLSVLAQWAVWCFAGLPRDSSIIHVFKLGLLSTACSGHASNVSDKAYLQNHVTTFVGSLRDPARCFMYPTTRLYLLXENTHANCGAMWSSGECXDLVLCLSVTCGFVLHIDGARMFNTSVPLGCPVHDPVXAADSVSICLSKGLGAPIGSVIVGSKAFIDKAXLLRXTLGGGMRQVGVLCAAAYVAVRDTVGKLADDHRKAKALAEGLKKIKQFTVDSSSVETNMVFFDIVDPRISPNKLCQVLEQRNVLAMPASSKSVRFVVHYQISDSDVQYALTCVEKAVEELLKGGTKLEHLTNGTVKNAYWH

SEQ ID NO: 46137 - protein, 196 aa, Sorghum bicolor
  Clone ID: SORBI-28MAY03-C1694_1.pep
MGLPVMRRERDAEAELNLPPGFRFHPTDDELVEHYLCRKAAGQRLPVPIIAEVDLYKFDPWDLPERALFGVREWYFFTPRDRKYPNGSRPNRAAGNGYWKATGADKPVAPRGRTLGIKKALVFYAGKAPRGVKTDWIMHEYRLADAGRAAASKKGSLRLDDWVLCRLYNKKNEWEKMQLGKESAAGVGTAKEEAMD

SEQ ID NO: 46138 - protein, 366 aa, Sorghum bicolor
  Clone ID: SORBI-28MAY03-C4967_1.pep
MAGPAPDRAALTVGPGMDMPIMHDSDRYELVRDIGSGNFGVARLMRDRRTSELVAVKYIERGEKIDENVQREIINHRSLKHPNIIRFKEVILTPTHLAIVMEYASGGELFERICKNVRFSEDEARYFFQQLISGVSYCHSMQVCHRDLKLENTLLDGSDAPRLKICDFGYSKSSVLHSQPKSTVGTPAYIAPEVLLKKEYDGKIADVWSCGVTLYVMVVGAYPFEDPEEPKNFRKTIQRILNVQYAIPDNVNISPECRHLISRIFVGDPAMRITIPEIRNHSWFLKNLPADLMDDDSMSNQYEEPDQPMQTMDQIMQILTEATIPPACSRSINVLADGLDMDDDMDDLDSDSDLDVDSSGEIVYAM

SEQ ID NO: 46139 - protein, 371 aa, Sorghum bicolor
  Clone ID: SORBI-28MAY03-C3688_1.pep
MALSDRSRESLLPSFLYSSSARSFAATGAAAARLPVSAPAPAAAGAGGRVPFSIQAPSEKIEMYSPAFYAACTAGGIASCGLTHMAVTPLDLVKCNMQIDPAKYKSISSGFGVLLKEQGARGFFRGWVPTLLGYSAQGACKFGFYEFFKKYYSDIAGPEYAQKYKTLIYLAGSASAEVIADVALCPFEAVKVRVQTQPGFARGLSDGLPKFVRSEGALGLYKGIVPLWGRQIPYTMMKFASFETIVELIYKHAVPVPKSECSKTTQLGISFAGGYIAGVFCAIVSHPADNLVSFLNNAKGATVGDAVKKLGLWGLFTRGLPLRIVMIGTLTGAQWGIYDAFKVMVGLPTTGGPAPAAVAAPAAEAESKASA

SEQ ID NO: 46140 - protein, 381 aa, Sorghum bicolor
  unsure (1)..(381): unsure at all Xaa locations
  Clone ID: SORBI-28MAY03-C7131_1.pep
MTQAPPRPPPPSSPIPPTPPAPPHPLPGRLPGRAGPPAPPRRPPRPARPPRRRQLRAAGGSGAVGESPSDGDLDRHIPQRRGCDYPPDAEVKALCEQAKAILMEEWNVQPVRCPVTVCGDIHGQFYDLIELFRIGGDAPYSESVVTGDNATTSLCSDDVDRGYYSVEMLYRDRITILRGNHESRQITQVYGFYDECLRKYGNANVWKYFTDLFDYXYFTDFIDYQVLTALIENSILCVHGGLSPSLDTLDNIRALDRIQEVPHEGPMCDLLWSDPDDRCGWGISPRGAGYTFGQDIAQQFNHTNGLSLISRAHQLVMEGFNWCQDKNVVTVFSAPNYCYRCGNMAAILEIGENMDQNFLQFDPAPRQIEPDMTRKTPDYFL

SEQ ID NO: 46141 - protein, 395 aa, Sorghum bicolor
  Clone ID: SORBI-28MAY03-C5752_1.pep
MAMSSADSWGSSPTSPIGFEGYEKRLEITFSDAPVFEDPCGLGLRALSREQIDSFLDLARCTIVSQLSNKNFDSYVLSESSLFVYPHKVVLKTCGTTKLLLSIPRILELAAGLSLPVLSAKYSRGTFIFPGAQPAPHRSFSEEVSVLNGFFGNLKSGGNAYVIGDTFKPNKKWHVYYATEEPEHPMVTLEMCMTGLDAKKAAVFFKNSDDGSCTSAKEMTKLSGISEIIPEMEICDFEFDPCGYSMNGVFGPAASTIHVTPEEGFSYASYEAMNFNPSSLVYSDVIKRVLAGFSPSEFSVAVTIFGGRGFAKSWAKGADVDSYMCDDLVEQELPGGGLLMYQSFTAVASGTVSPRSTLEMDGWSSDGMETATKSDDLCIGCWDVAKKVVKKDVDA

SEQ ID NO: 46142 - protein, 51 aa, Sorghum bicolor
  Clone ID: LIB3476-057-P1-K1-A2.pep
SHESTWLKEQAVTALQQAQGCEEWSTNVICASAAISTTMSWLGTGRWRDSL

SEQ ID NO: 46143 - protein, 560 aa, Sorghum bicolor
  Clone ID: SORBI-28MAY03-C7804_1.pep
MASMMQPQIILLKEGTDTSQGRAQVVSNINACTAVGDTVRTTLGPRGMDKLIHDDKGGVTISNDGATIMRLLDIVHPAAKILVDIAKSQDSEVGDGTTTVVLLAAEFLKEAKPYIEDGVHPHSLIRSYRTAGNMAIQRVKELAVSIEGKSLEEKKTLLAKCAATTLSSKLIGGEKEFFASMVVDAVLAIGNDDRLNLIGIKKVPGGTMRDSFLVNGVAFKKTFSYAGFEQQPKKFLNPKILLLNIELELKSEKENAEIRLSDPLQYQSIVDAEWNIIYDKLDKCVKSGAKIVLSRLAIGDLATQYFADRDIFCAGRVTEEDLQRVAAATGGTVQTSVNNVIDEVLGSCEVFEEKQVGNERFNIFSGCPSGQTATIVLRGGADQFIEEAERSLHDAIMIVRRALKNSTVVPGGGAIDMEISKYLRQHARTIAGKSQFFVNSFAKALEVIPRQLCDNAGFDATDVLNKLRQKHASGEGANYGVDINTGGIADSFANFVWEPAVVKINAINAATEASCLILSVDETVKNPKSESAQGEAAAGAMAGRGGGAMRGRGGRGMRRR

SEQ ID NO: 46144 - protein, 269 aa, Sorghum bicolor
  unsure (1)..(269): unsure at all Xaa locations
  Clone ID: SORBI-28MAY03-C6220_1.pep
MSGNDDKPHAAADRIKAATLSVAKGLSRAQAERAAAAAARNVNAYGQKEEGPSRWQERKEAKRQMYLMSTEKAAKLGTVKPKCFXTSSVGAYTQCQKCFQHGHWTYECKNERVYISRPSRTQQLKNPKLKKSVPVSYQFENPDIIKEREAEQKLMIAKQKKETAERKTGKRKRKRRPPTDSDRNSSGASVVDSAPESSVTGRADXAGSSSSYRSSDSEVKKRQHRRKQKKRRHRRDSTSSASSESESASDSDSDDKGSRRKSKKRGGRR

SEQ ID NO: 46145 - protein, 166 aa, Sorghum bicolor
  Clone ID: LIB3478-020-P1-K1-B6.pep
PDDIGLTRANEFGIVLGKLSGRHAVRSKLVELGYEIGDKEFEDFFKRYKEVAEKKKRVTDEDLEALLSDEIFQPKLIWSLADVQATCGTLSLSTATVKLIGPDGEERIACSVGTGPVDAAYKAVDQIIQIPTVLREYSMTSVTEGIDAIATTSSCGTGNVSINAKH

SEQ ID NO: 46146 - protein, 163 aa, Sorghum bicolor
  unsure (1)..(163): unsure at all Xaa locations
  Clone ID: LIB3476-017-P1-K1-F10.pep
EVVMAIKCRGELLDGLYTGINSQHITLTSKMVQEHSGLHVQPHKAIVGANAFAHESGIHQDGMLKYKGTYEIISPDDIGLTRANEFGIVLGKLSGRHAVRSKLVELGYEISDKEFEDFFKRYKEVAEKKMRVTDEDNRALLSDEIFQPXSNWSLADVQATCGT

SEQ ID NO: 46147 - protein, 58 aa, Sorghum bicolor
  Clone ID: LIB3478-050-P1-K1-B1.pep
AWWRSFCSRFLEGSALQLRTGLSWAYVVYNFCISYTILVASLYIIYKPYNLYLEVLAI

SEQ ID NO: 46148 - protein, 332 aa, Sorghum bicolor
  Clone ID: SORBI-28MAY03-C127_1.pep
MASDARLSLPCRLPSLLPPPVLLRRLPRAAAAAAASTSPRCRVASTAAAAPARARGRFRPRASEVEGQGPVQQQQQVEDEVVDSNVLQYCSIDRKKKKTIGEMEQEFLQALQAFYYDQKAIMSNEEFDNLKEELMWEGSSVVMLSADEQKLLEASMAYVSGNPIMTDQEFDELKLRLKKEGSDIVTEGPRCSLRSRKVYSDLTVDYFKMLLLYVPAAVVALTLFFFLDDLTGFEITLLLELPEPFSFIFTWFAALPLIFWVAQAFTNVIVKDFLILKGPCPNCGTENLSFFGTILSVSSGGSTNSVKCASCGTVLEYDSASRLITLPEPAEA

SEQ ID NO: 46149 - protein, 156 aa, Sorghum bicolor
  Clone ID: LIB3478-012-P1-K1-G3.pep
NLLSPARGRHRHRHPPPPPPPGSRPPSRPADPAERIRRHGLRREALLTVPPALAPPSAGAAAPAAPARARGRFRPRASEVEGQGPVQQQQQVEDEVVDSNVLQYCSIDRKKKKTIGEMEQEVLQALQAFYYDQKAIMFNEEFDNLKEELMWEGSKR

SEQ ID NO: 46150 - protein, 271 aa, Sorghum bicolor
  Clone ID: SORBI-28MAY03-C9432_1.pep
MAFRLSNNLIGILNFITFLLSIPILGAGIWLGQRADGTECERYLSAPVIAVGVFLLVVSLAGLVGACCRVTWLLWVYLLAMFVLILVLFCFTVFAFVVTNKGAGEAVSGRGYKEYRLGDYSNWLQKRVENTKNWDKIRSCLEDSKVCKKLQDKNETFTQFISSDLSPIESGCCKPPTICGYTYVSGTNWTTPANATADPDCQTWSNSALCYNCQSCKAGVVATVKRDWKRVAIVCIVFLVFIIIVYSVGCCAFRNNRRDNAYRGGWKGGYA

SEQ ID NO: 46151 - protein, 209 aa, Sorghum bicolor
  Clone ID: LIB5052-012-A1-XP1-A6.pep
MAFRLSNNLIGILNFITFLLSIPILGAGIWLGQRADGTECERYLSAPVIAVGVFLLVVSLAGLVGACCRVTWLLWVYLLAMFVLILVLFCFTVFAFVVTNKGAGEAVSGRGYKEYRLGDYSNWLQKRVENTKNWDKIRSCLEDSKVCKKLQDKNETFTQFISSDLSPIESGCCKPPTICGYTYVSGTNWTTPANATADPDCQTWSNSAL

SEQ ID NO: 46152 - protein, 232 aa, Sorghum bicolor
  Clone ID: SORBI-28MAY03-C485_2.pep
LANSKFFHLNIFASKNVLIDKVTVKAPGNSPNTDGIHMGDSENVTISGTTIGVGDDCISIGPGSKTIRIDGVKCGPGHGISVGSLGRYKDEKDVEDVKVKGCTLVGTTNGLRIKSYEDSKSSPKVTKFVYEDVTMDNVSYPIIIDQKYCPNNICVRSGASKVAVTDVVFKNIHGTSNTPEAITLNCADNLPCQGVQLHNVDIKYNKSNNKTMAVCKNAVGKSFGLSKELACI

SEQ ID NO: 46153 - protein, 157 aa, Sorghum bicolor
  Clone ID: SORBI-28MAY03-C485_1.pep
MKRNPRVTSSRRKCRKAHFTAPSSVRRVLMSAALSTELRHKYNVRSIPIRKDDEVQVVRGTYKGREGKVVQVYRRRWVIHVERITREKVNGSTVNVGIHPSKVIVTKLKLDKDRKALLDRKARGRNADKAKGKFTADDVAAAAGGAAATGASLQEID

SEQ ID NO: 46154 - protein, 89 aa, Sorghum bicolor
  unsure (1)..(89): unsure at all Xaa locations
  Clone ID: LIB5051-008-A1-XP1-B7.pep
RPGCEVHVRSIPIRKDDEVQVVRGTYKGREGKVVQVYRRRWVXKDRKALLDRKARGRNADKAKGKFTADDVAAAAGGAAATGASLQEID

SEQ ID NO: 46155 - protein, 113 aa, Sorghum bicolor
  unsure (1)..(113): unsure at all Xaa locations
  Clone ID: LIB3480-013-P1-K1-D3.pep
MVNVSTNHTKSKRAMNVNKHCGPNQIYNETTEHKRQARLMIDRAGCCWKYCPNNICVRSGAYNVAVTDVEFKNIHGTYNTPEAITLNXADNLPCQGVQLHNVDMEYNKSNNKT

SEQ ID NO: 46156 - protein, 278 aa, Sorghum bicolor
  Clone ID: SORBI-28MAY03-C15736_1.pep
MARLAILLVLLASSSALSAAQKAATTKAPATAKAAPGPAASSSGGGAADAAPPTDINKALKDEQFSEFKQLLHDTRVDTQINAQLTDSYNGLTIMAPTNTAFDKMKAGVLNGLSPQEQIQMVLYCVLPRFYSLSMLGTLDGKVNTQGSGHDGPYKYDIKRSGNNVNMSTGVNWMLLGSPVSKEFPLAIYPVDKVPLPYELFGPKPPTPAPAPAPAPAKSKTKKKKKSAGIAEPPTADDDTSTSDDQKAAAAPGVGAPTRWVTAALSVLGAAVLGGGLF

SEQ ID NO: 46157 - protein, 96 aa, Sorghum bicolor
  Clone ID: LIB3480-046-P1-K1-B4.pep
MPHLAATPPTSSAAAAVPTAHPTAAGRVAFRRPWDTPRLRVRARGVRREDGGGVRTEDQEQERTSSRTFYDLLGISAEGSPDEVRAAYRRWRGGGV

SEQ ID NO: 46158 - protein, 567 aa, Sorghum bicolor
  Clone ID: SORBI-28MAY03-C3045_1.pep
MASPALISDTEQWKALQAHVGAIQKTHLRDLMADADRCKAMTAEYEGIFLDYSRQQATGETIEKLLKLAEVAKLKEKIEKMFKGEKINSTENRSVLHVALRAPRDAVINSDGVNVVPEVWSVKDKIKEFSDTFRSGSWVGATGKPLTNVVSVGIGGSFLGPLFVHTALQTDPEAAECAKGRQLRFLANVDPVDVARSIKDLDPETTLVVVVSKTFTTAETMLNARTLKEWIVSSLGPQAVAKHMIAVSTNLKLVKEFGIDPNNAFAFWDWVGGRYSVCSAVGVLPLSLQYGFPIVQKFLEGASSIDNHFNSSSFEDAWAVLLGLLSVWNVSFLGYPARAILPYSQALEKLAPHIQQLSMESNGKGVSIDGIPLPFETGEIDFGEPGTNGQHSFYQLIHQGRVIPCDFIGVVKSQQPVYLKGETVSNHDELMSNFFAQPDALAYGKTPEQLHSEKVPENLIPHKTFKGNRPSLSLLLPTLSAYEVGQLLSIYEHRVAVQGFIWGINSFDQWGVELGKSLASQVRKQLHESRMEGKPVDGFNHSTSSLLARYLAVKPPTPYDTTVLPKV

SEQ ID NO: 46159 - protein, 89 aa, Sorghum bicolor
  Clone ID: SORBI-28MAY03-C1885_2.pep
MGKRKSAAKPPPKKRMDKLDTVFSCPFCNHGSSVECRIDMKNLIGEASCRICQENFSTTVNALTEPIDIYSEWIDESERVNTVEGDDDA

SEQ ID NO: 46160 - protein, 89 aa, Sorghum bicolor
  Clone ID: SORBI-28MAY03-C1885_1.pep
MGKRKSAAKPPPKKRMDKLDTVFSCPFCNHGSSVECRIDMKNLIGEASCRICQENFSTTVNALTEPIDIYSEWIDECERVNTVEGDDDA

SEQ ID NO: 46161 - protein, 80 aa, Sorghum bicolor
  Clone ID: LIB3480-038-P1-K1-H6.pep
RNSHASETNLIGEASCQFGTQHCSHDCRHDMKNLIGEASCRICQENFSTTVNALTEPIDIYSEWIDECERVNTGEGDEYA

SEQ ID NO: 46162 - protein, 346 aa, Sorghum bicolor
  Clone ID: SORBI-28MAY03-C622_1.pep
MATAAAATAASTSLLAPAASSTAPGASPNALFFPSSVPSLRAYPRLLLAFRRPAAAAAQGAVLEEEEVQADQRGQYDDDDDGYEGGRGPAFTAPTRPRTGKAALPLKRDRTRSKRFLEIQKLRESKKDYDVPTAISLMKQMSSAKFVESAEAHFRMNLDPKYNDQQLRATVNLPKGTGQSVKIAVLTQGEKIDEARAAGADIVGGEDLIEQIKGGFMEFDKLIASPDMMPKVAGLGKILGPRGLMPNPKAGTVSPNITQAIEEFKKGKVEYRVDKSGIVHIPFGKVDFPEEDLIANFMAVVRSVERNKPSGAKGIYWKTAYLCSSMGPSIKLNIKEMLDYGLDSSD

SEQ ID NO: 46163 - protein, 212 aa, Sorghum bicolor
  Clone ID: SORBI-28MAY03-C66_1.pep
MKVLLVALALLALAASAASTLTTGGCGCQTPHLPPPPVHLPPPVHLPPPVHLPPPVHVPPPPPQCHPHPTLPPHPHPCPTYPPHPSPCHPGHPGSCGVGGGPVTPPILGQCIEFLRHQCSPAATPYCSPQCQALRQQCCQQLRQVEPLHRYQAIFGVVLQSIQQQQPQGQSSPLPALMAAQIAQQLTAMCGLGVGQPSPCASCSPFAGGVHY

SEQ ID NO: 46164 - protein, 420 aa, Sorghum bicolor
  Clone ID: SORBI-28MAY03-C5091_1.pep
MFGRMPRKSSNNTKYYEVLGVSKTASQDELKKAYRKAAIKNHPDKGGDPEKFKELSQAYDVLSDPEKREIYDQYGEDALKEGMGGGGSSDFHSPFDIFEQLFPGSSGFGGGSRGRRQKRGEDVVHTMKVSLEDLYNGTTKKLSLSRSALCSKCKGKGSKSGASGTCHGCRGAGMRTITRQIGPGMIQQMNTVCPECKGSGEIISDKDKCPSCKGSKVVQEKKVLEVHVEKGMQHSQKIVFQGQADEAPDTVTGDIVFVLQLKDHPKFKRKYDDLYVEHTISLTEALCGFQFVLTHLDGRQLLIKSNPGEVIKPGQHKAINDEGMPQHGRPFMKGRLFVEFNVEFPEPGVLSTAQCRSLEKILPPKPGSQLSDMELDQCEETTLHDVNIEEEMRRRQQQRRQEAYDEDEEEAGPRVQCAQQ

SEQ ID NO: 46165 - protein, 960 aa, Sorghum bicolor
  Clone ID: SORBI-28MAY03-C86_1.pep
MPERHQSIDAQLRLLAPGKVSEDDKLVEYDALLVDRFLDILQDLHGPHLREFVQECYELSAEYENDRDEARLGELGSKLTSLPPGDSIVVASSFSHMLNLANLAEEVQVAQRRRIKLKRGDFADEASAPTESDIEETLKRLVSQLGKSREEVFDALKNQTVDLVFTAHPTQSVRRSLLQKHGRIRNCLRQLYAKDITADDKQELDEALQREIQAAFRTDEIRRTPPTPQDEMRAGMSYFHETIWKGVPKFLRRIDTALKNIGINERLPYNAPLIQFSSWMGGDRDGNPRVTPEVTRDVCLLARMMAANLYFSQIEDLMFELSMWRCSDELRIRADELHRSSKRAAKHYIEFWKQVPPNEPYRVILGDVRDKLYYTRERSRHLLSSGISEIPEEATFTNVEQFLEPLELCYRSLCACGDKPIADGSLLDFLRQVSTFGLALVKLDIRQESDRHTDVLDSITTHLGIGSYAEWSEEKRQDWLLSELRGKRPLFGSDLPQTEETADVLGTFHVLAELPADCFGAYIISMATAPSDVLAVELLQRECHVKQPLRVVPLFEKLADLEAAPAAVARLFSIDWYMNRINGKQEVMIGYSDSGKDAGRLSAAWQMYKAQEELIKVAKHYGVKLTMFHGRGGTVGRGGGPTHLAILSQPPDTIHGSLRVTVQGEVIEHSFGEELLCFRTLQRYTAATLEHGMHPPISPKPEWRALMDEMAVVATKEYRSIVFQEPRFVEYFRSATPETEYGRMNIGSRPSKRKPSGGIESLRAIPWIFAWTQTRFHLPVWLGFGAAIKHIMQKDIRNIHVLKEMYNEWPFFRVTLDLLEMVFAKGDPGIAAVYDKLLVAEDLQSFGEQLRKNYEETKELLLQVAGHKDVLEGDPYLKQRLRLRESYITTLNVCQAYTLKRIRDPSFQVSPQPPLSKEFTDESQPVELVQLNQQSEYAPGLEDTLILTMKGIAAGMQNTG

SEQ ID NO: 46166 - protein, 107 aa, Sorghum bicolor
  Clone ID: LIB3481-057-Q6-K1-D6.pep
PRVRKKLLLQVAGHKDVLEGDPYLKQRLRLRESYITTLNVCQAYTLKRIRDPSFQVSPQPPLSKEFTDESQPVELVQLNQQSEYAPGLEDTLILTMKGIAAGMQNTG

SEQ ID NO: 46167 - protein, 579 aa, Sorghum bicolor
  Clone ID: SORBI-28MAY03-C8371_1.pep
MAAATSSSTYLAIARKTLNPAPSVGTAAASVSFPATQPPCLLAASADRRRAVAAKVSSPSVIGTAMPSLDFETSVFKKEKVSLAGHEEYIVRGGRDLFPLLPEAFKGIKQIGVIGWGSQGPAQAQNLRDSLVEAKADVVVKIGLRKGSKSFEEARAAGFTEESGTLGDIWETVSSSDLVLLLISDSAQADNYEKIFSHMKPNSILGLSHGFLLGHLQSLGLDFPKNISVIAVCPKGMGPSVRRLYVQGKEINGAGINASFAVHQDVDGRATDVALGWSVALGSPFTFATTLEQEYRSDIFGERGILLGAVHGMVEALFRRYTEQGMDEDSAYKNTVESITGIISKTISKKGMLEVYNSLTEEGKKQFIEAYSAAYYPCMDILYECYEDVSSGSEIRSVVLAGRRFYEKEGLPAFPMGNIDQTRMWKVGERVRSTRPQGDLGPLHPFTAGVYVALMMAQIEVLRKKGHSYSEIINESLIESVDSLNPFMHARGVAFMVDNCSTTARLGSRKWAPRFDYILTQQAFVTVDKKAPINQDLISNFMSDPVHGAIEVCAQLRPTVDISVTADADFVRPELRQSS

SEQ ID NO: 46168 - protein, 149 aa, Sorghum bicolor
  Clone ID: SORBI-28MAY03-C751_1.pep
MADQLTDDQIAEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMIREADVDGDGQINYEEFVKVMMAK

SEQ ID NO: 46169 - protein, 531 aa, Sorghum bicolor
  Clone ID: SORBI-28MAY03-C94_1.pep
MATTATPQLLGGSVPQQWQTCLLVLLPVLLVSYYLLTSRSRNRSRSGKLGGAPRLPPGPAQLPILGNLHLLGPLPHKNLRELARRYGPVMQLRLGTVPTVVVSSAEAAREVLKVHDVDCCSRPASPGPKRLSYDLKNVGFAPYGEYWREMRKLFALELLSMRRVKAACYAREQEMDRLVADLDRAAASKASIVLNDHVFALTDGIIGTVAFGNIYASKQFAHKERFQHVLDDAMDMMASFSAEDFFPNAAGRLADRLSGFLARRERIFNELDVFFEKVIDQHMDPARPVPDNGGDLVDVLINLCKEHDGTLRFTRDHVKAIVLDTFIGAIDTSSVTILWAMSELMRKPQVLRKAQAEVRAAVGDDKPRVNSEDAAKIPYLKMVVKETLRLHPPATLLVPRETMRDTTICGYDVPANTRVFVNAWAIGRDPASWPAPDEFNPDRFVGSDVDYYGSHFELIPFGAGRRICPGLTMGETNVTFTLANLLYCYDWALPGAMKPEDVSMEETGALTFHRKTPLVVVPTKYKNRRAA

SEQ ID NO: 46170 - protein, 357 aa, Sorghum bicolor
  Clone ID: SORBI-28MAY03-C17434_1.pep
MTTKRCCLLVATLLAALLVSVTARLDVGFYNKTCPSAESIVQQTVAAAFGNSSGVAPALIRMHFHDCFVRGCDGSVLIDSTANNTAEKDSPANNPSLRFFDVVDRAKASLEAQCPGVVSCADILAFAARDSVVLTGGLGYQVPSGRRDGRVSNATQATNNLPPPFFNATQLVDRFASKNLTLEDMVVLSGAHTLGVSHCSSFAGPANLGDRLYNFSGSADGIDPALSKAYAFLLKSICPSNSSQFFPNTTTFMDIITPDKFDNKYYVGLTNNLGLFESDAALLTNATMKALVDSFVRNETTWKRKFAKSMVKMGKIEVLTGTQGEIRRNCRVINPASATDVLASQSGSSGFTGVAAS

SEQ ID NO: 46171 - protein, 145 aa, Sorghum bicolor
  Clone ID: SORBI-28MAY03-C5555_2.pep
MAASTARTVKDVNPHEFVKAYSAHLKRSGKMELPEWVDIVKTARFKELPPYDPDWYYTRAASIARKIYLRQGIGVGGFQKIYGGRQRNGSRPPHFCKSSGALSRNILQQLQKMGIIDVDPKGGRLITSQGRRDLDQVAGRVAVEA

SEQ ID NO: 46172 - protein, 145 aa, Sorghum bicolor
  Clone ID: SORBI-28MAY03-C5555_1.pep
MAASTARTVKDVNPHEFVKAYSAHLKRSGKMELPEWVDIVKTARFKELPPYDPDWYYTRAASIARKIYLRQGIGVGGFQKIYGGRQRNGSRPPHFCKSSGAISRNILQQLQKMGIIDVDPKGGRLITAQGRRDLDQVAGRVAVEA

SEQ ID NO: 46173 - protein, 530 aa, Sorghum bicolor
  Clone ID: SORBI-28MAY03-C1168_1.pep
MAFRRILSTAVRRRSAVAAAAAGNAREASTGVAAAPGVLAPDSTPVRAPVLPYDRIAEAVNARLRRLEHPDPRFLRYASPVPSHADHTAILAAPETRVTTLPNGLRLAAESSLAARTATVGVWIDAGSRYENEKAAGVAHFVEHMLFKGTGKRSAAQLEQEIEDMGGHLNAYTSREQTTYYAKVLDKDVPRAMEVLADILQNSNLDQARIEREREVILREMQEVEGQSEEVIFDHLHATAFQYTSLGRPILGSADNVKSITKEDLENYIATHYTAPRMVITAAGNVKHEDIVEQAKKLFNKLSTDPTTTNMLVAKEPASFTGSEVRIIDDDMPLAQFAVAFNGASWVDPDSVALMVMQSMLGSWNKSAGGGKHMGSELVQRAAINDIAESVMAFNTNYKHEGLFGVYAVAKADCLDDLAFAIMHEMSKLSYRVMEEDVIRARNQLKSSIQLHLDGSTAVVEDIGRQLLTYGRRIPTAELFARIDAVDASTVKRVANRFIFDQDVAIAAMGPIQGLPDYNWFRRRTYMLRY

SEQ ID NO: 46174 - protein, 290 aa, Sorghum bicolor
  Clone ID: SORBI-28MAY03-C5274_1.pep
MAAAAAQQKIRWGELEEDDGGDLDFLLPPRVVVGPDENGLKKVIEYRFDDDGNKVRVTTTTRVRKLARARLSRSAIERRQWPKFGDALKEDAGSRLTMVSTEEILLERPRAPGSKAEEPAASGDPLAMASKGGAVLMVCRTCGKKGDHWTSKCPYKDLAPPTETFTDRPPTSDGPPAPGGPVKGAYVPPTMRGGADRTGDVMRRRNDENSVRVTNLSEDTREPDLLELFRAFGPVSRVYVAVDQKTGSSRGFGFVNFVHREDAEKAISKLNGYGYDNLILRVEWATPRPN

SEQ ID NO: 46175 - protein, 99 aa, Sorghum bicolor
  unsure (1)..(99): unsure at all Xaa locations
  Clone ID: LIB3476-060-P1-K1-A5.pep
MAAAAAQQKIRAPGSKAEEPAASGDPLAMASKGGAVLMVCRTCGKKGDHWTSKCPYKDLAPPTETFTDRPPTSDGPPAPGGPVKGAYVPPXMRGGADRT

SEQ ID NO: 46176 - protein, 348 aa, Sorghum bicolor
  Clone ID: SORBI-28MAY03-C6616_1.pep
MPLEIQDSEVDIVIAALQPNLTTFFEAWRPFFSRFHIIVVKDPDMAEDLQIPTGFDLKVYTKSDINGVLGSSSINFSGHSCRYFGYLVSRKKYVISIDDNCLPAKDTAGLTVDAVAQHMANLKTPATPFFFNTLYDPYRKGADFVRGYPFSLREGVECMLSCGLWMHNADYDPMTHVVKRNQRNTTYVDAVMTVPLGAMLPVSGINVAFNRDVLGPAMFPGLRLRKEGKHRWDTLEDIWNGLCAKVVCDSLGYGVKTGLPYVMRSDAEAGKALESLKDWEGVKIMDDVLPFFQSLKLSRTAVTVDDCVKELAGIVREKLGPKNAIFTKAADAMVEWNNLWKAHGAQNA

SEQ ID NO: 46177 - protein, 90 aa, Sorghum bicolor
  Clone ID: LIB3480-013-P1-K1-C7.pep
LHPHQFCHLHLLQHRHLRKDWEGVKIMDDVLPFFQSLKLSRTAVTVDDCVKELAGIVREKLGPKNAIFTKAADAMVEWNNLWKAHGAQNA

SEQ ID NO: 46178 - protein, 409 aa, Sorghum bicolor
  Clone ID: SORBI-28MAY03-C7739_1.pep
MDASKLRELRDFVEACKKDPSLLADPSLAFFRDYLQSLGAKIPPAAAASFEKPKRSSMDDIDDDDDDDDLDMRDPTPEPDELDEEIVESDLELEGDIVQSDHDDPPQKMGDPSVEVTEENRDASQEAKGKAMEAMSEGKLEDAIEHLTNAIVLNPLSAIMYGTRASVFIKMKKPTAAIRDANAALEINPDSAKGYKTRGMAYAMLGKWEEAARDLHTASNMDYDEEISAVLKKVEPNAHKIVEHRRKYERLRKEREEKRAERDRLRRRAEAQAAYDKAKRKEQSSSRSSGGASPRGFPGGMPGGGFPGGMPGGGFPGGMSGGGFPGGMPGGGFPGSGMPGGFPGGGMPGNVDMSKILNDPDLMAAFSDPEVMAALQDVMNNPANFAKHQANPKVGPIITKMMAKFSGSQ

SEQ ID NO: 46179 - protein, 190 aa, Sorghum bicolor
  Clone ID: SORBI-28MAY03-C5451_1.pep
MKTILASETMDIPEGVTVTVAAKLVTVEGPRGKLTRNFKHLNLDFQLQEGGRKLKVDAWFGTRRTMAAIRTAISHVQNLIKGVTKGYRYKMRFVYAHFPINASITNSNTAIEIRNFLGEKKVRKVDMLDGVTILRSEKVKDELILDGNDIELVSRSAALINQKCHVKKKDIRKFLDGIYVSDKGVIEEEQ

SEQ ID NO: 46180 - protein, 50 aa, Sorghum bicolor
  Clone ID: LIB5050-005-R1-XP1-E10.pep
GSSFAHTSKPSSPPPPAALINQKCHVKKKDIRKFLDGIYVSDKGVIEEEQ

SEQ ID NO: 46181 - protein, 368 aa, Sorghum bicolor
  Clone ID: SORBI-28MAY03-C1111_1.pep
MATGEEHVAAAAAAVDETPEKKETSTTELLAPSGWTKKLVLTRVGRFEVLFVSPTGEEIKSKRQLTQYLKAHPGGPASSEFDWGTSDTPRRSARLSEKVKATWNPEGEKTPKRGRSSSKRGKKEEKEDVNEAGEDGASEEGKGTDVEMKDAENAEDEKKEAPSADAAEKTEEGEDKKEEAPAVDVAEKTEEGEDKKEEAPAVDAAEKTDDKEVAPVVDSAEKADDKEVAPAVDAAEKTEQSTESQAQPNNVAAPESEGKGDGKPAESESAPPAIVDEEKKEEKTENGQAAESVVPSLASSEGEKKENGGATEPAAPLVAETKTDAPPAEAEKGAENSGQVNTAPQEPTAANCDNKGQIQPGASAMRCT

SEQ ID NO: 46182 - protein, 150 aa, Sorghum bicolor
  Clone ID: SORBI-28MAY03-C867_1.pep
MSRRKTREPKEENVTLGPTVREGEYVFGVAHIFASFNDTFIHVTDLSGRETLVRITGGMKVKADRDESSPYAAMLASQDVAQRCKELGITALHIKLRATGGNKTKTPGPGAQSALRALARSGMKIGRIEDVTPVPTDSTRRKGGRRGRRL

SEQ ID NO: 46183 - protein, 238 aa, Sorghum bicolor
  unsure (1)..(238): unsure at all Xaa locations
  Clone ID: SORBI-28MAY03-C7996_2.pep
MGRRPARCYRQIKNKPYPKSRYCRGVPDPKIRIYDVGMKKKGVDEFPFCVHLVSWEKENVSSEALEAARIACNKYMTKSAGKDAFHLRVRVHPFHVLRINKMLSCAGADRLQTGMRGAFGKPQGTCARVDIGQVLLSVRCKESNANHAEEALRRAKFKFPGRQKIIRSRKWYVGMKILCCXTQCHVTALMKGLDDLFALSFXGFTKFTRAEYLKYKSEGRIAPDGVNAKLLGVHGPLS

SEQ ID NO: 46184 - protein, 220 aa, Sorghum bicolor
  Clone ID: SORBI-28MAY03-C7996_1.pep
MGRRPARCYRQIKNKPYPKSRYCRGVPDPKIRIYDVGMKKKGVDEFPYCVHLVSWEKENVSSEALEAARIACNKYMTKSAGKDAFHLRVRVHPFHVLRINKMLSCAGADRLQTGMRGAFGKPQGTCARVDIGQVLLSVRCKDNNAAHASEALRRAKFKFPGRQKIIESRKWGFTKFSRADYLKYKSEGRIVPDGVNAKLLGNHGRLEKRAPGQAFLEAVA

SEQ ID NO: 46185 - protein, 228 aa, Sorghum bicolor
  Clone ID: SORBI-28MAY03-C11868_1.pep
MAGNALANYVQVYAMLPLDIITVDNTFEKEDETRAQLKKLTEAGVDGVMIDVWWGLVEGKEPGVYDWSAYKQVFKLVQEAGLKLQAIMSCHQCGGNVGDVVNIPIPQWVRDVGEDNPDIFYTNREGVRNIEYLTLGVDDQPLFHGRTAIQLYADYMKSFRENMADFLDAGVIVDIEVGLGPAGEMRYPSYPQRCGWVYPGIGECICSEHQQEWRSRTQVVWIHLPPSI

SEQ ID NO: 46186 - protein, 304 aa, Sorghum bicolor
  Clone ID: SORBI-28MAY03-C1643_1.pep
MAGLSLQHPWAFAFGLLGNVISFMTFLAPIPTFYRIYKTKSTEGFQSVPYVVALFSAMLWIFYALIKSNETFLITINAAGCVIETIYIIMYFVYAPKKGKMFTAKIMLLLNVGIFGVILLLTLLLFKGDKRVVMLGWICVGFSVSVFVAPLSIMKRVIQTKSVEYMPFSLSLSLTLSAVVWFLYGLLIKDKYVALPNILGFTFGVVQMVLYVLYMNKTPVAVAEGKDAGGKLPSAADEHVLVNIAKLSPALPERSSGVHPVVAQMAAVPNRSCAAEAAAPPAMLPNRDVVDVFVSRHSPAVHVV

SEQ ID NO: 46187 - protein, 166 aa, Sorghum bicolor
  Clone ID: SORBI-28MAY03-C128_2.pep
GSCRSCPLAAVLDPSTTRRPRTTPPLPETPPPPRGGAGGGLLPPTGPPSVPPPPRSGAPRSGTSTRSTAPTRPSPPRAPPPGRRGSGRRRPGTSLGCCPARAAMNTGTLRARRPCQRSRRRRTCSDHGVGIVGSYQSSSTTTMTMKTRINQNYCGKHIYRLLSTYC

SEQ ID NO: 46188 - protein, 189 aa, Sorghum bicolor
  unsure (1)..(189): unsure at all Xaa locations
  Clone ID: SORBI-28MAY03-C128_1.pep
RRETHRKWSRRGNKIMDVLNLHPMLSLTIRLSIFFHRFRCVLNGFHDRHMDHTHAGSRGVVRGRRVVDGSSTAAKGHERQEPHQLPAHAPLYVPPGRPALRSPLSLASLSYPVSLVLGQFFFLRERESTPAAARPRRRLLTGRRNERMPTGNEWPRELSDEGERASRAGCWVYYYYMHACVCVXCLYSI

SEQ ID NO: 46189 - protein, 165 aa, Sorghum bicolor
  Clone ID: SORBI-28MAY03-C5762_1.pep
MDARMFGLETPLMVALQHLLDVPDGDAGAAGGDKAGAGAGGGATRTYVRDARAMAATPADVKELPGAYAFVVDMPGLGTGDIKVQVEDDRVLVISGERRREEREDAKYLRMERRMGKFMRKFVLPDNADMDKISAVCRDGVLTVTVDKLPPPEPKKPKTIEVKVA

SEQ ID NO: 46190 - protein, 107 aa, Sorghum bicolor
  Clone ID: LIB5050-006-R1-XP1-H12.pep
ADVKELPGAYAFVVDMPGLGTGDIKVQVEDDRVLVISGERRREEREDAKYLRMERRMGKFMRKFVLPDNADMDKISAVCRDGVLTVTVEKLPPPEPKKPKTIEVKVA

SEQ ID NO: 46191 - protein, 142 aa, Sorghum bicolor
  Clone ID: SORBI-28MAY03-C139_3.pep
MGKTRGMGAGRKLKTHRRNQRWADKAYKKSHLGNEWKKPFAGSSHAKGIVLEKIGIEAKQPNSAIRKCARVQLVKNGKKIAAFVPNDGCLNYIEENDEVLIAGFGRKGHAVGDIPGVRFKVVKVSGVSLLALFKEKKEKPRS

SEQ ID NO: 46192 - protein, 142 aa, Sorghum bicolor; identical to SEQ ID NO: 46191
  Clone ID: SORBI-28MAY03-C139_2.pep

SEQ ID NO: 46193 - protein, 142 aa, Sorghum bicolor; identical to SEQ ID NO: 46191
  Clone ID: SORBI-28MAY03-C139_1.pep

SEQ ID NO: 46194 - protein, 95 aa, Sorghum bicolor
  unsure (1)..(95): unsure at all Xaa locations
  Clone ID: LIB3481-049-Q6-K1-C9.pep
RSVLXXNGIEAEQPNSAIRKCARVQLVKNGKKIAAFVPNDGCXNYIEENDEVLIAGFGRKGHAVGDIPGVRFKVVKVSGVSLLALFKEKKEKPRS

SEQ ID NO: 46195 - protein, 152 aa, Sorghum bicolor
  Clone ID: SORBI-28MAY03-C2913_1.pep
MVKAVAVLGSSEGVKGTIFFTQEGDGPTTVTGSVSGLKPGLHGFHVHALGDTTNGCMSTGPHYNPASKEHGAPEDENRHAGDLGNVTAGADGVANISVTDSQIPLTGPNSIIGRAVVVHADPDDLGKGGHELSKSTGNAGGRVACGIIGLQG

SEQ ID NO: 46196 - protein, 109 aa, Sorghum bicolor
  unsure (1)..(109): unsure at all Xaa locations
  Clone ID: LIB3481-015-P1-K1-F5.pep
MVKAVAVLGSSEGVKGTIFFTQEGDGPTTVTGSVSGLKPGLHGFHVHALGDTTNGCMSTGPHYNPASKEHGAPEDENRHAGIXNVTAGANWVANISVTDRQIPLTGPNS

SEQ ID NO: 46197 - protein, 238 aa, Sorghum bicolor
  unsure (1)..(238): unsure at all Xaa locations
  Clone ID: SORBI-28MAY03-C3542_1.pep
LTPTSLREGVGGGHLAKVAEVARKLGILVIADEVYGKXLARGDTPFVPMGVFGHIAPVLSIGSLSKRWIVPGWRLGWVAVCDPNKILLNTKIIASITNFLNISTDPATFIQGALPHILENTKEDFFKRIIGLLAETSEICYREIKDIKCITCPHKPEGSMFVMVKLNLYLLEGIHDDIDFCCKLAKEESVILCPGSVLGMENWIRITFAIDSSSLLDGLERIKSFCQRHKKKNLLNGH

SEQ ID NO: 46198 - protein, 54 aa, Sorghum bicolor
  Clone ID: LIB3481-036-P1-K1-B9.pep
KDLILSRPSRREDESMAKVIRIQFSIPNTLPALDKHMYVRLRRCWYQFKMRHLY

SEQ ID NO: 46199 - protein, 366 aa, Sorghum bicolor
  Clone ID: SORBI-28MAY03-C4060_1.pep
MARCRRHLLLLALFLALAAAAPGQAQSHGEASAVFIDAASHRYLRDQQADGQDASMSLNEVSAAVSVLLGFAAPTSLPAISSSKLNKVLLPNPFDRPRAVFLMQIAGTDASAPSFVSEGSNIFKTRIEGANSADTGLSDTDDLIVIHSDESLDLSRSDYLDNELSSLANWLEGSYQKSSSKLVIPLESGNSLTLLLDKEADMEFVSSLASLLKTIERAIQVHEDFSGVMNPAELLECHFTGIKALENEYGSTEIVKQATEVVQRAVTKSFQSLHEAYKGKIVGLVISTKEASSSLGSIIDAPSSLHISRRLEEASKTKEASVALVRKSLAWITGIILLVSTLIGVCLLMNMPLTRDTLLYSNVKID

SEQ ID NO: 46200 - protein, 68 aa, Sorghum bicolor
  Clone ID: LIB3481-033-P1-K1-G5.pep
LPFFRPPFFFFFFFFFFFFFFFSIYTIIQVENSITIVTDLFGKGSSILQQLIVCSLARLSCIHHCTST

SEQ ID NO: 46201 - protein, 310 aa, Sorghum bicolor
  Clone ID: SORBI-28MAY03-C5545_1.pep
MDVVKAAQLSGRTLERVVVHPLVLLSIVDHYNRVARDTRKRVVGVLLGTSSRGSVDVTNSYAVPFEEDDKDPRIWFLDHNYHESMFSMFKRINAKEHVVGWYSTGPKLRENDLDVHALFNSYVPNPVLVIIDVQPKELGIPTKAYYAVEEVKENATQKSQKVFVHVPSEIAAHEVEEIGVEHLLRDVKDTTISTLATEVTSKLAALKGLDARLREIRSYLDLVIDGKLPLNHEILYHLQDVFNLLPNLNVNELIKAFAVKTNDMMLVIYLSSLIRSVIALHNLINNKMLNKEHEKAEDSKPTAIPTAAGS

SEQ ID NO: 46202 - protein, 369 aa, Sorghum bicolor
  Clone ID: SORBI-28MAY03-C6105_1.pep
MVSGRPGNGELDAWFKSLMVTSSSERGQAGSGGPAPTLSGWKDLPMELLVRIISTVGDDRIVIVASGVCTGWRDALGWGVTNLSLTWCKQSMNNLMISLAHKFTKLQVLTLRQNKPQLEDSAVESVANYCHDLRELDLSRSFRLSDRSLYALAHGCPRLTRLNISGCSNFSDTALIYLTCHCKHLKCLNLCGCGKAATDRALQAIAQNCGQLQSLNLGWCDDVTDKGVTSLASGCPDLRAVDLCGCVLITDESVVALANGCPHLRSLGLYFCQNITDRAMYSLANSRVKSKCGRWDAVKDGLANLNISQCTALTPPAVQAVCDSFPALHTCPERHSLIISGCLSLTSVHCACALHPHRAARALMANHAY

SEQ ID NO: 46203 - protein, 402 aa, Sorghum bicolor
  Clone ID: SORBI-28MAY03-C6361_1.pep
MAKPLNGISRSSMPRSNEGMRLIFSAVVGVMLGYLFGISFPTVNITKLHFPSSIISYIEDRNSGITTQTLLNHAWASANNRKKNSSESNTDEIPKIYVPTNPKGAERLPPGIVVSETDLYPRRLWGDPSEDLTSEPRYLVTFTVGIGQKSNIDAAVKKFSDKFTIMLFHYDGRTTEWDEFEWSKRAIHVSVRKQTKWWYAKRFLHPDIVARYEYIFIWDEDLGVEHFNAEKYIELVRKHGLEISQPGLQPDKGLTWQMTKRRGDQEVHKVTEERPGWCTDPHLPPCAAFVEIMATVFSRNAWRCVWHMIQNDLVHGWGLDFALRKCVEPAHEKIGVVDAQWIVHQAVPSLGNQGKSDNGRAPWEGVRARCRKEWGIFQTRLADAEKAYYLERGITPPNSTVV

SEQ ID NO: 46204 - protein, 218 aa, Sorghum bicolor
  Clone ID: SORBI-28MAY03-C572_1.pep
MAQAMASMTGLSQGVLPSRRAANRARAAAVVVRASAEGEAAAAQPGRRAVLGLVATGVVGGALSQAVHAATVNSIKIGAPPPPSGGLPGTENSDQARDFGLPLKDRFYLQPLPPAEAAARVKTSAQDIINLKPLIDKKAWPYVQNDLRLRASYLRYDLKTVIASKPKEEKKSLKELTGKLFSTIDDLDHAAKIKSTPEAEKYFAATKDVLGDVLAKIG

SEQ ID NO: 46205 - protein, 214 aa, Sorghum bicolor
  Clone ID: SORBI-28MAY03-C726_1.pep
MAAVEVCVKAAAGKPDTLGDCPFSQRVLLTLEEKKVPYEVKLVDLGNKPEWFLEINPEGKVPVLKGDDGKCIADSDVITQVIEEKFPTPSLVTPPEYASVGSKIFPAFVKFLKSKDASDGSEKALLDELQALDEHLKAHGPYINGDNVSAADLSLAPKLFHLQVALEHFKGWKIPENLTNVHAYTKALFSRESFVKTKPSEEHVIAGWAPKVNA

SEQ ID NO: 46206 - protein, 161 aa, Sorghum bicolor
  Clone ID: SORBI-28MAY03-C2012_2.pep
MVLKTELCRFSGQKIYPGKGIRFIRADSQVFLFANSKCKRYFHNRLKPAKLTWTAMYRKQHKKDIHAEAVKKRRRTTKKPYSRSIVGASLEVIQKKRAEKPEVRDAAREAALREIKERIKKTKDEKKAKKAEVTKSQKGQTKGAVQKGSKGPKLGGGGGKR

SEQ ID NO: 46207 - protein, 161 aa, Sorghum bicolor
  Clone ID: SORBI-28MAY03-C2012_1.pep
MVLKTELCRFSGQKIYPGKGIRFIRADSQVFLFANSKCKRYFHNRLKPAKLTWTAMYRKQHKKDIHAEAVKKRRRTTKKPYSRSIVGASLEVIQKKRAEKPEVRDAAREAALREIKERIKKTKDEKKAKKAEVTKSQKSQSKGAVQKGSKGPKLGGGGGKR

SEQ ID NO: 46208 - protein, 144 aa, Sorghum bicolor
  unsure (1)..(144): unsure at all Xaa locations
  Clone ID: SORBI-28MAY03-C2349_2.pep
MATISAATLVGAAAVARPSQAQGLPQLRVRGEKQVHRCGAADSRRPSQRDVDGGNSVNGKAAPASSSPAGGAASSLLAAASAMTTSSPALALVDERMSTEGTGLSLGLSNNLLGWILLGVFGLIWSLYTVYTXLDEDEDSGLSL

SEQ ID NO: 46209 - protein, 126 aa, Sorghum bicolor
  Clone ID: SORBI-28MAY03-C2349_1.pep
MATVSAAAATTVVARAAIARPNALGLPQLRARSERVRCSYAKDAAAVSAKAAGASLLAAAGAVTASAGPALALVDERMSTEGTGLSLGLSNNLLGWILLGVFGLIWSLYTVYTSDLDEDEESGLSL

SEQ ID NO: 46210 - protein, 692 aa, Sorghum bicolor
  unsure (1)..(692): unsure at all Xaa locations
  Clone ID: SORBI-28MAY03-C40827_1.pep
MAAGRHGGYRDCEARERELDAEASRRSKEQHHHLGGRHRDVDRRRDGGRSRSGAQVPXGPRPRRSPPPRSRLAGRLGDREPGEVLSGSASDDSGGRPHRGRENGVPGSIREGDVAVGSGISSPSKKRKFSPIIWDRDSPKPPHSDATRDKNVVDPGPSVLPPPPPRPQLVLGPPGGPGGWSPSAAEPTVGTESALQLPEHEVNKVTELEEEYPTMRNISTSRWAGANDDEEDGAAPMKKKSVSPADPSVAGQWKRTSPEPGEVSGGRTMSRSSDSGKMGNDEKEDYEVDKDDYMNVDREHASDSDTENHMSDTDSDNEIRRPETPEPEKPPHRCINMLQGCRSVDEFERLNKINEGTYGVVYRARDKKTSEIVALKKVKMEKEREGFPLTSLREINILLSFHHPSIVDVKEVVVGSSLDSIFMVMEYMEHDVKGVMETMKQPYTQSEVKCLMLQLLEGVKYLHDNWVLHRDLKTSNLLLNNRGELKICDFGLSRQYGSPLKPYTQLVVTLWYRAPELLLGTKEYSTAIDMWSVGCIMAELLAKEPLFNGKTEFEQLDKIFRTLGTPNEKIWPGYAKLPGVKVNFVKQPYNRLRDKFPAASFSGRPILSEAGFDLLNRLLTYDPDKRISADDALKHKWFSEVPLPKSKDFMPTFPALNELDRRTKRYLKSPDPLEEQRLKELQGNIGNRGLFG

SEQ ID NO: 46211 - protein, 169 aa, Sorghum bicolor
  Clone ID: SORBI-28MAY03-C1174_1.pep
MASTTSQASLLLQKQLKDLAKNPVDGFSAGLVDDSNVFEWQVTIIGPPDTLYDGGYFNAIMTFPQNYPNSPPSVRFTSEMWHPNVYPDGRVCISILHPPGEDPNGYELASERWTPVHTVESIVLSIISMLSSPNDESPANIEAAKDWREKRDEFKKKVRQCVRRSQEML

SEQ ID NO: 46212 - protein, 619 aa, Sorghum bicolor
  Clone ID: SORBI-28MAY03-C109_1.pep
MMRHSEIMKLLAFVLLMLGCQQSSLCLAVDSQVEALVEMKMQLVDNRGVLSDWKDNQMSPCYWEYVNCQDNKVSTITLSSSGLTGTLSPSIAKLTTLQQLKLDNNNITGGIPPEFGNLSSLTILNLGRNNLNGSIPDSLGQLSKLQILDLSHNHLSGNIPSSFSNPPSLNDINLAYNNISGEIPQHLLQAAHYNFTGNHLNCGQNLFPCEGGSTMTGGSKNSKLKVVIGSIAGAVTLCVTVALVLLWWQRMRYRPEIFIDVSGQNDHMLEFGQIKRFSWRELQIATNYFSEQNVLGKGGFGKVYKGVLPGPDSIKIAVKRLFNVERHEGELAFLREVELISIAVHKNILRLIGFCTTPTERLLVYPFMENLSVASRLRDIKLNEPVLDWSTRMRIALGAARGLEYLHEHCNPKIIHRDVKAANVLLDGNFEAVVGDFGLAKMMDIGRNTVTTGVRGTMGHIAPEYIKTGRPSVKTDIYGYGVMLLEIVTGERAIAFHPDRMEEAGEIMLIDQVKLWMEEGRLLDLVDRNLGGVYNLEELEKVTQIALLCTHMEPSQRPTMSEVVQMLEGEIVPAERWEEWQLAELQRRQQHEMRQQGKLFNFSEESLNIQEAIELSTGR

SEQ ID NO: 46213 - protein, 67 aa, Sorghum bicolor
  Clone ID: LIB3480-025-P1-K1-A1.pep
TKSEYIQQCICSLGPRNKTVLSAVEALVEMKMQLVDNRGVLSDWKDNQMSPCYWEYVNCQDNKVSTM

SEQ ID NO: 46214 - protein, 579 aa, Sorghum bicolor
  unsure (1)..(579): unsure at all Xaa locations
  Clone ID: SORBI-28MAY03-C87_1.pep
PQGSAPSNSPLSAAAPLESGMRHSDPPQLASLPATASAHPLLPHQYLHRHLRRRYPGSLFDSRSHDQPRRRPDQQQHKQRLNEATDIVTKFETTSAGPAHCRPDAQAGGAKRVRVANDAGIDSSEEAVEDAVEGEAALEKGGYMEDVEDKPVVMESDDPEAHRAPTYGSESVPAVQDLVATDDQPVTNPAIWLMVVSFFFARGFHRARLCECAATSYLVGMCDKPAGPSAVLEVGGDGAAPGVXSVTSGAPSSRFLPRRXFTPSAGREGEDICSRKLGPYLEMLQFQAASSSIGSGLNGGKQNLWCLKLAEKFGVIIANPWVTWFKAASLPAIVSLLATPYLLYKIFPPEIKDTPEAPALAAEKQKQMGPVTKNEWAMIGTMILAVALWIFGDAIGVSSVVAAMLGLSILLLLGVLDWADILNEKSAWDTLAWFSVLVGMAAQLTSLGIVSWMSSCIANLLQSFSLSWPAAFCVLQASYLVIHYLFASQTGHVGALYSAFLAMHVAAGVPSVLSALALAFNTDLFGGITHYSSGQAAVYFGAGYLDLPDVFRIGFISTLINTLIWGGIGTFWWKFLGLY

SEQ ID NO: 46215 - protein, 126 aa, Sorghum bicolor
  Clone ID: LIB3478-047-P1-K1-C9.pep
EFRADAWAKNEWVMIGTMILAVSLWVFGDAIGVPSVVAAMLGLSILLLLGVLDWDDCLNEKSAWDTLAWFAVLVGMAAQLTNLGIASWMSSCAAKLLQSFSMSWPVAFCILEGSYFLIHYLLASPT

SEQ ID NO: 46216 - protein, 149 aa, Sorghum bicolor
  Clone ID: LIB3478-009-P1-K1-F5.pep
FARGFVKTGLGDRIATYFVKWLGSSTLGLSYGLTISEACIAPAMPSTTARAGGVFLPIIKSLSLSAESKPNHPSSRKLGSYLVMTQFQASGNSSALFLTAAAQNLLCLKLAEELGVFIANPWVSWFKAASLPALAALLATPYLLYKIFP

SEQ ID NO: 46217 - protein, 234 aa, Sorghum bicolor
  Clone ID: SORBI-28MAY03-C160_1.pep
MPAGPGTPPASRSHCKPLRRRRLTGKAEMVSGSGVCAKRIVVDARHHMLGRLSSIIAKELLNGQKVVVVRCEEICMSGGLVRQKMKYLRFLRKRMNTKPSHGPIHFRAPSKILWRTIRGMIPHKTKRGEAALARLKTYEGVPPPYDKTKRVVIPDALKVLRLQPGHKYCLLGELSKEVGWNYHDTIRELEEKRKEKAKVAYERRKQLAKLRVKAEKTAEEKLGSQLEILAPIKY

SEQ ID NO: 46218 - protein, 129 aa, Sorghum bicolor
  Clone ID: SORBI-28MAY03-C142_1.pep
MASTVASLSIPATTFAAAAAGDVLPRRKAAATGRVWFPVARRGGGFAVRSTGPATPSNISDKLSESIKEAEETCADEKGTAECAAAWDNVEEISAAASHARDNLKENSDPLEKYCKENPETDECRIYDN

SEQ ID NO: 46219 - protein, 293 aa, Sorghum bicolor
  Clone ID: SORBI-28MAY03-C1384_2.pep
IPVDHAYATASEKESDISKLERQITLSEIKYMEEIKTMQVETTEKNEALTAKLQEHADLQHEKDELERQLLEVRKELDGAYHTIANQEEQASVREIKWDAFRKYSEDRLEAEQQRAEELELQVEALKQQLQEAEIRYKQKEEQVSLREVQWEADQNHSLEAQRHYATDLEKQIEDLTQKLQSADAHYKQKVTEVNKSVELEKKVQDLEQKLQLAYSKSEEQVTDAVESRSREVSLDSSTSSVKQQDRTLAADKASPSPTLQEVQEPSGIMAFKFILGVALLSILIGVFLGKRY

SEQ ID NO: 46220 - protein, 260 aa, Sorghum bicolor
  Clone ID: SORBI-28MAY03-C1384_1.pep
MAVGKNKRISKGKKGGKKKTVDPFSKKDWYDIKAPSVFSVRNIGKTLVSRTQGTRIASEGLKHRVFEVCLADLQGDEDQAYRKIRLRAEDVQGRNVLTNFWGMSFTTDKLRSLVKKWQTLIEAHVDVKTTDNYMLRLFCIGFTKRRPNQVKRTCYAQASQIRQIRRKMVEIMANQASTCDLKELVSKFIPEVIGKEIEKSTSSIFPLQNVFIRKVKILKAPKFDLGKLMEVHGDYKEDVGVKLERPVEGDEAGQEVAAAE

SEQ ID NO: 46221 - protein, 90 aa, Sorghum bicolor
  Clone ID: SORBI-28MAY03-C1991_2.pep
SLSAILTQVSDEGGGIPRSGLPRIFTYLYSTAKNPPELDRPNVGVTMAGYGFGLPISRLYARYFGGDLQIISMEGYGMVMFHLIVDSQSI

SEQ ID NO: 46222 - protein, 363 aa, Sorghum bicolor
  Clone ID: SORBI-28MAY03-C1991_1.pep
MASEPVARAVAEEVGRWGSMKQTGVTLRYMMEFGSRPTPRNLLLSAQFLHKELPIRFARRALELESLPFGLSNKPAILKVRDWYLDSFRDIRYFPEVRSRNDELAFTQMINMVKMRHNNVVPTMALGVQQLKKELGHARKVPFEFDDQIHEFLDRFYMSRIGIRMLIGQHVALHDPQPSGVIGLINTRLSPIQVAQAACEDARAICLREYGSAPDINIYGDPNFTFPYVTHHLHLMLFELVKNSLRAVQERDMNSDEDVPPVRIIVADGEEDVTIKVSDEGGGIPRSGLPRIFTYLYSTAKNPPELDRPNVGVTMAGYGFGLPISRLYARYFGGDLQIISMEGYGTDAYLHLSRLGDSEEPLP

SEQ ID NO: 46223 - protein, 101 aa, Sorghum bicolor
  Clone ID: SORBI-28MAY03-C2803_3.pep
PAAGALIQVYSSRRRRRSSLRVTESSSAPVHARSESMDTQVKLAVVVKVMGRTGSRGQVTQARVKFLDDQNRLIMRNVKGPVREGDILTLLESEREARRLR

SEQ ID NO: 46224 - protein, 103 aa, Sorghum bicolor
  Clone ID: SORBI-28MAY03-C2803_2.pep
PAAGRSGSALLAPPPPQFPSCARALVGLRPRLRSRSESMDTQVKLAVVVKVMGRTGSRGQVTQVRVKFLDDQNRLIMRNVKGPVREGDILTLLESEREARRLR

SEQ ID NO: 46225 - protein, 105 aa, Sorghum bicolor
  Clone ID: SORBI-28MAY03-C2803_1.pep
RERTPAGRFLIQVYSSRRRRRSSLRVTESSSAPVHARSESMDTQVKLAVVVKVMGRTGSRGQVTQVRVKFLDDQNRLIMRNVKGPVREGDILTLLESEREARRLR

SEQ ID NO: 46226 - protein, 437 aa, Sorghum bicolor
  Clone ID: SORBI-28MAY03-C3322_1.pep
MSDSHETDRNIEIWKIKKLIKALESARGNGTSMISLIMPPRDQVARVAKMLGDEYGTASNIKSRVNRQSVLAAITSAQQRLKLYNKVPPNGLVLYTGTIVTEDGKEKKVTIDFEPFKPINVSLYLCDNKFHTEALNELLESDDKFGFIVMDGNGTLFGTLSGNTREVLHKFTVDLPKKHGRGGQSALRFARLRMEKRHNYVRKTAELATQFFINPATSQPNVAGLILAGSADFKTELSQSDMFDQRLQAKILNVVDVSYGGENGFNQAIELSAEILANVKFIQEKKLIGKYFEEISQDTGKYVFGVDDTLKALEMGAVETLIVWENLDVNRYTLKNSSTGEITIKHLNKEQEADQSNFRDPTTNTDLEVQEKMSLLEWFANEYKKFGCSLEFVTNKSQEGSQFCRGFGGIGGMLRYQLDIRSFDELSDDDDVYEDSD

SEQ ID NO: 46227 - protein, 198 aa, Sorghum bicolor
  Clone ID: SORBI-28MAY03-C2865_1.pep
MAATVMASMTSLAFATATAGARRAGAFPASSAALAPRRRVMVVRAQSEDVEPTETTAATTSSSPSPAAAATTPTPKAKKAASRAGLWDALAFSGPAPERINGRLAMVGFVSALAVEASRGGGLLSQAGSGSGLTWFAATAAVLSVASLVPLLKGDSAEARSGAVMSADAELWNGRFAMLGLVALAFTEYLTGAPFINA

SEQ ID NO: 46228 - protein, 168 aa, Sorghum bicolor
  Clone ID: SORBI-28MAY03-C486_1.pep
MEPSNKLVAVLLVSLAMAAATVVQPSYAQNSPQNYLTPHNNARAAVGVGPVTWSTKLQQFAESYAAKRAGDCRLQHSGGPYGENIFWGSAGADWKAADAVRSWVDEKQWYSYATNSCAAGKVCGHYTQVVWRASTSIGCARVVCRDNRGVFIICNYEPRGNIVGHKPY

SEQ ID NO: 46229 - protein, 564 aa, Sorghum bicolor
  Clone ID: SORBI-28MAY03-C247_1.pep
MASTSSCETSASHAFAYPPRSSSALSSMIYMMASRGSATAPAAAAAVGAAAKPRGSSSAPCARVAAGGRRRSGVVVRCDAGVEAHVQAVAKAASIAALEQFKISADRYMKERSSIAVIGLSVHTAPVEMREKLAVAEELWPRAIQELTSLNHIEEAAVLSTCNRMEIYVVALSWNRGIREVVDWMSKKSGIPASELREHLFMLRGSDATRHLFEVSAGLDSLVLGEGQILAQVKQVVRSGQNSGGLGKNIDRMFKDAITAGKRVRCETNISSGAVSVSSAAVELALMKLPKSESLSARMLLIGAGKMGKLVIKHLIAKGCKKVVVVNRSVERVDAIRGEMKDIEIVYRPLSEMYEAAAEADVVFTSTASETPLFTKEHAEALPLVSDTMGGARLFVDISVPRNVSACVSEVGAARVYNVDDLKEVVEANKEDRLRKAMEAQTIITEELKRFEAWRDSLETVPTIKKLRSYADRIRASELEKCLQKVGEDALTKKMRRAIEELSTGIVNKLLHGPLQHLRCDGSDSRTLDETLENMHALNRMFSLDTEKAIIEQKIKAKVEKTQN

SEQ ID NO: 46230 - protein, 105 aa, Sorghum bicolor
  Clone ID: LIB3481-051-Q6-K1-A5.pep
MMASTTSATTAAAAATTKSRGSSSALCPRVAAGGRRRSGVVRCDATGVESQAQAVAKAASVAALEQFKISADRESLALASGNPPPLLPCLPVSCNPGMRGLWPFW

SEQ ID NO: 46231 - protein, 118 aa, Sorghum bicolor
  unsure (1)..(118): unsure at all Xaa locations
  Clone ID: LIB3478-058-Q6-K1-C12.pep
MMASTTSATTAAVAATTKSRGSSSALCSRVAACGRRRSWVVRCDSTGVESQAQAVANAVSVAALXQFKISTDRYMKERSTIAVIGLSVHTAPVEMRXKLAVADELXPRAIQELTSLNH

SEQ ID NO: 46232 - protein, 408 aa, Sorghum bicolor
  Clone ID: SORBI-28MAY03-C9002_1.pep
VSQGFLFLLACERRPRLRCFLLHLIMLAVSQEHLAHSQTCFRARMQLKPPTRPKLYSGLMPQEEFDSYCDLIPGLPEDLAKICLALVPRTHFPVMGAVSKRWMSFLESKELIAVRKEVGKLEEWVYVLTPDAGAKGSHWEILECSGQKQSPLPRMPGLTKAGFGVVVIGGKLFIIAGYSADHGKDCVSDEVYQYDSCLNRWTVLAKMNVARCDFACAEVNGVIYVAGGFGPNGESLSSVEVYDLEQNKWTLIEGLRRPRWGCFGCSFEGKLYVMGGRSSFTIGNSRFVDVYNPNNHAWDQVKNGCVMVTAHAVLGEKLFCIEWKNQRSLAIFNPADNSWQKVPVPLTGSSSTRFSFGVHEDKLLLFPLEEEPGYQTLMYDPAAPMGSEWCTSKLKPSGSCLCSVTIKA

SEQ ID NO: 46233 - protein, 439 aa, Sorghum bicolor
  Clone ID: SORBI-28MAY03-C799_1.pep
MRSAVVAALLLVAAVASPAAALYSAGSPVLQLNPNNFKSKVLNSNGVVLVEFFAPWCGHCKQLAPAWEKAAGVLKGVATVAALDADAHQALAQEYGIRGFPTIKVFSPGKPPVDYQGARDVKPIVEFALSQVKSLLRERLSGKASAGSNGKTSGGSSEKSEPSASVELNSRNFDELVVKSKDLWIVEFFAPWCGHCKKLAPEWKKAAKNLKGQVKLGHVDCDAEKSLMSKYKVEGFPTILVFGADKESPFLYQGARVSSAIESFALEQLEANSGPAEVSELTGPDVMEEKCASAAICFVSFLPDILDSKAEGRNKYLELLLSVAEKFKKSPYSFVWTAAGKQANLENQVGVGGYGYPAMVALNVKKGAYTPLRSAFQRDEIIEFVKEAGRGGKGNLPLNGAPTVVTSEPWDGKDGEVIEEDEFSLDELMGDSSSVNDEL

SEQ ID NO: 46234 - protein, 106 aa, Sorghum bicolor
  Clone ID: LIB3476-012-P1-K1-C12.pep
DAWVSKYKVEGFPTILVFGADKESPFLYQGARVSSAIESFALEQLEANSGPAEVSELTGPDVMEEKCASAAICFVSFLPDILDSKASLPCTINSLFLQSSGLLGRS

SEQ ID NO: 46235 - protein, 390 aa, Sorghum bicolor
  Clone ID: SORBI-28MAY03-C1159_1.pep
MEIDSLREGFDRVAEKRSLSSAKALEAVDQIVNEVEQAIVKLQMMNTDSTGNVDHPSILAELKSKLNEMAPLNQLEGSQKELNGALSKYLKVLEKSFNPDISKAYRNVDFEVHTVNNIIANHFYRQGLFDLGDMFARECGELGGTSLKLPFQEMYAILEAMKARNLEPALSWAAKNHDQLLQNGSMLEFKLYQLQFVEILSKGSRGEGKDEALLYARTHLVPFAAVHKEEFQKLMACLLWVGRLDQSPYSELMSSAHWEKLAEELTHQFCSLLGQSRESPLSVAVSAGFQGLPTLLKLTQVMAAKKQEWQVMKQLPVPIDIGPEFQYHSVFVCPVLREQSSDENPPMRMPCGHVVSKQSIMKLSKSSSRPFKCPYCPSEAVASHCKQLHF

SEQ ID NO: 46236 - protein, 315 aa, Sorghum bicolor
  Clone ID: SORBI-28MAY03-C13840_1.pep
MATQTGVAASKVLILVGAGMTGSILLRNGRLSDVLGELQEIMKGVNQGTASGPYDIALIQAQIRNLAQEVRDLTLSRPITILNGKSDSGGGLSSYILPAAAVGAMGYCYMWWKGLSLSDVMFVTKRNMANAVESMSKQLEQVSSALAATKRHLTQRLENLDGKMDEQVEVSKAIRNEVNDVKDDLSQIGFDIESIQKMVAGLEGKIELLENKQDVANTGIWYLCQVAGGLKDGINAKFFQETGEKLKLSHSAQPENKPVKGLEFFSESTKEQEVVDSKPIAVTIDAKKPEKTTAVKGTAVHRSIRFSYRKEGLAL

SEQ ID NO: 46237 - protein, 156 aa, Sorghum bicolor
  Clone ID: SORBI-28MAY03-C19434_1.pep
FIQHENRTETGIKLGRKDLLVLAGDRRGEGGPRRREAGLLVVVVVLLGAGGASTLGGAVGVGVLGGDEADVLVGVAVGALPGELAAAAALLGVAAHPGGRLAVAAVVRGDLVRVPALLAAVHRRFVWLIAGCCCCCEKRMNAIANGNWMAPCCFPG

SEQ ID NO: 46238 - protein, 78 aa, Sorghum bicolor
  Clone ID: SORBI-28MAY03-C17295_3.pep
MGLSTKLFAVLLLLLIGGYTEMQGPVTVALARKCQSKSFKFKGPCSRDENCATVCLTEGFTSGKCRGLRRRCFCTRDC

SEQ ID NO: 46239 - protein, 79 aa, Sorghum bicolor
  Clone ID: SORBI-28MAY03-C17295_2.pep
MGLSTKLFAVLLLLLIGGYTDTQLGPVTMALARKCESPSHRFQGPCSRDANCATVCRTEGFTGGKCKGLRHRCFCTKDC

SEQ ID NO: 46240 - protein, 79 aa, Sorghum bicolor; identical to SEQ ID NO: 46239
  Clone ID: SORBI-28MAY03-C17295_1.pep

SEQ ID NO: 46241 - protein, 78 aa, Sorghum bicolor
  Clone ID: LIB5049-005-R1-XP1-H1.pep
MGLSAKLFAVLLLLLIGYNTETQGPITMALARKCESPSLKFRGPCSRDANCASVCLTEGFTGGECKGLRHRCFCTRDC

SEQ ID NO: 46242 - protein, 449 aa, Sorghum bicolor
  Clone ID: SORBI-28MAY03-C2477_1.pep
MVEHKGNVLMHKYEMGKLLGQGTFAKVYHARNTKTSESVAIKVIDKDKVMKVGLIDQIKREISVMKLVRHPNIVQLYEVMATKTKIYFVLEHVKGGELFNKVQRGRLKEDAARKYFQQLICAVDFCHSRGVYHRDLKPENLLLDENSNLKVSDFGLSALAECQRQDGLLHTTCGTPAYVAPEVINRKGYDGAKADIWSCGVILFVLLAGYLPFHDKNLMDMYKKIGKAEFKCPCWFSTDARRLLLRILDPNPSTRISMEKIMENPWFRKGLDAKLLRYNLQSKNAPQVDKNADSDSLSINITAESKQQEEKKPTNMNAFDIISLSTGLDLSGLFEESDNKREYKFTSTNTSSTIVSKIEDVAKNLRLKLTKKDGGLLKMEASKPGRKGVMGIDAEIFEVSPNFHLVEIKKTNGDTLEYQKVLNREMRPALKDIVWAWQGEQSKQQQTMI

SEQ ID NO: 46243 - protein, 142 aa, Sorghum bicolor
  Clone ID: SORBI-28MAY03-C2858_1.pep
MASTNMASATSRFMLAAGVPTAGSGSGSSGRVSFAPAPNQLGRRLVVRADPEAPAEPAEGEGAVATKPKAEKPPPIGPKRGTKVKILRRESYWYNGIGNVVTVDQDPNTRYPVVVRFNKVNYAGVSTNNYALDEVQEVNEQK

SEQ ID NO: 46244 - protein, 227 aa, Sorghum bicolor
  unsure (1)..(227): unsure at all Xaa locations
  Clone ID: SORBI-28MAY03-C1088_2.pep
APRRRRPDQPHDHHFHATAVRRADVGKACFGVNVNPVSSGRKSIGTTVGVSVKGGVLVKVNPGYGKTGCTTVGVWKGGVGVNVNPGYGKPGGTTVGVWKGGVGVNVNPGKPGGTTVGVGKGGVGVDVNPGYGKPGGTTVGVGKGGVGVNVNPAKPGGTGTTVGVGKGGVGVGVNPGYGKPGGTTVGVGKGXVGVHVNNPQQKPVNVNAWPLLXMYAALETQVHEDPS

SEQ ID NO: 46245 - protein, 342 aa, Sorghum bicolor
  Clone ID: SORBI-28MAY03-C1088_1.pep
ARGGVARPHFPGRSDLSTTVSAAAVAAAAAAAALVPRLTGRRSAPASRIPEICRRRIRSKPRTFSSSPSFPIVPAAAMATDGAASDAGSKKKLLIFDSEEDLAVSLAKYTAELSEKFAAERGAFTAVLSGGSLIQALRKLTEPPYLDSVDWSKWHVFWVDERVVRKDHVDSNYKLAFDGFLSKVPIPPGQVYAINDALSAEGAADDYEACLKQLVKNGVISMSAATGFPRFDLQLLGMGPDGHIASLFGGHPLVNEKERWVTYIKDSPKPPPERITFTFPVINSSAYVAMVVTGVGKAGAVQKALSDKQTSSDLLPVEMAVLQDGEFTWFSDKPAVSMLQNN

SEQ ID NO: 46246 - protein, 67 aa, Sorghum bicolor
  Clone ID: LIB3478-051-P1-K1-F6.pep
RSPSLHWEHRSIYQLAHWPSSIVFHGEAHCRSTWLPIDCVSTKLMHLVLRINYWQPLSRTPADLLQL

SEQ ID NO: 46247 - protein, 183 aa, Sorghum bicolor
  Clone ID: SORBI-28MAY03-C8334_2.pep
MATIVNTTEEEPMLAVVRFTAELAWADAGPEVADPEVTRLCLEAQEHILAGRWLDMASLMLASADLLLTSPSRVADKDLECVLSVICSLVTKAGSEDEALQITNLICSKLIQQPGDKPALRLKVLFSLYNLLLSPYGKAFVYKKALELATAGKAAEYIIPSFKNIDSFVSEWGIGNLEQRELY

SEQ ID NO: 46248 - protein, 667 aa, Sorghum bicolor
  unsure (1)..(667): unsure at all Xaa locations
  Clone ID: SORBI-28MAY03-C8334_1.pep
HEGGFLLLQLGFAIFALRMLRPEIALPGSEPRPQTTYVSVPYSDFLGSIDKDQVKKVEVDGVHIMFRHGAEVESQXSVWCRHQHSAEQMLXDDNTGASRRIAFTTTRPVDIKTPYEKMVENXXEFGTRDKRSGGMLNSALVALIYVVLIAVVLQRLPISFSQNSAGQLRNRKNSNSGGTKVSESTDIVTFADVAGVDEAKEELEEIVEFLRNPDRYIRLGARPPRGVLLVGLPGTGKTLLAKAVAGEAEVPFISCSASEFVELYVGMGAARVRDLFARAKKESPSIIFIDEIDAVAKSRDGRYRIVSNDEREQTLNQLLTEMDGFDTNSAVIVLGATNRADVLDPALRRPGRFDRVVMVEAPDRFGRESILKVHVNRRELPLSKDVNLADIAAMTTGFTGADLANLVNEAALLAGRLNKEMVEKIDFIRAVERSIAGIEKKHAKLKGNEKAVVARHEVGHALVGTAVANLLPGQPRVEKLSILPRSGGALGFTYTPPTTEDRYLLFVDELRGRLVTLLGGRAAEEVVLGGRVSAGGADDIRRATDMAYKAVAEYGLNQRIGPISLATLSNGGLDDSGGSPWGRDQGHLVDLVQREVKVLLQSSLEVALSVIRANPAVLEGLGAYLEENEKVEGEELQEWLKSVVAPKELTSFIRGQQEQVLQLEASS

SEQ ID NO: 46249 - protein, 618 aa, Sorghum bicolor
  Clone ID: SORBI-28MAY03-C1854_1.pep
MNADFGAPKELAGGLQHRRALYQPPLPPCLQGPTVRAEYGDATTTIDPTCAQAVAQAFPHTFGQPLVSFVAPSADAAAAEERHPIRVGVVFSGRQSPGGHNVVWGLHDALKAYNPQSVLYGFVGGTEGLFANKTLVLTDDVLASYKNQGGFDLLGRSIDQIRTTKQVNAAMTTCRSLNLDGLVIIGGVTSNSDAAQLAETLIQNNCKTKVVGVPVSLNGDLKNQFVETTVGFDTVCKVNSQLVSNVCLDAISAGKYYYFVRLMGRKASHVAFECALQSHPNMLILGEEVALSKLTLMEIINKICDGVQARAELGKYHGVLVIPEGLIESIPEMYALIQEINILHNNNVPVAEMSSQLSPWAAALFQFLPPFIRRELLLHQESDNSAQLSQIDTEQLLAHLVETEMIKRTKEGRYKGRKFSSVCHFFGYQARGSIPSNFDCDYAYALGRISLHMITVGLTGYMATVANLKDPVDKWRCAAAPLTAMMSVKRHLRGPGAIPIGRPSIHPSPIDLKGKAYELLREKASSFLLDDFYRTPGGIQFEGPGSDAKPITLTIENQDYMGDIEILKEYLGKVRTMVKPGCSREILKAAISSMVSVTDVLTVMSHPLNTELPLYHFK

SEQ ID NO: 46250 - protein, 579 aa, Sorghum bicolor
  Clone ID: SORBI-28MAY03-C5362_1.pep
MGKSPAKWIKSVLFGKKSSSRSGSAKAKDLSKGASNKGYAAAGKEPAFSESSPVISEPVLVSAHNDETAREVAKAENSSVQEEVPVTDVCQDLEKQGAVGSDSSNDADRVREEQAAVKAQAAFRGYLARRAFRALKGIIRLQALIRGHLVRRQAVSTLRATWLIVKFQALVRGRNVRLSQAFIQATRELSLEKFGGAKPGSWKEKLSSNAFARKLLSSPIVVEALHFQYDEMDPNSAFNWLERWTISHVWKPISQPKRVGADAKPHTRKASYAMETESAKLKRNARKSSAVPSEASQTNTTIEIEKTRRNPRKLSSTPAESVPDGQLTELEKVKRSLRKVTNSMAETSKTPNPTTEIPDPQEVQCERPLRSAKQVPIHPENQDPRNVNLSDNSKIDILVPDIQPDVEDASDPVTITNEEKVDEPPSVVAPVAEIMPLQDINNEENALVNDVEERSKEEHPSTESLKGSKRRSSFSTKPEYPENGSKNSPALPSYMAATQSAKAKLRGSSSPRLSSDSAEKNGFTRRHSLPSSNNGKMISHSPRTQRPTLAGGKDGAKGDKAMLSSRDASERPLKAEWRR

SEQ ID NO: 46251 - protein, 263 aa, Sorghum bicolor
  Clone ID: SORBI-28MAY03-C6254_1.pep
MAAALAVTDEVALPIRAVGDLAAAAEVSREEVAVITQCAALGGKLPFEDASVGAVLAVIKNVESLREQLVAEISRVLKAGGRVLVQSPALSSSQKPNTDIERKLLMGGFAEVQSSAANSQDSVQSVTVKAKKASWSMGSSFPLKKATRALPKIQIDDDSDLIDEDSLLTEEDLKKPQLPVVGDCEVGAAKKACKNCTCGRAEAEEKVGKLELTAEQINNPQSACGSCGLGDAFRCGTCPYRGLPPFKPGEKVSLSGNFLAADI

SEQ ID NO: 46252 - protein, 135 aa, Sorghum bicolor
  Clone ID: SORBI-28MAY03-C418_1.pep
MAGRGKAIGSGAAKKAMSRSSKAGLQFPVGRIARFLKAGKYAERVGAGAPVYLAAVLEYLAAEVLELAGNAARDNKKTRIVPRHIQLAVRNDEELSRLLGTVTIASGGVMPNIHNLLLPKKSGGGSAKAAAGDED

SEQ ID NO: 46253 - protein, 627 aa, Sorghum bicolor
  Clone ID: SORBI-28MAY03-C833_1.pep
TRHHPTKKDGVGGKTEQDNHEGVDFLPSQEWKKLANGNSKIPGTLDDYRKLVVPIIEEYFSTGDVELAASELRGLGSDQFQHYFVKKLISMAMDRHDKEKEMASILLSSLYADLLSSYTISQGFMMLLESTEDLTVDIPDATDVLAVFIARAIVDEILPPIFLTRARALLPEFSKGIQVLQVVEKSYLSAPHHAELVERKWGGSTHFTVEEAKRRIQNILREYIESGDIDEAFRCIRELSLPFFHHEVVKRALTFAMENISSQPLILKLLKEAAAGCLISPNQISKGFSRLAEGVDDLSLDIPSAKALFDKLVSTAMAEGWLDASFGKSAAPDEEMQNTSAVKMKHFKEESAHIIHEYFLSDDVPELIRSLEELSAPEFNPIFLKKLVTLAMDRKSREKEMASVLLSSLRLELFSTEDIMKGFIMLLQSAEDTALDIVDAPSELALFLARAVIDEVLIPLNLDEISIKLRPNSSGSQTVQMARALLSARHSGERILRCWGGGTGWAVEDAKDKITKLLEEYNTGGDLGEACRCIRDLGMPFFNHEVVKKALVMAMEKQNDTSILALLQECFGEGLITINQMTKGFARVKEGLDDLVLDIPNAQEKFGEYVELATEHGWLLPTFESIP

SEQ ID NO: 46254 - protein, 747 aa, Sorghum bicolor
  unsure (1)..(747): unsure at all Xaa locations
  Clone ID: SORBI-28MAY03-C813_1.pep
CPLCGGLDHAYFCTQCEAEGFRKITFFQDRPDVMAKYTCRIEADKTLYPVLLSNGNLIEQGDLEGGKHYALWEDPFKKPSYLFALVAGQLGCREDSFVTCSGRNVTLRIWTPAQDLPKTAHAMYSLKAAMKWDEEVFGLEYDLDLFNIVVVPDFNMGAMENKSLNIFQSRLVLASPETATDGDYAAILGVVGHEYFHNWTGNRVTCRDWFQLTLXERLAVFRDHEFSSDLGCRTVKRIADVSKLRIYQFPQDAGPMAHPIRPHSYIKMDNFYTVTVYEKGAEVVTMYKTMFGASGFRKGMDLYFQRHDGQAVTCEDFYAAMCDANNAQLPNFLQWYSQAGTPIVKVASSYDPSSQTFSLKFTQQEPPTPGQPVKEPMFIPVXLGLLXPTGKHMPLTSVYSDGTLQTLSTDGQPVFTTVLQFKKKEEEFIFKNIPERPVPSLLRGYSAPVRLDSDLSESDLFFLLANDSDEFNRWEAGQVLARKLMLSLVADFQQQKTLALNPKFVDGIRSILRNTSLDKEFIAKAITLPGQGEIMDMMEVADPDAVHAVRNFIKKELALQLKDDLLAAVKSNRSSEAYTFDHDSMARRALKNTCLAYLASLNEPDFTELALHEYKSATNMTEQFAALAALSQNPGPVRDDALLDFYNKWQDDYLVVSKWFALQATSEIPGNVANVQKLLSHPAFDMRNPNKVYSLIGGFCGSPVNFHAKDGSGYKFLGEIVLQLEMIVSANGLSENVYQIASKSLAG

SEQ ID NO: 46255 - protein, 160 aa, Sorghum bicolor
  unsure (1)..(160): unsure at all Xaa locations
  Clone ID: LIB3476-052-P1-K1-F2.pep
PVDHASASLEGLYKSTGNFCTQCEAEGFRKITFFQDRPDVMAKYTCRIEADKTLYPVLLSNGNLIEQGDLEGGKHYALWEDPFKKPSYLFALVAGQLGCREDSFVTCSGRNVTLRIWTPAQDLPKTAHAMYSLKAAMKWDEEVXGLEYDLDLFNCCCSRF

SEQ ID NO: 46256 - protein, 492 aa, Sorghum bicolor
  Clone ID: SORBI-28MAY03-C2009_1.pep
TRASSIPRPERVSPWQLEPAVSPPPVNPLPVHRPKRPRSNAVASLAESSAPTKEAAPKVTLETQQHALQRPLQTQDNAAPKSGFGDNSELDAAHKSALRPSGFDLEKNTIGMQRKLGSDSWMHMNRPEGYNEMLSGYQQPNKDVQNPQGFCSLPDQIAAGRPNFWHTVNAHYQDQQGNHNLFPGSWSMMPSSTGFGLNRQSYPMMQEVGGLSQSATNTKFGNGAYAALPGHGIDQYSSGWFGHMIPGARMDDVQPRVIKPQPLVLAHGEAQKMKGNSCKLFGIHLDSPAKSEPLKSPPSVAYDGMPQTPAAAEWRMVDSIEADRCSDPLKMPKQLDATQVDPVPEKCSQVSRGTQCKSQGGSTRSCKKVHKQGIALGRSVDLTKFNGYTELIAELDEMFDFNGELKGSNKEWMVVYTDNEGDMMLVGDDPWNEFCNMVHKIFIYTREEVQRMNPGTLNSRSEDSLANSMERGSTARETPGSLSASSLDSENC

SEQ ID NO: 46257 - protein, 139 aa, Sorghum bicolor
  unsure (1)..(139): unsure at all Xaa locations
  Clone ID: LIB3481-038-P1-K1-C1.pep
CDQEDFAALPGHGIDQYSSGWVGXMIPGARMDHVQPRVIKPQPLVLAHGEAQKMKGNSCKLFGIHLDSPAKSEPLKSPPSVASFGPRRGSVVVLTDRSSLTVLGGILVLSACIHDSVQSKTRFVLVPWSILLQVGSPKG

SEQ ID NO: 46258 - protein, 620 aa, Sorghum bicolor
  unsure (1)..(620): unsure at all Xaa locations
  Clone ID: SORBI-28MAY03-C1882_1.pep
MWRTCVSRRLSRAKASASRLLSTXASSSYTVVDHTYDAVVVGAGGAGLRAAIGLSEHGFNTACITKLFPTRSHTVAAQGGINAALGNMSEDDWRWHMYDTVKGSDWLGDQDSIQYMCREAPKAVIELENYGLPFSRTEEGKIYQRAFGGQSLDFGKGGQAYRCACAADRTGHAMLHTLYGQAMKHNTQFFVEYFALDLLMDNEGKCQGIIALNMEDGTLHRFRASNTILATGGYGRAYFSATSAHTCTGDGNAMVARAGLPLQDLEFVQFHPTGIYGAGCLITEGSRGEGGILRNSEGERFMERYAPTAKDLASRDVVSRSMTMEIREGRGVGPLKDHIYLHLNHLPPEVLKERLPGISETAAIFAGVDVTKEPIPVLPTVHYNMGGIPTNYHGEVVDIKGDNPDAVVPGLMAAGEAACASVHGANRLGANSLLDIVVFGRACANRVADISKPGEKQKPLEKDAGEKTIAWLDKLRNANGSLPTSKIRLNMQRVMQNNAAVFRTQETLEEGCELISKTWESFHDVKLSDRSLIWNSDLIETLELENLLINACITMYSAEARKESRGAHAREDFTTRDDEKWMKHSLGYWENEKVRLAYRPVHMNTLDDEVESFPPKARVY

SEQ ID NO: 46259 - protein, 83 aa, Sorghum bicolor
  Clone ID: LIB3480-038-P1-K1-C7.pep
YLFKFFIIYFYFFFFFLFFFFFYFFFFFFFFFFFFFFFFIHQTFLNHHEFRTPGRHQQVTHAKFMYTNVSQALACVLLYLYGR

SEQ ID NO: 46260 - protein, 519 aa, Sorghum bicolor
  Clone ID: SORBI-28MAY03-C4596_1.pep
MMGKALVGSAVFLLLAALGAAGASAADITRADFPAGFVFGVGSSAYQVEGAVAEDGRKPSIWDTFTHKGYSIDGATGDVTADQYHKYKEDVKLLHELGVDAYRMSIAWPRLIPDGRGAVNPKGLEYYNNLIDELLSYGIQPHVTIYHFDFPQALQDEYKGLLSPRFIEDYTAYADVCFKNFGDRVKYWSTVNEPNIETIGGFDQGILPPQRCSAPFGFGCDEGNSTTEPYIAAHHLVLAHASAVSLYREKYQAEQGGRIARALLGWWYEPATETPDDIAAAARMNDFHVGWFMHPMVYGDYPPVMRKNVGSRLPSFTNEEAKRVKGSFDFVGFNHYVAVYVKADLSRLDEKVRDYMADAAVAYDMPFLKSRNQFPFGLGLTADFTTPTPWALKKMLKHLQVKYKNPAVMIHENGAAGQPDPSGVNTYDDEFRSQYLQDYIEATLQSIRNGSNVQGYFVWSFLDVFEYLFGYRLRFGVCGVEFNSTARTRYQRHSAKWYSSFLRGGELRPVALPEGAYSQ

SEQ ID NO: 46261 - protein, 128 aa, Sorghum bicolor
  Clone ID: SORBI-28MAY03-C1460_3.pep
RSSWSSSVAGGGYGYGEAAEYTETTVTEVVSTGGEDEYDTYKVREKEHKHKQHLGEAGAIAAGAFALYEKHEAKKDPEHAHRHKIEEEIAAAAAVGSGGFAFHEHHEKKKDHKEAEEAGGEKKHHFFG

SEQ ID NO: 46262 - protein, 145 aa, Sorghum bicolor
  Clone ID: SORBI-28MAY03-C1460_2.pep
MAEEKHHHHHLFHHKKDEEQLEQPVAGGGYGYGEAAEYTETTVTEVVSTGGEDEYDTYKKEEKEHKHKQHPGEAGAIAAGAFALYEKHEAKKDPEHAHRHKIEEEIAAAAAVGSGGFAFHEHHEKKKDHKEAEEAAGEKKHHFFG

SEQ ID NO: 46263 - protein, 184 aa, Sorghum bicolor
  unsure (1)..(184): unsure at all Xaa locations
  Clone ID: SORBI-28MAY03-C1460_1.pep
MAEEKHHHHHLFHHKKDEEQLEQPVAGGGYGYGEAAEYTETTVTEVVSTGGEDEYDTYKKEEKEHKHKQHLGEAGAIAAGAFALWCPPAATTSTRRTRSRSTRTSTRTTSARPAPSPPAPSHXYEKHEAKKDPEHAHRHKIEEEIAAAAAVGSGGFAFHEHHEKKKDHKEAEEAAGEKKHHFFG

SEQ ID NO: 46264 - protein, 241 aa, Sorghum bicolor
  Clone ID: SORBI-28MAY03-C8095_1.pep
NITPEWFGEDEKYVRALLSLAANVSPTIIFVDVGPGLLGLPTWAGPLVPLRKIKNEFMTHWDGLLSRPDQRILVLAATNRPFDLDEAIIRRFERRIMVGLPSMESRELIMRRLLSKEKVDEGLDYKELATMTEGYSGSDLKNLCTTAAYRPVRELIQRERKKELEKMKREKGKTPSDLPEKKEKEETIILRPLNMTDLKEAKNQVAASFAAEGAIMSELRQWNELYGEGGSRKKQQLTYFL

SEQ ID NO: 46265 - protein, 84 aa, Sorghum bicolor
  Clone ID: LIB3478-012-P1-K1-H1.pep
VVEMSKGKLVLDKPVVDKRLNHQKGTMATYMLLLRGFQCVHPLFLPCIFCCFNMPSGSRSDGAKGKLLSPTLTYQQLGHRQGKH

SEQ ID NO: 46266 - protein, 53 aa, Sorghum bicolor
  Clone ID: LIB3476-043-P1-K1-H1.pep
KKESFTATLLYIKVVFGGMEHDYSERAWYLPWSRTARDIRLSRTTAETCCSLS

SEQ ID NO: 46267 - protein, 415 aa, Sorghum bicolor
  Clone ID: SORBI-28MAY03-C5709_1.pep
MAVEAALAWYEELREKDDMQEKISNEINQLWLGTRNKEFSQGLSKAELRKKRAELEKKCDALSQRYWQVVFEMGSKPDFSGMTEAERAETAEKLRSDELRYARRLTEEGDPRALSIEAFVPILDFDPKQGGRYYNRYTLVDLTTFDLDEESPIGPMQFTDSPHKVIETDHFKLSGAVNFLSVKVASSDIGFPIHVYGTVIVRDSIDERCVYHFRCDPDHCQLINSEAESLILTGPKRGLALCGYMYVEIDLKIKDHLGQSREFSKGLLSISDPTNCASMVSMVETISLATRLSTVDVTYAVVNRAAEGFIAVKVLQGGFHGKITAYTTSVKDILVLYDSKEADAMTFDDCGDILQLMRPVVSVHVEDFLIIVFHTSDGKSESIQFAPMFNGRDEGQITVGATKMCVKLAWSVMKP

SEQ ID NO: 46268 - protein, 127 aa, Sorghum bicolor
  Clone ID: LIB3480-014-P1-K1-D4.pep
PIGPMRHIDSPYKKESYFLRLCKAVNFLSVKIGCSDVGYPIHVYGTIIVRDSIDERCVYHFRRDSDNCQLISSEAESLILTGPKRGLALAGDIYVETDLKMKDDLVQDRELSKGLIIIRGTPTRLFE

SEQ ID NO: 46269 - protein, 395 aa, Sorghum bicolor
  Clone ID: SORBI-28MAY03-C598_1.pep
MQSAAAFRPCPAGAGAGQLVSRNPSRGPLLPVPARPLRVVVSAATTRALGLGRLRLSASPDDRSGQRQVSCGAAGDAVAAPSAEEGGGFMKTLWLGSLFGLWYLFNIYFNIYNKQVLKVFPYPINITEAQFAVGSVVSLFFWTTGIIKRPKISGAQLVAILPLAIVHTMGNLFTNMSLGKVAVSFTHTIKAMEPFFSVLLSAIFLGEFPTVWVVASLLPIVGGVALASLTEASFNWIGFWSAMASNVTFQSRNVLSKKLMVKKEESLDNLNLFSIITVMSFFVLAPVTFFTEGVKITPTFLQSAGLNVNQVLTRSLLAGLCFHAYQQVSYMILAMVSPVTHSVGNCVKRVVVIVTSVLFFRTPVSPINSLGTAIALAGVFLYSQLKRLKPKPKTP

SEQ ID NO: 46270 - protein, 323 aa, Sorghum bicolor
  unsure (1)..(323): unsure at all Xaa locations
  Clone ID: SORBI-28MAY03-C6138_1.pep
MSSSGAPAPAAAMAVDEAEDDQLASMSTEDIIRASRLLDNEIRVLKDELQRTNLELESFKEKIKENQEKIKLNKQLPYLVGNIVEILEMNPEDEAEEDGANIDLDSQRKGKCVVLKTSTRQTIFLPVVGLVDPDKLKPGDLVGVNKDSYLILDTLPSEYDSRXPCIIFIDEIDAIGTKRFDSEVSGDREVQRTMLELLNQLDGFSSDERIKVIAATNRADILDPALMRSGRLDRKIEFPHPSEEARARILQIHSRKMNVNPDVNFEELARSTDDFNGAQLKAVCVEAGMLALRRDATEVTHEDFNEGIVQVQAKKKSSLNYYA

SEQ ID NO: 46271 - protein, 435 aa, Sorghum bicolor
  Clone ID: SORBI-28MAY03-C591_1.pep
MEMKLTIKRVPTVVSNYQDDADKPRAGCGRNCLGDCCLPASKLPLYAFKLNPAKRSQEGAASTKLLVDILLSEWEDRMARGLFRYDVTACETKVIPGNLGFVAQLNEGRHLKKRPTEFRVDRVLQPFDPAKFNFTKVGQEEVLFQFENGDGDDSYFLNDAPIIAVDRAPNVVAINVSPIEYGHVLLIPRVLDRLPQKIDPESFLLALQMAAEAASPYFRLGYNSLGAFATINHLHFQAYYLSVPFPVEKAATLKIPLSEDTMKNGVTVSKLINYPVRGLVFEGGNTLEDLANVVSNACIWLQDNNVPYNVLISDCGKRVFLFPQCYAEKQALGEVSQELLDTQVNPAVWEISGHIVLKRRSDYEEASETSAWKLLAEVSLSEERFEEVKAYIFSAAGLVLSDEEEEEASEGKGTTTFAPVPVSPMPVAEGCLVHQ

SEQ ID NO: 46272 - protein, 113 aa, Sorghum bicolor
  Clone ID: LIB3481-005-Q6-K1-D8.pep
MQCYAEKQALGEVSQELLDTQVNPAVWEISGHIVLKRRSDYEEASETSAWKLLAEVSLSEERFEEVKAYIFSAAGLVLSDEEEEEASEGKGTTTFAPVPVSPMPVAEGCLVHQ

SEQ ID NO: 46273 - protein, 380 aa, Sorghum bicolor
  Clone ID: SORBI-28MAY03-C6155_1.pep
MGSGEKTVTAYGEYTYAELEREPYWPSEKLRISITGAGGFIGSHIARRLKSEGHYIIASDWKKNEHMTEDMFCHEFHLVDLRVMDNCLKVTQGVDHVFNLAADMGGMGFIQSNHSVIMYNNTMISFNMLEAARINGVKRFFYASSACIYPEFKQLDTNVSLKESDAWPAEPQDAYGLEKLATEELCKHYTKDFGIECRVGRFHNIYGPFGTWKGGREKAPAAFCRKAQTSTERFEMWGDGLQTRSFTFIDECVEGVLRLTKSDFREPVNIGSDEMVSMNEMAEIVLSFEDRKLPIHHIPGPEGVRGRNSDNTLIKEKLGWAPTMKLKDGLRFTYFWIKEQIEKEKTQGVDIAAYGSSKVVSTQAPVQLGSLRAADGKEGL

SEQ ID NO: 46274 - protein, 532 aa, Sorghum bicolor
  Clone ID: SORBI-28MAY03-C7982_1.pep
ARGAARPLHPRCVGGGLPTGGCCRGGCLLGGAPNEACALAGHWGLGKLIAFYDDNHISIDGDTEIAFTEDVSTRFEALGWHTIWVKNGNNGYDDIRAAIKEAKAVTDKPTLIKVTTTIGFGSPNKANSYSVHGSALGAKEVEATRQNLGWPYEPFFVPEDVKSHWSRHTPEGAALEADWNAKFAEYEKKYADDAATLKSIITGEFPTGWADALPKYTPESPGDATRNLSQQCLNALANVVPGLIGGSADLASSNMTLLKMFGDFQKDTAEERNVRFGVREHGMGAICNGIALHSPGFVPYCATFFVFTDYMRGAMRISALSEAGVIYVMTHDSIGLGEDGPTHQPIEHLVSFRAMPNILMLRPADGNETAGAYKVAVLNRKRPSILALSRQKLPHLPGTSIEGVEKGGYTISDNSTGNKPDLIVLGTGSELEIAEKAADELRKEGKTVRVVSFVSWELFDEQSDEYKESVLPAAVTARISIEAGSTLGWQKYVGAQGKAIGIDKFGASAPAGTIYKEYGITVESVIAAAKSF

SEQ ID NO: 46275 - protein, 249 aa, Sorghum bicolor
  Clone ID: SORBI-28MAY03-C107037_1.pep
MVKLAFGSVGDSFSATSIKAYVSEFIATLLFVFAGVGSAIAFGQLTNDGALDPAGLVAIAIAHALALFVGVSIAANISGGHLNPAVTFGLAVGGHITILTGIFYWVAQLLGASVACLLLKFVTHGKAIPTHGVSGISELEGVVFEIIITFALVYTVYATAADPKKGSLGTIAPIAIGFIVGANILAAGPFSGGSMNPARSFGPAVAAGNFAGNWVYWVGPLIGGGLAGLIYGDVFIGGNYQQVADQDYA

SEQ ID NO: 46276 - protein, 399 aa, Sorghum bicolor
  Clone ID: SORBI-28MAY03-C838_1.pep
MRRPPAAVPGPVAGSVWDDMLGFYRQPAPILLVATGVPLAVIYAFSRPILVLLGESPAIASAAAVFVYGLIPQIFAYAANFPIQKFMQAQSIMAPSAYISAATLAVHVALSYLAVYRWGMGLLGASLILSLSWWVIVVAQFVYIVTSERCRLTWTGFSWEAFSGLPSFFKLSVASAVMLCLETWYFQILVLIAGLLKDLELALPSLSVCMTITGWVFMISVGSDAAASVRVSNELGAGNPKAASFSVVVVTLLSFVLSVLISIVILLCRDYISYIFTEGEDVSRAVSKLTPLLAVTLILNGIQPVLSGVAVGCGWQAFVAYVNVGCYYIVGIPLGCLLGFYFDLGAAGIWSGMIGGTFMQTLILVWVTYRTNWTKEVQEAQKRLNKWNDGKAPLLSAQE

SEQ ID NO: 46277 - protein, 428 aa, Sorghum bicolor
  Clone ID: SORBI-28MAY03-C7780_1.pep
MAKPRRGRSASRSSSGSSSRSPSHSVSSGSVSSRSRSRSRSFSSSSSQSRSRSPPPAKRGSPGARKGRSPSPPPKKGSPSKKVRSPSPPPKKASPPRKASPAESAVLCIDHLSRNVNEAHLKEIFGNFGEIVNVELSMDRMVNLPRGYGYIEFKKRADAEKALLYMDGGQIDGNVVKLRFTLQPRQRAASPMKAPPPPPKRDAPQIEKGVTSAEKDAQQRPRESSPRRKPASPPRKRSPNRRAESPRRPPDPSPRRRPDSPPIRRRPDPSPVRRGDTPPRRRPLSPVRRRSPSPPPRRHRSPMRPSPRRGRGSPSPRRRSPGPLRRRSPPPRRLRSPPRRPPPPRRYSRSPPRRPLRSRSRSISPRRGRGPPLRRGRSDSSYSRSPTPPPRKGPRRVSRSRSPRRPPRGRSISSDSRSSSSPSPRRGR

SEQ ID NO: 46278 - protein, 510 aa, Sorghum bicolor
  Clone ID: SORBI-28MAY03-C947_1.pep
MFIESFRVESPHVRYGPTEIESEYRYDTTELVHEGKDGASRWVVRPKSVKYNFRTSTAVPKLGVMLVGWGGNNGSTLTAGVIANREGISWATKDKVQQANYFGSLTQASTIRVGSYNGEEIYAPFKSLLPMVNPDDLVFGGWDISNMNLADSMTRAKVLDIDLQKQLRPYMESMVPLPGIYDPDFIAANQGSRANNVIKGTKKEQVEQIIKDIREFKEKNKVDKIVVLWTANTERYSNVCTGLNDTMENLLASVDKNEAQISPSTLYAIACVMEGVPFINGSPHNTFVPGLIDLAIKNNCLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKNTIVLHNTCEDSLLAAPIILDLVLLAELSTRIQLKAEGEDKFHSFHPVATILSYLTKAPLVPPGTPVVNALAKQRAMLENIMRACVGLAPENNMILEYK

SEQ ID NO: 46279 - protein, 131 aa, Sorghum bicolor
  unsure (1)..(131): unsure at all Xaa locations
  Clone ID: SORBI-28MAY03-C3346_1.pep
FRNCVAVTAFPSRARNHGAPTVSHRRAPPPPRPLPPXPSRTAGPSQSSQQTTPPSPNQPPPAPWPSATRMGYPTPPSPPRRAPAPPRRXPPGGAAAAWVRIPPPAVPPAPPPPPLQPPPPPLVEAPPRRLP

SEQ ID NO: 46280 - protein, 480 aa, Sorghum bicolor
  Clone ID: SORBI-28MAY03-C31273_1.pep
MVKICCLGAGYVGGPTMAVIALKCPAIEVCVVDISVPRIAAWNSDQLPIYEPGLDDVVKQCRGRNLFFSNDIEKHVAEADIIFVSVNTPTKTRGLGAGKAADLTYWESAARMIADVAKSDKIVVEKSTVPVKTAEAIEKILTHNSKGINFQILSNPEFLAEGTAIEDLFKPDRVLIGGRETPEGQKAVKALKDVYANWVPEDRILTTNLWSAELSKLAANAFLAQRISSVNAISALCEATGANVAEVAYAVGKDSRIGPRFLNASVGFGGSCFQKDILNLVYICECNGLPEVANYWKQVIKINDYQKSRFVNRVVSSMFNTVSGKKIAVLGFAFKKDTGDTRETAAIDVCKGLLGDKAKISIYDPQVTEDQIQRDLAMNKFDWDHPIHLQPMSPTAVKQVSVTWDPYEATKGAHGICILTEWDEFKALDYKKIYDSMQKPAFLFDGRNVIDAEKMREIGFIVYSIGKPLDPWLKDMPAVA

SEQ ID NO: 46281 - protein, 225 aa, Sorghum bicolor
  Clone ID: SORBI-28MAY03-C274_1.pep
MATTAALSTAANPTQLCRSRATLGKPVKGLGLGMGRERAQSITCQAASSIPADRVPDMEKRKLMNLLLLGAISLPTVGMVVPYGAFFVPAGSGGAGGGTYAKDKLGNDITVDEWLKTHGPNDRTLAQGLKGDPTYLVVEQDKTLATYGINAVCTHLGCVVPWNGAENKFICPCHGSQYNNQGKVVRGPAPLSLALVHADVDDGKVLFVPWVETDFRTGEDPWWKA

SEQ ID NO: 46282 - protein, 171 aa, Sorghum bicolor
  Clone ID: LIB3481-043-Q6-K1-B12.pep
AFGGVNYAGVGGGGGGGNGYGYLGMVVPYGAFFVPAGSGGAGGGTYAKDKLGNDITVDEWLERRGANYRTLAQGLKGDPTYLVVEQDKTLATYGINAVCTHLGCVVPWNGAENKFICPCHGSQYNNQGKVVRGPAPLSLALVHADVDDGKVLFVPWVETDFRTGEDPWWKA

SEQ ID NO: 46283 - protein, 92 aa, Sorghum bicolor
  Clone ID: LIB3478-024-P1-K1-E11.pep
LKTHGPNDRTLAQGLRGDPTYLVVERDKTLATYGINALSYASGSSSVPLLGIRGPAPLSLALVHADVDDGKVLFVPWVETDFRTGEDPWWKA

SEQ ID NO: 46284 - protein, 166 aa, Sorghum bicolor
  Clone ID: SORBI-28MAY03-C1277_2.pep
MPPKLDPSQVVEVFVRVTGGEVGAASSLAPKIGPLGLSPKKIGEDIAKETAKDWKGLRVTVKLTVQNRQAKVSVVPSAAALVIKALKEPERDRKKVKNIKHSGNISLDDVVEIAKTMRPRSMAKEMAGTVKEILGTCVSVGCTVDGKDPNDLQQEIDDGEVEIPSA

SEQ ID NO: 46285 - protein, 166 aa, Sorghum bicolor
  Clone ID: SORBI-28MAY03-C1277_1.pep
MPPKLDPSQVVEVFVRVTGGEVGAASSLAPKIGPLGLSPKKIGEDIAKETAKDWKGLRVTVKLTVQNRQAKVSVVPSAAALVIKALKEPERDRKKVKNIKHSGNISLDDVVEIAKTMRPRSMAKEMAGTVKEILGTCVSVGCTVDGKDPKDLQQEIDDGEVEIPSA

SEQ ID NO: 46286 - protein, 210 aa, Sorghum bicolor
  Clone ID: SORBI-28MAY03-C48_1.pep
LLSRVRCYSLILFGGPRTLPMHTFVMTPLLAAVYVGAMQNIFSKSAKYSLFDPCKEMAYIPLDEDMKVKGKAAIDVVCNPLGKSGGALIQQFMILSFGSLANSTPYLGGILLVIVLAWLGAVRSLDSQFSTLAKQDLEKEKMLKAQAVEVETTAKVVGTGNGSLQETLASEPSANGAATKQSREPESTTTEKSGQEPESTTTEKSGQQSQ

SEQ ID NO: 46287 - protein, 568 aa, Sorghum bicolor
  Clone ID: SORBI-28MAY03-C503_1.pep
IGEHRCWWGSALVALVGTSKVVLGCIAFGIFWVMAVFPTVPFMPVGRTAGSLLGAMLMVLFRVISPEDAYSAIDLPIIGLLFGTMVVSIFLERADIFNYLGNLLSRQSTGSKHPLFRVSSVSASTRALFPTHTCCAVLTEFILKVARQNNRPPQPFLLALATSSNIGSAATPIGNPQNLVIPVDCGISFGQFLLRVFPALIVGVLTNAAILLLYFWKYLSVEKDQEGGQATGPEVVADDEVTSHRFTPARMSHVSSLNPDDEDCISEPIIRSNSVRSSVNENLRSRSVNSEADIQLAIKSLRASSMSHEVVEVSTVPDRKDEGASSRKFTRSASQQRSVIIEDLAPAPEMNGEKEKETEVAEKRWKILVWKTAVYLITLGMLIALLMGLNMSWTAITAALVLLALDFTDAQACLEKVSYSLLIFFCGMFITVDGFNKTGIPNTLWELVEPYSRIDSARGVALLAVVILILSNVASNVPTVLLLGTRVAASAAAISHGSERKAWLILAWVSTVAGNLTLLGSAANLIVCEQARRAQFFGYNLTFWSHLRFGVPSTIIVTAIGLLIVISY

SEQ ID NO: 46288 - protein, 509 aa, Sorghum bicolor
  unsure (1)..(509): unsure at all Xaa locations
  Clone ID: SORBI-28MAY03-C9947_1.pep
MAGAASSLGPAPVVVSVLPLCWPLLRQPRPRPHRDQRPARNFNRRARRLAAVVDPYLSVTFEEYEGGRIKSSEAFDEIKSYLTTASTRDVRHLRAEAGGGGPRHGADTDKDKRVLSIAKVTGEEVADAFRGATVWWSAAAVPPPGDTTVPWSRAXRAERRFFRLEFHEGHRDLVLNDYLPYVRREGRAVMAKNRQRRLYTNILKEGFDDGYYQDVWTHVPFEHPKTFDKLAMDPAKKKEIIDDLDMFKKSKDYYARVGKPWKRGYLLYGPPGTGKSTMVAAMANHLEYDVYDFELTSVKTNTDLRKLLIETKSKSIMVFEDIDCSLDLTGKRKSKEEEEGRKDGDGDGDDAAAAAKKKQEEDAAKSSKVTLSGLLNFIDGIWSACGEERLIVFTTNHVGKLDPALIRTGRMDKKVEMSYCDYESFKFLARMHLRDDDVVEAHEAQCRRVRALLEEVNMVPVDVGEHLTPRSPGEFEDAGPCLDRLVTALEKAKEEEGARLPPTGATGTT

SEQ ID NO: 46289 - protein, 205 aa, Sorghum bicolor
  Clone ID: SORBI-28MAY03-C8458_1.pep
MQRAVQAVRSHGSVLKYAVLQHISAPKPAMLPAVFSRFMSVSSARLEDSGFETATVSDVLKSKGKSADGSWLWCTTEDTVYDAVKSMTQHNVGALVVVKPGEAKSIAGIVTERDYLRKIIVQGRSSKSTKVGDIMTEENKLITVNPNTKVLQAMQLMTDNRIRHIPVIDGTGMLGMVSIGDVVRAVVAEHREELNRLNDYIQGGY

SEQ ID NO: 46290 - protein, 489 aa, Sorghum bicolor
  Clone ID: SORBI-28MAY03-C18446_1.pep
MPQMDGPADQIAAGWFAAEPAAERPVALPRTGSSSRLNAQAPEFVPRGPPSPAPAVVVPPPPQVIRMFAAPPPPPRAAFFAAPPPRPFEYYAPVAGRGGFAAKEQQAPEPEPEAEMLPPAAVKAEPVVDGLDDEVVHKITKQVEYYFSDINLATTEHLMRFITKGPEGYVPISGIAGFKKVKASVHNNVMLAAALRTSSKLVVSDDGKRVKRQEPFTESDLQELQSRIVVAENLPGDPSYQNLKKIFSAVGSVISIRTCYPQTPNGTGPATNRSAKLDMLFANKLHAFVEYETPEDAEKAILELNDEKNWRNGLRVRLLNTCTVKGAGKGKKGVHETDGNGEEDVSTSNHSNEKLFEESSQLLDVLPEHLFDENFNDKEVPKRGKGRGRGGRGRGRGNHQYNNNQHHQNNQQHYNHHGNNHLGGNRGSPHPVGTPPHNLITKPEQYPQLPIGANKLPPGPRMPDGTRGFTMGRGKPQAVLPGLCAVGES

SEQ ID NO: 46291 - protein, 694 aa, Sorghum bicolor
  Clone ID: SORBI-28MAY03-C2243_1.pep
MAALEAARSWAGSVIPPELAAAAGGDPLAALAATAAALVAGLLILAVWFRSGGGAPSKPVAAPVRPPPVKVDADADVDDGRKRVTIFFGTQTGTAEGFAKSMAEEARARYEKAVFKVVDLDDYAQEDEEYEEKLKKETVVLFFLATYGDGEPTDNAARFYKWFTEGKEKEVWLKDLKYGIFGLGNRQYEHFNKVAKVLEELLEEQGGKRLVPVGLGDDDQCIEDDFTAWKELVWPELDQLLRDEDDTTGASTPYTAAIPEYRVVFIDKSDLSFQDRSWTLANGTGVIDIQHPCRGTRAVRKELHKPASDRSCIHLEFDISGTGLVYETGDHVGVYAENSVETVEEAERLLDLSPDTFFSIHADAEDGSPRKGGGSLAPPFPSPCTLRTALLRYADLLNPPKKAALLALASHASDPAEAERLRFLASPAGKDEYSQWITASQRSLIEVMAAFPSAKPPLGVFFAAIAPRLQPRYYSISSSPMMAPSRIHVTCALVYGPSPTGRIHQGVCSTWMKNTIPLEYSEESSWAPIFVRQSNFKLPADPSTPIIMIGPGTGLAPFRGFLQERLALKQSGTELGTSILFFGCRNRNMDYIYEDELQTFLEEGALSELIIAFSREGPTKEYVQHKMVEKATEIWNIISHGGYLYVCGDAKGMARDVHRMLHTIVQEQGSLDSSKTESYVKSLQMEGRYLRDVW

SEQ ID NO: 46292 - protein, 137 aa, Sorghum bicolor
  unsure (1)..(137): unsure at all Xaa locations
  Clone ID: SORBI-28MAY03-C1575_2.pep
RTRGYAGIGWCIWRSKEDLPDELIFHINYLGADQPTFTLNFSKGSSQIIAQYYQLIRLGFEGYKDVMQNCQENATVLKEGIEKMGXFDVVSKDSGVPLVAFSLKDSSKYTVFEISESLRRFGXIVPATPCPDAEHVA

SEQ ID NO: 46293 - protein, 476 aa, Sorghum bicolor
  unsure (1)..(476): unsure at all Xaa locations
  Clone ID: SORBI-28MAY03-C1575_1.pep
SRTGPRPWSPARSAPRAGGSGSTSGPPRRGSSTRSTWTSSCSTATWGGSGRPCSHPACRHRAASSEWPLTTGPPTRWGTTSSPVFPATAVERRTATGVGTRGTSETLILAALPWKTERQTRWKEQXKEGDKPNIVTGANGQVCWEKFARYFEVELKEVKXSQAYYVMRPVKAVEMVDENTIRGAPVGGAPLTGEFEDVKLFDDLLTRAGVGPPWDVPIHVDAASGGFLAPFLYPELEWDFRLPLVKSINVSGHKYGLVYAGVGWVIWRSKEEPPHRPVLPAHPPGPRGIQEHHGELPRERHGAQGRPGQVGPLQQGYKNIMENCQENAAILREGIAATGRFDVLSKDTGVPLVAFSLKDSSRFSVFDISENLRRFSWIVPAYTMPADAEHVAVLRVVIREDFSRSLCERLVSDIKKILHELDARATHAVTWVSTAAAAAVQADDGAVVGKKSALEIEREVAARWRNAVNKKKTGVC

SEQ ID NO: 46294 - protein, 351 aa, Sorghum bicolor
  Clone ID: SORBI-28MAY03-C3285_1.pep
MYGWEMLSFNIHDGFLEAIVRGNRSGLLTAADYNNLCQCETLDDIKMHLTATEYGPYLQNEPSPLHTTTIVEKCTLKLVDEYKHMLCQATEPLSTFLQYITYGHMIDNVVLIVTGTLHERDVNELLEKCHPLGMFDSIASLAVAQNMRELYRLVLVDTPLAPYFSECITSEDLDDMNIEIMRNTLYKAYLEDFYKFCQKLGGATAEIMCDLLSFEADRRAVNITINSIGTELTRDDRRKLYSNFGLLYPYGHEELAVCEDVDQVRGAMEKYPPYQSIFSRISYGESQMLDKAFYEEEVKRLCLSFEQQFHYAVFFAYIRLREQEIRNLMWISECVAQNQKSRVHDSVVFIF

SEQ ID NO: 46295 - protein, 123 aa, Sorghum bicolor
  Clone ID: SORBI-28MAY03-C1747_1.pep
MAAAASSKGRAIAGSFVSRVLAGKAASPRRAVHASAYDKNLEDQVRPAFVPDDVIGGGAGNPDKYWSPHPTTGVFGPAAVDPKLAAAAGAPDAAAANAAGGTVLDQKVWFRPLEDVEKPPPVA

SEQ ID NO: 46296 - protein, 183 aa, Sorghum bicolor
  Clone ID: SORBI-28MAY03-C551_1.pep
MALETCFRAWALHAAPAAGGKDSRLLVVGSSSGSGSNLVLPSKRAAAAAVVAPLSVGRVATRRPRHVCQSKNAVDEVLVADEKNWDGMVMACETPVLVEFWAPWCGPCRMIAPVIDELAKDYAGKITCCKVNTDESPNVASTYGIRSIPTVLIFKAGEKKESVIGAVPKSTLTTLIDKYIGTS

SEQ ID NO: 46297 - protein, 167 aa, Sorghum bicolor
  Clone ID: LIB3481-041-Q6-K1-A12.pep
MALETCFRAWALHAAPAAGGKDSRLLVVGGGSGSGSNLVLPSKRAAAAAVVAPLSVGRVATRRPRHVCQSKNAVDEVLVADEKNWDGMVMACETPVLVEFWAPWCGPCKITCCKVNTDESPNVASTYGIRSIPTVLIFKAGEKKESVIGAVPKSTLTTLIDKYIGTS

SEQ ID NO: 46298 - protein, 141 aa, Sorghum bicolor
  Clone ID: SORBI-28MAY03-C2292_1.pep
MMMMGGGAHAPPWQQSPAASMDADEAASPYARPGAPQHYLPSNEVSAAAAPPAPDPAEAPLAPAGDPDASHEVRMHEVKVRRGSRGRSHDWTACPYAHPGEKARRRDPRRYHYSRAACPDFRKAGCNPGDACEYSHGALPC

SEQ ID NO: 46299 - protein, 104 aa, Sorghum bicolor
  Clone ID: LIB3481-006-Q6-K1-F6.pep
RSTPRPIAGGRAPATRSLMSQQSTTGAPSMLSDWGSPDGKLDWGVQGDELHKFRKSASFAFRGQSPAPVPTPAEPDVSWVNSLVKDGHAGNIFAQWPEQEQMVA

SEQ ID NO: 46300 - protein, 459 aa, Sorghum bicolor
  Clone ID: SORBI-28MAY03-C6486_1.pep
MAPANVRAAQAPSADRRLSTLVRHLLPSSPRRTAAEAAADASATLESFPTMASQGSSVFAALAQAPEDPILGVTVAYNKDPSPVKVNLGVGAYRTEEGKPLVLNVVRRAEQMLINNPSRVKEYLPITGLAEFNKLSAKLIFGADSPAIQENRVATVQCLSGTGSLRVGGEFLARHYHERTIYIPQPTWGNHPKVFTLSGLTVRSYRYYDPATRGLDFKGLLEDLSSAPSGSIVLLHACAHNPTGVDPTLDQWEQIRQLMRSKSLLPFFDSAYQGFASGSLDKDAQSVRMFVADGGELLMAQSYAKNMGLYGERVGALSIVCGSADVAVRVESQLKLVIRPMYSNPPLHGASIVATILRDSEMYNEWTLELKAMADRIISMRQQLFDALKSRGTPGDWSHIIKQIGMFTFTGLNSEQVAFMRQEYHIYMTSDGRISMAGLSMRTVPHLADAIHAAVTQLK

SEQ ID NO: 46301 - protein, 612 aa, Sorghum bicolor
  unsure (1)..(612): unsure at all Xaa locations
  Clone ID: SORBI-28MAY03-C6954_1.pep
MAFGERVTTFEDSDKDSEYDYDCGDSGPVFGAVVVADGIMYELVRVRVHHLSGDIIRHDADPDTIQAYEETAGQMVSDTVKLPFSQLFEDPAVGEEALVGKFKKLXRPYSRIPQPRRRSTVNIVQSAVSTIRPNSPEGSGSSLFCSAXEVVNSVSDFPPPTLFISVPCFPLVLDGHCFYVPLLIYCKILVHMSIVXISAMPISLTITIATYYSYYTPHLAVQRLLDALFASVLGSTGAFGGGIGFSKTVISQALNKYSNSEAGGDVGCSERGNEMAEFLMDTTQLTMTCEEAGEESVMKRTTLVANTSNMPVAAREASIYTGITIAEYFRDMGYNVSMMADSTSRWAEALREISGRLAEMPADSGYPAYLAARLASFYERAGKVKCLGSPDRTGSVTIVGAVSPPGGDFSDPVTSATLSIVQVFWGLDKKLAQRKHFPSVNWLISYSKYSKALESFYEKFDPDFIDIRTKAREVLQREDDLNEIVQLVGKDALAESDKITLETAKLLREDYLAQNAFTPYDKFCPFYKSVWMMRNIIHFNTLANQAVERAAGTDGQKITYSVIKHRLGDLFYRLVSQKFEDPAEGEEALVAKFKKLYDDLTNGFRNLEDEAR

SEQ ID NO: 46302 - protein, 165 aa, Sorghum bicolor
  unsure (1)..(165): unsure at all Xaa locations
  Clone ID: LIB3478-012-P1-K1-E7.pep
PRPVSSKLAADTPLLTGQRVLDALFPSVLGGTCAIPGAFGCGKTVISQALSKYSNSEAVVYVGCGERGNEMAEVLMDFPQLTMTLPDGREESVMKRTTLVANTSNMPVAAREASIYTGITIAEYFRDMGYNVSMMADSTSRWAEALRENSGRLAEMPAEXGYPAY

SEQ ID NO: 46303 - protein, 260 aa, Sorghum bicolor
  unsure (1)..(260): unsure at all Xaa locations
  Clone ID: SORBI-28MAY03-C14600_1.pep
FNNLPCLCLLDCSVRTACYVYIYIWCAYVWLGSDNTAEEAPRAYDAEARKGRGRPAPAICPAGVPGAPESPAKPSGSAAAXPAPPPKACADEVFSNLNNDNNDLFAMFAFNDNKVPVKPAEVASFLPAVKPLVPSKRSATNMLSDQNSNSYGSSDFGWDDDTMTSGYTFAPNNAIPASYMQGGESKRMRNNYGVAMFQGNGAPSLAQVMPGFDPEMNYQPLPYVESSSSDASMDSLLPQDGASNGDIWSLDELLMAAGAY

SEQ ID NO: 46304 - protein, 97 aa, Sorghum bicolor
  Clone ID: LIB3480-022-P1-K1-C6.pep
RTRGISHCLMLRAAHQMHQWTAFYHRMGQAMGISGALMSCSWQLVLIEKLWLLSVWRVNSKKMAPTCGDAGGASQLNPLHFVAVVIYGRLHIYAFAS

SEQ ID NO: 46305 - protein, 148 aa, Sorghum bicolor
  Clone ID: SORBI-28MAY03-C7130_1.pep
MASKRILKELKDLQKDPPTSCSAGPVGEDMFHWQATIMGPSDSPFAGGVFLVNIHFPPDYPFKPPKVSFRTKVFHPNINSNGSICLDILKEQWSPALTISKVLLSICSLLTDPNPDDPLVPEIAHMYKTDRAKYESTARSWTQKYAMG

SEQ ID NO: 46306 - protein, 291 aa, Sorghum bicolor
  Clone ID: SORBI-28MAY03-C637_1.pep
MSGGGQDLQLPPGFRFHPTDEELVMHYLCRRCAGLPIAVPIIAEIDLYKFDPWQLPRMALYGEKEWYFFSPRDRKYPNGSRPNRAAGSGYWKATGADKPVGTPKPLAIKKALVFYAGKAPKGEKTNWIMHEYRLADVDRSARKKNSLRLDDWVLCRIYNKKGGLEKPAAVAGGDHKPMFAAAAVSSPPEQKPFVAAPGGLPPFPDLAAYYDRPSDSMPRLHADSSCSEQVLSPEQLACDREVQSQPKISEWERTFASDPVNPAGSMLDPVVGGHAGDPLLQDILMYWGKPF

SEQ ID NO: 46307 - protein, 118 aa, Sorghum bicolor
  Clone ID: LIB3481-042-Q6-K1-C9.pep
LSLQLDDWVLCRIYNKKGVIERYDTVDDDADDAVAEDVKPAPASRNNPRGTASGRGGAAAAAAPMKVEFPEYGGYYDYDDLEATPSAGMLCFDRPSAAVPTAPASAPAPAPGPALSSS

SEQ ID NO: 46308 - protein, 266 aa, Sorghum bicolor
  Clone ID: SORBI-28MAY03-C17346_1.pep
MGTLPRCLLAGICAAALLAAVVVAHGAEPETASMVVGLAKCADCSRKNMKPEAVFNGLQVAVKCKNADGVFVTKALGEVDRTGAFSVPLAADLLREDGELKQDCFAQLHSAANQPCPGQEPSWIVRSATSEYDDDKTKKTFVAVAGKVHYPSKECASAFLCYHFFKKHLLHKKPTVMSPHIHKKPAVPEYKPPTTTTPVPVYHSPVPEYKPGHPTPTPIYHPTAEHKTQNHETDTEKFKKLLPFIKKNPFFFPKFPKFPGGKEIKA

SEQ ID NO: 46309 - protein, 459 aa, Sorghum bicolor
  Clone ID: SORBI-28MAY03-C2784_1.pep
MASAAFAVSSPAASAVAARSKVLGRGANLGRNRTGCRVGITRKNFGRVMMALAVDVSRFEGVPMAPPDPILGVSEAFKADKNDLKLNLGVGAYRTEELQPYVLNVVKKAEKLMLEKGDNKEYLPIEGLAAFNKATAELLLGADNPVIKQGLVATIQSLSGTGSLRLAAAFIQRYFPEAKVIISSPTWGNHKNIFNDARVPWSEYRYYDPKTVGLDFEGMIADIEAAPEGSFVLLHGCAHNPTGIDPTPEQWEKIADVIQEKKHMPFFDVAYQGFASGSLDEDAFSVRLFVKRGMEVFVAQSYSKNLGLYSERIGAINVVCSAPDIADRVKSQLKRLARPMYSNPPIHGARIVANVVGDPTMFGEWKQEMEEMAGRIKNVRQKLYDSLSAKDQSGKDWSFILRQIGMFSYTGLNKAQSDNMTDKWHVYMTKDGRISLAGLSLAKCDYLADAIIDSFHNVN

SEQ ID NO: 46310 - protein, 213 aa, Sorghum bicolor
  unsure (1)..(213): unsure at all Xaa locations
  Clone ID: SORBI-28MAY03-C5264_3.pep
MSAAEAKAAVVPESVLRKRKREEQWAADKKEKALADRKKALESRKIIFSRAKQYAQEYDAQEKELVQLKREARLKGGFYVSPEAKLLFVVRIRGINAMHPKTRKILQLLRLRQIFNGVFLKVNKATINMLRRVEPYVAYGYPNLKSVRELIYKRGYGKLNKQRIPLSNNNVIEEGLGKHNIICIEDLVHEIMTVGPHXQEAHNFLWXFKLKAP

SEQ ID NO: 46311 - protein, 245 aa, Sorghum bicolor
  Clone ID: SORBI-28MAY03-C5264_1.pep
MSAAEAKAAVVPESVLRKRKREEQWAADKKEKALADRKKALESRKIIFSRAKQYAQEYDAQEKELVQLKREARLKGGFYVSPEAKLLFVVRIRGINAMHPKTRKILQLLRLRQIFNGVFLKVNKATINMLRRVEPYVAYGYPNLKSVRELIYKRGYGKLNKQRIPLSNNNVIEEGLGKHNIICIEDLVHEIMTVGPHFKEANNFLWPFKLKAPLGGLKKKRNHYVEGGDAGNRENYINELIKRMN

SEQ ID NO: 46312 - protein, 180 aa, Sorghum bicolor
  Clone ID: LIB5050-001-R1-XP1-D10.pep
SKTLNPTDAMQLFYYLSALGSLAAVSALPLDLSETATPSRVESLGALDAGVGSVSGSGSEAPSVARIVYWPTIATAQAPLADADPATPAASPSAALTNSERIQRGLPLNAPSNLWTEKRALQPRFSDAPARTSTDTFVFKHAPTGPPAEQDAPPTPSTTPPDTESPRTEPTHNARTQSTT

SEQ ID NO: 46313 - protein, 89 aa, Sorghum bicolor
  Clone ID: LIB3480-003-P1-K1-E8.pep
MSAADAKAAVVPESVLRKRKREEQWAADKKEKALADRKNALESRKIILSRAKQYSQEYDAHEKELVQLMREALLKGGFYVSPQAKLLFV

SEQ ID NO: 46314 - protein, 88 aa, Sorghum bicolor
  Clone ID: SORBI-28MAY03-C3885_2.pep
GVRGRVGWSKSPFVVSYRGYTADACVPTGGDVGTPLSCLAGTDRWMNRQLDAAEWGTVAWAKKNYMHYNYCDDGWRFPQGFPAECSRN

SEQ ID NO: 46315 - protein, 298 aa, Sorghum bicolor
  unsure (1)..(298): unsure at all Xaa locations
  Clone ID: SORBI-28MAY03-C3885_1.pep
TGAAERGEATLAARSPAPLLAATLALLDAATVASADSWLYEKVTTDGNVRPAYDAAGPQVAPLSLYRRSGAALNAKEPYLDGEFSVQMRLSPGNSAGTVASFYLASGDADGHDEIDREFMGNATGHPVVLNTNVWANGDGKKEHQFDLWFDPAADCHTYTIIWNPTNVIFKVDDLVIRVFKRYPDLPYPGXNPLSVPPTLWDGSYWATQQGKVKVAGPNSPFVVSYRGYTADACVPTGGGDVGAPLSCPAGTDRWMNRQLDAAEWGTVAWAKKNYMHYTYCGDGWRFPQGFPAECSRN

SEQ ID NO: 46316 - protein, 115 aa, Sorghum bicolor
  Clone ID: LIB3476-053-P1-K1-H4.pep
MARPAAWTPPALSPAVAVLCLVGRSTSEEFWLDEFTTDGDVRKDYDGSGRKVASLVLDQSSGAGFNSTRKYLFCEFIVEMKLVAGNSVGTVTFLYLTSGEGDLHDEIDMDVMVNS

SEQ ID NO: 46317 - protein, 300 aa, Sorghum bicolor
  Clone ID: SORBI-28MAY03-C44181_1.pep
SARWWTSAGTPRRATCSACWPGCSSGGSRTPCRSPSRPWRRSSSSRRSASPPPTPSPRPTWTTLFPSAFEPSSSHSPSSITTTSVSLPSTVRPCSAGPGVCRTTCCWGSAVRQRSSAGGTITLRTATLRCIMRSGKNDGEKLMDWGKCRKLQWNIILLLGAGFAIADGFKASGLTDILSEALGFLRGAPVLAVAPVACVFSGVITEFTSDDATTTLVLPLLAELGKSIGVHPLLLMVPGAVGAQLSYLLPTGSPGNVVGFSTGYITIRDMVVTGTPLKIVGVAALTILLPTLGSLVFGMA

SEQ ID NO: 46318 - protein, 228 aa, Sorghum bicolor
  Clone ID: SORBI-28MAY03-C747_1.pep
MATQISKKKKFVSDGVFYAELNEMLTRELAEDGYSGVEVRVTPMRTEIIIRATRTQNVLGEKGRRIRELTSVVQKRFNFPENGVELYAEKVVNRGLCAIAQAESLRYKLLGGLAVRRACYGVLRFVMESGAKGCEVIVSGKLRAQRAKSMKFKDGYMISSGQPVNEYIDSAVRHVLLRQGVLGIKVKIMLDWDPKGKVGPITPLPDLVTIHTPKDEDELRPPVLAPEV

SEQ ID NO: 46319 - protein, 449 aa, Sorghum bicolor
  unsure (1)..(449): unsure at all Xaa locations
  Clone ID: SORBI-28MAY03-C7303_1.pep
MDRAELTTEQVLKQDIPWKPYMSPKLVSGTYLYMLRRYDHKPXSQRSPLHEENAQAYLRLFLNNHRPISDQVSLENVLALTDEMPTTNAKPAAQVYDQALPDEDVHXLTKGCLVKVIRFFPEAGCGXLTAVLRERTSLLFSSIPTGPASHNNCRLTKIHGVFLSSISYCYLXLRSIVHGLVDSFHCLSTLLREPYVRTCTRQADGIKLLIPLISPASTQQSIQLLYETCLCIWLLSFYDAAVDYLSTTRVMPRLVEVVKGSTKEKVVRVVVLSFRNLLAKGAFAAQMIDLGLPQIVQNLKAQAWTDEDLLDALNQLEVGLKENLKKLSSFDKYKQQVLLGHLDWSPMHKDPSFWRENINNFEENDFQILRVLMTIIDTSSDTTALAVACYDLSQFLQYHPSGRIVVADLKAKDRVMKLMNHENTEVRKNALLCVQRLFLGAKYASFLQA

SEQ ID NO: 46320 - protein, 171 aa, Sorghum bicolor
  unsure (1)..(171): unsure at all Xaa locations
  Clone ID: LIB3476-043-P1-K1-F10.pep
SNSKSKLTSIHDVLRGLVDWLCSQLRNPTHPSCSIPTSIHCLSTLLREPYVRTLFVQADGIKLLIPLISXASTQQSIQXDYLSTTRVMPRLVEVVKGSTKEKVVRVVVLSFRNLLAKGAFAAQMIDLGLPXIVXNXKAQAWTDEDLLDALNQLEVGLXENLKKVKFFDKYK

SEQ ID NO: 46321 - protein, 111 aa, Sorghum bicolor
  Clone ID: SORBI-28MAY03-C66801_1.pep
MPATTNPAYGVAEPLLHGKRYCWWLRWLLVIVVGLAAMYVPNFTDFLALVGSSVCVLLGFVLPASFHLKVFGGEMEWPGVVSDVLLVVIGLLLAVFGTYTSLLQIFHSSSA

SEQ ID NO: 46322 - protein, 518 aa, Sorghum bicolor
  Clone ID: SORBI-28MAY03-C15334_1.pep
MEEYSDRGSKAEIAYLRRGSRFSSRNQSSEERTNNHSSDKPGSSTRFNPMKARIGDNQERPRYVRDSFKSSSSKVAPASSSKFPLSKFEERRRQPFLPGFDNAGSSRRKVDAKRLVGSKKIAVDNESSDTLQGESEGFTTEQVPYPEGSHFTGHSGVSSYTVKSLVQTASLSSRTQRQKHKEVNMGTPGACSSSLTNGSSIPGNSTMGVRPAYGHVSGGQVRGLKNLGCTSVPDAQPSGCPSESVSSRRFEFMRKRAFDQENSSRSRSLSLGLSPPTDIHNTGHRIRMNEQSLSQQIPQRSSRNHQEPAVSVRTRRPSPHATRMSVPDERADGMLSLHESPTRNVQPAQEHLSLEEVSTESSIRPFFVEFDNNIFSSSRRRCSNTRAERQLLVLETNLFFGAFASYDRHRDMRMDIDNMSYEELLALEERIGSVSTALSEEQFTKCLRRSIYSQVASEVSKSTVDDMKCSICQEEYMEGEEVGRLPCEHWYHVCCIGQWLRQKNWCPVCKASAVPSKG

SEQ ID NO: 46323 - protein, 301 aa, Sorghum bicolor
  Clone ID: SORBI-28MAY03-C5532_1.pep
SSQLNVIIRVIEGKAHTNFQQRPAMDSWMPMGRRETDFKDSRSAFKDARTASQSFRDTQGFFMQAYDDNHHRLSFNNQFQDQGSAHRFADPYFYMAQQPSLTVESSTRTQTANNDLRFWGDQNSIYGNPGDQQQQGFSFGQNPSSWLNQPFPQVEQPRVVRPHATVAPFDLEKTREGSGFKIFGFQVDTTSPSPAQLSSPLCAIREHVVQTRPSAPVNELQPVQNECLPEGSVSTAGTATENEKNIQQAQQSSKDIQSKSQGASTRSCTKVLWQKVTIDDSLIVPGASVPTKLILKSFACP

SEQ ID NO: 46324 - protein, 197 aa, Sorghum bicolor
  Clone ID: LIB3478-056-Q6-K1-C11.pep
EPASSPPVNPLPLSSRVKRPRQNAPPPSPEASVLTKESAAKIDIDSAQTQHQNSVLQGQEQMTLRNNLTESNDSDSTVQKPMMWSPSPNGKAHTNFQQRPAMDSWMPMGRRETDFKDSRSAFKDARTASQSFRDTQGFFMQAYDDNHHRLSFNNQFQDQGSAHRFADPYFYMAQQPSLTVESSTRTQTANNDLRFWG

SEQ ID NO: 46325 - protein, 689 aa, Sorghum bicolor
  Clone ID: SORBI-28MAY03-C185_1.pep
MAPPSVSSSHLLITASLPKPKPSSLRPPRLPLAKPLPTGAALLALAASPALAADAPTPAPVPPAPAPAPELQAEAPTPTANPFSTSLLTAPKPSAAASDLPEGAQWRYSEFLSAVKRGKVERVRFTKDGGLLQLTAVDGRRATVVVPNDPDLIDILATNGVDISVSEGESAGPGGFVAFVGNLLFPFLAFAGLFFLFRRAQGGPGAGPGGLGGPMDFGRSKSKFQEVPETGVTFLDVAGADQAKLELQEVVDFLKNPDKYTALGAKIPKGCLLVGPPGTGKTLLARAVAGEAGVPFFSCAASEFVELFVGVGASRVRDLFEKAKAKAPCIVFIDEIDAVGRQRGAGLGGGNDEREQTINQLLTEMDGFAGNSGVIVLAATNRPDVLDSALLRPGRFDRQVTVDRPDVAGRVKILEVHSRGKALAKDVDFEKIARRTPGFTGADLQNLMNEAAILAARRDLKEISKDEISDALERIIAGPEKKNAVVSEEKKRLVAYHEAGHALVGALMPEYDPVAKISIIPRGQAGGLTFFAPSEERLESGLYSRSYLENQMAVALGGRVAEEVIFGQENVTTGASNDFMQVSRVARQMVERFGFSKKIGQVAIGGPGGNPFLGQQMSSQKDYSMATADVVDAEVRELVEKAYSRATQIITTHIDILHKLAQLLIEKETVDGEEFMSLFIDGQAELFVA

SEQ ID NO: 46326 - protein, 89 aa, Sorghum bicolor
  Clone ID: SORBI-28MAY03-C19465_1.pep
MEGKSRLPEVTIVPAARPLAGDGTIDAAKAAAAPGKEPISPGTPSSADAGRRGKERRAVEAVPLPGWKLDALCQESCPSPTMRARFPYF

SEQ ID NO: 46327 - protein, 336 aa, Sorghum bicolor
  Clone ID: SORBI-28MAY03-C14310_1.pep
MAFLNMEQQTWAFTFGILGNIISLMVFLSPLPTFYRVYRKKSTEGFQSTPYVVTLFSCMLWIFYALLKSGAELLVTINGVGCVIETVYLGMYLLYAPKAARVLTAKMLLGLNVGVFGLVALVTMVLSNGGLRVKVLGWICVSVALSVFAAPLSIMRQVIRTKSVEFMPISLSFFLVLSAVIWFAYGALKKDVFVAAPNVLGFVFGLAQMALYMAYRNKKPAAAAVIMVEEVKLPAEQYASKEVAPPAAAHEGSRASCGAEVHPIDIDTLPVADVGRHHDSQAVVVIDVDVEPAATCAAAAAAAGGVRGDGAAGVVTAGPEQPAAMKPVDMAIAVEA

SEQ ID NO: 46328 - protein, 113 aa, Sorghum bicolor
  Clone ID: SORBI-28MAY03-C1286_2.pep
MAAPKGATLALAVLLAATVVAPPAAVRAAMSCSTVYSTLMPCLPFVQMGGIRSLLAQANNTPDRRTICGCLKNVANGANGSDTYINRAAALPSKCGVSLPYKISTNVNCNTIN

SEQ ID NO: 46329 - protein, 123 aa, Sorghum bicolor
  Clone ID: SORBI-28MAY03-C1286_1.pep
MAAPKGATLALAVLLAATVVAPPAAVRAAMSCSTVYSTLMPCLPFVQMGGAMPPQPCCGGIRSLLAQANNTPDRRTICGCLKNVANGANGSDTYINRAAALPSKCGVSLPYKISTNVNCNTIN

SEQ ID NO: 46330 - protein, 62 aa, Sorghum bicolor
  Clone ID: LIB5052-002-A1-XP1-C4.pep
FQLSLIFHFLNHSNFFFFFFFFFFFFFFSKTTRGYIWIEAPTHYIEITQQGTPAHTSSAARP

SEQ ID NO: 46331 - protein, 330 aa, Sorghum bicolor
  Clone ID: SORBI-28MAY03-C4298_1.pep
MAMAALRREGRRILLSPTVPNPSPAAASAAVTRSSAISQPEMAPLGARSISTQVVRNRMKSVKNIQKITKAMKMVAASKLRAVQTRTENSRGLWEPFTALLGDAPSVDVKKNVIVAITSDKGLCGGINSTSVKVSRALHKLTSGPEKESKFVILGEKGKVQLVRDSRNSIEMTVTELQKNPINYTQIAVLADDILKNVEYDALRVIFNKFHSVISFKPTMVTILSPEVAEKESEAGGKMGDLDSYEIEGGETKSEILQNLAEFQFSCVLYNGALENACSELGARMSAMDSSSRNAGDMLDRLTLTYNRTRQASITTELIEIISGASALEG

SEQ ID NO: 46332 - protein, 384 aa, Sorghum bicolor
  unsure (1)..(384): unsure at all Xaa locations
  Clone ID: SORBI-28MAY03-C2086_1.pep
MALQAALLPSTLSVPKKGSLAAAVKDTAFLSVPQKKLQAASLSVRTQVATAPVATPGSSTATKDGKKTVRQGVXVITGASSGLGLAAAKALAETGKWHVVMACRDFLKAARAAKGAGMADGSYTIMHLDLASLDSVRQFVENVRQLEMPIDVVVCNAAVYRPTATDPSYTADGFEMSVGVNHLGHFLLARELLSDLQSSDYPSKRLIIVGSITGNTNTLAGNVPPKANLGDLRGLAGGLNGIGSSVMIDGGEFDGAKAYKDSKVCNMLTMQEFHRRYHEETGVTFASLYPGCIATTGLFREHIPLFRLLFPPFQKYITKGYVSEEEAGKRLAQVVSDPSLTKSGVYWSWNKNSASFENQLSEEASDSDKAKKLWEISEKLVGLA

SEQ ID NO: 46333 - protein, 78 aa, Sorghum bicolor
  Clone ID: LIB3476-046-P1-K1-C5.pep
MALQAATSFLPSALSARKEGSVKDSAFLGVRLADGLKLETTALGLRTKRVSTSVAIRAQTAAVSFPSVTPASPSGKKT

SEQ ID NO: 46334 - protein, 188 aa, Sorghum bicolor
  Clone ID: SORBI-28MAY03-C5953_1.pep
MGIDLVAGGRNKKTKRTAPKSDDVYLKLLVKLYRFLVRRTKSNFNAVILKRLFMSKTNRPPISLRRLVKFMEGKEEKNIAVIVGTVTDDKRIQEVPAMKVTALRFTETARARIVNAGGECLTFDQLALRAPLGENTVLLRGPKNAREAVRHFGKAPGVPHSHTKPYVRSKGRKFEKARGRRNSRGFKV

SEQ ID NO: 46335 - protein, 102 aa, Sorghum bicolor
  Clone ID: SORBI-28MAY03-C5395_3.pep
MYRWGDIEFPLPFGRVLSPSESFIHELDEKTSASLKFTVLNPKGRIWTMVAGGGASVIYADTGGDLGYASELGNYAEYSGAPKEGEVLQYARVLLDCATGDP

SEQ ID NO: 46336 - protein, 422 aa, Sorghum bicolor
  Clone ID: SORBI-28MAY03-C5395_1.pep
MARKKIREYDSKRLLREHLKRLAGIDLQILSAQVTQSTDFTELANQEPWLSSMKLVVKPDMLFGKRGKSGLVALNLDLAQVRQFVKERLGVEVEMGGCKAPITTFIVEPFVPHDQEYYLSIVSERLGSTISFSECGGIEIEENWDKVKTIFLPTEKQMTPDACAPLIATLPLEVRTKIGGFIRGVFSVFQDLDFSFLEMNPFTLVNGEPYPLDMRGELDDTAAFKNFNKWGDIEFPLPFGRVLSPSESFIHELDEKTSASLKFTVLNPKGRIWTMVAGGGASVIYADTVGDLGYASELGNYAEYSGAPKEEEVLQYARVLLDCATADPDGRKRALLIGGGIANFTDVAATFNGIIRALREKESKLKAARMNIYVRRGGPNYQTGLAKMRTLGTELGVPIEVYGPEATMTGICKEAIDCIMAA

SEQ ID NO: 46337 - protein, 150 aa, Sorghum bicolor
  unsure (1)..(150): unsure at all Xaa locations
  Clone ID: LIB3476-021-P1-K1-B2.pep
LPEGGSARAGIDLQILSAQVTQSTDFTELANQEPWLSSMKLVVKPDMLFGKRGKSGLVALNLDLAQVRQFVKERLGVEVEMGGCKAPITTFIVEPFVPHDQEYYLSIVSERLGSTISFSECGGIEIEENWDXXKTIFLPTEKQMTPDACA

SEQ ID NO: 46338 - protein, 310 aa, Sorghum bicolor
  unsure (1)..(310): unsure at all Xaa locations
  Clone ID: SORBI-28MAY03-C1288_1.pep
MKVTVVSRSGREVVKGGIDLKDSAKVADLQEAIHARTKKYYPSRQRLTLPLQPGKGGKPVVLNPRASLSEYCEKGSGSLTVVFKDLGTQVYYSTLFFFEYLGPLIIYPMFYYLPVYKYFGYEGERIIHPVQTYAMYYWCFHYFKRIMETFFVHRFSHATSPXSNVFMGMGDHRTFGAYIAYYCNHPLYTPVSDLQMKIGFGFGIICQIANFYCHILLRNLRSPSGSGGYQIPRGFLFNIVTCANYTTEIYQWVGFNIATQTVAGYIFLIVAAAIMTNWALGKHSRLKKLFDGKDGRPKYPRRWVILPPFL

SEQ ID NO: 46339 - protein, 94 aa, Sorghum bicolor
  unsure (1)..(94): unsure at all Xaa locations
  Clone ID: LIB3481-019-P1-K1-G10.pep
RPEAHRCFNKELKIGQRMMTISTVGVPNTXKMLASHKLQSTLAVSLHAPNQKLRETIVPSAKSYPLGALMDDCKKYFLETGRRVSFEYTLLAGI

SEQ ID NO: 46340 - protein, 492 aa, Sorghum bicolor
  Clone ID: SORBI-28MAY03-C5552_1.pep
CKLCFFRTSLSFTEVEVLGKTSHVDARLPSSSDTAVIMYTSGSTGLPKGVMITHGNMVATTAAVMTIVPNLGKNDVYLAYLPLAHVFELAAETVMLASGTAIGYGSALTMTDTSNKIKKGTKGDVSVLNPTLMISVPAILDRIRDAVFKKVGEKGGLTKKLFDFAYKRNLAAIEGSWFGSWAPERMIWDNIIYKPIRAMLGGRVRFVLCGGAPLSSDTQRFMNICLGVPVGQGYGLTETCAGAAFTEWDDTSVGRVGPPLPCSYVKLVSWEEGGYRISDSPMPRGEVVVGGHSITKGYFNNEAKTNEVYKVDERGIRWFYTGDIGQFHPDGCLEIIDRKKDIVKLQHGEYVSLGKVESALATSNYVENIMVYADPFHSYCVALVVPAHQALEKWAQNSGINYKGFEELCQNDQANKEVQQSLSKAAKAARLEKFEVPAKIMLLPEPWTPESGLVTAALKLKREQIKTKFNFTPVYGQCSFSLMSYDMTLRIV

SEQ ID NO: 46341 - protein, 108 aa, Sorghum bicolor
  Clone ID: LIB3476-007-P1-K1-G5.pep
VYADPFHSYCVALVVPAHQALEKWAQNSGINYKGFEELCQNDQANKEVQQSLSKAAKAARLEKFEVPAKIMLLPEPWTPESGLVTAALKLKREQIKTKFKDDLDKLYH

SEQ ID NO: 46342 - protein, 550 aa, Sorghum bicolor
  Clone ID: SORBI-28MAY03-C1340_1.pep
MALYLLFESASGYGLFHAYGIDEIGQSVEAVRSSVLDLDRFGKAVKLTAFNPFSSAVDALNQCNAISEGIMTDELRSFLELNLPKPKEGKKAKYSLGVVEPKVGSHISEVTGIPCQSNEFVQELLRGVRLHFDRFINELKDSDLEKAQLGLGHSYSRAKVKFNVNRVDNMVIQAIFLLDTLDKDINSFSMRVREWFSWHFPELVKIVNDNYLYAKLAKFIVNKSDLAEKDIPALADIVGDEDKAKEIVEAAKASMGQDLSPVDLINVQQFAQRVMNLSEYRKNLYEYLVTKMNDIAPNLTSLIGEVVGARLISHAGSLSNLAKCAASTLQILGAEKALFRALKTKGNTPKYGLIFHSSFIGRASTKNKGRMARYLANKCSIASRIDCYSEASTSVFGQKLREQVEERLEFYDKGVAPRKNLDVMKAAIDSMVNDTSMDDDNHKTDASAKKSKKKKTKAEADGDAMDVDKPSHVADGEAEPGTEKKKKKKKHKLEEAQEENGAAHANGGAEETETPKKKKKKSREVSEEAEPKTATEGKKKKKKAKAEDDE

SEQ ID NO: 46343 - protein, 417 aa, Sorghum bicolor
  Clone ID: SORBI-28MAY03-C1405_1.pep
MAICSAHTTTTSLHSPCTTTVSNAAGFRQRQVIFFTSSSNRRSCGGGGGGRRHHGGARTSCFQVSCSVDKPVVIGLAADSGCGKSTFMRRLTSVFGGAAVPPKGGNPDSNTLISDTTTVICLDDYHSLDRNGRKEYGVTALDPRANNFDLMYEQVKAIKDGQAVEKPIYNHVTGLLDPPELITPPKIFVIEGLHPMFDQRVRDLLDFSIYLDISDEVKFAWKIQRDMAERGHSLESIQASIEARKPDFDAYIDPQKQYADAVIEVLPTQLIPGDNEGKVLRVKLIMKEGVKFFNPVYLFDEGSSISWVPCGRKLTCSYPGIKFAYGPDTYFGKEVSVLEMDGQFDKLDELIYVESHLSNLSTKFYGEVTQQMLKHADFPGSNNGTGLFQTIIGLKIRDLYEQIVAERAGVPAEAAKV

SEQ ID NO: 46344 - protein, 347 aa, Sorghum bicolor
  Clone ID: SORBI-28MAY03-C9288_1.pep
MMSGSRVLFVVAAAVGVLLAAAAVSSRPVVVPLATGRPGAGGNDELSVYFHVESCPQLETIVRSAVDAALQQNVRLTAGLLRVFFHDCFPQGCDASILLDNGERGLPPNVGLQQEAVQLVEDIRAKVHAACGPTVSCADITVLATRDAVSLSGGPSFTVPLGRLDSVAPASSNDVFTLPPPTSTVDALLSAFASKNLSDPADLVALSGAHTVGKARCSSFGDVAGPATDDITRCVTATCSAAGAGDTLRDLDFLTPAVFDNLYFIELTLKKNKGVMLPSDQGLATDPRTSWLVQGFADNHWWFFDQFGTSMVKMSQLKGPQGNVGEIRRNCLRPNTNSDVDIAAATA

SEQ ID NO: 46345 - protein, 591 aa, Sorghum bicolor
  unsure (1)..(591): unsure at all Xaa locations
  Clone ID: SORBI-28MAY03-C3102_1.pep
AWTGRRTSGRWTSDCTRGSGSSGRSGTPSSPSPSRPPRRRAATTSTPSRTGTRAAPACASQSAPGVCSAPLARSSGEGASKFLNEQITKAVVTXVPAYFNDSQRTATKDAGRIAGLEVLRIINEPTAASLAYGFEKKNNETILVFDLGGGTFDVSVLEVGDGVFEVLSTSGDTHLGGDDFDKRIVDWLASNFKKDEGIDLLKDKQALQRLTEAAEKAKMELSTLTQANISLPFITATADGPKHIEATLSRAKFEELCSDLIDRLKTPVNNALRDAKLSVSDLDEVILVGGSTRIPAVQELVRKLTDKDPNVTVNPDEVVSLGAAVQGGVLAGDVKDVVLLDVTPLSLGLETLGGVMTKIIPRNTTLPTSKSEVFSTAADGQTSVEINVLQGEREFVRDNKSLGSFRLDGIPPAPRGVPQIEVKFDIDANGILSVAAIDKGTGKKQDITITGASTLPKDEVERMVEEADKFAKEDKEKRDAIDTKNQADSVVYQTEKQLKELGDKVPAPVKEKVDVKLQELKDAISGGSTQSMKDAMAALNQEVMQIGQAMYNQPGASAAGPTPGAEAGPTPGTGPAQNDGDVIDADFTDSN

SEQ ID NO: 46346 - protein, 70 aa, Sorghum bicolor
  Clone ID: LIB3481-018-P1-K1-B2.pep
LRFIYTLQRPFSLLDSETNISLYNTGELKPRHSSFLRHDLCSSIRFPCRDVSIASVYASTITWPQSPSLS

SEQ ID NO: 46347 - protein, 449 aa, Sorghum bicolor
  Clone ID: SORBI-28MAY03-C38928_1.pep
RDSWKGSEGSREKRRRGETRGSELEEMESPRSPEAEIGHRVEDLWEVAEPQLSPSEKLNSCFEDIPVASFPRTHPSQVIEIPSDASLAETVEILSKNKILSAPIRNVEAPEDASWMDKYIGIVEFAGIAMWLLSQSDAAVNGTVGSGAGSPVSNLVSRLGSFTFSRTSSGRVETATDSESDEAASVGGSFFETLTSSEFYKNTKVGDISGSFRWAPFLALQTSDTFLTMLLLLSKYRMKSLPVVEVGGDKIENIITQSSVVHMLAECVGLSWFESWGTKKLSELGLPIMKPSKLVKVNEDQPVLKAFQLMREKGVGGLPVMDTSGAKAIGNISIRDVQYLLTAPKIYKEHRSITTKDFLSAVRHHLQEQCEASPLLHDVITCKKDDTIKDIILKLDSEKIHRIYVVDDKGNTEGVITLRDIISKLVHEPRHYFGDFFDGVVPLPANSTV

SEQ ID NO: 46348 - protein, 221 aa, Sorghum bicolor
  Clone ID: SORBI-28MAY03-C45579_1.pep
MGVAMAIRTVVLLPAVLTLLSFLLLPLASLALTQDFCVADLTCSDTPAGYPCKSSVTANDFYYHGLAGQGKINPLIKAAVTPAFVGQFPGVNGLGISAARLDIEVGGVVPLHTHPAGSELLFVTQGTVAAGFISSGSNTVYTKTLYAGDVMVFPQGLLHYQYNAGTGPAVGLVAFSSSNPGLQITDFALFANNLPSAVVEKVTFLDDAQVKKLKSVLGGSG

SEQ ID NO: 46349 - protein, 362 aa, Sorghum bicolor
  Clone ID: SORBI-28MAY03-C44757_1.pep
MAARLAVAFLAVSSAFLAVSGQKFNAIFSFGDSMSDTGNLCVNGPPAGLTLTQPPYGETFFGRATCRCSDGRLVVDFLAEKFGLPLLKPSKQGGSDFKQGANMAIIGATTMDSGFFQSLGIGDKIWNNGPLNTQIQWFQQLMPSICGSTQACKSYLSKSLFVLGEFGGNDYNAQIFGGYTPEQASGQSGTIVDAIGKGVEQLISLGAMYVVVPGVLPVGCFPIYLTLYQTSNAGDYDQYGCLKRFNALSANHNSLLQSKVSSLQAKYPGARIMYADFYSHVYDMVKSPGSYGFSTNLRACCGAGGGKYNYQNGARCGMSGAYACSNPSSSLSWDGIHLTEAAYKKIADGWVSGAYCHPAISA

SEQ ID NO: 46350 - protein, 222 aa, Sorghum bicolor
  unsure (1)..(222): unsure at all Xaa locations
  Clone ID: SORBI-28MAY03-C346_2.pep
IVACNLLPQALQDVLRIQIHGVLNGISSCGRRQECIDSNLFVLILPNLFQCDLLNMPAVSQLEKDEKYQLVYELLKIFLTKRLDSYLEFQTANSALLKXYGLVHEECVTKMRLMSLLDLSSRCSGEIPYSAITVELRINDDEVEQWIVKAIASKILDCKIDQLNQTVIVSRHMERIFGMAQWHGLRTKLGVWRGNIASAINTIQANKVTEEGTQGMQGLMIR

SEQ ID NO: 46351 - protein, 210 aa, Sorghum bicolor
  Clone ID: SORBI-28MAY03-C346_1.pep
IITICCIQNYGSSNLPPEVSISSLSRRSVAAHPWHDLEIGPGAPAVFNVVVEITKGSKVKYELDKKTGLIKVDRVLYSSVVYPHNYGFIPRTLCEDNDPMDVLVLMQEPVIPGSFLRARAIGLMPMIDQGEKDDKIIAVCADDPEYRHYNDISELSPHRLQEIKRFFEDYKKNENKEVAVDAFLPATTARDAIQYSMDLYAQYILQSLRQ

SEQ ID NO: 46352 - protein, 267 aa, Sorghum bicolor
  Clone ID: SORBI-28MAY03-C17380_1.pep
MAAKIFSLVMLLALFASAATATYIPQPHCSQISIAAPHPAYLPPVCANPMLQPYGLQQAIAASILQSSPLFIQQPSALLQQLSLVNLLAQSIRAQQLQQLVLPSINQVTVANLAAYSQQQQFIPFSQLAAVNPAAYLQLQQLQQFSQLAAASPAAFWPQQQLLPFYPQGVANAATLLQLQQLLSFNQLAAVNPAAYLQLQQLLQFSRLGAVSPATFWPQQQLLRFYPQGVANAATLFQQQQLLPFIQLALANPATSCQQPFIGGALF

SEQ ID NO: 46353 - protein, 181 aa, Sorghum bicolor
  Clone ID: LIB5050-004-R1-XP1-F5.pep
MAAKIFSLIMLLALFASAATATYIPQPHCSQISIAAPHPAYLPPVCANPMLQPYGLQQAIAASILQSSPLFIQQQLLPFYPQGVANAATLLQLQQLLPFNQLAAVNPAAYLQLQLLLQFSQLGAVSPATFWPQQQLLPFYPQGVANAATLFQQQQLLPFIQLALANPATSCQQPFIGGALF

SEQ ID NO: 46354 - protein, 746 aa, Sorghum bicolor
  unsure (1)..(746): unsure at all Xaa locations
  Clone ID: SORBI-28MAY03-C5944_1.pep
MCFMMDPALGRKTCYVQFPQRFDGIDMHDRYANRNIVFFDINMKGLDGIQGPVYVGTGCCFNRQALYGYDPVLTEADLEPNIVVKSCCGRRKKKNKSYMDSQSRIMKRTESSAPIFNMEVIEGRAMKSEYEEFKVRINALVAKAQKVPEEGWTMADGTAWPVNTPTDHPGMIQVFLGHSGGLDTDGNELPRLVYVSREKRPGFQHHKXGACLRGSAVLTNGAYLLNVDCDHYFNSSKALREAMCFMMDPALGRKTCYVQFPQRFDGIDSHDRYANRNIVFFDINMKGLDGIQGPVYVGTGCCTRPPTRPGTRPVLTEADLEPNIVVKSCCGRRKKKNKSYMDSQSRIMKRTESSAPIFNMEDIEEGIEGYEDERSVLMSQRKLEKRFGQSPIFIASTFMTQGGIPPSTNPASLLKEAIHVISCGYEDKTEWGKEIGWIYGSVTEDILTGFKMHARGWQSIYCMPPRPCFKGSAPINLSDRLNQVLRWALGSVEILLSRHCPIWYGYNGRLKLLERLAYINTIVYPITSIPLIAYCVLPAICLLTNKFIIPEISNYAGMFFILLFASIFATGILELRWSGVGIEDWWRNEQFWVIGGTSAHLFAVFQGLLKVLAGIDTNFTVTSKASDEDGDFAELYVFKWTSLLIPPTTVLVINLVGMVAGISYAINSGYQSWGPLFGKLFFSIWVILHLYPFLKGLMGRQNRTPTIVIVWSILLASIFSLLWVKIDPFISPTQKAAALGQCGVNC

SEQ ID NO: 46355 - protein, 551 aa, Sorghum bicolor
  Clone ID: SORBI-28MAY03-C77_1.pep
MAARRAASSVLSRFLLTRPSPSPSPASAASPAGKSALLGAGGPLHRFSTAPAAAAATAEEPIQPAVEVKHTQLLINGNFVDAASGKTFPTLDPRTGEVIARVAEGDSEDIDRAVAAARRAFDEGPWPRMTAYERCRVLLRFADLIERHAEEIAALETWDNGKTLAQAAGAEVPMVARCIRYYAGWADKIHGLVVPGDGAHHVQVLHEPVGVAGQIIPWNFPLLMFAWKVGPALACGNTVVLKTAEQTPLSALYVANLLHEAGLPEGVLNVVSGFGPTAGAALCSHMGVDKLAFTGSTGTGQIVLELAARSNLKPVTLELGGKSPFVVMDDADVDQAVELAHQAVFFNQGQCCCAGSRTFVHERVYDEFVEKSKARALKRVVGDPFRNGVEQGPQIDGDQFNKILRYVQSGVDSGATLVTGGDRVGSRGFYIQPTVFADAKDDMKIAREEIFGPVQTILKFSGMEEVIRRANATHYGLAAGVFTRSLDAANTLSRALRAGTVWVNCYDVFDATIPFGGYKMSGVGREKGVYALRNYLQTKAVVTPIKDPAWL

SEQ ID NO: 46356 - protein, 415 aa, Sorghum bicolor
  Clone ID: SORBI-28MAY03-C796_1.pep
MEAAVAAALRSPTAAGPSRRSAAPGPSSLPFDRRRSFAFGSIKGLGRQQLTSRTRRRSSVVRASWSPSESLPPSSSIAPLRMESPAGQLLSQILHTHPHLLSAAAEQQLEQLQTDREAEKEKEKESEAGDKSTPTGGDLVLYRRIAEVKEKERRRTLEEILYALVVQKFVEADVSLVPALSHSIDSSGRVDQWTETVEEKLQRLHSPEAYEMIENHLSLILGQRQGDATIAAISKLRVGQVYAASVMYGYFLKRVDQRFQLEKTMKSLPWGSEEEDSALNQVMTTDSMPSARVSSSHPEMGSWTAPDFNAGGPSQSIKPSRLRSYVMSFDSDTLQRYATVRSKEAFGIIEKHTEALFGKPEIVITPEGAVDSSKDEHIRISFSGLRRLILEAVTFGSFLWDVESFVDSRYHFVTN

SEQ ID NO: 46357 - protein, 123 aa, Sorghum bicolor
  Clone ID: LIB3478-020-P1-K1-H2.pep
LPDITSSSSSPSSSIAPLRMESPAGQLLSQILHTHPHLLSAAAEQQLEQLQTDREAEKEKEKESEAGDKSTPTGGDLVLYRRIAEVKEKERRRTLEEILYALVVQKFVEADVSFVPTLSHSID

SEQ ID NO: 46358 - protein, 201 aa, Sorghum bicolor
  Clone ID: SORBI-28MAY03-C10252_1.pep
MAMATQASAATRHLLAAAWAKPRQLSSQLAMPSSRGPAPLRASDDGPAAAAVTEEAPKGFVPPQLDPNTPSPIFGGSTGGLLRKAQVEEFYVITWTSPKEQVFEMPTGGAAIMREGPNLLKLARKEQCLALGTRLRSKYKINYQFYRVFPNGEVQYLHPKDGVYPEKVNAGRQGVGQNFRSIGKNVSPIEVKFTGKESFDI

SEQ ID NO: 46359 - protein, 398 aa, Sorghum bicolor
  Clone ID: SORBI-28MAY03-C1511_1.pep
MAVLQVAAAAPPPVSAIGFEGYEKRLEISFSEAPVFADPNGRGLRALSRDQIDSVLDLARCTIVSELSNEDFDSYVLSASSLFVYPYKMVIKTCGTTKLLLAIPRILELAKELSLPLSAVKYSRGTFIFPDAQPSPHKNFADEVAFLNRFFGGLKSGGNAYVIGDSAKPGQKWHVYYASEHPEEPVVTLEMCMTGLDKKKASVFFKTSADGYTSCAKEMTKLSGISDIIPEMEICDFDFEPCGYSMNAVHGPAFSTIHVTPEDGFSYASYEVMGFNPGSSSYGDLVKRVLRCFGPVEFSVAVTIFGERDNAKTWGKKLEAEAYACSNMVEQVLPSGGLLIYQSFTATGAATPGSPRSVLHDFAGDIVKPGDSGEADGPCWEADAVDESEEREVKKMKC

SEQ ID NO: 46360 - protein, 221 aa, Sorghum bicolor
  Clone ID: SORBI-28MAY03-C1099_1.pep
MALPNQGTVDYPSFKLVIVGDGGTGKTTFVKRHLTGEFEKKYEPTIGVEVHPLDFTTNCGKIRFYCWDTAGQEKFGGLRDGYYIHGQCAIIMFDVTSRLTYKNVPTWHRDLCRVCENIPIVLCGNKVDVKNRQVKAKQVTFHRKKNLQYYEISAKSNYNFEKPFLYLARKLAGDPNLHFVEAVALKPPEVTIDMAMQQQHEAELAAAAAQPLPDDDDDLIE

SEQ ID NO: 46361 - protein, 75 aa, Sorghum bicolor
  Clone ID: LIB5052-001-A1-XP1-C4.pep
PAGLRKFCQSNYNFEKPFLYLARKLAGDPNLHFVEAVALKPPEVTIDMAMQQQHEAELAAAAAQPLPDDDDDLIE

SEQ ID NO: 46362 - protein, 192 aa, Sorghum bicolor
  Clone ID: SORBI-28MAY03-C17501_1.pep
MKMVIVLAVCLALSAASASALQMPGMGLQDLYGAGALMTMMGAGGGLYPCAEYLRQPQCSPVAAPFYALREQTMWQPNFICQPLRQQCCQQMRMMDMQSRCQAMCGVVQSVVQQLQMTMQLQGVAAASSLLYQPALVQQWQQLLPAAQALTPLAMAVAQVAQNMPAMCGLYQLPSYCTTPCATSAAIPPYYY

SEQ ID NO: 46363 - protein, 344 aa, Sorghum bicolor
  Clone ID: SORBI-28MAY03-C17324_1.pep
MANQAPPVPRVKLGTQGFEVSKLGFGCMGLTGAYNSPLDDEAGIAVITHAFSRGITFFDTSNVYGPLTNEILLGKALKQLPREQVQVATKFGILRDESGNRTVCGRPEYVRACCEASLRRLDIDCIDLYYQHRIDTTIPIEETIGELKKLVEEGKVKYIGLSEASPDTIRRAHAVHPITAVQMEWSLWSRDIEPEIVPLCRELGIGIVPYSPLGRGFFGGRGVKEQVSAESVLHGIPRFAPENLEKNKQIYLRMEELANKHQCSPTQLALAWVLHQGNDVVPIPGTTKIKNLDSNIDSLKVKLTDEDLKEMGSQIREEDVAGGRQFASFEHATWKYADTPKKQS

SEQ ID NO: 46364 - protein, 190 aa, Sorghum bicolor
  unsure (1)..(190): unsure at all Xaa locations
  Clone ID: LIB5049-012-R1-XP1-E1.pep
MANQAPPVPRVKLGTQGFEVSKLGFGCMGLTGAYNSPLDDEAGIAVITHAFSRGITFFDTSNVXTAPLTKRKFPPSGKRGAFKKKNFLPRREKKKKGVGGGAPPPTPWFFFFFLEEKNHPRGGGGGEKIYPVLGGKTHPPPPPGEGFFYPTPGGGGNNPFPRGKKGGGGIKKKGGGGGGGEKKFFFFFFC

SEQ ID NO: 46365 - protein, 467 aa, Sorghum bicolor
  Clone ID: SORBI-28MAY03-C398_1.pep
MASAAMLRSAARSLRLRLRQPLEQQRCLQARQILSSSAPTEALGLQRSSTHARSYSSQLSATSQCSNLTRKSCYLPNPYLYQVWSRSFASDNGDKFEAVVPFMGESVTDGTLANFLKKPGDRVEADEPIAQIETDKVTIDVASPEAGVIEKLIASEGDTVTPGTKVAIISKSAQPAETHVAPSEEATPKESSTPKVEEKPKVEEKAPKVEPPKMQAPKPTAPSKMSPSEPQLPPKERERRVPMPRLRKRIANRLKDSQNTFAMLTTFNEVDMTNLMKLRSDYKDEFVTKHGVKLGLMSCFVKAAVSALQNQPIVNAVIDGDDIIYRDYVDVSVAVGTSKGLVVPVIRDADTMNFADIEKGINNLAKKATEGALSIDDMAGGTFTISNGGVYGSLISTPIINPPQSAILGMHSIVQRPVVVNGDILARPMMYLALTYDHRLIDGREAVFFLRRIKDVVEDPRRLLLDI

SEQ ID NO: 46366 - protein, 364 aa, Sorghum bicolor
  unsure (1)..(364): unsure at all Xaa locations
  Clone ID: SORBI-28MAY03-C56929_1.pep
MNTDFHMTEGEGEWSYSKNSRRQEIFFLETRPMIENAIKEVYTTLLPKTMIIADLGCSSGPNTMLFISSVINIIVEKCKSTGDDCMELQFFLNDLPGNDFNELFRSIEKFKRPNTTGERDHLPPLYYIMGLPESYYKRLFPRESVHLFHSSYCLHWRSQVPIRQNLKKYLHLLLYDHNKIQGQTNPIKCLYIQYTXYRPLGLECMPYMKEYALVFFGRKNEDVYNGDLNQLFALVARSLQSLVLKGIVEKEKLESFNLPIYGPSVGEVKELVMQSHLFNMDLIKQFEMNWDPFDDLEGDDVEDNTRSSMNIAKFIMSVLKYLIVHHFGETILDAWFAEFKCLVGEHLEKEKTKFTVIAMSLKKE

SEQ ID NO: 46367 - protein, 229 aa, Sorghum bicolor
  Clone ID: SORBI-28MAY03-C18551_1.pep
MASSLAKSSSSVLLLAAFVALFAASASVDAATFNVINRCKDTLWPAALPGGGARLDPGKTWTVQVPAGTAHARMWARTGCRFDGSGRGTCQTGDCGGALACTVSGRTPATLAEYTLNNNGPDYIDISLVDGFNVPMSFRCGGKGPSCKADVNAKCPAKLKVPGGCASACEKLGGDTYCCRGQYTDKCPPTDYSRFFKGLCLDAYSYAKDDQTSTFTCPKGSNYEIVLCP

SEQ ID NO: 46368 - protein, 195 aa, Sorghum bicolor
  unsure (1)..(195): unsure at all Xaa locations
  Clone ID: LIB5047-007-R1-XP1-C2.pep
MSQSQHPHTALQNLLVSDRLTVRTCTTVHGARLANNQQTMASSLAKSSSSVLLLAAFVALFAASASVDAATFNVINRCKDTLWPAALPGGGARLDPGKTWTVQVPAGTAHARMWARTGCRFDGSGRGTCQTGDCGGALACTVSGRTPATLAEYTLNNNGXDYIDISLVDGFNVAMSFRCGGKGPSCKADVNAKCP

SEQ ID NO: 46369 - protein, 344 aa, Sorghum bicolor
  Clone ID: SORBI-28MAY03-C7170_1.pep
MAPLNHHQVLIKKALAKKPNSTKRMTGFGLKPSAALLKSRPQQQPPAPVQPRRRVRVLFEDPDATDSDSDDEEEAAGAPTTGPATRTKLFSFEAYIGKAPAKPVLPAATVAACTSGGAPESYRGVRLRKWGKWAAEIRNPFTGKRQWLGTFDTAGAASAAYLSASRSFADEKRRRRGQAVPASASSPATSASATPTASSSSSTSTAPFAHPSPSSVLESTTKAAAPNPESPEPVATPTPVVLPPSTESAAQLPDDPEFYQDLLRGLQLPDIDPMDFRAGLDALDVSDAAFCLDDEQDLLLGDFGDEELEIDLDLDDINDVFPEMPGCDLGRGMDDFLQTVDFCV

SEQ ID NO: 46370 - protein, 119 aa, Sorghum bicolor
  Clone ID: SORBI-28MAY03-C5785_3.pep
MVQRLTYRKRHSYATKSNQTRVVKTPGGKLVYQYTKKRASGPKCPVTGKKIQGIPHLRPAEYKRSRLSRNRRTVNRPYGGVLSGIAVRERIIRAFLVEEQKIVKKVLKIQKTKDKTAAK

SEQ ID NO: 46371 - protein, 119 aa, Sorghum bicolor
  Clone ID: SORBI-28MAY03-C5785_2.pep
MVQRLTYRKRHSYATKSNQTRVVKTPGGRLVYQYTKKRASGPKCPVTGKKIQGIPHLRPAEYKRSRLSRNRRTVNRPYGGVLSGTAVRERIIRAFLVEEQKIVKKVLKIQKTKDKASKS

SEQ ID NO: 46372 - protein, 119 aa, Sorghum bicolor
  Clone ID: SORBI-28MAY03-C5785_1.pep
MVQRLTYRKRHSYATKSNQTRVVKTPGGKLVYQYTKKRASGPKCPVTGKKIQGIPHLRPAEYKRSRLSRNRRTVNRPYGGVLSGTAVRERIIRAFLVEEQKIVKKVLKLQKTKDKTSSK

SEQ ID NO: 46373 - protein, 534 aa, Sorghum bicolor
  Clone ID: SORBI-28MAY03-C836_1.pep
MGHTAAAAAVAAEPALGLTKPNAIEPPQVTFSAKDVEFSEWKGDILAVAVTEKDLSKDADSKFENAVLKKLDGQLGGLLSEAAAEEDFTGKTGQSVVLRLAGQGFKRVGLIGLGQNAPSTAAAGRGLGESVASVAKAAQASTAAIVLASPSGIQEEFKLTAAAAIASGTVLGLYEDSRYKSESKKVHLKQVDIIGLGSGADVDQKLKYANDLSSGVIFGRELVNSPANVLTPAVLAEEASKIASTYSDVFTATILDVEKCKELKMGSYLGVAAASANPPHFIHLCYKPTDGNVKRKLAIVGKGLTFDSGGYNIKTGPGCSIELMKFDMGGSAAVFGAAKALGQIKPPGVEVHFIVAACENMISGTGMRPGDIVTASNGKTIEVNNTDAEGRLTLADALVYACNQGVEKIIDLATLTGACVIALGPSIAGVFTPSDELAKEVTAASEVSGEKFWRLPLEESYWESMKSGVADMVNTGGRQGGSITAALFLKQFVDEKVQWMHIDMAGPVWNDKKRAATGFGVSTLVEWVLKNSSS

SEQ ID NO: 46374 - protein, 247 aa, Sorghum bicolor
  Clone ID: SORBI-28MAY03-C12137_1.pep
MNKKSVVLYPGLGVGHLTPMIELAKLFTQHGVAVTVALVEPPAKSPDFSTAVARAAASNPRVTFHVLPPPDPADSSSDGGTPSHHVDQMFSYLKAMNAPLRDLLRSLPAVDALVVDMFCRDALGVAAELNLPVYYFYASGASALAVFLNLPRMTTTGFLQAAAGDSVLSLPGAPPFRASELPELIRNGSATGETIFRMLHAIPEANGILVNTFESLEPRAVRALRDGLCVPDRSTPPVYCIGPLVSG

SEQ ID NO: 46375 - protein, 255 aa, Sorghum bicolor
  Clone ID: SORBI-28MAY03-C308_1.pep
MALASTSATAPAAVLKTPSFLGARRALANAAAAAKPAPRRSLVVVAAVAPKKSWIPAFKSDAEFINPPWLDGSLPGDFGFDPLGLGKDPAFLKWYREAELIHGRWAMAAVLGIFVGQAWSGIPWFEAGADPGAIAPFSFGSLLGTQLLLMGWVESKRWVDFFNPDSQSVEWATPWSRTAENFANFTGEQGYPGGKFFDPLGLAGTVKDGVYIPDVDKLERLKLAEIKHARLAMLAMLIFYFEAGQGKTPLGALGL

SEQ ID NO: 46376 - protein, 152 aa, Sorghum bicolor
  Clone ID: SORBI-28MAY03-C245_2.pep
MSTPARKRLMRDFKRLQQDPPAGISGAPHDNNIMLWNAVIFGPDDTPWDGGTFKLTLQFTEDYPNKPPTVRFVSRMFHPNIYADGSICLDILQNQWSPIYDVAAILTSIQSLLCDPNPNSPANSEAARMFSENKREYNRKVREVVEQSWTAD

SEQ ID NO: 46377 - protein, 152 aa, Sorghum bicolor
  Clone ID: SORBI-28MAY03-C245_1.pep
MSTPARKRLMRDFKRLQQDPPAGISGAPHDNNIMLWNAVIFGPDDTPWDGGTFKLTLQFTEDYPNKPPTVRFVSRMFHPNIYADGSICLDILQNQWSPIYDVAAILTSIQSLLCDPNPNSPANSEAARLFSENKREYNRKVREIVEQSWTAD

SEQ ID NO: 46378 - protein, 276 aa, Sorghum bicolor
  Clone ID: SORBI-28MAY03-C4207_1.pep
GGSEEKDTTNDAWPAAAVGEDDRGVRSTTPMDDHLRHQLMATPAAAPASMCGSEGKKRQAGVGSEHRSSRGCGGVISPPAAIMNGRGTAEEAPPRVRLAALLGERRCDFFTTASGLPGAASTPSLPASTSRSSCSGSPSPSPSPSSGGCGGTATTSSSAVTESALRQSSGGDNDDEDAELDEASTTTAARQHQYHHQQQQQECYASDHFFWNDIAAAEAASYMFIDGLAGAGPGGHPATAEVGAEPPSSPTWEYCSDYSLWRIDDNEYYKKMLDSS

SEQ ID NO: 46379 - protein, 294 aa, Sorghum bicolor
  Clone ID: SORBI-28MAY03-C3143_1.pep
MEVEADAEVRHWTADVNGISLHVAERGPADGPAVLLIHGFPELWLSWRHQMAALAARGFRALAPDLRGYGEFEGRRSEFISRYERRARIKDRVSSSNMETEFQDGKQEVIEAWYMDDSEEDQRLPHHRDPKEFIPLDKLSELGIISWRLNPDNWENDENLKKIREARGYSYMDICDVCPEKLPNYEIKIKNFFEEHLHTDEEIRYCLEGSGYFDVRDENDQWIRVAVKKGGMIVLPAGMYHRFTLDNENYIKAMRLFVGEPVWTPYNRPHDHLPARKEYLDKLLKPEGQAVEAR

SEQ ID NO: 46380 - protein, 165 aa, Sorghum bicolor
  Clone ID: LIB5048-006-R1-XP1-E3.pep
MEVEADAEVRHWTADVNGISLHVAERGPADGPAVLLIHGFPELWLSWRHQMAALAARGFRALAPDLRGYGDSSVPTDPAAYSILHIVGDLVALLDHLQLTKVFVVGHDWGAQVAWHLCLFRPDRVRAAVVLGIPYFPRGSRPLTDRFVPLGDGYYINQFLEPGRN

SEQ ID NO: 46381 - protein, 389 aa, Sorghum bicolor
  Clone ID: SORBI-28MAY03-C3194_1.pep
MGRWNNAITNTVPPYLFTGSETTSVWLEVSEVKGDDVVCIIKNTATLAGSLFTLHCSQIHIDLPTLSHEDKDVIKKWGAPNKIDFLSLSYTRHAEDVRQAREYLSKLGDLSQTQIFAKIENVEGLNHLREILAEADGIILSRGNLGIDLPPEKVFLFQKSALHKCNMAGKPAVVTRVVDSMTDNLRPTRAEATDVANAVLDGSDAILLGAETLRGLYPVETISTVGRICAEAEKVFNQDLYFKRTVKYVGEPMTHLESIASSAVRAAIKVKASVIICFTSSGRAARLIAKYRPSMPVLSVVIPRLKTNQLKWSFTGAFEARQSLIVRGLFPMLADPRHPAESTNSTNESVLKVALDHGKASGVIKSHDRVVVCQKVGDSSVVKIIELDD

SEQ ID NO: 46382 - protein, 235 aa, Sorghum bicolor
  unsure (1)..(235): unsure at all Xaa locations
  Clone ID: SORBI-28MAY03-C107_3.pep
IEVAVATKFAALPWRFGRGSVLSALKKSLDRLGLSSVELYQLHWPGIWGNEGYLDGLADAYEQGLVKAVGVSNYNEKRLRDAHARLKKRGVPLAANQVNYSLIYRTPELNGVKAACDELGITWIAYSPIAQRPXVLTGKYTPEKPPTGPRANTYTPEFLTKLQPLMNRIKEIGASYGKSPTQVSLNWLTCQGNVVPIPGAKNASQAKEFAGALGWSLTGDEVEELRTLAREIKGI

SEQ ID NO: 46383 - protein, 505 aa, Sorghum bicolor
  unsure (1)..(505): unsure at all Xaa locations
  Clone ID: SORBI-28MAY03-C107_1.pep
MATPAMVPLRHLFLDGEWRPPAQGRRVPVVNPTTQAPIGEMPARTAEDADAAGAAARPAPRRSRGRDGARAPGAGRAQCQGARVTRGIQRNPELPKLEALDCGKPYDEAVWYMDDVAGCFEYFADRAEALDKRQNSPVSLPMETFKCHLRREPIGVVGLITPWNYPLLMATWKVAPALAAGCTAVLKPSELVTWPSXQLADISIEVGLPSGVLNIVTGLGPDAGAPLSGHPDVDKVAFTGSFETGKKIMAAAAPMVKPVTLELGGKSPIVVFDDVDIDKAVEWTLFGCFWTNGQICSASSRLLIHTKIAKEFNERMVAWAKNIKVSDPLEEGCRLGPVVSEGQYEKIKKFISAXEGGAILRSQEGQPRQEVRWGFFIEPTIITDITTSMEIWREEVFGPVLCVKEFSTEDEAIELANDTQYGLAGAVISGDRERCQRLSEEIDAGCIWVNCSQPCFCQAPWGGNKRSGFGRELGEGGIDNYLSVKQVTEYISDEPWGWYQSPSKL

SEQ ID NO: 46384 - protein, 80 aa, Sorghum bicolor
  Clone ID: LIB3481-011-Q6-K1-D11.pep
VRLMNRIKEIGASYGKSPTQVSLNWLTCQGNVVPIPGAKNASQAKEFAGALGWSLTGDEVEELRTLAREIKGIKMPIEES

SEQ ID NO: 46385 - protein, 114 aa, Sorghum bicolor
  Clone ID: LIB3481-013-P1-K1-H11.pep
RPPTRTPTRPEQGLVKAVGVSNYNEKRLRDAHARLKKRGVPLAANQVNYSLIYRTPELNGVKAACDELGITSIAYSPIAQGVLTGKYTPEKPPTGSRANTYTPEFLTKLQPLMN

SEQ ID NO: 46386 - protein, 61 aa, Sorghum bicolor
  unsure (1)..(61): unsure at all Xaa locations
  Clone ID: LIB3478-022-P1-K1-G7.pep
QTHAPXQASARHHTHRTRVCSCLPDRATSYLLPSLRTRHDGLAGHRRSGLLLPSSSPGSGG

SEQ ID NO: 46387 - protein, 524 aa, Sorghum bicolor
  Clone ID: SORBI-28MAY03-C45820_1.pep
MAAVHGGLLPGIFAVLMVIAVASAASSEASSVVIGLAKCADCTRKNMKAEAAFKGLEVAIKCRNSKGEYESKAIGKLDVSGAFSIPLSTDMHAADCVAQLHSAAGTPCPGQEPSRIVPQSSDGNFVVVPGKTDYPSAECASATLCGPIKKHLLDHFHKKPVPPKPKPEPKPKPEPKPQPKYHSPTPTYRSPTPIYHPPARQLFDKKHMVDHFHKDHDYHHFLDHFHKKPSPLKPKPEPKPEPEPKPHHFFDHFHKKPVPPKPKPEPKPQPEYHPPTPTYGSPTPIYHPPARHLFDKKPLLDHFHKDHDYHHVFDHFHKKPVPPKPKPEPKPQPKPQPEPDHFHKGHDYHHFFYHFHKKPVPPKPKPEPKPQPEPEYHPPTPTYGSPTPIYHPPARHLFDKNPLHDDFHKHHDYHHIFDHFHKKPVPPKPKPQPKPEYHPPTPTYGSPTPIYHPPVVKEISFDKKHFLDHFHKDHDYHKFFDHFHKKPVPPKPKPEPKPKPEPEYHPPAPTYASPTPIYHPPAKN

SEQ ID NO: 46388 - protein, 148 aa, Sorghum bicolor
  Clone ID: SORBI-28MAY03-C4385_1.pep
MSAVAVSSSSSLNPDAPLFIPAALLQVEDFSPQWWDLITTTAWFRDHWSREHAHLDEMAEQLDAAGLLPDEEDLFYDDQLEQAPAAVDPAPAAAVLKTDEVLKALNLTSPKGGDAPRGFREKPRHSEKPTKYAGSPKSSAPRVIHQPR

SEQ ID NO: 46389 - protein, 398 aa, Sorghum bicolor
  Clone ID: SORBI-28MAY03-C4845_1.pep
MEPDSARKRLALLALLLLLAAPARPASAAPVEDGLLSNGDFETAPAGGFVKSASVAEGASSIPGWTINGTVELISAGQHQGGMILIVPQGDHAVRLGNDASVGQVVDVEKGSEYAITFSAARTCAQLESLNVSVLGGISQTVDLQTLYNIEGWDAYALAFQATEEQAHLQFMNPGMEDDPTCGPILDNVAVKKLFTPDKPKDNVVLNGDFEEGPWMFPNTSFGVLLPTNLDEQTSAIPGWMIESNRAVRYIDSDEYKVPQGKRAIELLSGKEGIISQMVETTPQKVYSLTFTLGTAGDSCQPPMAIMAFAGDQAQNFHYSPIGNATSQAANVTFTARAERTRVAFYSVYYNTRSDDHSSLCGPVIDDVRVWGLNAAAGLKASIGLVLGIVGLAGMVLF

SEQ ID NO: 46390 - protein, 504 aa, Sorghum bicolor
  Clone ID: SORBI-28MAY03-C5493_1.pep
MALAILARRRAAEAVLRRPQAAAAGAAVSAWRAYAAAGEESDVVVVGGGPGGYVAAIKAAQLGLKTTCIEKRGTLGGTCLNVGCIPSKALLHSSHMYHEAMSSFAHHGVKFSNLEVDLPAMMAQKDKAVAGLTKGIEGLFKKNKVTYVKGFGKLSSPSEVSVDLIDGGSTVVKGKNIIIATGSDVKSLPGITIDEKKVVSSTGALCLSEIPKKLVVIGAGYIGLEMGSVWNRLGSEVTVVEFAPDIVPSMDGEVRRQFQRMLEKQKFKFMLKTKVVGCDTSGDGVKLTLEPAAGGEQTILEADVVLVSAGRTPFTSGIGLETLGVETDNAGRILVDKRFMTNVKGVYAIGDAIPGPMLAHKAEEDGVACVEFIAGKEGHVDYDTVPGVVYTHPEVASVGKTEEQVKDLGIAYQVGKFPLLANSRAKAIDDAEGVVKVIAEKETDKILGVHIMAPNAGEIIHEAVLALQYGASSEDVARTCHAHPTVSEALKEACLQTFDKAIHI

SEQ ID NO: 46391 - protein, 499 aa, Sorghum bicolor
  Clone ID: SORBI-28MAY03-C8902_1.pep
MASGGAVREVRSPAELEAAVAGVRAAAVHFWASWCEASKQMDEVFAHLAVDFPHAAFLRVEAEEQPEISEAHGVSAVPYVVFYKEGKIVDTLEGANPASLANKVAKVAGPASVAESAVPASLGVAAGPAVLENIQKMAQQNGSSAAESTNSGSKEDALNKRLEQLVNSHPVFLFMKGTPEQPRCGFSRKVVDILKQEGVKFGSFDILTDNDVREGMKKFSNWPTFPQLYCKGELLGGCDIVIAMHDSGELKDVFEEHNIPLKPQGSKNEEAGEPGSATDKGGAVAEPIRLTDAQKARLESLINSSPVMVFIKGTPEEPKCGSSGKLLHILKQENIPFSSFDILSDDEVRQGLKVFSNWPSYPQLYIKGELVGGSDIVMEMHKSGELKKVLSEKGVIPKESLEDRLKSLISSAPVMLFMKGTPDAPRCGFSSKVVNALKKEGVSFGSFDILSDEEVRQGLKTYSNWPTFPQLYYKSELIGGCDIILEMEKSGELKSTLSE

SEQ ID NO: 46392 - protein, 197 aa, Sorghum bicolor
  Clone ID: SORBI-28MAY03-C3255_1.pep
MGGGKDKHDESDKGLFSNMMHGVAGGHGYPHQGYPPQGYPPPQGAYPPPPGAYPPPPPGAYPPPPGAYPPQHGYPQPGGYPPQGGYPPAGYPGSSHQGYGSSHGGSHMGMGTVLAGGAAAAAAAYGAHKLSHGHSGHGGHGVFGGGYGHGGYGHGYGGHGKFKHGHGGHGKFKHGHGKFKHGKHGHGMFGGKFKKWK

SEQ ID NO: 46393 - protein, 178 aa, Sorghum bicolor
  Clone ID: SORBI-28MAY03-C5050_3.pep
MVAFRFHQYQVVGRALPTPGDEHPKIYRMKLWATNEVRAKSKFWYFLRKLKKVKKSNGQVLAINEIFERNPTTIKNYGIWLRYQSRTGYHNMYKEYRDTTLNGAVEQMYNEMASRHRVRSPCIQIIKTATVHFKLCKRDNTKQFHNSEIKFPLVYRKVRPPTRKLKTTFKASRPNLFM

SEQ ID NO: 46394 - protein, 178 aa, Sorghum bicolor
  Clone ID: SORBI-28MAY03-C5050_2.pep
MVAHRFHQYQVVGRALPTPADEHPKIYRMKLWATNEVRSKSKFWYFLRKLKKVKKSNGQVLAINEIFERNPTTIKNYGIWLRYQSRTGYHNMYKEYRDTTLNGAVEQMYNEMASRHRVRSPCIQIIKTATVDFKLCKRDNTKQFHNSKIKFPLVYRKVRPPTRKLKTTFKASRPNLFM

SEQ ID NO: 46395 - protein, 178 aa, Sorghum bicolor
  Clone ID: SORBI-28MAY03-C5050_1.pep
MVAHRFHQYQVVGRALPTPTDEHPKIYRMKLWATNEVRAKSKFWYFLRKLKKVKKSNGQMLAINEIFERNPTTIKNYGIWLRYQSRTGYHNMYKEYRDTTLNGAVEQMYNEMASRHRVRSPCIQIIKTATVHFKLCKRDNTKQFHNSKIKFPLVYRKVRSPTRKLKTTFKASRPNLFM

SEQ ID NO: 46396 - protein, 656 aa, Sorghum bicolor
  Clone ID: SORBI-28MAY03-C3580_1.pep
MAAQGQAAAGSASESGGSPAASAAAAAAFPATSLYVGDLHESVQDAQLFDVFSQVGGVVSVRVCRDINSRKSLGYAYVNYNNPGDAARALELLNFTPINGKPIRIMYSNRDPSSRKSGAGNIFIKNLDKSIDNKALYDTFCAFGNILSCKIATDPSGESRGYGFVQFERDESAQSAIDKLNGMLINDKKVYVGPFVRKQDRENVSSNFKFSNVYVKNLLDTVTDDELKEMFGKYGSITSAVVMRDSDGKSRCFGFVNFENADDAAQAVQELNGKIFNDKELYVGRAQKKSEREMELKEKFEKNIQEVAEKFQNTNLYLKNLEDNIDDEKLRELFAEYGNITSCKVMRDSNGVSRGSGFVAFKSAEDANRALTEMNGKMVGSKPLYVALAQRKEDRKAKLQAQFSQMRPVAMAPSVGPRLPMFPPGVPGVGQQLFYGQPPPAFINPQAGFAFQQPLMPGMRPGGPMPNFMMPMVQQGQQPQRPAGRRAGASGMQQPMPMAGQQQMFPRGGRGYRYPTGRGMPDPGMHSVGAVMPSPYEMGGVPMRDAGLSQPQPVPIGALATALANAPPDQQRLMLGENLYPLVEQLEREQAAKVTGMLLEMDQTEVLHLLESPDALKAKVAEAMEVLRSAQHLQQSNASPEQQLANLSLNDGVVSS

SEQ ID NO: 46397 - protein, 353 aa, Sorghum bicolor
  Clone ID: SORBI-28MAY03-C1236_1.pep
MRKYRRIYDMSTSQIGPRPSIIAGSSMPLIVCSPKQRDLICLGPNLRTTTRQAPLGWKQTILRGNILSYNLGGMGCSAGVIAVDLARDMLQASGTVLAVVISTETISLTWYSGKHRSMLIPNAFFRAGCAALLLSNRRRDFHRAKYQLVHMVRTHKGADDRAFRSVYQEEDEERIEGLSISRDPRTMAGDALKTNITTLGPLVLPLSEQLLFIATLVAKKVLKMKKVKPYIPDFKLAFEHFCIHAGGRAVLDELESNLSLTDWHMEPSRMTLHRFGNTSSSSLWYELAYSEAKGRIRRRHRVWQIAFGSGFKCNSAVWRALRSVNPAEENNPWMDEIDRFPVDVPKVSKVTSD

SEQ ID NO: 46398 - protein, 289 aa, Sorghum bicolor
  Clone ID: SORBI-28MAY03-C1419_1.pep
MSKDDVTAEAEAAAKAPYWDPPPAPLLDTSELKKWSLYRALIAEFMATLIFLYVSIATVIGYKNQSKAESCTGVGALGIAWSFGATIFILVYCTGGISGGHINPAVTFGLFVGRKLSLVRTLLYIVAQCLGAICGVGIVKGIMKVPYNSLGGGANAVATAPSDGVLTGYSVGSALAAEIVGTFILVYTVFSATDPKRTARDSFIPVLVPLPIGFAVFVVHLATIPITGTGINPARSLGAAVVHAAWKDHWIFWVGPLIGATVAALYHKLVLRGEAVKALGSFRSTSATV

SEQ ID NO: 46399 - protein, 125 aa, Sorghum bicolor
  Clone ID: LIB3478-020-P1-K1-B4.pep
IVKGIMKVPYNSLGGGANAVATGPSDGVLAGYSVGSALAAEIVGTFILVYTVFSATDPKRTARDSFIPVLVPLPIGFAVFVVHLATIPITGTGINPARSLGAAVVHAAWKDHVIEIINLYNHTLI

SEQ ID NO: 46400 - protein, 241 aa, Sorghum bicolor
  unsure (1)..(241): unsure at all Xaa locations
  Clone ID: SORBI-28MAY03-C6090_1.pep
NLVNVGTSNPASYGSTNSQKQMSLPAKAGQTSSAGTMNEGYGTRNAYNANGNQSAGXAPDTQNIPANITMQYDRSAGPPGSQFSGSSLQSQASRGSNMLALGPSQQHQSFEFPALGQSLQPTGLNPFEEWPQQQENCGGIDDYLTEEIRMRSHEILENEEMQQMLRLLSMGGAGTNLTEDAFNFPSYMPAPSPNLSYEDDRTRAPGKAVVGWLKIKAAMRWGIFVRKKAAERRAQLVELDD

SEQ ID NO: 46401 - protein, 120 aa, Sorghum bicolor
  unsure (1)..(120): unsure at all Xaa locations
  Clone ID: LIB3478-017-P1-K1-F2.pep
VWRLEKIGKDGAFHKKLNANGIYTVEDFLRLLVRDQQRLRSILGSGMSNKMWDSLVEHAKTCVLSGKHYVYYARDSRNVGAIFNNIYEFTGLIADDQFISAENLTDNQKVYADAXVKKAY

SEQ ID NO: 46402 - protein, 397 aa, Sorghum bicolor
  Clone ID: SORBI-28MAY03-C658_1.pep
MALRLNDVALCLSPPLAARRRRHCRSGGGSRFVAVASMTSAVSTKLENKKPFAPPREVHVQVTHSMPPQKIEIFKSLDDWARDNILTHLKPVEKCWQPQDFLPDPSSEGFHDEVKELRERAKEIPDDYFVCLVGDMITEEALPTYQTMLNTLDGVRDETGASPTAWAVWTRAWTAEENRHGDLLNKYMYLTGRVDMRQIEKTIQYLIGSGMDPRTENNPYLGFIYTSFQERATFISHGNTARHAKDFGDLKLAQICGIIASDEKRHETAYTKIVEKLFEIDPDGTVVALADMMKKKIAMPAHLMFDGQDDKLFEHFSMVAQRLGVYTARDYADILEFLVDRWKVADLTGLSGEGNKAQDYLCTLASRIRKLDERAQSRAKKAGTLPFSWVYGREVQL

SEQ ID NO: 46403 - protein, 420 aa, Sorghum bicolor
  Clone ID: SORBI-28MAY03-C1071_1.pep
MSAAPTGPAPPVATPMAPPPSYPASSTISASVAASVEEEDDLYGRLKSLQRHMEFVEIQEEYVKDEQKNLKRELLRAQEEVKRIQSVPLVIGQFMEMVDGNNGIVGSTTGSNYYVRILSTINRELLKPSASVALHRHSNALVDVLPPEADSSISLLGSSEKPNVTYNDIGGCDIQKQEIREAVELPLTHHELYKQIGIDPPRGVLLYGPPGTGKTMLAKAVAHHTTAAFIRVVGSEFVQKYLGEGPRMVRDVFRLAKENAPAIIFIDEVDAIATARFDAQTGADREVQRILMELLNQMDGFDQTVNVKVIMATNRADTLDPALLRPGRLDRKIEFPLPDRRQKRLVFQVCTAKMNLSDEVDLEDYVSRPDKISAADIAAICQEAGMHAVRKNRYVILPKDFEKGYRTNVKKPETDFDFYK

SEQ ID NO: 46404 - protein, 367 aa, Sorghum bicolor
  unsure (1)..(367): unsure at all Xaa locations
  Clone ID: SORBI-28MAY03-C7205_1.pep
MASPQISRRALGLLLVLATAAAAVVSPAAADDVVALTEADFEKEVGQDRGALVEFYAPWCGHCKKLAPEYEKLGASFKKAKSVLIAKVDCDEHKGLCSKYGVSGYPTIQWFPKGSLEPKKYEGQRSVEALAEYVNSEAGTNVKIVAIPSSVVVLTPETFDSIVLDETKDVLVEFYAPWCGHCKHLAPVYEKLASVFKQDDGVVIANLDADKHTDLAEXYGVSGLLTFLHFPKGNXAGEDYDGGRDLDDFVKFINEKCGTSRDSKGQLNSEAGLVASLNPLVKEFLNAAADKRKEVISKIEEDVAKLSGSAAKHGKIYVTAAKKIMDKGSDYTKKETERLHRLLEKSISPSKADEFIIKKNILSTFSS

SEQ ID NO: 46405 - protein, 120 aa, Sorghum bicolor
  Clone ID: LIB3476-030-P1-K1-G12.pep
MAISQISRGTLSILLLLAAAFAAAPAALADGDDVVALTESTFEKEVGQDRGALVEFYAPWCGHCKKLAPEYERLGASFKKAKSVLIAKIDCDEHKSLCSKYGVSGYPTIQWFPKGSLEPK

SEQ ID NO: 46406 - protein, 388 aa, Sorghum bicolor
  Clone ID: SORBI-28MAY03-C1486_1.pep
MASATLLKSSFLPKKAEWGAMRQAATPKPVTVSMVVRASAYADELVQTAKTIASPGRGILAMDESNATCGKRLDSIGLENTEANRQAYRTLLVSAPGLGQYISGAILFEETLYQSTVDGKKIVDVLNEQGIVPGIKVDKGLVPLAGSNNESWCQGLDGLASREAAYYQAGARFAKWRTVVSIPNGPSELAVRSYTIGKSLSGDISSYACLGSIVEPEILLDGEHGIERTFEVAQKVWAETFYYMAENNVMFEGILLKPSMVTPGAECEEKATPEQVAEYTLKLLHRRIPPAVPGIMFLSGGQSEVEATQNLNAMNQSPNPWHVSFSYARALQNTCLKTWGGRPENVKAAQDALLLRAKANSLAQLGKYTGDGEAAAAKEGMFVKNYSY

SEQ ID NO: 46407 - protein, 91 aa, Sorghum bicolor
  Clone ID: LIB3478-012-P1-K1-B5.pep
MQSEVEATQNLNAMNQSPNPWHVSFSYARALQNTCLKTWGGRPENVKAAQDALLLRAKANSLAQLGKYTGDGEAAAAKEGMFVIGTKASDT

SEQ ID NO: 46408 - protein, 333 aa, Sorghum bicolor
  Clone ID: SORBI-28MAY03-C1750_1.pep
MASTTTATFLAVFLLVAASSSAPARSCAPSDLHALLSVKQALGNPATLSTWTASSPNCCAWDHLRCNDAGRVNNVFIDAADDVHGQIPSAVGGLTELMSLTLFKLPGLTGSIPACLTALSKLEFLTISHTSVSGAIPESLTRLRSLDSVDLSSNQLTGTIPASFADLPNLRSLDLRHNQLTGTIPAGLVQGQFRSLILSYNQLTGPIPRDDAHDEINTVDLSHNKLTGDPSHLFVAGRPIGKVDLSWNYLDFDLSKLVFPPELTYLDLSHNHIRGTVPLSLERLSTLQKLDLSYNRLCGPLPKGHGVIKHGCKPYAHNQCRKGTPLAGCQDLE

SEQ ID NO: 46409 - protein, 149 aa, Sorghum bicolor
  unsure (1)..(149): unsure at all Xaa locations
  Clone ID: SORBI-28MAY03-C25252_1.pep
MANKCLPFALFIVLLGLSSNLAAGQILFQGFNWESWKDDGRWNNFMKGKVPDIADTVMQDVAHILAYHANASIFYEHLFPWDLDKEIYDQVSMRDRHGIQFDDEVLNINADADINLPAAEGKVIGNIGXSYDCDHPVPEGLQVAVHEDE

SEQ ID NO: 46410 - protein, 414 aa, Sorghum bicolor
  unsure (1)..(414): unsure at all Xaa locations
  Clone ID: SORBI-28MAY03-C196_1.pep
MWAASCLASCCAACACEACRTAVGSIGRRSARIAYCGLFALSLFASWALREVAAPLLQSIPWINHFHKTPDREWFETDAVLRVSLGNFLFFTILAVIMAGIKDQKDPRDKIHHGGWMAKIFCWAVIVFLMFFVPNGVVSFYESISKFGSGLFLLVQVVLLLDFVHGWNENWVAKDEQFWYMALXLVASAVCSCATASPSGRLFHWFTPSGHDCGLNMFFIVFTLILVFAFAIVALHPKINGSLLPASVIGLYCTYLCYSGLSSEPRDYECNGLHNQSKAVSTGSLTLGLLTTVLSVVYSAVRAGSSATVLSPPDSPRGTDKPLLPFSKADEQEDKKDVPRPVTYSYSFFHLIFSLASMYSAMLLTGWSTSVGESGKLVDVGWPSVWVRIATQWATAGLFIWSLVAPILFPDREF

SEQ ID NO: 46411 - protein, 377 aa, Sorghum bicolor
  Clone ID: SORBI-28MAY03-C71286_1.pep
MAATTTSRPAAAALPLAVLAAAMVVALAAAGDVVEQQLEVVGSRYPPLAPGLSFDFYKKSCPKAESIVKEFLSSAVRQNVGLAAALIRVHFHDCFVQGCDASVLLDSTPTQPSEQLSPPNLTLRPAAFKAINDIRARLEQACGRVVSCADITALAARESVALGGGPAYKVPLGRRDGLAAASNAAVLAALPSPTSTVPTLLSFLSKINLDVTDLVALSGGHTVGVAHCSSFSNRLFPTQDPTLNKFFAGQLYGTCPTDTTVNTTVNDIRTPNTFDNKYYVDLLNRQGLFTSDQDLLTNATTRPIVTKFAVDQNAFFEQFVYSYVKMGQINVLTGSQGQVRANCSARNAGAAGNGGEDQLPWSDVVETVVDATGSLVL

SEQ ID NO: 46412 - protein, 140 aa, Sorghum bicolor
  Clone ID: SORBI-28MAY03-C6164_3.pep
MADQETPVAVEAPTPVLGEPIDLMTALQLVMKKSGAHDGLVKGLREAAKAIEKHAAQLCVLAEDCDQPDYVKLVKALCSEHNVHLVTVPSAKTLGEWAGLCKIDSEGKARKVVGCSCVVVKDYGEESEGLNIVQEYVKSH

SEQ ID NO: 46413 - protein, 140 aa, Sorghum bicolor
  Clone ID: SORBI-28MAY03-C6164_2.pep
MADQEAPVAVEAPTPILGEPMDLMTALQLVMKKSSAHDGLVKGLREAAKAIEKHAAQLCVLAEDCDQPDYVKLVKALCAEHNVHLVTVPAAKTLGEWAGLCKIDSEGKARKVVGCSCVVVKDYGEESEGLNIVQEYVKSH

SEQ ID NO: 46414 - protein, 140 aa, Sorghum bicolor
  Clone ID: SORBI-28MAY03-C6164_1.pep
MADQETPAVVEAPTPVLGEPMDLMTALQLVMKKSGAHDGLVKGLREAAKAIEKHAAQLCVLAEDCDQPDYVKLVKALCAEHNVHLVTVPSAKTLGEWAGLCKIDSEGKARKVVGCSCVVVKDYGEESEGLNIVQEYVKSH

SEQ ID NO: 46415 - protein, 107 aa, Sorghum bicolor
  unsure (1)..(107): unsure at all Xaa locations
  Clone ID: SORBI-28MAY03-C13982_2.pep
AGRAQEFSLAVEKXQVAQQEAERSKFLVAKAEQERRAAIVRAEGESESARLISEATAMAGTGLIELRRIEAAKEIAAELARSPNVAYIPSGENGKMLLGLNAAGFGR

SEQ ID NO: 46416 - protein, 150 aa, Sorghum bicolor
  unsure (1)..(150): unsure at all Xaa locations
  Clone ID: SORBI-28MAY03-C13982_1.pep
MPAKMGTLALATTVATTSSPTSKTTRAAESAPTTASMSATVASAAPAATVAACAPLPAPASPKVLRPTELFKRNTSGLRPAPAPGGPXKRRKKKPARRSAAAAPSADHSADGPSPDDSSDDAADKAAAAPASLFARWVTIAVALALALAA

SEQ ID NO: 46417 - protein, 176 aa, Sorghum bicolor
  Clone ID: SORBI-28MAY03-C29621_1.pep
RSHTQTQLAAALSSESHGRRACSYHSLFSRLSTYVQQRRIHTYVHTYVYTGVYTYVVRTSSSTWSMWVPCREATPGDTYVRTPLLLLAARHAMHVAAGRASSHHLEDGAGHRRLPAATAAPAVAHALLLLVPVAVVLALLLAPVAGDLVERRPYAAATLPHVRRPDQRSSTDHKLH

SEQ ID NO: 46418 - protein, 530 aa, Sorghum bicolor
  Clone ID: SORBI-28MAY03-C6775_1.pep
MEAVGVAPAPVAAPEKKKLLDLKDPFPAAANGSAKASPAGKWAMKKKLVGGDAGYVLEDVPHLTDYMPHLPTYPNPLQDNPAYSVVKQYFVNPDDTVTQKIVVHKTSARGTHFRRAGPRQRVYFQSDEVNAAIVTCGGLCPGLNTVIRELVCGLYDMYGVTSVVGIEGGYKGFYSKNTVPLTPKSVNDIHKRGGTVLGTSRGGHDTAKIVDCLQDRGINQVYIIGGDGTQKGASVIYEEVRRRGLKCSVVGIPKTIDNDIAVIDKSFGFDTAVEEAQRAINAAHVEAESAENGIGVVKLMGRNSGFIAMYATLASRDVDCCLIPESPFYLEGKGGLLEFIEKRLKDNGHMVIVVAEGAGQDLIAKSMNFVDTQDASGNKLLLDVGLWLSQKIKDHFKKKPSFPITLKYIDPTYMIRAVRSNASDNVYCTLLAHSALHGAMAGYTGFTVAPVNGRHAYIPFYRITEKQNKVVITDRMWARVLCSTNQPCFLSHEDVENMKHDDDEHHLHNTQLLEGESSPVKDASKCNGTV

SEQ ID NO: 46419 - protein, 176 aa, Sorghum bicolor
  Clone ID: SORBI-28MAY03-C19367_1.pep
MASTTSMPSVLFLLLAAFAASASAATFTIKNNCGYTVWPAGIPVGGGTQLNSGQTWTVNVPAGTSGRFWGRTGCSFSGGSGHCDSGDCAGKLSCTVSGQTPATLAEYTIGGTGNPQDYYDISCVDGYNQPMSFSCSTGVALSCTYAKCPDAYQYSTDDTKTHACSANSNYQITFCP

SEQ ID NO: 46420 - protein, 202 aa, Sorghum bicolor
  Clone ID: LIB5052-009-A1-XP1-D8.pep
MGICLSGAKPEEASYTALSSSLTIISMASTTSMPSVFFLLLAAFAASASAATFTIKNNCGYTVWPAGIPVGGGTQLNSGQTWTVNVPAGTSGRFWGRTGCSFSGGSGHCDSGGCAGKLSCTVSGQTPATLAEYTIGGTGNPQDYYDISCVDGYNQPMSFSCSTGVALSCTYAKCPDAYQYSTDDTKTHACSANSYYQITFCP

SEQ ID NO: 46421 - protein, 362 aa, Sorghum bicolor
  Clone ID: SORBI-28MAY03-C30_1.pep
MVVMGKEEEKHQQAEEEEVQEEEARVVVLQQDVTEDEAAVAQEVSVLPAAVAKVPSLSQPPAVDALFPPRVRACIRPRTRAVDRVRPALQAMRAGRPRLRADAEAVLEADASDLLAGFDNPLDHLPLSPYFSNYLLLSELEHGLLARHVPGPPPARVAFVGSGPLPLSSLVLAARHLPAAAFDNYDICGDANDRARRLVRADAALAARMAFRTSDVADVYMDLVGYEGFFLAALVGMAAEEKARVVEHLGRHMAPGAALVVRSAHGARGFLYPVVDPEEIRRGGFDVLAVHHPEGEVINSVIIARKPVPPVDAHAVAVAAAGVGHAHAHAHGAVLSRPCLCCEMEARAHQKMEEVAVEQLPS

SEQ ID NO: 46422 - protein, 351 aa, Sorghum bicolor
  Clone ID: SORBI-28MAY03-C3685_1.pep
MAVASASPLPSAPSAKPATAPSPLAPSSGFLALRARRCGAPRLRPAAAAWRRLRVEAIRTQQEKQRTEVPVEESAPVRGAAAPLDGVGADDPMVASSEESWVVRLEQSFNIFATESMIMILDGVYRDRNYARFFVLETIARVPYFGFISVLHLYETFGWWRRADYIKVHFAQSWNEFHHLLIMEELGGNALWIDRFLARFMAFFYYFMTVAMYMLSPRMAYHFSECVERHAYSTYDKFLKLHEEELKRLPAPEAALNYYLNEDLYLFDEFQTAGVPCSRRPKIDNLYDVFVNVRDDEAEHCKTMKACQTHGNLRSPHSMLDCLEVDSECVIPEPEDDCEGFVDSVKKSLTK

SEQ ID NO: 46423 - protein, 404 aa, Sorghum bicolor
  Clone ID: SORBI-28MAY03-C7119_1.pep
MVAFSRPLVTVKALEGDMVTDAPGIALPPVFGAPIRPDVVRFAHKLLSCNKRQPYAVSRRAGHQTSAESWGTGRAVSRIPRVPGGGTHRAGQGAFGNMCRGGRMFAPTKIWRKWHHRVNINLRRVAVASALAATAVPALVQARGHRIETVPEMPLVISDSAESIEKTSQALKILKQIGAYADAEKAKDSVAIRPGKGKMRNRRYINRKGPLIVYGTEGSKVVKAFRNLPGVDVANVERLNLLDLAPGGHLGRFVIWTESAFKKLEEVYGSFDAPSLKKKGFVLPRPKMTNADLGRIINSDEVQSVVKPLNKEVKRREKRKNPLKNMAAVLKLNPYLGTARKMATLAEAARVKARKEKLDSKRTKLSPEEAAKVKAAGKAWYKTMISDSDYTEFENFTKWLGVTQ

SEQ ID NO: 46424 - protein, 65 aa, Sorghum bicolor
  unsure (1)..(65): unsure at all Xaa locations
  Clone ID: LIB3476-042-P1-K1-A2.pep
SRQPYAVSRRAGHQTSAESWGTGRAVSRIPRVPGGGTHXAGQAAFGNMCRGGRMFRPPRLGRGPR

SEQ ID NO: 46425 - protein, 251 aa, Sorghum bicolor
  unsure (1)..(251): unsure at all Xaa locations
  Clone ID: SORBI-28MAY03-C6384_2.pep
MKFNIANPTTGCQKKLEIDDDQKLRAFYDRRISQEVSGDALGEEFKGYVFKIMGGCDKQGFPMKQGVLTSGRVRLLLHRGTPCFRGYGRRNGERRRKSVRGCIVSQDLSVINLVIVKKGENDLPGLTDTEKPRMRGPKRASKIRKLFNLSKDDDVRKYVNTYRRTFTTKSGKKVSKAPKIQRLVTPLTLQRKRARIADKKKRIAKKKSEAAEYQKLLAQRLKEQRDRRSESLAKRRXKLSSAAKATAASTA

SEQ ID NO: 46426 - protein, 251 aa, Sorghum bicolor
  Clone ID: SORBI-28MAY03-C6384_1.pep
MKFNIANPTTGCQKKLEIDDDQKLRVFFDKRISQEVSGDALGEEFKGYVFKIMGGCDKQGFPMKQGVLTPGRVRLLLHRGTPCFRGYGRRNGERRRKSVRGCIVSQDLSVINLVIVKKGENDLPGLTDTEKPRMRGPKRASKIRKLFNLSKDDDVRKYVNTYRRTFTTKSGKKVSKAPKIQRLVTPQVLQRKRARIAEKKKRIAKKQAEAAEYQKLLAQRLKEQRERRSESLAKRRSKLSAAAKASAATSA

SEQ ID NO: 46427 - protein, 186 aa, Sorghum bicolor
  unsure (1)..(186): unsure at all Xaa locations
  Clone ID: LIB5121-008-A1-PF1-B8.pep
CEDQDQEEEERGAXXQGFPMKQGVLTPGRVRLLLHRGTPCFRGYGRRNGERRRKSVRGCIVSQDLSVINLVIVKKGENDLPGLTDTEKPRMRGPKRASKIRKLFNLSKDDDVRKYVNTYRRTFTTKSGKKVSKAPKIQRLVTPQVLQRKRARIAEKKKRIAKKQADAAEYQKLAAQRLKEQRNAGA

SEQ ID NO: 46428 - protein, 339 aa, Sorghum bicolor
  Clone ID: SORBI-28MAY03-C123_2.pep
VRRLYVQGKEVNGAGINSSFAVHQDVDGRATDVALAWSVALGSPFTFATTLEQEYKSDIFGERGILLGAVHGIVEALFRRYTEQGMDEESAYKNTVEGITGIISKTISKKGMLEVYNSLSEEGKKEFNKAYSASFYPCMDILYECYEDVASGSEIRSVVLAGRRFYEKEGLPAFPMGNIDQTRMWKVGEKVRATRPEGDLGPLHAFTAGVYIALMMAQIEILRKKGHSYSEIINESVIESVDSLNPFMHARGVAFMVDNCSTTARLGSRKWAPRFDYILTQQAFVTVDKDAPINQDLISNFLSDPVHGAIEVCAELRPTVDIFVTANADFVRPELRQSF

SEQ ID NO: 46429 - protein, 211 aa, Sorghum bicolor
  Clone ID: SORBI-28MAY03-C123_1.pep
MATAYAPMASQVMKSSLQLHSKPRGLSGAALTTTRRPRFTVKAIQPEKATYQVVQPINGDPFIGSLETPVTSSPLVAWYLSNLPAYRTAVSPLLRGIEVGLAHGYLLVGPFALTGPLRNTPVHGQAGALGAAGLVAILSVCLTMYGVASFNEGEPSTAPTLTLTGRKKEADKLQTADGWSKFTGGFFFGGISGVLWAYFLLYVLDLPYYFK

SEQ ID NO: 46430 - protein, 123 aa, Sorghum bicolor
  Clone ID: LIB3478-013-P1-K1-G12.pep
EDVASGSEIRSVVLAGRRFYEKEGLPAFPMGNIDQTRMWKVGEKVRATRPEGDLGPLHAFTAGVYIALMMAQIEILRKKGHSYSEIINESVIESVDSLNPFMHAHAYGEEEGGRQAADRRRMV

SEQ ID NO: 46431 - protein, 509 aa, Sorghum bicolor
  unsure (1)..(509): unsure at all Xaa locations
  Clone ID: SORBI-28MAY03-C6625_1.pep
MAIRSSKACWISLLLALALSAVARAEEPAAEGAAEAVLTLDVDSFDEAVAKHPFMVVEFYAPWCGHCKKLAPEYETAAKELSKHDPPIVLAKVDANEEKNRPLATKYEIQGFPTLKIFRNQGKNIQEYKGPREADGIVDYLKKQVGPASKELKSQEDVATHYDDKNIYIVGVFTEFSGTEFTNFMEVAEKLRSDYDFGLLLDASHRRHGDAEVEASSVFDMCRNMKALAVLLRRGGAAPLPLSLAPDVPAVVTSALNPDSRLFPLXIIVNCIHLAVGSMGPRPCIQHSTEMEEYEYKEKHFLIGDLESSQGALQYFGLNENKAPLILIQDGDSKKFLKDQIEADQIVSWLKEYFDGKLTPFKKSEPIPEVNNEPVKVVVADNIHDFVFKSGKNVLIEFYAPWCGHCKKLAPILEEAATTLQSDEEVVIAKMDATANDVPSEFEVQGYPTMYFVTPSGKVTAYDSGRTADDIVDFIKKSKETAGATQATTTTSEKAADAAEKAEPVKDEL

SEQ ID NO: 46432 - protein, 105 aa, Sorghum bicolor
  unsure (1)..(105): unsure at all Xaa locations
  Clone ID: LIB3480-033-P1-K1-A3.pep
VXLSTFHSSHLSASSPRFFLWNVEWQLPRRPSRRRRRQRPPPRWPETSRPPRSCPSRARARASPRRTAGRRGRVRVATAPAPAAVVGGGRRLERGGEGNWDRQLI

SEQ ID NO: 46433 - protein, 816 aa, Sorghum bicolor
  Clone ID: SORBI-28MAY03-C1091_1.pep
MGEAAGDRVLSRLHSVRERIGDSLSAHPNELVAVFTRLKNLGKGMLQPHQIIAEYNSAIPEAEREKLKDGAFEDVLRAAQEAIVIPPWVALAIRPRPGVWEYVRVNVSELAVEELRVPEYLQFKEQLVEEGPNNNFVLELDFEPFNASFPRPSLSKSIGNGVQFLNRHLSSKLFHDKESMYPLLNFLRAHNYKGMTMMLNDRIRSLSALQGALRKAEEHLSTLQADTPYSEFHHRFQELGLEKGWGDCAKRAQETIHLLLDLLEAPDPSTLEKFLGTIPMVFNVVILSPHGYFAQANVLGYPDTGGQVVYILDQVRAMENEMLLRIKQCGLDITPKILIVTRLLPDATGTTCGQRLEKVLGTEHCHILRVPFRTENGIVRKWISRFEVWPYLETYTDDVAHEIAGELQANPDLIIGNYSDGNLVACLLAHKMGVTHCTIAHALEKTKYPNSDLYWKKFEDHYHFSCQFTTDLIAMNHADFIITSTFQEIAGNKDTVGQYESHMAFTMPGLYRVVHGIDVFDPKFNIVSPGADLSIYFPYTESHKRLTSLHPEIEELLYSQTENTEHKFVLNDRNKPIIFSMARLDRVKNLTGLVELYGRNKRLQELVNLVVVCGDHGNPSKDKEEQAEFKKMFDLIEQYNLNGHIRWISAQMNRVRNGELYRYICDTKGAFVQPAFYEAFGLTVVEAMTCGLPTFATAYGGPAEIIVHGVSGFHIDPYQGDKASALLVDFFEKCQTDSSHWNKISQGGLQRIEEKYTWKLYSERLMTLTGVYGFWKYVSNLERRETRRYLEMLYALKYRTMASTVPLAVEGEPSSK

SEQ ID NO: 46434 - protein, 387 aa, Sorghum bicolor
  Clone ID: SORBI-28MAY03-C7340_1.pep
MGAGGRMTEKEREKQEQLARATGGAAMQRSPVEKPPFTVGQIKKAIPPHCFERSVLKSFSYVVHDLIIAAALLYFALAIIPALPSPLHYAAWPLYWIAQGCVCTGVWVIAHECGHHAFSDYQLLDDIVGLVLHSSLMVPYFSWKYSHRRHHSNTGSLERDEVFVPKKKEALAWYTPYVYNNPVGRLVHIVVQLTLGWPLYLATNASGRPYPRFACHFDPYGPIYNDRERAQIFISDAGVMAVSFGLYKLAATFGFWWVVRVYAVPLLIVNAWLVLITYLQHTHPALPHYDSTEWDWLRGALATMDRDYGILNRVFHNITDTHVAHHLFSTMPHYHAMEATKAIKPILGEYYQFDPTPVAKATWREARECIYVEPENRKGIFWYNNKF

SEQ ID NO: 46435 - protein, 173 aa, Sorghum bicolor
  Clone ID: SORBI-28MAY03-C156_1.pep
MAAAAAAVAVCPSSSARGTRPAELPRRSISKAPTPAKKQAAMAASMISPSALVAPPSRAQGLPSLGRRASSFAVVCGTGKKIKTDKPFGIGGGLTVDKDASGRKVKGKGVYQFVDKYGANVDGYSPIYNENEWSPSGNVYVGGTTGLLIWAITLAGLLGGGALLVYNTSALSG

SEQ ID NO: 46436 - protein, 88 aa, Sorghum bicolor
  Clone ID: LIB3481-058-Q6-K1-H8.pep
SPFGIGGGLTVDKDASGRKVKGKGVYQFVDKYGANVDGYSPIYNENEWSPSGNVYVGGTTGLLIWAITLAGLLGGGALLVYNTSALSG

SEQ ID NO: 46437 - protein, 132 aa, Sorghum bicolor
  Clone ID: LIB5052-007-A1-XP1-E11.pep
MAASMISPSALVAPPSRAQGLPSLGRRASSFAVVCGTGKKIKTDKPFGIGGGLTVDKDASGRKVKGKGVYQFVDKYGANVDGYSPIYNENEWSPSGNVYVGGTTGLLIWAITLAGLLGGGALLVYNTSALSG

SEQ ID NO: 46438 - protein, 98 aa, Sorghum bicolor
  Clone ID: LIB3478-056-Q6-K1-D7.pep
MQLRHPHVRSPHTPQSKRLTVDKDASGRKVKGKGVYQFVDKYGANVDGYSPIYNENEWSPSGNVYVGGTTGLLIWAITLAGLLGGGALLVYNTSALSG

SEQ ID NO: 46439 - protein, 37 aa, Sorghum bicolor
  unsure (1)..(37): unsure at all Xaa locations
  Clone ID: LIB5051-002-A1-XP1-A9.pep
ITDRHPAGMILHDEPHQEEAHGQGRNEFLSRILXPAG

SEQ ID NO: 46440 - protein, 91 aa, Sorghum bicolor
  Clone ID: SORBI-28MAY03-C257_2.pep
DIVALSGGHTLGRCHKDRSGFEGAWTSNPLIFDNSYFTELLSGEKEGLLQLGIDKTFWFSGRPLACRFMIPDEDAFFADYAEAHLKLSELG

SEQ ID NO: 46441 - protein, 250 aa, Sorghum bicolor
  Clone ID: SORBI-28MAY03-C257_1.pep
MVKAYPTVSEDYLKAVDKAKRKLRGLIAEKNCAPLMLRLAWHSAGTFDVATKTGGPFGTMKNPAEQAHGANAGLEIAVRLLEPIKEQFPILSYADFYQLAGVVAVEVTGGPDVPFHPGRQDKPEPPPEGRLPDATQGSDHLRQVFSTQMGLSDQDIVALSGGHTLGRCHKDRSGFEGAWTSNPLIFDNSYFTELLSGEKEGLLQLPSDKALLSDPSFRPLVDKYAADEDAFFADYAEAHLKLSELGFAEA

SEQ ID NO: 46442 - protein, 332 aa, Sorghum bicolor
  Clone ID: SORBI-28MAY03-C3480_1.pep
MARQCIASMLALALLLGAFAAIPTGVQAIGVCYGVNGDNLPSASDVVKLYQSNGINLMRIYFADTNALNALSGSNIGVIMDVPNTDLSSLASDPSAAATWVKSNVQAFPGVNFKYIAVGNEVSGGDTNNILPAMKNVNSALSNAGLGKIKVSTAVQSGVTQGYPPSQGSFSQSYMAPIAQYLQSTGAPLLCNVYPYFSYTGNEAQIALSYALFTSPGTVVQDGSNAYQNLFDALVDTFVSALENAGAGNVGVVVSESGWPSAGGDAATPGNAQTYNQNLINHVGKGTPKRPGAIETYIFAMFNEDKKTGAETERHFGLFNPDKSPAYSINFS

SEQ ID NO: 46443 - protein, 386 aa, Sorghum bicolor
  Clone ID: SORBI-28MAY03-C1389_1.pep
MAKPISIEVWNPSGKYRVVSTKSMPGTRWIRLLTDNDCRLEICTEQKTILSVDDILALIGDRCDGVIGQLTEDWGDVLFSALKRAGGTAFSNMAVGYNNVDVEAANRNGIAVGNTPGVLTETTAELAASLTLSAARRIVEADQFMRAGLYDGWLPHLFVGNLLKGQTVGVIGAGRIGSAYARMMIEGFKMNLIYYDLYQATRLEKFVTAYGQFLKANGEEPVTWKRAATMEDVLREADVISLHPVLDKTTYHLINPERLAIMKKEAVLVNASRGPVIDEVALVEHLKANPMFRVGLDVFEDEPYMKPGLADMKNAVVVPHIASASKWTREGMATLTALNVLGKIKGYPVWGNPNQVEPFLDENSTPPRACPSIVNAKQLGLPSAKL

SEQ ID NO: 46444 - protein, 203 aa, Sorghum bicolor
  Clone ID: SORBI-28MAY03-C41537_1.pep
MASHQDKASYQAGETKARTEEKTGQAMGATKDTAQHAKETTKQKASDSDTGSYLGQKTEEAKHKAGQTTESTKQKAGQTTEAAKQKAAETTEATKQKAGETTEATKQKTAETTEATKQKAAEAMEATKQKAAEAGQYAKETVVSGKDKSAGVIQQATEQVKSAAAGAKDAVMNTLGMGGDNNSKQSDTNTDSSKDSSTITRDH

SEQ ID NO: 46445 - protein, 401 aa, Sorghum bicolor
  Clone ID: SORBI-28MAY03-C6560_1.pep
MVLEATMICIDNSEWMRNGDYAPSRFQAQADAVNLICGAKTQSNPENTVGVMTMAGKGVRVLVTPTSDLGKILACMHGLEVGAEANLAAAIQVAQLALKHRQNKRQQQRIIAFIGSPVKYDKKVLETIGKKLKKNNVALDIVDFGESDDEKPEKLEALIAAVNSSDSSHIVHVPPGDNALSDVLLSTPIFTGEEGGSGFAASAAAAAATGASGFEFGVDPNVDPELALALRLSMEEERARQEAIAKKAAEDTSNTENNNASSSNSDSVMAEAEPASNAAAGDKKEQPKDDDDLLQQALAMSMEGGASGSAAVTDSAMAEAGAVDPDLALALQMSVQDANMSSDTDMSKVFEDRTFVSSILNSLPGVDPNDPSVKDLLASLHSQGEQEKKEDKSDKTEDEKN

SEQ ID NO: 46446 - protein, 142 aa, Sorghum bicolor
  Clone ID: SORBI-28MAY03-C1465_1.pep
MAGIGPIRQDWEPVVVRKKAPTAAAKKDEKAVNAARRAGAEIETMKKYNAGTNKAASSGTSLNTKRLDDDTENLAHERVPSDLKKNLMQARLDKKMTQAQLAQMINEKPQVIQEYESGKAIPNQQIIGKLERALGTKLRGKK

SEQ ID NO: 46447 - protein, 147 aa, Sorghum bicolor
  Clone ID: LIB5049-003-R1-XP1-A2.pep
MDSRAVGDGAGGGPDASSPADPPSPEPDPSAGSMDARLPADLLRAVLQRLPPIDLARSACVCRAWRAVASDRAVVEAAFCAPWGVRRVVGESATGAFWRTACLGRFALSHAVRRGDTAPGVALKYSVQVTDIKRFHNMMSDHGIYSR

SEQ ID NO: 46448 - protein, 110 aa, Sorghum bicolor
  unsure (1)..(110): unsure at all Xaa locations
  Clone ID: LIB3478-012-P1-K1-G5.pep
MDARLPADLLRAVLERLTPIDLSAVRLRMTGVARGTFLNTKRLDDDTENLAHERVSSDLMKNLMQARLRXKMTHAQLAQMINEKPXVIHEYESGKAILNQQIIGKLERAL

SEQ ID NO: 46449 - protein, 318 aa, Sorghum bicolor
  Clone ID: SORBI-28MAY03-C810_1.pep
PAGAAARGPGPRLPRRGREAVGAPARARAGLRRSGDRAGAPGVGAPPALPRPRPGHPGADRLAAGEAATRRRRVGGRGAGEVGSQLDRRRGLLFCFGWGQRLPFRAAAVVAVVRASGRQRHVVPGRRRRREPERAHRVAHPHTDGVKYTPQYKWVEAELKRVDREVTPWLFISTHVPWYNSNNFHYMEGEPMRAQLEKMAVDARVDAVLAGHVHAYERTHRYSNIKYNVTDGECTRIADRRAPVYVVVGEGGNVEGLADELTRPPPASSGSREYSLGHAAPGIKNRTPGCYAWSRTQEGYLVPCCRFVSVAWWLYPDV

SEQ ID NO: 46450 - protein, 101 aa, Sorghum bicolor
  unsure (1)..(101): unsure at all Xaa locations
  Clone ID: LIB3478-030-P1-K1-A12.pep
MHTVAIQRRRHGAVTLLLVAAAVVLLSAAAQTAAAHRPRGCGVTSKYVRKHQASEDMPLDADVFAVPPGRNAPQQVHIGLADQTGTXMFVSWVTVEAEGNS

SEQ ID NO: 46451 - protein, 86 aa, Sorghum bicolor
  Clone ID: LIB3478-024-P1-K1-A9.pep
LPERRVCRLRPGELIGDLGQTADSNSTLAHYESHQGDAVLFVGDLSYADKHPLHDNNRWDTWGRFAERNVAYQPWVWTTVNHEVDY

SEQ ID NO: 46452 - protein, 145 aa, Sorghum bicolor
  Clone ID: LIB3478-031-P1-K1-A12.pep
TPWKASQSSEPYWYSVKLGPAHIIVLSSYSAFGKYTPQYKWVEAELKRVDREVTPWLFISTHVPWYNSNNFHYMEGEPMRAQLEKMAVDARVDAVFAGHVHAYERTHRYSNIKYNVTDGKCTPIVDRRAPVYVVIGDGGYVEGLG

SEQ ID NO: 46453 - protein, 390 aa, Sorghum bicolor
  unsure (1)..(390): unsure at all Xaa locations
  Clone ID: SORBI-28MAY03-C5668_1.pep
NPRRTNQPLHLAHHTTPHELEPSPRPNTSLRSQSPPPPLXRVQGRREEMAATEGVLLGMGNPLLDISAVVDDAFLAKYDIKLNNAILAEEKHLPMYDELASKSNVEYIAGGATQNSIRVAQWMLQTPGATSYMGCIGKDKFGEEMKKNAQAAGVTAHYYEDETAPTGTCAVCVVGGERSLIANLSAANCYKSEHLKKPENWALVEKAKYIYIAGFFLTVSPDSIQLVAEHAAANNKVFLMNLSAPFICEFFRDAQEKVLPYADYIFGNETEAKIFAKVRGWETENIEEIALKISQLPLASGKQKRIAVITQGADPVVVAEDGKVKTFPVILLPKEKLVDTNGAGDAFVGGFLSQLAQGKSIEDSVRAGCYAANVIIQRPGCTYPEKPDFN

SEQ ID NO: 46454 - protein, 221 aa, Sorghum bicolor
  Clone ID: SORBI-28MAY03-C7103_1.pep
MALPNQQVVDYPSFKLVIVGDGGTGKTTFVKRHLTGEFEKKYEPTIGVEVHPLDFSTNCGKIRFYCWDTAGQEKFGGLRDGYYIHGQCAIIMFDVTSRLTYKNVPTWHRDLCRVCENIPIVLCGNKVDVKNRQVKAKQVTFHRKKNLQYYEISAKSNYNFEKPFLYLARKLAGDQNLHFVEAVALKPPEVQIDMAMQQQHEAELAAAAAQPLPDDDDDLIE

SEQ ID NO: 46455 - protein, 303 aa, Sorghum bicolor
  Clone ID: SORBI-28MAY03-C6532_1.pep
MAMAMATAKLVLLMVLVAGSSCGGSAWRGPLSLLRTLPTTTAAQSVEAAAERLKEDLSSAASSASASSSLIHALRPLMGSAGDLGLRAGVPCDSWRLAVEAYNKRDWTTVPGSCEGYVGHYMLGGHYRRDSRVVVDEAIAYAEGLKLAGNGKEVWVFDIDETSLSNLPYYATHGFGTKPYNATSFNEYVLEGSAPVLPESQRLFKKLISLGIKPVFLTGRTEDQRAITVTNLRRQGYSGWMDLLLKPVGLKATAIAYKSGERQKLQDAGYVIVGNIGDQWSDILGAPEGARTFKLPDPLYYIG

SEQ ID NO: 46456 - protein, 204 aa, Sorghum bicolor
  Clone ID: SORBI-28MAY03-C66910_1.pep
MGFGMGNNNGASSSSSRLDPAPLLPHHGSGSREVGLSSQPKTFANVFIAVVGAGVLGLPYTFSHTGWAAGTLLLFSVAAVTFYCMMLLVACRRRLADEHPKIASFGDLGDAVFGAHGRFAVDVMLVLSQVSFCVGYLIFISNTMAHLYPITAPSSSALLSPKALVIWAMLPFQLGLNSIKTLTLLAPLSIFADVVDLGAMGVVL

SEQ ID NO: 46457 - protein, 404 aa, Sorghum bicolor
  unsure (1)..(404): unsure at all Xaa locations
  Clone ID: SORBI-28MAY03-C11565_1.pep
METMAGATVTVEEVRKAQRAAGPATVLTIATATPGNCVHQADYPDXNFRSTKSEHMTELXEKLNSMWDKSQRRKRWTHLTEGXLADNPNIWAYMAPALDARQEIVVAEVRKLGAPAAQKAITQWKQPKSKITHLVFSTTSGVDMPSADYQLXRIRRLRLTCSRHSREDKGCSRVGTMLSIAFDSAKGDGEFRHPQICIKCISVENPSPSXPFSYAMVGQALFGDGAAAVIVGADPDERVERPLFQLVSASQTILPDSEGAIDGHLREVGLTFHLLKDVPGLISKNIERSLEEAFKPLGITDYNSIFWVAHPGGPAILDQVEAKVGLEKERMRATRHVLSEYGNMSSACVLFILDEMRKRSAEDGQATTGEGFDWGVLFGFGPGLTVETVVLHSVPITTGAAITA

SEQ ID NO: 46458 - protein, 577 aa, Sorghum bicolor
  unsure (1)..(577): unsure at all Xaa locations
  Clone ID: SORBI-28MAY03-C6149_1.pep
MDTHVGSVNGSAAAPASNDTVGCPASAPGCPMASTPAQPASTLSAGEASLGRHLARRLVQVGVNDVFAVPGDFNLTLLDHLIAEPGLRLVGCCNELNAGYAADGYARARGVGACAVTFTVGGLSVLNAIAGAYSENLPATCTAAAPSSNESGSKTIXQQLHRPLAMALRESKPVYLSISCNLPALPHPTFSRDPVPFFLAPRMSNKMGLEAAVEATVEFLNKAVKPVLVGGPKLRVAKAGKAFVDLVDASGYAYAVMPSAKGLVPETHPHFIGTYWGAVSTAFCAEIVESADAYLFAGPIFNDYSSVGYSFLLKKDKAIIVQPERVIIGNGPAFGCVMMKEYLSELAKRVKKNTTAYENYKRIFVPEGQPLESQPNEPLRVNVLFKHIQKMLTGDSAVIAETGDSWFNCQKLKLPEGCGYEFQMQYGSIGWSVGALLGYAQGANQKRVIACIGDGSFQVTAQDVSTMLRCEQNSIIFLINNGGYTIEVEIHDGPYNVIKNWNYTGFVDAIHNGEGKCWTSKVKCEEELTAAIETALAEKKDCLCFIEVIAHKDDTSKELLEWGSRVSAANSRPPNPQ

SEQ ID NO: 46459 - protein, 361 aa, Sorghum bicolor
  Clone ID: SORBI-28MAY03-C7763_1.pep
MALVPSGSGADQVIAEVAMNGGADPNATTVRATVVQASTIFHDTPATLDKAERLIAEAAGYGSQLVVFPEAFIGGYPRGSTFGFGISISIINPKDKGKEAFRRYHAAAIDVPGPEVTRLAAMAGKYKVFLVMGVIEREGYTLYCSVLFFDPLGRYLGKHRKLMPTALERIIWGFGDGSTIPVYDTPLGKIGALICWENKMPLLRTALYGKGIEIYCAPTADSRPVWQASMTHIALEGGCFVLSANQFCRRKDYPPPPEYEFAGLGEEPSADTVVCPGGSVIISPSGEVLAGPNYEGEALITADLDLGEIVRAKFDFDVVGHYSRPEVLSLVVNDQPHLPVSFTSAGEKTPAAKSDSDAKSY

SEQ ID NO: 46460 - protein, 362 aa, Sorghum bicolor
  unsure (1)..(362): unsure at all Xaa locations
  Clone ID: SORBI-28MAY03-C72_1.pep
MGSTAEDVAAVADEEACMYAMQLASSSILPMTLKNALELGLLEVLQKDAGKALAAEEVVARLPVAPTNPAAADMVDRMLRLLASYDVVKCQMEDKDGKYERRYSAAPTCNWLTPFMHGXSNSPIKTSFSPRIXIQTKRNLKVVLLYGGIPSSKAYGMTALEYHGTDPRFNRVFNEGMKNHSVIITKKLLEFYTGFDESVSTLVDVGGGIGATLHAITSHHSHIRGVNFDLPHVISEAPPFPGVQHVGGDMFKSVPAGDAILMKWILHDWSDAHCATLLKNCYDALPEKGGKVIVVECVLPVTTDAVPKAQGVFHVDMIMLAHNPGGRERYEREFRDLAKAAGFSGFKATYIYANAWAIEFIK

SEQ ID NO: 46461 - protein, 273 aa, Sorghum bicolor
  Clone ID: SORBI-28MAY03-C587_1.pep
MALAASHHGLLPVAPAPTATLTPSRGHLRFRAARPLRHRPARRICCQSINSANVLGASSKTSDEAVPVPVVQIDQDSDRDATIVQLSFGDRLGALLDTMKALKDLGLDVTKGSVTTDSAVTQTKFHIMRSGRKVEDPDMLERIRLTIINNLLQYHPESSEKLAMGEFFGIKPPEKKAVVDIATRIVIEDDGPKRSMLYIETADRPGLLLEIIKIIADTNVDVESAEIDTEGLVAKDKFHVSYRGAKLNSSLSQALINCLRYYLRRPETDEDSY

SEQ ID NO: 46462 - protein, 431 aa, Sorghum bicolor
  unsure (1)..(431): unsure at all Xaa locations
  Clone ID: SORBI-28MAY03-C7361_1.pep
MEAPARLPISLLVVSALLLLLSAQGPAGAAAAAVPPRIQPLATAALRRLYDTSNYGRLQLNNGLALTPQMGWNSWNFFACNINETVIRETADALVSTGLAALGYNFVNIDDCWSYVKRGKQDQLLPDPKTFPSGVKALADDVRGKGLKLGIYSDAGKFTCQVRPGSLDHDSEDAAAFAPWGADYRKXDTCLVSSTCPHKRXPHMRDALDATGRKFFYYLSVWGRVVPALWAGKVGHSWRTTDDITDTWQSMTDIADKNNKWASYAGPGGWNDPDMLEVGNGGMTSAEYRSHFSIWALMKAPLLIGCDVRNMTSETMEILSNKEVIQVNQDPLGVQGRKILGEGKYGCREVWAGPLSGNRLVIALWNRCSETANITMKLPAVGLDGSAAYSVRDLWKHETLSENVVGTFGAQVDVHDTKMYIFSPATSVASI

SEQ ID NO: 46463 - protein, 71 aa, Sorghum bicolor
  unsure (1)..(71): unsure at all Xaa locations
  Clone ID: LIB3476-032-P1-K1-H1.pep
MQSQIVCHACRTVLLYPRGASSVCCAVCQAITTVPPPGLEMAQLICGXCRTLLMYTRSADTVRCSCCNTVN

SEQ ID NO: 46464 - protein, 75 aa, Sorghum bicolor
  Clone ID: LIB3478-050-P1-K1-F1.pep
YYIFKIFLNIFFFQQTNKLRNNARIMKLCCNSSQLSDYRSLIEPILYTQKNQYTVSDHCFISKVLIKILHGVSPR

SEQ ID NO: 46465 - protein, 487 aa, Sorghum bicolor
  unsure (1)..(487): unsure at all Xaa locations
  Clone ID: SORBI-28MAY03-C8889_1.pep
ARGSPPSFNLQIWPLPHAQSPKPYTSPLSATATAIAMAGRRPAPAALLLLLLAASFAPISSAVRPVSDAHRSAAAELFAPSADGSFGDLESTYEAVRTFQILGLENYKSLSGKACKFAAENLASPGSTAKDLFHAVRISGALGCGVDAGVYDGVVATLKAVIKDTNSLLEFYCSVAGLRNIKEHGHHVVMSDSERTFHSMKALSPSDGSSRLDTNSAXSTSSVSWLALEPYPTFAPWGHNRSRHNLTIQAEFSISXIFEMVIADHCVTFRFNVTEPYIFVSYMHFKGSLALFQLPSMYADFKWMFNHRTPLSFPCGTRVFVPLILSLPSKVFSLTSKDQLKVEVTTVFGSASPSLKVNLVQVLGSDSKVITNENKELQYDLDNNVHYLDIAPLKIDVGKYSIVFEISLQEPEHETVYVTGGRNTESVIVTGLIKVNKAEIGISDNDAGTVESVQKLDLLKDTKVSLSANHLQKLRLSFQLTTPLGHT

SEQ ID NO: 46466 - protein, 59 aa, Sorghum bicolor
  Clone ID: LIB3480-043-P1-K1-E5.pep
ASLFHAGVGAVLLLYVLFWLKLELVTTLKYLGFLVIFLVFVGHRTLSYLSSVSTKQKTA

SEQ ID NO: 46467 - protein, 405 aa, Sorghum bicolor
  unsure (1)..(405): unsure at all Xaa locations
  Clone ID: SORBI-28MAY03-C7032_1.pep
MASNTGTANCTTVTHPRPSTGKLITILSIDAGGSRGLSPATVITHPEAKTQQVAGPDDLNGHYFAVLGGTRTGALHASMLAAPDDNNRARXNRRPLSPSKAXNHPKTFPQNQPVFLTKGRVVVGLVRRPRYDDVFLQRRRVPLTHDVKPAETGTDSILAAFDVKYLQPIIFSTYEPLPHALKNAHLSDICISTSAAPTYFPAHFFKTEATDGRSREFHLVDGGVAANNPTMVAMSMLTKEVLRRNPDFNAGRPTEYTNYLIISVGTGSAKQAEKYTAPQCAKWGLIQWLYNGGFTPIIDIFSHASSDMVDIHAAVLFEALHCEKNYLRIQDDTLTGDTSSVDIATKENMESLIGIGQELLKKPVARVNIDTGVYESCSGEGTNAEALAHFAKKLSDERKLRKSNL

SEQ ID NO: 46468 - protein, 218 aa, Sorghum bicolor
  unsure (1)..(218): unsure at all Xaa locations
  Clone ID: SORBI-28MAY03-C1112_2.pep
MATGSEASKPAEVPAETVLDWHKQDNKRMLHAVYRVGDLDRTIKYYTECFGMKLLRKRDIPEEKYTNAFLGFGPEDTNFAVELTYNYGVDKYDIGTGFGHFAIANEDVYKLAENIKSKGGKITREPGPVKGGSTVIAFAQDPDGYMFELIQRAETPEPLCQVMLRVGDLERSIKFYEKALGLKLLRKKDVPDYKYTIAMFGYADEDKTXVLELTYNYG

SEQ ID NO: 46469 - protein, 299 aa, Sorghum bicolor
  unsure (1)..(299): unsure at all Xaa locations
  Clone ID: SORBI-28MAY03-C1112_1.pep
MQAKEWQLVAPEGVKPAESPPLCLLVLLHRIESDLRPNPSQALSSGMATGSEASKPAEVPAETVLDWHKQDNKRMLHAVYRVGDLDRTIKYYTECFGMKLLRKRDIPEEKYTNALVGFGXRXTNFEITRTPGPVKGGSTVIAFAQDPDGYMFELIQRAETPEPLCQVMLRVGDLERSIKFYEKALGLKLLRKKDVPDYKYTIAMLGYADEDKTTVLELTYNYGVTEYSKGNAYAQVAIGTNDVYKSAEAVELATKELGGKILRQPGPLPGINTKIASFVDPDGWKVVLVDNTDFLRELH

SEQ ID NO: 46470 - protein, 246 aa, Sorghum bicolor
  Clone ID: LIB5049-010-R1-XP1-F3.pep
MMSGWAPAAYYTLVLLLLLVLGVVTAQSSNGGVGRSRRQEEQAVSEVSFGNLAHASSPMESIALSSGMATGSEASKPAEVPAETVLDWHKQDNKRMLHAVYRVGDLDRTIKYYTECFGMKLLRKRDIPEEKYTNAFLGFGPEDTNFAVELTYNYGVDKYDIGTGFGHFAIANEDVYKLAENIKSKGGKITREPGPVKGGSTVIAFAQDPDGYMFELIQRAETPEPLCQVMLRGGDLERSIRFMRKP

SEQ ID NO: 46471 - protein, 136 aa, Sorghum bicolor
  Clone ID: SORBI-28MAY03-C4451_1.pep
MARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGERA

SEQ ID NO: 46472 - protein, 263 aa, Sorghum bicolor
  Clone ID: SORBI-28MAY03-C13693_1.pep
MATAAAPDDSTVRETTKAEEVLPPTLGSGSQPPNLFDGTTRLYISYICPYVQRVWIARNFKGLQEKIQLVAIDLQDKPAWFLEKVYPPGKVPVLEHNGNIIAESLDLLSYLDANFEGPKLFPGDQDPAKQAFADELIANSDSIIIALFRAGRAYAEGQGDDDISKLLAPALDKVEESLGRFSDGPFLLGQSMSAVDMVYAPFIERFKDFFAAVKHYDMTQERPKLKEWIEELNKIDAYTATWGDRRLQLAALMNKFGIQSPVA

SEQ ID NO: 46473 - protein, 204 aa, Sorghum bicolor
  Clone ID: SORBI-28MAY03-C471_2.pep
MGAYKYVSELWRRKQSDVMRFVQRVRCWEYRQQPAIVRLTRPTRPDKARRLGYKAKQGYVVYRVRVRRGGRKRPVPKGIVYGKPKHQGITQLKFQRNKRSVAEERAGRKLGGLRVLNSYWVNEDSTYKYFEIILVDVAHTTIRNDPRINWLCNPVHKHRELRGLTSAGKKFRGLRGKGHTHHKNRPSRRATWKRNQTLSLRRYR

SEQ ID NO: 46474 - protein, 204 aa, Sorghum bicolor
  Clone ID: SORBI-28MAY03-C471_1.pep
MGAYKYVSELWRRKQSDVMRFVQRVRCWEYRQQPAIVRLTRPTRPDKARRLGYKAKQGYVVYRVRVRRGGRKRPVPKGIVYGKPKHQGITQLKFQRNKRSVAEERAGRKLGGLRVLNSYWVNEDSTYKYFEIILVDVAHTAIKTDPRINWLCNPVHKHRELRGLTSAGKKFRGLRGKGHTHHKNRPSRRATWKRNQTLSLRRYR

SEQ ID NO: 46475 - protein, 317 aa, Sorghum bicolor
  Clone ID: SORBI-28MAY03-C1411_1.pep
MASDGSGVVTVYGNNGAALLEPSKQPKSATFSVKVGLAQMLRGGVIMDVVTPEQARIAEEAGACAVMALERVPADIRSQGGVARMSDPGLIRDIKRAVTIPVMAKARIGHFVEAQILEAVGVDYVDESEVLTPADDAHHINKHNFRVPFVCGCRDLGEALRRVREGAAMIRTKGEAGTGNIVEAVRHVRSVMGDVRALRNMDDDEVFAYAKRIAAPYDLVMQTKQLGRLPVVQFAAGGVATPADAALMMQLGCDGVFVGSGIFKSGDPARRARAIVQAVTHYSDPTILADVSAGLGEAMVGINLNDPKVERYAARSE

SEQ ID NO: 46476 - protein, 667 aa, Sorghum bicolor
  Clone ID: SORBI-28MAY03-C11141_1.pep
MDAAAEVDHHAAERAAVRFDVEAMKVAWAGSRHAVEVGDRMARLVASDPVFRKDNRTMLSRKDLFKDTLRKAAHAWKRIVELRLTEEEAGMLRLYVDQPGYVDLHWGMFVPAIKGQGTEEQQKKWLPMAYKFQIIGCYAQTELGHGSNVQGLETTATFDPKTDEFVIHSPTLTSSKWWPGGLGKASTHAVVYARLITEGKDYGIHGFIVQLRSLEDHSPLPGVTLGDIGGKFGSGAYNSMDNGVLRFDHVRIPRDQMLMRLSQVTREGKYVNSDVPKQLLYGTMVFVRQTIVADASKALSRAVCIAVRYSAIRKQFGSQDGGPETKVLDYKTQQSRLFPLLASAYAFRFVGDWLKWLYMDVTQKLEAKDYSTLQETHACTAGLKAVTTSATADAIEECRKLCGGHGYLNSSGLPELFAVYVPACTYEGDNIVLLLQVARILMKTVSQLASGKQPVGTMAYMGNVQYLMQCKCAVNTAEDWLNPVAIQEAFEARALRMAVNCAQNIGQAASQEEGFSERSPDLLEAAVAHIQLIIVTKFIAKVQQDIPGHGVKEQLQNLCNVYALYILHKHLGDFLATGCITPKQGALANEQLGKLYAQVRPNAVALVDAFNYTDHYLGSVLGRYDGNVYPALYEEAWKDPLNETVVPEGYHEYLRPLLKQQLKLSRL

SEQ ID NO: 46477 - protein, 216 aa, Sorghum bicolor
  Clone ID: SORBI-28MAY03-C710_1.pep
MSKLQSEVLKDAISQIVGDAKEKNRKFTETVELQIGLKNYDPQKDKRFSGSVKLPHIPRPKMKVCMLGDAQHVEEAEKMGLDYMDVESLKKMNKNKKLVKKLAKKYHAFLASEAIIKQIPRLLGPGLNKAGKFPTLVTHQESLESKVNETKATVKFQLKKVLCMGVAVGNLSMEEKQIQQNIQMSVNFLVSLLKKNWQNVRCLYVKSTMGKPYRVF

SEQ ID NO: 46478 - protein, 131 aa, Sorghum bicolor
  Clone ID: SORBI-28MAY03-C118_1.pep
MASQLSAAVPQFHGLRGYASPRSVVAMPSVRVGRKRSQGIRCDYIGSATNLIMVTTTTLMLFAGRFGLAPSANRKATAGLKLEARDSGLQTGDPAGFTLADTLACGAVGHILGVGIVLGLKNTGALDQIIG

SEQ ID NO: 46479 - protein, 131 aa, Sorghum bicolor; identical to SEQ ID NO: 46478
  Clone ID: LIB5052-010-A1-XP1-B1.pep

SEQ ID NO: 46480 - protein, 63 aa, Sorghum bicolor
  unsure (1)..(63): unsure at all Xaa locations
  Clone ID: LIB3481-003-Q6-K1-H11.pep
MASQLSAAVPQFHGLRGYASPRSVVAMPSVRVGRKRGRXVRCDYIGSATNLVCIYIYICVKYI

SEQ ID NO: 46481 - protein, 547 aa, Sorghum bicolor
  Clone ID: SORBI-28MAY03-C78_1.pep
MARRAASSLVSRCLLARASAPAAPPAVPSALRRPDGMRGLLPGVLQRFSTAAAVEEPITPSVQVNYTKLLINGNFVDAASGKTFPTLDPRTGEVIAHVAEGDAEDINRAVAAARKAFDEGPWPKMTAYERSRILLRFADLIEKHNDELAALETWDNGKPYEQAAHIEVPMVARLMRYYAGWADKIHGLVVPADGPHHVQILHEPIGVAGQIIPWNFPLLMFAWKVGPALACGNTLVLKTAEQTPLSALYISKLLHEAGLPEGVVNVVSGFGPTAGAALASHMDVDKLAFTGSTDTGKVVLELAARSNLKTVTLELGGKSPFIIMDDADIDHAVELAHFALFFNQGQCCCAGSRTFVHERVYDEFVEKAKARALKRVVGDPFRKGVEQGPQIDDEQFNKILRYIRSGVDSGANLVTGGDRLGEKGYYIQPTIFSDVQDGMKIAQEEIFGPVQSILKFKDLNEVIKRANASPYGLAAGVFTNSLDTANTLTRALRAGTVWINCFDIFDAAIPFGGYKMSGIGREKGIDSLKNYLQVKAVVTPIKNAAWL

SEQ ID NO: 46482 - protein, 264 aa, Sorghum bicolor
  Clone ID: SORBI-28MAY03-C1775_1.pep
MASVAEMQPLAPAGYRRSPEMKEKVEASEVDLEAGTGETLYPGISRGESALRWGFVRKVYGILAAQLLLTTAVSALTVLHPTLNATLSDSAGLALVLAVLPFILMIPLYHYQHKHPHNFVFLGLFTLCLSFSIGVACANTQGKIVLEALVLTAGVVVSLTAYAFWASKKGKEFGYLGPILSSALTILVLTSFLQIFFPLGPVSVGLFGGLGALVFAGFILYDTENLIRRHTYDEYIWASVGLYLDILNLFLSILNMLRSMQSDN

SEQ ID NO: 46483 - protein, 547 aa, Sorghum bicolor
  Clone ID: SORBI-28MAY03-C14568_1.pep
MAAKKQLPQAVAAASGHTKMGEEKLIIRSEKVRFIDVLSMLFLRRPITSYAFVEAGDRTAADFGSTPGDWLVALTQLIQKALDAAYYPALVIGAVVEFLLNFVALNNGILGIFLNIFRCKLVIPHRDAPNFRSMIGLIDGRTELKPLPAGGGPEDRRLQVVGVSAAGSDDYYVDVESGGGGGSSTGTAAVPLVQQQYVNGRLIRLRTFSVFEVSMMAAKIAYENAAYIENVVNNVWKFHFVGFYNCWNKFVGDHTTQAFVFTDKANDASVIVVSFRGTEPFNMRDWSTDVNLSWLGMGVLGHVHVGFLKALGLQEEDGKDAAKAFPKAAPNAVAGKPLAYYTLREELRAQLKKHPNANVVITGHSLGGALAAIFPALLAFHGERDILDRLLSVVTYGQPRVGDKVFAAYVRGNVPVEPLRVVYRYDVVPRVPFDAPPVAEFAHGGTCVYFDGWYKGREIANGGDAPNPNYFNPRYLLSMYGNAWGDLFKGAFLWTKEGKDYREGAVSLLYRATGLLVPGIASHSPRDYVNAVRLGSVVVAGKEEEVV

SEQ ID NO: 46484 - protein, 101 aa, Sorghum bicolor
  Clone ID: SORBI-28MAY03-C666_2.pep
TCCRRPGILTKDESNAGQLQPVKSRQSDYPTVTDSTNYLDSELREELYYSIGIHPENSNQFEHSIHLHQIYRVVHTILWQEEHIIASNARKWKKERNTILS

SEQ ID NO: 46485 - protein, 302 aa, Sorghum bicolor
  Clone ID: SORBI-28MAY03-C666_1.pep
MGALDLHLEFASAQHGQAKLNVEEYAKGSLLSDGNYNTEKINGSNPDEYEKFQKGIMQYGCPHYRRRCRIRAPCCNEVFDCRHCHNETKNSIKIDKMKRHELPRHEVQQVVCSLCGTEQEVQQVCINCGVCMGKYFCGLCKLFDDDVSKQQYHCNGCGICRIGGRENFFHCSKCGCCYSIALKNSHACVEGAMHHDCPICFEYLFESTNDVSVLPCGHTIHVKCLKEMEEHCQFACPLCSKSVCDMSKAWERLDMELATLSDSCDDKMVRILCNDCGAISDVQFHLIAHKCQNCKSYNTRQI

SEQ ID NO: 46486 - protein, 143 aa, Sorghum bicolor
  Clone ID: SORBI-28MAY03-C253_1.pep
MAASTVSGLAGASSLASRPAFSTSFTRGSRVSARNPLMTRNLERNGRITCMTFPRDWLRRDLSIIGYGLIGWMGPSSIPAINGNSLTGLFFSSIGEELAHFPTPPPVTSQFWLWLVTWHLGLFIVLTFGQIGFKGRTEDYFEK

SEQ ID NO: 46487 - protein, 286 aa, Sorghum bicolor
  unsure (1)..(286): unsure at all Xaa locations
  Clone ID: SORBI-28MAY03-C33549_1.pep
MAHYEQQGRRQQVDEYGNPIPGGHAIQGRQAGGYGAVAGTGSYDAGGYGSQQQQAGYGPTGTGMHDAGGYGGGQQAGYGATGTGTHDAGGYGGSGHTGYGATGTGVHDAGGPGGYGARAHGTHGVTGIQDGAGGVGHTGGLAAATAVCTHGNGTGHGAHGGATGGSHDARVTGKHXHRKDGRRRTAWGAYGGTGYAGPTTGTGTTGGGTYVPTTGGGTHEKKGVMEKIKEKIPGGHKDYQHTTAGTGGGYGGTTGTYGTATTTTTEGTHEKKGFMEKIKEKLPGQH

SEQ ID NO: 46488 - protein, 421 aa, Sorghum bicolor
  Clone ID: SORBI-28MAY03-C56075_1.pep
MAISWRVCLFALVVALGFLFFLDGAAAARSAGTSSAAAQRRREVRSLLTRLNKPPLATIESPDGDIIDCVHISKQPAFDHPLLKNHSIQMMPSCHPEGLNNNSNIAPNPFTQTWHQNGKCPENTIPIRRTKEEDVLRVSSIERYGKKSPWSIPNRFSIDDPDSVNVLRGHQHAIASAPEDDNYYGTQATFNLWEPIVEMDEGFSLTQFWISSGSYSNNDLNTIEAGWQVYPGLYKDRHTRLFIYWTRDAYNKTGCYNLLCSGFIQTSNQIAIGASNSYLSPVSVYGGSQYDFTILVWKDPKDGNWWLQVGGHDLGYWPTSIFTRLAGSAASVEWGGEVASSPDAGQTSTQMGSGHFPEEGFSKASYVKNIQLVDSTNNLKSPSAVSLVAKWPKCYNVQNGTSADWGTYIFYGGPGKNPNCQ

SEQ ID NO: 46489 - protein, 116 aa, Sorghum bicolor
  Clone ID: SORBI-28MAY03-C329_2.pep
SFGPPAPPPGFWMSFLRVMHGVVNFCGRVSCLISQNTQAFHMFITAFLQLCDRAGMLYGELARFVLRLLGIKTKPKKGGVKGAGAPSSEGRGQQFVEAPKANSSWDSVWTEDGKGK

SEQ ID NO: 46490 - protein, 369 aa, Sorghum bicolor
  Clone ID: SORBI-28MAY03-C329_1.pep
MGEITNVMEYQAIAKQKLPKMAYDYYASGAEDEWTLKENREAFSRILFRPRILIDVSKIDMTTTVLGFKISMPIMVAPTAMQKMAHPDGEYATARAAAAAGTIMTLSSWATSSVEEVASTGPGIRFFQLYVYKDRKVVEQLVRRAERAGFKAIALTVDTPRLGRREADIKNRFVLPPHLTLKNFEGLDLGKMDQAADSGLASYVAGQVDRTLSWKDVKWLQTITTMPILLTGVRTAEDTRLAVANGAAGIIVSNHGARQLDYVPATISALEEVVKAARGQIPVFLDGGVRRGTDVFKALALGAAGVFVGRPVVFSLAAAGEAGVSNVLRMLRDEFELTMALSGCTSLADITRNHIITESDRLRVMPSRL

SEQ ID NO: 46491 - protein, 110 aa, Sorghum bicolor
  unsure (1)..(110): unsure at all Xaa locations
  Clone ID: LIB3481-015-P1-K1-E5.pep
MGEITNVMEYQAIAKQKLPKMAYDYYASGAEDEWTLKENREAFCRILFRPRILIDVSKIDMTTSVLGFKISXMPIMVAPTAMQKMAHPDWEYATARAASAGGTIMTLSSW

SEQ ID NO: 46492 - protein, 214 aa, Sorghum bicolor
  Clone ID: SORBI-28MAY03-C1031_1.pep
MAPMKLYGAVMSWNVTRCATALEEAGSDYEIVPINFATAEHKSPEHLARNPFGQVPALQDGDLYLFESRAICKYAARKNKPELLRVGNLEESAMVDVWMEVEANQYTSVLNPILFQVLISPMLGGTTDQKVVDENLEKLKKVLEVYEARLTKCKYLAGDFLSLADLNHVSATLCLFATPYASVFDAYPHVKAWWSSLMERPSVQKVAAMMKPSA

SEQ ID NO: 46493 - protein, 392 aa, Sorghum bicolor
  Clone ID: SORBI-28MAY03-C1922_1.pep
MALRASPVSHGAAAAPLPPFARRRMARGVVVAMASTINRVKTVKEPYTPPREVHRQITHSLPPQKREIFDSLQPWAKDNLLNLLKPVEKSWQPQDFLPEPSSDGFYDEVKELRERANEIPDEYFVCLVGDMVTEEALPTYQTMLNTLDGVRDETGASPTTWAVWTRAWTAEENRHGDLLNKYMYLTGRVDMKQIEKTIQYLIGSGMDPGTENNPYLGFLYTSFQERATFVSHGNTARHAKEYGDLKLAQICGTIAADEKRHETAYTKIVEKLFEIDPDYTVLAFADMMRKKITMPAHLMYDGKDDNLFEHFSAVAQRLGVYTAKDYADILEFLVQRWKVADLTGLSGEGRRAQDFVCTLAPRIRRLDERAQARAKQAPVIPFSWIYDRKVQL

SEQ ID NO: 46494 - protein, 334 aa, Sorghum bicolor
  Clone ID: SORBI-28MAY03-C6350_1.pep
MAPLGDGGAVPAAANNLVVSFGEMLIDFVPDVAGLSLAESGGFVKAPGGAPANVACAIAKLGGSSAFLGKFGDDEFGHMLVNILKQNNVNSEGCLFDQHARTALAFVTLKHNGEREFMFYRNPSADMLLTEAELNLDLIRRAKIFHYGSISLIADPVRSAHLAAMRAAKAAGILCSYDPNVRLPLWPSPDAAREGILSIWKEADFIKVSDDEVAFLTKGDANDEKNVLSLWFEGLKLLIVTDGDKGCRYFTKDFKGSVPGFKVDTIDTTGAGDAFVGSLLVNVAKDDSIFHNEEKLREALKFSNACGAICTTKKGAIPALPTVATAQELIAKAT

SEQ ID NO: 46495 - protein, 481 aa, Sorghum bicolor
  Clone ID: SORBI-28MAY03-C10178_1.pep
MALTRIGLAGLAVMGQNLALNIAEKGFPISVYNRTTSKVDETVQRAKAEGNLPVYGFHDPASFVNSIQKPRVVIMLVKAGAPVDQTIATLAAHLEQGDCIIDGGNEWYENTERREKAMEERGLLYLGMGVSGGEEGARNGPSLMPGGSFEAYKYIEDIVLKVAAQVPDSGPCVTYIGKGGSGNFVKMVHNGIEYGDMQLISEAYDVLKSVGKLTNSELHQVFSEWNKGELLSFLIEITADIFGIKDEQGEGYLVDKVLDKTGMKGTGKWTVQQAAELSVAAPTIEASLDSRFLSGLKDERVEASKIFQGDYSTGLPVDKAQLIEDVRQALYASKICSYAQGMNIIKAKSSEKGWGLNLGELARIWKGGCIIRAIFLDRIKKAYDRNSNLANLLVDPEFAQEIMDRQAAWRRVVCLAINNGVSTPGMSASLAYFDSYRRDRLPANLVQAQRDYFGAHTYERVDMPGAFHTEWFKIARNISKN

SEQ ID NO: 46496 - protein, 444 aa, Sorghum bicolor
  unsure (1)..(444): unsure at all Xaa locations
  Clone ID: SORBI-28MAY03-C8090_1.pep
NIGASNRDDSFYMYKMPRMISXIVGRGDGMKQNLLNMVCLAKALAGPASYTTKYCGCELGQQTYFDDATIKYLLGGAHYTSKLAVWMGAFITVQIXXYDRGFPGYGILISKTQMISLKCAACGFVSDVDMRDKLTTFILKNPPEQKKGGKDKKAMRRAEKERLKEGEAADEEMKKLKKDAKKKGASKEPTAKGSKKKATAAGSDEDHSTSPTRSRDGDHAAADEEEDDDDVQWQTDTSIEAAKQRMQEQLSAATAEMVMLSTEETEKKKKQATHANGSAKEIPVEKPAVTKPSPYEELVGDIKASLGSAPTPTQLKAVLASSTLPPQDVMNALLEALFDGVGKGFAKEVVKNKKYLAVAVPDEAAQVLLVQAIEAFGGKCNPEALKEVPVVLKALYDGDILEEETIVDWYNAAVAAGKDSQVVKNAKPFVEWLQSAESEEEDDE

SEQ ID NO: 46497 - protein, 241 aa, Sorghum bicolor
  unsure (1)..(241): unsure at all Xaa locations
  Clone ID: SORBI-28MAY03-C76_4.pep
MGRGRVELKRIENKINRQVTFAKRRNGLLKKAYELSVLCDAEVALIIFSNRGKLYEFSSTQSMPKTLEKYQKCSFAGPETAVQNRENEQLKSSRNEYLKLKARVDNLQRTQRNLLGEDLESLGIKELEHLEKQLDSSLKHIRSTRTQHMVDQLTELQKREQMFCEANKCLRRRLEESNQVIWQHAWEQQGERHPEVQPQQLHGNNFFHPLDAAGEPTXQIGYPSEXLTSSCMTTFLPPWLP

SEQ ID NO: 46498 - protein, 246 aa, Sorghum bicolor
  unsure (1)..(246): unsure at all Xaa locations
  Clone ID: SORBI-28MAY03-C76_3.pep
MGRGKVELKRIENKISRQVTFAKRRNGLLKKAYELSLLCDAEVALIIFSGRGRLFEFSSSSCMYKTLERYRSSNYSSQEVKVPLDSGINYQDYLKLRTRVEFLQTTQRNILGEDLGPLSMKELEQLENQIETSLKQIRSRENQMLLDQLFDLKSKEQELQDLNKDLRKKCQLQETSPENVLHVSSWEEGGHSGASGNVLDPYQGLLQHPESDPSLQIGYHQQAYMDQLXTNEDMAGPNEHGRSGWI

SEQ ID NO: 46499 - protein, 243 aa, Sorghum bicolor
  unsure (1)..(243): unsure at all Xaa locations
  Clone ID: SORBI-28MAY03-C76_2.pep
MGRGRVELKRIENKINRQVTFAKRRNGLLKKAYELSVLCDAEVALIIFSNRGKLYEFCSGQSITKTLERYEKSNYGXPDTAVQNKENELVQSSRNEYLKLKARVDNLQRTQRNLLGEDLGSLGIKELEQLEKQLDSSLRHIRSTRTQHMLDQLTDLQRREQMLCEANKCLRRKLEETSNXRCIASVEHGANLLGYERPLPPXQAPSHIGNGLFFHPLEAAAEPTLQIGFAPEHMNNFMPTWLP

SEQ ID NO: 46500 - protein, 209 aa, Sorghum bicolor
  unsure (1)..(209): unsure at all Xaa locations
  Clone ID: SORBI-28MAY03-C76_1.pep
MLKSRTELCCRPSEVTEQRAEELAPGDKHERGQIAITRRGNAPHEQDNGGNARNGLLKQVDNLSILRDAQVALIGFFRHGHLYESANNSVKYTIXGSRSTTVAPPTLTPLQKTVQSTTRRLPARYLGSLVVRKMQPLQKXLNSSIKHIRSTMTKHMAGPRTELQKREQMFCEGNKRLRSRLEESNRIRRQPTWNQQDGSLREVHPRRRR

SEQ ID NO: 46501 - protein, 141 aa, Sorghum bicolor
  unsure (1)..(141): unsure at all Xaa locations
  Clone ID: LIB3480-014-P1-K1-C8.pep
DAWGSFRPERPRCRHAPAGLTRSGTCGETLIIFSNTCNLYXFCIVQSITKTLXRYEKSNYGGPDTAVQNKENELLQSIRNEYLKLKASIDKLQTTHMNFIGKDLATLAIKLLQQLEKQLDSSLRHIRSTRTQHMLDQLTYL

SEQ ID NO: 46502 - protein, 481 aa, Sorghum bicolor
  Clone ID: SORBI-28MAY03-C12363_1.pep
MVAARLRLALLLLLPVFLCSAWARPRLEPTIRLPSDRADDAVGTRWAVLVAGSNGYYNYRHQADICHAYQIMKKGGLKDENIIVFMYDDIAHSPENPRPGVLINHPQGGDVYAGVPKDYTGREVSVNNFFAVLLGNKTALKGGSGKVVDSGPNDHIFVFYSDHGGPGVLGMPTYPYLYGDDLVDVLKKKHAAGTYKSLVFYLEACESGSIFEGLLPDDINVYATTASNAEESSWGTYCPGEFPSPPPEYDTCLGDLYSVSWMEDSDFHNLRTESLKQQYKLVKDRTAVQDTFSYGSHVMQYGSLELNVQKLFSYIGTNPANDGNTFVEDNSLPSFSKAVNQRDADLVYFWQKYRKLADDSSKKNEARKELLEVMAHRSHVDNSVELIGSLLFGSEDGPRVLKAVRAAGEPLVDDWSCLKSMVRTFEAQCGSLAQYGMKHMRSFANICNAGILPEAVSKVAAQACTSIPSNPWSSIDKGFSA

SEQ ID NO: 46503 - protein, 473 aa, Sorghum bicolor
  Clone ID: SORBI-28MAY03-C2549_1.pep
MERYTIIKEVGDGTFGSVWRATNKESGEVVAIKKMKKKYYSWEECINLREVKSLRRMNHPNIVKLKEVIRENDMLFFVFEYMECSLYQLMKSRGKPFSETEIRNWCFQIFQALSHMHQRGYFHRDLKPENLLVTKELIKIADFGLAREISSEPPYTEYVSTRWYRAPEVLLQATVYNAAVDMWAMGAIIAELFSLRPLFPGSSEPDELYKICSILGTPNQRTWPEGLQLAASIGFQFPQCESVHLSEVVPLASEDAISLISWLCSWDPRRRPTAVEVLQHPFFQQCFYVPPSLRFKSTGYASTPPSAGAKGAVDQKNIRRYSMGTVPNARPTVNYSYLSNNAPARAAGVQRKLELDHQLPETNNHKVTKANMMNQSWSRPAAVRSNGNYLAKDQNPRAPDLAEKLSQLSMGPNRVSGLGSERFATDLKYRTHGNTVKRPLPVGSRAWHGPADPFRRPYEMPGDRALLPRKLVS

SEQ ID NO: 46504 - protein, 475 aa, Sorghum bicolor
  Clone ID: SORBI-28MAY03-C2639_1.pep
MAGGFRVLHLVRPFLAFLPEVQSADRKIPFREKVIYTVISLFIFLVCSQLPLYGIHSTTGADPFYWMRVILASNRGTVMELGITPIVTSGMVMQLLVGSKIIEVDNSVREDRALLNGAQKLLGILIAIGEAVAYVLSGMYGSVSQLGTGNAILIILQLFFAGIIVICLDELLQKGYGLGSGISLFIATNICENIIWKAFSPTTINSGRGAEFEGAVIALFHLLITRTDKVRALREAFYRQNLPNVTNLLATVLVFLIVIYFQGFRVVLPVRSKNARGQQGSYPIKLFYTSNMPIILHSALITNLYFISQLLYRKYSGNFLVNLLGKWKESEYSGHSVPVGGLAYYVTAPSSLADVLANPFHALFYVVFMLSACALFSKTWIEVSGSSAKDVAKQLKEQQMVMPGHRESNLQKELNRYIPTAAAFGGVCIGALTVLADFMGAIGSGTGILLAVTIIYQYFETFEKERATELGFFGF

SEQ ID NO: 46505 - protein, 579 aa, Sorghum bicolor
  Clone ID: SORBI-28MAY03-C3018_1.pep
MYPSVEELLFPRNSVDKPVCKGKTDAQSKGKSVMSSLTQPAPYSLPTHAPPPPPPCISEWSRPRRSLQHPWQYEDNAKATSDSRWRIPMYKMPYAPPPPAVPPPGYGPSPHFPYPGRLLSSGHPYGDLAGNMENSAQRSLHRWIQCDGCGVQPIVGPRYKSNVKEDYDLCDSCFQRMGNEMEYTKIDKPISPHKFLRDPHATRKVHHTRVLMKSKREKLESRFILDVTVLDGTLMTPSTSFTKIWRMHNNGSVVWPLGTQLIWVGGDQFALQSSVPLEIPVDGFPVDKEIDVAVDFVAPRRPGRYISYWRLASPSGQKFGQRVWVHIQVEDPSFVNDNNRSAAINLNLPPESNSANTTNLIDVNIEPVDSALTAKRTKEFHFCSTDVSGPKKSLPATLVATSSSAAAPANPTGDVPMSSAPAAAFVPSVNVPMPEVVTHTPSPAMPVLPTTIPMSAPVSAPAIAPVSASGAVPAPPPVSAVVPELSDLDVHNEEKLLRELEEMGFRQIDLNKEILRQNNYNLEQSVDDLCGVNEWDPLLAELEEMGFDDTEVNKELLAKNGGSIKRAVMDLIAREKKDK

SEQ ID NO: 46506 - protein, 77 aa, Sorghum bicolor
  Clone ID: LIB3481-017-P1-K1-B10.pep
FNVHMEAYGAMEGAEEMGEKNMFLDKRLHLTSCFTNSGSFNRGEKSPNAPCQDWKKKHFFELKLYCNIVRHIRWFSA

SEQ ID NO: 46507 - protein, 92 aa, Sorghum bicolor
  Clone ID: SORBI-28MAY03-C678_1.pep
MAYFQEVDYCSEEVRSVAPAGGFGRYGGGVQQHVVKEKFEEVDTVSRAGGHHHGHGHHGHGVVVRETRVEEDFNTCTGEFHERKESFLARAN

SEQ ID NO: 46508 - protein, 133 aa, Sorghum bicolor
  Clone ID: SORBI-28MAY03-C33751_1.pep
SSSQRREREHGRREWGGREEEEEEGGRGHKSRSYRQVKSRVREGSVIVIPAGHPTALVAGENSNLAVLCFEVNANFDEKVFLAGRNSALKQMDGPAKLLAFGADEEEVVDRVIGAQKDAVFLRGPQSRRVSSA

SEQ ID NO: 46509 - protein, 571 aa, Sorghum bicolor
  Clone ID: SORBI-28MAY03-C54_1.pep
MAPLLLHASAISHSAHPGLRSHIGPNNEHISRHLSSSSQNTKRRCNISLRSRAQRISSQLGGQKLEHWEIPKRDWFPPSFTFGAATSAFQIEGGWNEDGKGPSTWDHFCHTYPDFIADKSNGDVAADSYHLYEEDVKLLKEMGMDAYRFSISWPRILPNGTLSDINEKGIAYYNNLINLLIDNGIEPYVTIFHWDTPQALVDDYGGFLDKRIIKDYTDFAGLCFERFGDRVNNWLTFNEPHTFTCLSYGTGILAPGRCSPGMKCPDPTGDSIREPYLVGHNLLLAHAETVDLYNKFHRGEKGRIGLALNVMGTVPYGSTFLDEQAHERCMDYNLGWYLEPVVRGDYPHSMRSSVRDRLPHFTEKEQQKLVGSYDMIGINYYSSRFAKHVDITENFSPELNTHDCCATEEITGPNGNTIGPATGNAWVYLYPKGLKDILMIMKKRYGNPPVYITENGIGDIDNGDLSMEAALDDHIRLDYLQRHISVLKDSIDSGANVRGHFTWSLLDNFEWSSGYTERFGIVYVDRENGCKRTLKRSARWLKEFNGAAKRPGNLIKPNFSEINKIKVVTPA

SEQ ID NO: 46510 - protein, 331 aa, Sorghum bicolor
  Clone ID: SORBI-28MAY03-C1753_1.pep
MGEPSADFSAEGVSSSSGLCHSTCLKPGCEHGCACWEDEYVEAVISSGQDDLAVEEIGMALTEVMHANDDEEGPGLDEDSDNDVIDDPILSLESDSTDDLVDVDSVSPAFPSGDGDAMESSIDNSVAGNSSINGTPRLVSAMKGTRAKKGIIAKLSVSWAPDVYDPPITSDSHTVRGHHRSSMKSNYKYKSSKSSSRSTTGSKKDKKHSRHSSSSGGGSKRDRKHSSHSTSSASSSRAVTSGSQYRNTYCGDGISSSRTVTCVPESAKVSPLVLAENAAPQEPVPVLKTLEPIKCATSCSKEKPFALLSRQFSPARYKGMFSFWSQNQLAS

SEQ ID NO: 46511 - protein, 44 aa, Sorghum bicolor
  Clone ID: SORBI-28MAY03-C727_7.pep
SFLFSEDHNNLPLRSQQNHVQVLVEKASDLIVAATQVEKVVHQI

SEQ ID NO: 46512 - protein, 199 aa, Sorghum bicolor
  Clone ID: SORBI-28MAY03-C727_1.pep
AQGIPKLFTSRLLPMPDARGDEMATAPTPAASGSPRAPSSSSASSSASSSSSSRPPPPSFLMCSCATGNPRCFCSRTPAARALFLCAGGSAPQLDVAVAGPSTQGSAAAAATPSHPLLPCLSVRTASVSRCKQARCTNVSCFCLATLLILESIAIPNNVSAELLSQIFQSKTFIDQSPSYASTSWLILAKPSIYLRHCN

SEQ ID NO: 46513 - protein, 54 aa, Sorghum bicolor
  Clone ID: LIB3481-031-P1-K1-F2.pep
LNLASFIAHKVTRKWQKLGINSFLIFKNLTKIDTRNWAKTSLFASYPIFKNPDS

SEQ ID NO: 46514 - protein, 95 aa, Sorghum bicolor
  Clone ID: LIB3481-043-Q6-K1-H9.pep
SLTGMRLWIYASAKWGRQGLQDGIWIVVNDPYSNKYDDVKLPDKKPASSLFLFTKLYGFTLCPYCLLDEQCRKILSSACDSTIMLLSLPTVPCFH

SEQ ID NO: 46515 - protein, 57 aa, Sorghum bicolor
  Clone ID: LIB3476-011-P1-K1-C7.pep
CISVTCLQCLNFTVYVGNRSQGNGCIVVNLHDLVGALNNFFYAISVARYCHLPAIPQ

SEQ ID NO: 46516 - protein, 158 aa, Sorghum bicolor
  Clone ID: LIB5049-006-R1-XP1-G8.pep
RGRPGRDGRATAPSPASLSARLCLGGGDQIDGPAQAVHRRPPPASPPPLPPSPSPSPSPSLRPLPERRLNLDVRQTLQQHRRPRVPSSVSPTILDRLDPGARAALAALVQVTRTTKATTASSRLVTQGSAAVAAAQGHPSFPFSPTAQSSSTRIQPWI

SEQ ID NO: 46517 - protein, 102 aa, Sorghum bicolor
  Clone ID: LIB3480-006-P1-K1-G6.pep
VLINHFACTILLRNMITCCQQIGCTKISFFCLATLLIQESIAFPYHVSDESLSEPCQCKSFIDQGPSHGTTWWLFLGNASMDLCQCEVGSARSSGWDMDCCK

SEQ ID NO: 46518 - protein, 100 aa, Sorghum bicolor
  Clone ID: LIB5048-008-R1-XP1-D10.pep
PGKPPTLCSSQPPRTLASLPRRRNPAPPVRISWARVRRGSVQARIDFSSARRLQTSIYCLKKSREIRQCCSANDCISSWTDKGKMQPLINQNTNRAASSH

SEQ ID NO: 46519 - protein, 141 aa, Sorghum bicolor
  Clone ID: LIB3478-038-P1-K1-D7.pep
ATAPSPASLGARLCLGGGDQIDGPAQAVHRRPPPASPPPLPPSPSPSLRPLPKRHLNLDVRQTLQQHRRPRVPSSVSPAILDRLDPGTRAALAALVQVTRTTKATTASSRLVTQGSAAVAAAQGHPSFPFSRTAQSSSTRL

SEQ ID NO: 46520 - protein, 81 aa, Sorghum bicolor
  unsure (1)..(81): unsure at all Xaa locations
  Clone ID: LIB3476-048-P1-K1-E2.pep
RSSTPDLHGRATAPSPASLGARLCLGGGDADRRPCAGGAPASSXCIXXXTXSLSLSLSLSLSAAFPGTAPQPGCPANSAAA

SEQ ID NO: 46521 - protein, 384 aa, Sorghum bicolor
  unsure (1)..(384): unsure at all Xaa locations
  Clone ID: SORBI-28MAY03-C3103_1.pep
MDEGQGVRYWCHRCEEVIDPMPEMKCPSCDGGFVEEMGSEDFEAATNARSDRSLSLLAPLLFGMLGGXSSRRSRRWRDAMADASADEDDEEDDSDHELEASSKDPGTECSASQLRMLQTIRDRDDVRGSDDTDSDTERDLERARRERIERRMARERIQERMERQRERARQIERVSARGRERTESLILINSNNEAIILQGTFGSDDNQEDSSNTSSGVSLGDYFLGPALDTLLQRLAESDLNRSGTPPAKKEAVAALPTVNIEEVLGCSVCLEDFEMGAEAKQMPCQHKFHSHCILPWLELHSSCPICRFQLPTEETKNPCESASTAGAMNRDGDNAAASSSDTESSNRNGDNHSDSPIFSALSTLFSDPFSSDDDESVPHSSEN

SEQ ID NO: 46522 - protein, 173 aa, Sorghum bicolor
  Clone ID: LIB5050-005-R1-XP1-H1.pep
AVPYRFLLLLLLSFPLRFGPPAWLGVYQARRGPNPPPKADGRRRRRRCSLPAPRRRLLLDTVNLLPLRPCRRGRGRGPRGRVVSPAAPIWASPALTPPDSPRADAGLRYRRLRDRLLGISTRLWDPRADQLSTSTSAPCFWAGEANPRAFLDFSRALLRCGVLYLQSLPTYCL

SEQ ID NO: 46523 - protein, 238 aa, Sorghum bicolor
  Clone ID: SORBI-28MAY03-C3120_1.pep
RISGLPFHGEDKNLIATSEQPLCAYHLGDRIYPAELPIKYAGYSTCFRKEAGSHGRDTAGIFRVHQFEKIEQFCITSPNGNDSWEMHEEMLKNSEDFYKEIGLPYQVVSIVSGALNDAAAKKYDLEAWFPASKTFRELVSCSNCTDFQSRRLGIGYGQKKNDEQSKQFVHMLNSTLTATERTLCCILENFQKEDGVEVPKALQPYMGGIEFLPFKQPLDVKQAADSKSNKSKSKGKAP

SEQ ID NO: 46524 - protein, 501 aa, Sorghum bicolor
  Clone ID: SORBI-28MAY03-C56_1.pep
MDLVLLEKALLGLFAAAVLAVAVAKLTGKRYRLPPGPAGAPVVGNWLQVGDDLNHRNLMSLAKRFGDIFLLRMGVRNLVVVSTPELAKEVLHTQGVEFGSRTRNVVFDIFTGKGQDMVFTVYGDHWRKMRRIMTVPFFTNKVVAQNRVGWEEEARLVVEDVRKDPRAAAEGVVIRRRLQLMMYNDMFRIMFDTRFESEQDPLFNKLKALNAERSRLSQSFEYNYGDFIPVLRPFLRGYLNRCHDLKTRRMKVFEDNFVQERKKVMAQTGEIRCAMDHILEAERKGEINHDNVLYIVENINVAAIETTLWSIEWGIAELVNHPAIQSKLREEMDSVLGAGVPVTEPDLERLPYLQAIVKETLRLRMAIPLLVPHMNLNDGKLAGYDIPAESKILVNAWFLANDPKRWVRPDEFRPERFLEEEKTVEAHGNDFRFVPFGVGRRSCPGIILALPIIGITLGRLVQNFQLLPPPGQDKIDTTEKPGQFSNQIAKHATIVCKPLEA

SEQ ID NO: 46525 - protein, 326 aa, Sorghum bicolor
  Clone ID: SORBI-28MAY03-C14782_1.pep
MAMEGPVLCRPAMQAKLPAAAALVNNSLTKSGQLGTALFGAISKYRNISRFISPISQPSTKNIGPCCSFSSSSDGNGYMAGNFSESDEDYVNSTVLEAVEVRSGSEGYVIKMRDGKNLRCVHNNSQGRNIPESAPQPAIVLRIEDGSETLLPIIVLEMPSVLLMAAIRNVHIARPTIYQVVKEMIDKMGYEVKLVRVNKRIQEAYCAELYLTKIDDPTDSITFDLRPSDAINIAVRCKVPVQVHRSLAYSDGIRPVEPARMAVAAGLSDGLLFTELDRPDGQPCVEAQEFGLVRNMLIAAVEERYKDAASWKDKLMRLRSKRKNWA

SEQ ID NO: 46526 - protein, 186 aa, Sorghum bicolor
  unsure (1)..(186): unsure at all Xaa locations
  Clone ID: LIB5049-003-R1-XP1-C7.pep
MAMEGPVLCRPAMQAKLPAAAALVNNSLTKSGQLGTALFGAISKYRNISRFISPISQPSTKNIGPCCSFSSSSDGNGYMAGNFSESDEDYVNSTVLEAVEVRSGSEGYVIKMRDGKNLRCVHNNSQGRNIPESAPQPAIVLRIEDGSETLLXIIVLEMPSVLLMAAIRNVHIARPTIYPXVKEMID

SEQ ID NO: 46527 - protein, 483 aa, Sorghum bicolor
  unsure (1)..(483): unsure at all Xaa locations
  Clone ID: SORBI-28MAY03-C7290_1.pep
MASGTGTGSRQLQPPAAAADADPGAGGDKLVFEAPPQPVRDDYVENAVKFLSHPKVRGSPVVYRRSFLEKKGLTTEEIDEAFRRVPDPQPSTTATTSPQQQVNSQNHSAGVQTYTPAQPVHPATAGPVALRTQPRFSWYQAFLAAGLLLGFGASAAVFIKKLFLPRLKSWIRNVVAEGDGTEGNQLKATIDEETAEAVKASASAVSAIAKTNQHLLASKXKEKKILVTLTHALDSQAKELKSLTESISHTRGPINITRDDRFSQYRPLEDHAPPVMRNGAINSSWRASQQTNMYGASNGDFGSARSSFAPAPVEPTAGSFSRSYAEQTMSTTQRGDRSSGSKPWEMQQYSQQRPGYGSNSQLSDDGSYSDAQDSYAPSYHQNGKAPDFQADEPRPLTYNTGVEERPPPQRRWVPPQPPGVVMPEAAAAIRQPKTPPKQPSSNASEAAGEVQVNGASSASDAVTEVPVNGATASDAGHSEIEEQ

SEQ ID NO: 46528 - protein, 368 aa, Sorghum bicolor
  Clone ID: SORBI-28MAY03-C288_1.pep
MAAVTAAAVSLSSSSSPAAAAAKAKAAASPSSPCSHLQFLSLYPQRRTRAVRMRVQVSSTETAEAEAVKKEKVSKKQDEGVVTNKYRPKEPYVGRCLSNTRITGDDAPGETWHMVFSTEGEVPYREGQSIGIIADGEDKNGKPHKLRLYSIASSALGDFGDSKTVSLCVKRLVYTNDQGEIVKGVCSNFLCDLKPGSEVKITGPVGKEMLMPKDPNATIIMLATGTGIAPFRSFLWKMFFEEHEDYKYTGLAWLFLGVPTSDTLLYKEELEKMKEMAPENFRLDFAVSREQTNAAGEKMYIQTRMAEYKEELWELLKKDNTYVYMCGLKGMEKGIDDIMVDLAAKDGIDWMEYKKQLKKGEQWNVEVY

SEQ ID NO: 46529 - protein, 114 aa, Sorghum bicolor
  unsure (1)..(114): unsure at all Xaa locations
  Clone ID: LIB3478-002-P1-K1-E7.pep
LLLHSTPRSSRTPAAAXAMAAVTAASPSSPCSHLQFLSLYPQRRTRAVRMRVQVSSTETAEAEAVKKEKVSKKQDEGVVTNKYRPKEPYGRRCLSNTRITGDDAPRGAWHMVFS

SEQ ID NO: 46530 - protein, 473 aa, Sorghum bicolor
  Clone ID: SORBI-28MAY03-C849_1.pep
MNEKASVSKELNAKHKKILESLLRLPENRECADCKSKGPRWASVNLGIFICMTCSGIHRSLGVHISKVRSATLDTWLPEQVAFIQSMGNEKANSYWEAELPPNYDRVGIENFIRAKYEDKRWVPRNGTSRPTSGVRDEKSQESLASANRSGHGHRSSFEQNRVTALPSKVAPVASRIPSQASPQPPKVEPPVPKVVSPPQPQKSPAKVEATPPKVEKPSVAPPPKVDYATDLFNMLSMDGTTEKESESSSNDDNAWDGFQSAQPVPSSEKKDSAKPAESKTQSTSGIEDLFKDSPALSISSAPAVSQVNAKNDIMSLFEKSNMVSPFAAHQQQLAFMSQQQALLMAALKAGNAPQMIPGNANQLNANGSNPPLGTLPFQNWTNLGYQNPGLTPAAAQNGATKVANNNQDFSSGTFGFGTPGVYNTSSAVPANGATAAGASNNGTASTASSNLPSQSGKDYDFSSLTQGFFTKR

SEQ ID NO: 46531 - protein, 83 aa, Sorghum bicolor
  Clone ID: LIB3481-013-P1-K1-E1.pep
ILFTNPIWCSMKFQRPHSATSRQYSLPRCAKTKGTRRKVLIVVRNLGGTILCCCWSQPRILITKICPVLERQGSKRGIRTISI

SEQ ID NO: 46532 - protein, 482 aa, Sorghum bicolor
  Clone ID: SORBI-28MAY03-C41778_1.pep
MVKMEERTGSLYGRLNRTSTRGFLAYVAAGAACAAVLACFVLSAADPPATAARNDVAARLRLSSRSPRVWPDLAFNWRVVVATVVGFLGSAFGTVGGVGGGGIFVPMLNLVVGFDTKSAAALSKCMIMGASASSVWYNLQVSHPTKEAPVIDYKLALLFQPMLMLGITIGVELSVIFPYWLITVLIIILFVGTSSRSFYKGILMWREETRILMETREREEQSKSTCAAGDVIIDPSYEEPLLTQPQPKKKSALETFLFNLRWKNILVLMSVWSSFLVLQVLKNNAKSCSTFYWVVNILQVPVAVSVFLWEAMQLCRESRARRMNGNLECVCEASIEWSPAQLIFCAFCGLLGGTVGGLLGSGGGFILGPLLLELGCIPQVASATATFVMMFSSSLSVVEFYFLHRFPLPFAGYLIFISILAGFWGQCLVRKIVHVLKRASVIVFILSSVIFASALTMGVVGTQKSISMIKNHEYMGFLDFCE

SEQ ID NO: 46533 - protein, 136 aa, Sorghum bicolor; identical to SEQ ID NO: 46471
  Clone ID: SORBI-28MAY03-C7894_1.pep

SEQ ID NO: 46534 - protein, 240 aa, Sorghum bicolor
  Clone ID: SORBI-28MAY03-C5475_1.pep
RGGPASAVPPAPPPAGPALLSLLRLPHFSSPAIRARTRREEKGSPDHQGAASRSRGGAEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGEGLYEGLDWLSNNIANKA

SEQ ID NO: 46535 - protein, 233 aa, Sorghum bicolor
  Clone ID: SORBI-28MAY03-C20876_1.pep
MGILVITVDLDCCRCRAKITKVLDCLKEEFCIEKVEFEDKKEKKVVVVRGKFDAEKLCKKVWCKAGSKVVKEIIIVDVWPIPPKPPKPCDPCNPKPEKCCVCDHCKPKPEKCCVCDHCKPKPKQEQKPKPEEKPKAATPKTEYKFVPYPYLVPNPGMCQSWPWQCPPHQQCQCCQKPPSPPPAPPQRPPCTCSSHGSCGCGQTLPVWPPQPPVWPPPWAGCNVVADENSCSVM

SEQ ID NO: 46536 - protein, 880 aa, Sorghum bicolor
  unsure (1)..(880): unsure at all Xaa locations
  Clone ID: SORBI-28MAY03-C1517_1.pep
MANAPATKHAFKSILASLPKPGGGEYGKFFSLPALNDPRIDRLPYSIRVLLESAIRHCDNFQVTESDVEKIIDWENTSPKLAEIPFKPARCILMDNTGVPAVVDLAAMRDMMPKLGCDPYKINPLIPVDAVIDHAVRVDFAGRHDALDRNEELEFQRNVVXHHVNLEYLGRVVFNTDGILYPDSVVGTDSHTTMIDGLGVAGWGVGGIEAEATMLGQPMSMVLPGVRGFKLTGKLRSGVTATDLVLTVTQMLRKHGVVGKFVEFYGEGMGKLSLADRATIANMSPEYGATMGFFPVDHVTLDYLKLTGRSDETVSMIEAYLRANKMFVDYNEPPTERIYSSYLELDLDEVEPSMSGPKRPHDRVPLKEMKSDWHACLDNKVGFKGFAVPKEQQDKVVKFDFHGQPAEMKHGSVVIAAITSCTNTSNPSVMLGAGLVAKKACELGLEVKPWVKTSLAPGSGVVTKYLLQSGLQEYLNQQGFHIVGYGCTTCIGNSGDLDESVSAAITENDVVAAAVLSGNRNFEGRVHPLTRANYLASPPLVVAYALAGTVDIDFEKEPIGLGKDGKEVYFRDIWPSTEEIAQVVQSSVLPDMFKGTYEAITKGNPMWNQLTVPEASLYSWDSKSTYIHEPPYFKDMTMSPPGPSAVKDAYCLLNFGDSITTDHISPAGSIHKDSPAAKYLMERGVDRKDFNSYGSRRGNDEIMARGTFANIRIVNKFLNGEVGPKTIHVPTGEKLYVFDAAMRYKSEGHATIILAGAEYGSGSSRDWAAKGPMLLGVKAVIAKSFERIHRSNLVGMGIIPLCFKAGEDADSLGLTGHERYSIDLPANLSEIRPGQDVTVITDNGKSFTCTLRFDTEVELAYFNHGGILPYVIRNLAGAQN

SEQ ID NO: 46537 - protein, 565 aa, Sorghum bicolor
  Clone ID: SORBI-28MAY03-C50_1.pep
MALLLASAMNHTAHPAGLRSHPNNESFSRHHLCSSPQNISKRRSNLSFRPRAQTISSESAGIHRLSPWEIPRRDWFPPSFLFGAATSAYQIEGAWNEDGKGPSTWDHFCHNFPEWIVDRSNGDVAADSYHMYAEDVRLLKEMGMDAYRFSISWPRILPKGTLAGGINEKGVEYYNKLIDLLLENGIEPYITIFHWDTPQALVDAYGGFLDERIIKDYTDFAKVCFEKFGKKVKNWLTFNEPETFCSVSYGTGVLAPGRCSPGVSCAVPTGNSLSEPYIVAHNLLRAHAETVDIYNKYHKGADGRIGLALNVFGRVPYTNTFLDQQAQERSMDKCLGWFLEPVVRGDYPFSMRVSARDRVPYFKEKEQEKLVGSYDMIGINYYTSTFSKHIDLSPNNSPVLNTDDAYASQETKGPDGNAIGPPTGNAWINMYPKGLHDILMTMKNKYGNPPMYITENGMGDIDKGDLPKPVALEDHTRLDYIQRHLSVLKQSIDLGADVRGYFAWSLLDNFEWSSGYTERFGIVYVDRENGCERTMKRSARWLQEFNGAAKKVENNKILTPAGQLN

SEQ ID NO: 46538 - protein, 55 aa, Sorghum bicolor
  unsure (1)..(55): unsure at all Xaa locations
  Clone ID: LIB3476-055-P1-K1-D6.pep
HRFVTQTGAKGFASARGSXHRFLLKTGAKGSLPRQHMSVAVGQDPLAPVCHTNRC

SEQ ID NO: 46539 - protein, 241 aa, Sorghum bicolor
  unsure (1)..(241): unsure at all Xaa locations
  Clone ID: SORBI-28MAY03-C21230_1.pep
MVSSTTMAAASCGGGGGVGVGVRAAGVLPLASLNHISIVCRSVEASLRFYTDVLGFVPIRRPGSFDFDGAWLFNYGIGIHLLQSEDPGSLPEKGEINPKDNHISFQCESMVAVERRLKEMGIPYVQRCVXHDPDGFMIEICNCDNLPVIPLAGAVQLGSCKRAAAAVVVGKQQQQQRGGGRRRPPPSPPVTATAAAHHQAIRVAEESSSSHISCAGGGGRASAAFPRRRAGAAVAHFVRVI

SEQ ID NO: 46540 - protein, 250 aa, Sorghum bicolor
  Clone ID: SORBI-28MAY03-C3837_1.pep
MAKSYPTVSAEYSEAVEKARQKLRALIAEKSCAPLMLRLAWHSAGTFDVSSRTGGPFGTMKNPAELAHGANAGLDIAVRLLEPIKEEFPILSYADFYQLAGVVAVEVTGGPQIPFHPGREDKPQPPPEGRLPDATKGSDHLRQVFGKQMGLSDQDIVALSGGHTLGRCHKERSGFEGAWTSNPLVFDNSYFKELLSGDKEGLLQLPSDKALLSDPAFRPLVDKYAADEKAFFEDYKEAHLKLSELGFADA

SEQ ID NO: 46541 - protein, 619 aa, Sorghum bicolor
  Clone ID: SORBI-28MAY03-C41897_1.pep
MATRPGPLTEWPWQRLGNFKYLVMGPVVVDGARRVVARGWGDIDLAFALILPSLLLRMAHNQIWISAARYQTARSKHRIVDRGIEFEQVDRERGWDDQIILNGLLFYAGYLAIPSARHLPAWRTDGAAVMALLHAGPVEFLYYWFHRALHHHFLYSRYHSHHHSSIVTEPITSVIHPFAEHMVYYVLFAIPMLSTVYIGNASVLGIVVYIAYIDFMNNMGHCNFELVPKWMFQVFPPLKYLMYTPSFHSLHHTQFRTNYSLFMPFYDYIYNTMDKSSDQLYESSLRGTEETPDLVHLTHMTDLQSAYHLRIGFASIASRPSDSSMWYMWVLWPVAWLSMVLAWVYGSSTFVVERIKLGKLKMQTWAVPRYNFQYGLSWERESINDLIEKAILDADARGVKVLSLGLLNQAKQLNGGGELFRQKYPKLTVRLVDGSGLATAVVLKSIPHDAKQVFLHAGPSKIACATAFALCERGVQVIMNPKKEYDMLKSQIADSKASYLKHSSNHTPQIWLVDNIDDKEQKMAPQGAIFVPISQFPIKKIRKDCTYLSTPAMKIPETMQNIHACENWLPRRVMSAWRIGGILHALEGWTMHECGDAMMHTEKAWSAAIRHGFIPLTKA

SEQ ID NO: 46542 - protein, 147 aa, Sorghum bicolor
  Clone ID: SORBI-28MAY03-C11_1.pep
MSSSRRSSSPDSNNNTDVSGGGGGGFAADERKRKRMLSNRESARRSRAKKQQRLEELVAEVARLQAENAAAQSRIAAFEREFAKVDGDNAVLRARHGELSSRLESLGGVLEVLQMAGAAVDIPEMVTEDPMLRPWQPSFPPMQPIGF

SEQ ID NO: 46543 - protein, 254 aa, Sorghum bicolor
  Clone ID: SORBI-28MAY03-C1434_1.pep
MADSTTNDAPVVNSQPTTEEEVTVERAAAAAEEEEERLRYLEFVQQAAAQALVLAAAAYAYAKQGAGPLRPGVDHVEGTVKAVVGPVYDRFHAVPLDLLKFIDRKVGESVEEIDRRVPPVVKEAPTLARSAAKEVREAGLVGTATGLAKSAIARAEPKARELYTRYEPVAERRAAEAWVALNRLPLVPSVTRAVLPTAAQLSARYNSAVRDGAKRGNTVATYLPLVPTERLARVFPYPMADVAPAPEMQPIPSQ

SEQ ID NO: 46544 - protein, 421 aa, Sorghum bicolor
  Clone ID: SORBI-28MAY03-C5075_1.pep
MAIRRGPSYAVAALLALASVAAVAGEVFFQEKFEDGWESRWVKSEWKKDENMAGEWNHTSGKWNGDAEDKGIQTSEDYRFYAISAEYPEFSSKDKTLVLQFSVKHEQKLDCGGGYVKLLGGDVDQKKFGGDTPYSIMFGPDICGYSTKKVHTILTKDGKNHLIKKDVPCETDQLTHVYTLIIRPDATYSILIDNEEKQTGSIYEHWDILPPKQIKDPEAKKPEDWDDKEYIPDPEDKKPEGYDDIPKEIPDPDAKKPEDWDDEEDGEWTAPTIPNPEYKGPWKQKKIKNPNYQGKWKAPMIDNPDFKDDPYIYAFDSLKYIGIELWQVKSGTLFDNFIITDDPALAKTFAEETWGKHKEAEKAAFDAAEKKKEEEEAAKGGDDEDDDLEDEEDDEKADEDKADSDAEDSKDDSDDEKHDEL

SEQ ID NO: 46545 - protein, 410 aa, Sorghum bicolor
  Clone ID: SORBI-28MAY03-C3052_1.pep
RRWLIPSTRAHRRLQRWPTSLGSRCLASSSSPSTPAWRFIAPTATLAPSPSSWYLTSTCWPSSPACATTSSWIATPPSARRSRLGFGASRRSLRSCSATKSLRLCPCPSKFLSGRWQRLPPVAASTLSSSTTRSLSCQRRRHRPPRSRKQTPTKFVCHHMAHTVVSAPRVRSQGHLGCSLIANFLAFSLPLSTIFAVTSVVLACRRGQTARSGARCDQIRCCCARWQGKSLRFALLRVKEKMMTTTELMGLPQIGLSGVLIVRVLTKRRNFRSHLVISMLDSSPARELIASGKGETRGRVAEVLIQRISVYMEYMETTCEQGGLFVNLKSWRSRADQKEAGSSKEADEERRKTEDLKNLRSTTTEEWKKQRCKGEGRTVLEFISVPRSKLPSVIPVCMALLLSRCGLHLV

SEQ ID NO: 46546 - protein, 318 aa, Sorghum bicolor
  unsure (1)..(318): unsure at all Xaa locations
  Clone ID: SORBI-28MAY03-C25247_1.pep
MVSARIVLLLRATLLCAGAAVASSWEDHDGHRCARRCEDRPWHQRARGVEQCREEEARESQQQEERGRGDRHEHDRRGEGSSSGDEREQEQGRWRRPXYVFDRRSFRRVVRSEQGSVRALRPFHEASKLLRGIRNYRVADLEANPRYFVVPSHTDAHCTGYVVQGEGVVTLIWCNQLRPCETGQCQFIVEXDGAITYLANTDGRKKLVIAKILHTISVPGEFQFFFGPGGSDPESFLSSFGESGQSGGRQRVEEAAGGRHGGRGEREKEEQEQEEREGRHGGRGQRKQEEEEREGRHGGRGRREEAAETLLRMVTARM

SEQ ID NO: 46547 - protein, 126 aa, Sorghum bicolor
  Clone ID: SORBI-28MAY03-C44332_1.pep
MGGGHDMHGHNGGVKGYVSNLVHGGGGGGHGHGYGGGHGGYGGHGHGYGGHGQGYGHAYPPPAAAGAYPPPHGGYPPAAAYPAHSAHYGNMGSYHSSHSHGGGHHGGYGGKHKGGMFGGGKFRKWK

SEQ ID NO: 46548 - protein, 246 aa, Sorghum bicolor
  unsure (1)..(246): unsure at all Xaa locations
  Clone ID: SORBI-28MAY03-C287_3.pep
LMRALEPFIRDASSAPHGSSPLLHPHHQPLSPSSPFSFHHAAAYGGYPFAAAAAEGAGQLSPAQMQYIQARLHLQRQSQQSSVLGPRAQPMKASASAAAPTPPRPQKLYRGVRQRHWGKWVAEIRXPRNRTRLWLGTFDTAEDAALAYDKAAFRLRGDMARLNFPALRRDPARPAGPLHASVDAKLTAICQSLTGSKNGGSSGDESAGSPPDSPKCSASASTEGEEESVSDGFPTITELSTTVSMT

SEQ ID NO: 46549 - protein, 132 aa, Sorghum bicolor
  Clone ID: SORBI-28MAY03-C287_2.pep
QIRDNAASRCPLHASVDAKLQTLCQNIAASKKGAKKHASASAAAAAATSSSAPTSNCSSSPSSDDASSSCCLESAAESSCPSPSPSASPESSTVPEMQQLDFSEAPWDEAAGFALTEYPSYEIDWDSLLAAN

SEQ ID NO: 46550 - protein, 219 aa, Sorghum bicolor
  Clone ID: SORBI-28MAY03-C287_1.pep
MAPSSKLSQGIKKASRSHAYHRRGLWAIKAKHGGAFPKAEKPAAVAEPKFYPADDVKPRKPSTRKPKPTKLRSSITPGTVLILLAGRFMGKRVVFLKQLKSGLLLVTGPFKINGVPIRRVNQTYTIATSTKVDISGVNVEKFDDKYFAREKKKKATKTEGELFETEKESTKDLPQFKKDDQKAVDTELIKAIDAVPDLKTYLGARFSLRDGDKPHEMVF

SEQ ID NO: 46551 - protein, 79 aa, Sorghum bicolor
  Clone ID: LIB3478-052-P1-K1-F3.pep
DFFLNFITPLLARGNRDPENLFSLLDSCRLLFGLRSKGLFCNTLVSSPPLFLCINTHLVSLLLLRNRSDFQTFSYFDFA

SEQ ID NO: 46552 - protein, 344 aa, Sorghum bicolor
  Clone ID: SORBI-28MAY03-C544_1.pep
MLALEMHRLAIILHLVVVVAGAIRVLGHPGDAGGVTPLVHFWEKALPGTPVPEVIADLVHKGIDHSPLAEHYPVTDYGARDVFFDTNYAVAGDDIKRKKGWQRCRRCAEDAKAGFYFRETQLRVGSTMTFSFRPAMVAPILPHAVAEKVPFGDLPDLLATFDIAPSSAEAATVADTLSQCQALPIDGEHKACATSLESTVQSAMRMLGTAGTDDDDSATTLWAAASALPSTGLPLQPYVIQAVTTLDGDRHVGCHIMPYPYAVYFCHMTPAMPTKVYLVSLRSSISGGGPAVTMAAICHLDTSNWQKAHPAFEMVHTQPGGVPVCHFMSYGNLLFGEKAVAATR

SEQ ID NO: 46553 - protein, 445 aa, Sorghum bicolor
  Clone ID: SORBI-28MAY03-C9317_1.pep
MHPQRMKQAAAQQQLMQQALLLQQQQQQQQAQQPPLFPGHHHPHPGLLAAPQMEPIVSGNLPPGFDSSTCRSVYVGNISLQVTDTVLQEVFQSIGPVEGCKLIRKEKSSFGFIDYYDRRYAALAILSLNGRPLYGQPIKVNWAYTSTQREDTSGHFNIFVGDLCPEVTDATLFAFFSGYSTCSDARVMWDQKTGRSRGFGFVSFRNQQDAQSAINDLNGKWLGNRQIRCNWATKGANAGEEKQILDSKVDLTNGTSESGKENPNEDGPESNPQFTTVYVGNLPHEATNNDVHLFFHSLGAGSIEEVRVTRDKGFGFVRYSTHEEAAQAIQMANGQLIGGRQIKCSWGSKPTPPGTASSPLPPPAPALFSTGVSPTDFLAYQRMALNKMATNPSLMGQHALNQVALGMGGRASQSIYDGGFQGISTAAATTSAQQQQQQQQQLMYY

SEQ ID NO: 46554 - protein, 469 aa, Sorghum bicolor
  unsure (1)..(469): unsure at all Xaa locations
  Clone ID: SORBI-28MAY03-C26_1.pep
IIGWFRFIDTKTGLQRPIAWIDENGKRYFPESFMQDQKLFIKKENGNGNPEYTRAQCYGTQEQACSIGXEDIGNLEDHKLEYDGEELEDQDLGLDRIPSXKKYCDMGEAIGENEPCALLPTACNLLPHQANLGEVSRAQRTIEAVEKLLLQGXAPVEPIVNXKGIFRTPLLDDHRQVRYHIHQKQVQVTGCHRGNANVRYAWLPCSKSTVHEMMLNGVLQVHKPPINFAAYGEGILLTPANRSDACVKYSDVDENGIVHMMLCRVIMGNVEIVHPGSNQHRPSSDHVDSGVDDLKNPQHYIVWDMNMNRHIYSEFVVIVKLPSKTKDSFVSQEECQNSSDLSLVLNSSSPDCISEEMNLEAPPALGGGCAAPMLGDSMEKAPSSPWMPFSMLFAAISTKVSPENMDMVISCYEEFKSKKISRGELVKKLRHVVGDRVLISTIMRLQDKLPPVERREAPDASAAKMVAKP

SEQ ID NO: 46555 - protein, 183 aa, Sorghum bicolor
  Clone ID: LIB3476-034-P1-K1-D11.pep
STEDMGPRPFPVKEVHKIAVLDIRLANADRHAGNILVCKEGELGNYKLIPIDHGYCLPEKFEDCTFEWLYWPQAREPFNDETIEYIKSLDAEEDIKLLKFHGWELPPRCARVLRISTMLLKKGAARGLTPHDIGRILCRETVNRGSEIEDIIQEAEDAVLPGSSENMFVETVSEIIDHHLDKE

SEQ ID NO: 46556 - protein, 123 aa, Sorghum bicolor
  unsure (1)..(123): unsure at all Xaa locations
  Clone ID: LIB3481-057-Q6-K1-C10.pep
QLPFICIKQEMNLEAPPALGGGCAAPMLGDSXEKAPSSPWMPFSMLFAAISTKVSPENMDMVISCYEEFKSKKISRGELVKKLRHVVGDRVLISTIMRVQDKLPPVERREAPDASAAKMVAKP

SEQ ID NO: 46557 - protein, 100 aa, Sorghum bicolor
  Clone ID: LIB3481-009-Q6-K1-D8.pep
RPEIVHPGSNQHRPSSDHVDSGVDDLKNPQHYIVWDMNMNRHIYSEFVVIVKLPSKTKDSFVSQEECQNSSDLSLVLNSSSPDCISEVRCFTWGINKIVL

SEQ ID NO: 46558 - protein, 320 aa, Sorghum bicolor
  Clone ID: SORBI-28MAY03-C33496_1.pep
MPHTGAMKTKVLVLLLLLSVCSSLALEWQTDTGSGSGSGSGRPYHFGEESFRHWTRSRQGRFRVLEQFTHELLEDAVGNYRVAELEAAPRAFLQPSHYDADEVMFVKEGEGVVVLLRGERKESFCVREGDVLVIPAGAVVYSANTHHSEWFRVVMLLSPVSTSGHFEEFYPIGGESPESFLSVFSDDVIQASFNTRREEWEKVFEKQSKGEITTASEEQIRELSRSCSRGGGRSSREEGGDTGSRSSSKWEIKPSSLTGKRPTHSNSHGKHYEITGDECPHLRVLDMKVGLANISRGSMMALSYSTRAHKIAIVVDGGKG

SEQ ID NO: 46559 - protein, 228 aa, Sorghum bicolor
  Clone ID: SORBI-28MAY03-C1058_2.pep
MKATTGSSSVARVLVLLATTACLLWKEAACFSASGMNKAFATFYGGSDASGTMGGACGYGNLYSTGYGTNTAALSTALFNDGASCGQCYRISCDYQADPRFCIRGTSVTITATNLCPPNYALPNDDGGWCNPPRQHFDMAEPAWLKIGIYRGGIVPVNYQRVPCVKQGGVRFTINGRDYFELVLISNVGGCGSIQSASIKGSRTGWMAMSRNWGVNWQSNAYLDGQSL

SEQ ID NO: 46560 - protein, 261 aa, Sorghum bicolor
  unsure (1)..(261): unsure at all Xaa locations
  Clone ID: SORBI-28MAY03-C1058_1.pep
MPALLLLLVAAALLLSPAAARIPGVYGGGGWQSAHATFYGGSDAAGTVGGACGCGNLYSQGSGVNNGALSTALFNEGLSCGACFQLKCEKHAPGWXGWRRPATPSILVTATTFCPANYALPADDRAWRTPPRPHLARAMPMSPHIAEDRAGIVPVSXRRSPSRGSGGAPWRMRRSRRFQLALIPHVAGAGARVGTPWRGTGARTRTATRTWGHSRRRSSSPPAPAPPSRVTGRPRRTGRSGKAAPPTRQFGXTFEVRSFRV

SEQ ID NO: 46561 - protein, 559 aa, Sorghum bicolor
  Clone ID: SORBI-28MAY03-C183_1.pep
MASSGVSWTLPDHPKLPKGKPVAVVVLDGWGEASPDQYNCIHVAQTPVMDSLKNGAPEKWTLVKAHGTAVGLPSDDDMGNSEVGHNALGAGRIFAQGAKLVDSALASGKIYSGDGFNYIKESFESGTLHLIGLLSDGGVHSRLDQLQLLLKGASERGAKKIRVHILTDGRDVLDGSSVGFVETLENDLSELRGKGIDAQIASGGGRMYVTMDRYENDWDVVKRGWDAQVLGEAPYKFKSALEAVKTLRAQPNANDQYLPPFVIVDDSGKAVGPVLDGDAVVTLNFRADRMVMLAKALEYADFDKFDRVRVPKIRYAGMLQYDGELKLPSRYLVSPPEIDRTSGEYLVKNGVRTFACSETVKFGHVTFFWNGNRSGYFDETKEEYVEVPSDSGITFNVAPKMKALEIAEKARDALLSGKFDQVRVNLPNGDMVGHTGDIEATVVACKAADEAVKIILDAVEQVGGIYLVTADHGNAEDMVKRNKAGKPLLDKNGGIQILTSHTLQPVPVAIGGPGLHSGVKFRKDIETPGLANVAATVMNLHGFVAPADYEQTLIEVADN

SEQ ID NO: 46562 - protein, 220 aa, Sorghum bicolor
  Clone ID: SORBI-28MAY03-C875_3.pep
MGISRDSMHKRRATGGKQKAWRKKRKYELGRQPANTKLSSNKTVRRVRVRGGNVKWRALRLDTGNYSWGSEALTRKTRILDVVYNASNNELVRTQTLVKSAIVQVDAAPFKQWYLTHYGVDIGRKKVPVAKKDAAEGQEGEAIAEETKKSNHVQRKLEKRQQGRALDTHIEEQFGSGRLLACISSRPGQCGRADGYILEGKELEFYMKKLQRKKGKGAAS

SEQ ID NO: 46563 - protein, 221 aa, Sorghum bicolor
  Clone ID: SORBI-28MAY03-C875_1.pep
MGISRDSMHKRRATGGKQKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLTHYGVDIGRKKKAPAAKKEAAEGQEGEAAAEEAKKSNHVKRKLEKRQEGRELDAHIEEQFGSGRLLACISSRPGQCGRADGYILEGKELEFYMKKLQRKKGKGAAA

SEQ ID NO: 46564 - protein, 122 aa, Sorghum bicolor
  Clone ID: LIB5052-012-A1-XP1-G3.pep
MCGGAIISEFIPQRDSAAARAGHGKRGLVCADDFWPPHAADFGGGRDHLVDYDVDVMGMGMGTTFFQHHPQPSYVSDAVTVAQQEQVPTVAYVHHHQLPPPQDDAAGMDMWTFDGINTAVPM

SEQ ID NO: 46565 - protein, 106 aa, Sorghum bicolor
  Clone ID: SORBI-28MAY03-C14457_4.pep
MHDLSTMHGYIGRYHQLQPFILGCQACHPCKGPWVVHCARRRSHRNSSCTPPCSCRVGLRPRRTQPCSPWRPPEGQPPVRAPRAAAPPRRRPSSWTPSLKLVFFFL

SEQ ID NO: 46566 - protein, 116 aa, Sorghum bicolor
  Clone ID: SORBI-28MAY03-C14457_3.pep
MHDLSTMHGYIGRYHQLQPFIMGCQACHPCKGPWVVHCARRRSHRNSSCTPPCSCRVGLRPRRTQPCSPWRPPEGQPPVRAPRAAAPPRRRPSSWTPSLKLVFFFVMAVWFSRPGR

SEQ ID NO: 46567 - protein, 104 aa, Sorghum bicolor
  Clone ID: SORBI-28MAY03-C14457_2.pep
SRRRPGRGPTTSVTNKTKRHPPQKKRSKMASKKMVVVVAALLLVALMTLEAAPPAAAADCKAECVKFASSLGVSPEDCVKKCDAFAAQNQGGQPDYMNKKLDIP

SEQ ID NO: 46568 - protein, 106 aa, Sorghum bicolor; identical to SEQ ID NO: 46565
  Clone ID: SORBI-28MAY03-C14457_1.pep

SEQ ID NO: 46569 - protein, 151 aa, Sorghum bicolor
  unsure (1)..(151): unsure at all Xaa locations
  Clone ID: SORBI-28MAY03-C28_13.pep
MSSVFSGDETAPFFGFLGAAAALVFSCMGAAYGTAKSGVGVASMGVMRPELVMKSIVPVVMAGVLGIYGLIIAVIISTGINPSIXIACGLAGLAAGMAIGIVGDAGVRANAQQPKLFVGMILILTFAEALALYGLIVGIILSSRAGQSRAD

SEQ ID NO: 46570 - protein, 277 aa, Sorghum bicolor
  Clone ID: SORBI-28MAY03-C28_12.pep
MATKKSVGTLTEADLKGKKVFLRADLNVPLGDSQKITDDTRIRASVPTIKFLMEKGAKVILASHLGRPKGVTPKYSLKPLVPRLSELLGVNVVMANDCIGEEVQKLAASLPDGGVLLLENVRFYKEEEKNDPEFAKKLASVADLYVNDAFGTAHRAHASTEGVTKYLKPAVAGFLMQKELDYLVGAVANPKKPFAAIVGGSKVSTKIGVIESLLAKVDILILGGGMIFTFYKAQGYAVGKSPVEEDKLELATSLIEKAKSKGVSLLLPTDVVVADKF

SEQ ID NO: 46571 - protein, 165 aa, Sorghum bicolor
  Clone ID: SORBI-28MAY03-C28_9.pep
MSSAFSGDETAPFFGFLGAAAALVFSCMGAAYGTAKSGVGVASMGVMRPELVMKSIVPVVMAGVLGIYGLIIAVIISTGINPKAKPYYLFDGYAHLSSGLACGLAGLAAGMAIGIVGDAGVRANAQQPKLFVGMILILIFAEALALYGLIVGIILSSRAGQSRAD

SEQ ID NO: 46572 - protein, 157 aa, Sorghum bicolor
  Clone ID: SORBI-28MAY03-C28_8.pep
MAYRADDDYDYLFKVVLIGDSGVGKSNLLPRFTRNEFSLESKSTIGVEFATRSIHVDDKVVKAQIWDTAGQERYRAITSAYYRGAVGALVVYDVTRHVTFENVERWMRELKDHTDANIVIMLVGNKADLRHLRAVPTEDAKALAEREDAFFMEASGL

SEQ ID NO: 46573 - protein, 239 aa, Sorghum bicolor
  Clone ID: SORBI-28MAY03-C28_7.pep
VIAPLPTGGARPPQPAMAVAELWETLKQAIVAYTGLSPAAFFTAVAVAAALYHVVSGLFAAPSPPPPRPREEPEAEPLPPPVQLGEVSEEELRQYDGSDTKKPLLMAIKGQIYDVRPGRVFYGPGGPYALFAGKDASRALAKMSFEPQDLTGDISGLGPFELDALQDWEYKFMSKYVKVGTVKKTVPVEDGSTASTAPEASEATTEAEKAQTTEEKPREVSAQAVKEKEAPSDEGAQEN

SEQ ID NO: 46574 - protein, 146 aa, Sorghum bicolor
  Clone ID: SORBI-28MAY03-C28_5.pep
GMGSRQSCLNGAGTSIAVLRESHVPALLCTFIVALGPLQLGFTNGYSSPTQDGVVRDLNLSISEFSVFGSLPNVGAMVGAIASGQMAKYIGRRGSLMIAAIPNIMGWLAISLAKDTSFLYMGRLLEGFGVGVMSYVVPVYVAEISS

SEQ ID NO: 46575 - protein, 131 aa, Sorghum bicolor
  Clone ID: SORBI-28MAY03-C28_4.pep
MASKLISLFLALTILSTVLALVHGCTPYCPTPPVVPPPSPPSGGGGGSCPMNALKLEVCANVLNLLKLSIPPKNDQCCPLLEGLVDLDAAVCLCTAIKANILGINLNVPVDLTLLLNHCGKICPADFTCPA

SEQ ID NO: 46576 - protein, 405 aa, Sorghum bicolor
  unsure (1)..(405): unsure at all Xaa locations
  Clone ID: SORBI-28MAY03-C28_3.pep
MATKRSVGTLGEADLKGKKVFVRADLNVPLDDAQKITDDTRIRASVPTIKFLLEKGAKVILASHLGRPKGVTPKYSLKPLVPRLSELLGVEVVMANDCIGEEVEKLVAALPEGGVLLLENVRFYKEEEKNEPEFAKKLASGGGLYVNDAFATAHRVRTRTDGLAKHFDLVGVYALMTTGLDXLLSGSGPGNTPWQAVLPIWRLSLPVVLMAFLEASPLVSFGDAVVGATPPPPKLLVGMIDDLTLAAALALYGRIVGGAPPDRVALYHAADPLVADGLAARAQTEMNPPTAIPADCLGLXVGPDATLTFNDSLDPAHTIIWNGXPMGVVEYPKFAAGTEAIAKKLAERTTTKGVTTIIGGGDSVAXAVEKAGLADKMSHISTGGGASLELLEGKTLPGVLALDDA

SEQ ID NO: 46577 - protein, 236 aa, Sorghum bicolor
  Clone ID: SORBI-28MAY03-C28_1.pep
MAASSWSSSSSCTSSFGSLDDDVVCVIKSDSVAAAAVAEGSVKFLCSYGGRILPRHTDGTLRYVGGDNRVLSVDRPLRFYDLQRKMRELCGWEAYLRCQLPTEDLDALISVTCDDDLANLLQEYDEASKDRLQSLKIRAFLFPRTPAPASSIPRSSPPSSPSSHSRPSPSAHLHRRNTSRAPAAGVSLTCAPRWWAAPRASRQAQAHQSQNYDLRSLDEERSHPHRYLVQNGRHLQ

SEQ ID NO: 46578 - protein, 236 aa, Sorghum bicolor; identical to SEQ ID NO: 46577
  Clone ID: LIB3478-015-B5_FLI.pep

SEQ ID NO: 46579 - protein, 64 aa, Sorghum bicolor
  Clone ID: LIB5051-006-A1-XP1-B8.pep
MYLQYYINEKGDKVYTTKKESPLGVPTQSAHPARFSPDDKYSRQRYLLKKRFALLPTQKPAPKY

SEQ ID NO: 46580 - protein, 64 aa, Sorghum bicolor
  Clone ID: LIB3476-030-P1-K1-A2.pep
MYLQYYINEKGDKVYTTKKESPLGVPTQSAHPARFSPDDKYSRQRYLLKKRFALLPTQQPAPKY

SEQ ID NO: 46581 - protein, 143 aa, Sorghum bicolor
  unsure (1)..(143): unsure at all Xaa locations
  Clone ID: LIB3476-028-P1-K1-H11.pep
MAGRRAEEEYDYLFKVVLIGDSGVGKSNLLSRFTRNEFCLESKSTIGVEFATRTLHVEGKIIKAQIWDTAGQERYRAITSAYYRGALGAVLVYDVSKPTTFENISRWLKELRDHADSNIRIMLVGNKTDXRHXRAVATDDAQS

SEQ ID NO: 46582 - protein, 147 aa, Sorghum bicolor
  unsure (1)..(147): unsure at all Xaa locations
  Clone ID: LIB3480-016-P1-K1-F3.pep
LDYLVGAVANPKKPFAAIVGGSKVSTKIGVIESLLARAETEDAQVEETTGISTNGDNDDPLSRFLPPPVTTKCSAALQQKINRFLAYKRAGKSFNAEVRNRKDYRNPDFLQHAVRXPRNDQIGTCFGKDVFDPYGYDKGDYYDEIEA

SEQ ID NO: 46583 - protein, 125 aa, Sorghum bicolor
  unsure (1)..(125): unsure at all Xaa locations
  Clone ID: LIB3478-002-P1-K1-D9.pep
ISPNLSASAPAPAREEKGRPRRANAHPSTLSSSRGRRPSKRTRPDRPHPPFPNNRSAAARRETLPRPSPPTTRPEGLAIDRVPAGSDMATKRSVGTLGEADLKGKEVFVRADLNVPLDDAXKDHR

SEQ ID NO: 46584 - protein, 149 aa, Sorghum bicolor
  Clone ID: LIB3476-044-P1-K1-F8.pep
RFTRNEFCLESKSTIGVEFATRTLQIEGKTIKAQIWDTAGQERYRAITSAYYRGAVGALLVYDITKKQTFENIQRWLRELRDHADSNIVIMMVGNKSDLNHLRSVAEEDGQALAEKEGLSFLETSALEALNVEKAFQTVLSDIHQIISK

SEQ ID NO: 46585 - protein, 120 aa, Sorghum bicolor
  Clone ID: LIB5051-012-A1-XP1-E11.pep
MAMASSSGLRSCSAVGVPSLLAPSSRWSSRLPFCANATTSGRVTMSAEWMPGQPRPAHLDGSSPGDFGFDPLGLATVPENFERFKESEVYHCRWAMLAVPGILVPEALGLGNCAGKPLVM

SEQ ID NO: 46586 - protein, 247 aa, Sorghum bicolor
  Clone ID: LIB5121-003-A1-PF1-G5.pep
PLQATAAKQQQQSADSSSVPSPPLFVILQKPSSSSISSSPTACKDMADAVERLKTGFEQFKADVYDKKPELFEPLKAHQSPKYMVFACSDSRVCPSVTLGLHPGEAFAVRNIASMVPPYDKTKYAGVGSAIEYAVCALKVEVIVVIGHSRCGGIKALLSLEDGAPDKFHFVEEWVRIGGPAKTKVKADHASVPFEDQCSILEKEAVNVSLENLKTYPFVKEGVEKGTLKLVGGHYDFVNGKFETWEP

SEQ ID NO: 46587 - protein, 106 aa, Sorghum bicolor
  Clone ID: LIB3481-015-P1-K1-C8.pep
RPLGALGCVFPELLARNDLADDPEAFAELKVKELKNGRLAMFSMFGFFVQAIVTGKGPLENLADHLADPVNNNAWAYATNFVPRQVRRCPDACERARALVSACTMM

SEQ ID NO: 46588 - protein, 129 aa, Sorghum bicolor
  Clone ID: 9848842.pep
RGSIGGQVWTANMERIMKAQALRDSSMSGYMSSKKTMEINPENAIMEELRKRAEADKNDKSVKDLVMLLFETALLTSGFSLDDPNTFGSRIHRMLKLGLSIDEDEAPEADTDMPPLEDDAGESKMEEVD

SEQ ID NO: 46589 - protein, 146 aa, Sorghum bicolor
  Clone ID: 30964281.pep
MAGEKKQGLQLLDFWVSPFGQRCRIALDEKGLSYEYLEQDLANKSELLLRANPVHKKIPVLLHDGRPVCESLIIVQYLDEAFPATPSLLPAAAGDAYARAQARFWADYVDKKLYDCGTRLWKLKGDGHAQARTEMVEILRTLEGAL

SEQ ID NO: 46590 - protein, 82 aa, Sorghum bicolor
  unsure (1)..(82): unsure at all Xaa locations
  Clone ID: 7551911.pep
KKKKKKKXLKTEVYDKKPELFEPLKAGQSPKYMVFACSDSRVCPSVTLGLQPGEAFTVRNIAAMVPAYNFVSGEFDTWEIKS

SEQ ID NO: 46591 - protein, 85 aa, Sorghum bicolor
  Clone ID: LIB3478-006-P1-K1-A1.pep
MAGATMALTSRALVGKPATTSTRDVFGEGRITMRKTAAKPKPAASGSPWYGADRVLYLGPFSGAVEGYRVAGGPLGEVVDPLYPG

SEQ ID NO: 46592 - protein, 148 aa, Sorghum bicolor
  unsure (1)..(148): unsure at all Xaa locations
  Clone ID: 7553080.pep
KRGRGGTAGNKFRMSLGLXGAKNLYIISVKGIKGRLNRLPSACVGDMVMATVKKGKPDLRKKVMPAVIVRQXYMYFEDNAGVIVNPKGEMKGSAITGPIGKECADLWPRIASAANAIVFCMIISVSVATVAKSAIGLNGSFMFGHSIL

SEQ ID NO: 46593 - protein, 116 aa, Sorghum bicolor
  Clone ID: 7660757.pep
MSCCGGNCGCGSGCKCGSGCGGCKMYPDMAEQQVTTTAKTLVMGVAPSSKGHAEGGFEAAAGAGAENDGCKCGPNCSCNPCTCKCGSVVTVCVFESASQSSAMAPYASGSGTDGNQ

SEQ ID NO: 46594 - protein, 55 aa, Sorghum bicolor
  Clone ID: 7553217.pep
KTLVMGVAPSSKGHAEGGFEAAAGAGAENDGCKCGPNCSCNPLHCTAARRKDGFP

SEQ ID NO: 46595 - protein, 73 aa, Sorghum bicolor
  Clone ID: 30950760.pep
MNRKPGYGAKLRAIYGVGRLMLPLPSPKRMWIGARLISGACGIILPIIKAEGVRQMFFPATVPAYYRAAPMGE

SEQ ID NO: 46596 - protein, 120 aa, Sorghum bicolor
  Clone ID: LIB3480-033-P1-K1-D10.pep
MASETETFAFQAEINQLLVGLACSSPEPALRPGMRGVVQVLGGESDPPFVPAARPSMSLGGSANNQQLLLSLQDSVSDYNALLGLAGLSDDSLSSADSLNSSSLTSTLRRGGHDIGFSST

SEQ ID NO: 46597 - protein, 132 aa, Sorghum bicolor
  Clone ID: LIB3478-036-P1-K1-D9.pep
PHTHNLARAACPRRLDTSRLRQRLHALAYGDDARHSLVDEMTKRTKKAGIVGKYGTRYGASLRKQIKKMEVSQHSKYFCEFCGKFAVKRKAVGIWGCKDCGKVKAGGAYTMNTASAVTVRSTISGLREQTEA

SEQ ID NO: 46598 - protein, 69 aa, Sorghum bicolor
  Clone ID: 7553236.pep
GVDARRWRWQPPICQCLDTSTSGCNPGCKACVKSISDGLYECKDRIVNFCKRRCTRPPAAAAADPRAGK

SEQ ID NO: 46599 - protein, 165 aa, Sorghum bicolor
  Clone ID: 7661050.pep
MQLLVRNPASSGGCAFLPAAAATLRPPSSATLSWRRPGCSWRSKRCLSLPPRANTDGSGSGAAAAEASTVGDTLEREEGGGVNAGASAESSSNRKQPPPVDPKIEKELKKAVQKTAATFAPRASTKTKNPAVPGTALYSIFEVQGYVSMLLGGALSFNLIFPSNE

SEQ ID NO: 46600 - protein, 46 aa, Sorghum bicolor
  Clone ID: SORBI-28MAY03-C104_17.pep
CILFPDNAGVIVNPKGEMKGSAITGPIGKECADLWPRIASAANAIV

SEQ ID NO: 46601 - protein, 181 aa, Sorghum bicolor
  Clone ID: SORBI-28MAY03-C104_18.pep
ELLLRANPVHKKIPVLLHDGRPVCESLIIVQYLDEAFPATPSLLPAAAGDAYARAQARFWADYVDKKLYDCGTRLWKLKGDGHAQARTEMVEILRTLEGALGDGEFFGGEAFGFVDVALVPFTSWFLAYERFGDLSVEKECPRLAAWAKRCAERPSVAKNLYPGEKVYEFICGLKKRFGIE

SEQ ID NO: 46602 - protein, 189 aa, Sorghum bicolor
  Clone ID: SORBI-28MAY03-C104_19.pep
RIAATKAVRRPRRREKSIEPYHLEEGNELLSAFKVANFSSGEDDATFWSRLIQPDPADMIQETLAPRAARNKKSYVEDPQLDKSNNRKRRAVEAQEKPRRRSGRTVETVNSLPLVDGAVAQVREWSFGNVPKKDASRFVRAVKKFGNATQIGLIVDDVGGVLAKASHEAQIELFDLLIDGCQEAVKENT

SEQ ID NO: 46603 - protein, 131 aa, Sorghum bicolor
  Clone ID: SORBI-28MAY03-C104_20.pep
SGDELTSLKDYVTRMKEGQNDIYYITGESKKAVENSPFLEKLKKKGYEVLYMVDAIDEYAIGQLKDLVMLLFETALLTSGFSLDDPNTFGSRIHRMLKLGLSIDEDEAPEADTDMPPLEDDAGESKMEEVD

SEQ ID NO: 46604 - protein, 130 aa, Sorghum bicolor
  Clone ID: SORBI-28MAY03-C104_21.pep
RYFTYSVGRKRGIAPPFGSKARPCRADPGGRHCQVGSLAGAAHLLKDNAGVLNVCRDIVQPMHFQKSTNCQELEEAFLQIISTLPVPEAQELLQQCLGFSTRNVDDCPHLVAAFKTWFRRAGRAPMGGEY

SEQ ID NO: 46605 - protein, 148 aa, Sorghum bicolor
  Clone ID: SORBI-28MAY03-C104_22.pep
HEASSSSSPTKLLACLVAAALALAATVVAPCAAQNSPQDYAQSYAAQRQGDCKLIHSGGPYGENIFWGSAGADWSASDAVASWVSEKQYYNHDTNSCADGKVCGHYTQVVWRDSTAIGCARVVCDNNAGVFIICSYNPPGNYVGQSPY

SEQ ID NO: 46606 - protein, 55 aa, Sorghum bicolor
  Clone ID: SORBI-28MAY03-C104_23.pep
CLLTTSRSIMHHIIYIVHKSSALEMKAVENAIAYYIHIGAIRYIYIYVAACRKHE

SEQ ID NO: 46607 - protein, 206 aa, Sorghum bicolor
  Clone ID: SORBI-28MAY03-C104_24.pep
MDPPAPSPRPPVGDGAQPSERNRQRPRSALRGALGVAFPIAVSFLFSFLVGLAGLALGGLSSTASVSMPSTCRVLSTGVDLRSSKVCELGLLNYRAKHIFYPSSKRRFRCHDDYYWASVLQVEYTEYFSGQVSYAVAEAPKEALPHNCRPDFGAAWSTTLKFKVNESYSCRYMLGSNKADIHSDKLFNCTAEEPSTTELLKRILIL

SEQ ID NO: 46608 - protein, 207 aa, Sorghum bicolor
  Clone ID: SORBI-28MAY03-C104_25.pep
MAASALHQTTSFLGQALVSRPAAAAADAGGRITMRRTVKFGEAVWFKAGAQIFSEGGLDYLGNPNLVHAQSILAIWACQVVLMGFVEGYRVGGGPLGEGLDKVYPGGAFDPLGLADDPDYGWDTAGLSADPETFARNRELEVIHSRWAMLGALGCVFPEILAMFSMFGFFVQAIVTGKGPIENLFDHVADPVANNAWAYATNFVPGN

SEQ ID NO: 46609 - protein, 142 aa, Sorghum bicolor
  Clone ID: SORBI-28MAY03-C104_26.pep
TCSKLKNVWQVKVMATEGTTNPRARAVTVRQAASQHQAEPLAGDVALDSLGRSLPPDLGCIPKQPDSLTAPRGAAGSGPDGALTLPGVPFQGTWARSVAEDASPDYNSGDEATRFSSWAGPGSLAVTRGILVSFFSSAYLYA

SEQ ID NO: 46610 - protein, 69 aa, Sorghum bicolor
  Clone ID: SORBI-28MAY03-C104_27.pep
RIPPNTSFVCIIPNNRTLNTLFYTKVKFTCHGPSLWECKPYHALECSRGDIHGGLLGPAGHLPGTKLGA

SEQ ID NO: 46611 - protein, 222 aa, Sorghum bicolor
  Clone ID: SORBI-28MAY03-C104_28.pep
AARPQRRQVRRGRLVQGRLPDLQRGRPGLPGQPQPDPRAEHASVPFDDQCSILEKEAVNVSLANLKTYPFVKERLAKGTLKLVGAHYDFVSGKFLTWEPVMDAVDRLKSGFEQFKIEVYDKKPELFEPLKSGQAPRYMVFACADSRVCPSVTLGLMPGEAFTVRNIAALVPGYDKTKYTGIGSAIEYAVCALKVQVLVVIGHSCCGGIRALLSLQDGAPDNL

SEQ ID NO: 46612 - protein, 147 aa, Sorghum bicolor
  Clone ID: SORBI-28MAY03-C104_29.pep
MMSESEEHGSLLEKINEKIHEYKHSSSSSSSDSDDDKKPKKTKKKKKLFGRKHSLHHVLGGGKAADLVLWRNKQASGSILAGVTVIWLLFEGIGYHLLTFLCHALIVFLTVWFVWSNAASFVNRSPPKFPEVILSEVQCLKVAHIAR

SEQ ID NO: 46613 - protein, 174 aa, Sorghum bicolor
  Clone ID: SORBI-28MAY03-C104_30.pep
MADAVERLKTGFEQFKADVYDKKPELFEPLKAHQSPKYMVFACSDSRVCPSVTLGLHPGEAFAVRNIASMVPPYDKTKYAGVGSAIEYAVCALKVEVIVVIGHSRCGGIKALLSLEDGAPDKFHFVEEWVRIGGPAKTKVKTDHASVPFEDQCSILEKVRYIHTLHMHIRTVSL

SEQ ID NO: 46614 - protein, 127 aa, Sorghum bicolor
  Clone ID: SORBI-28MAY03-C104_31.pep
CSARTPCRPRSCWCRGCSTASRKPTTPRRRTPTSRRRRSPRRCSRRRDRRSGSACSRPGFSKDPAKFEEYKLKEIKNGRLAMLAFVGFCVQQSAYPGTGPLENLATHLADPWHNNIGDIIIPRSISP

SEQ ID NO: 46615 - protein, 93 aa, Sorghum bicolor
  Clone ID: SORBI-28MAY03-C104_32.pep
YNISHASLLFTSGAPAMTSRGLVEKDFEQIGEFLHQAVTICLNIQKEYGKLLKDFNKGLLNNKDIENLKTQVEKFADSFDMPGFTLESMKYKE

SEQ ID NO: 46616 - protein, 84 aa, Sorghum bicolor
  Clone ID: SORBI-28MAY03-C104_33.pep
MSCCGGNCGCGSGCKCGSGCGGCKMYPDMAEQQVTTTAKTLVMGVAPSSKGHAEGGFEAAAGAGAENEGCKCGPNCSCNPCTCK

SEQ ID NO: 46617 - protein, 84 aa, Sorghum bicolor
  Clone ID: SORBI-28MAY03-C104_34.pep
MSCCGGNCGCGSGCKCGSGCGGCKMYPDMAEQQVTTTAKTLAMGVAPSSKGHAEGGFEAAAGAGAENDGCKCGPNCSCNPCTCK

SEQ ID NO: 46618 - protein, 63 aa, Sorghum bicolor
  Clone ID: SORBI-28MAY03-C104_35.pep
MNGAKRSAEAVGCQNASVGERSALEGSKRESGGRRSGSENVGLSNENIGENPMPRKPKVSSAR

SEQ ID NO: 46619 - protein, 139 aa, Sorghum bicolor
  Clone ID: SORBI-28MAY03-C104_36.pep
MAASALHQTTSFLGQALDYLGNPNLVHAQSILAIWACQVVLMGFVEGYRVGGGPLGEGLDKVYPGGAFDPLGLADDPDTAAELKVKELKNGRLAMFSMFGFFVQAIVTGKGPIENLFDHVADPVANNAWAYATNFVPGN

SEQ ID NO: 46620 - protein, 195 aa, Sorghum bicolor
  Clone ID: SORBI-28MAY03-C104_37.pep
MKNVAKCDTWCELQNPANHRVFERKLRPRPSGRGHVCLGVTPTSSPRAAAAGAVAMSKRGRGGTAGNKFRMSLGLPVAATVNCADNTGAKNLYIISVKGIKGRLNRLPSACVGDMVMATVKKGKPDLRKKVMPAVIVRQRKPWRRKDGVYMYFEDNAGVIVNPKGEMKGSAITGPIGKECADLWPRIASAANAIV

SEQ ID NO: 46621 - protein, 271 aa, Sorghum bicolor
  Clone ID: SORBI-28MAY03-C104_38.pep
MQPKSKRHLFSSFLSLLSSEAGRQAAMAMASSSGLRSCSAVGVPSPLAPSSRWSSRLPFCANATTSGRVTMSAEWMPGQPRPAHLDGSSPGDFGFDPLGLATVPENFERFKESEVYHCRWAMLAVPGILVPEALGLGNWVKAQEWAAVPGGQATYLGNPVPWGSLPTILVIEFVAIAFAEHQRTMEKDPEKKKYPGGAFDPLGFSKDPAKFEEYKLKEIKNGRLAMLAFVGFCVQQSAYPGTGPLENLATHLADPWHNNIGDIIIPRSISP

SEQ ID NO: 46622 - protein, 191 aa, Sorghum bicolor
  Clone ID: SORBI-28MAY03-C104_39.pep
PAGPGRCISILIDRLIIGELHSIPSVPLAEDVVLRRQLRVRLRLQPLHLQVSCIITPCTALQPGGRTDSLSCSIAVSSLCVCLSQPVSRVPWHHMLVVLVLMGTNNNCTGMLASCRPSRAPPGAHLLAVGVVLCVCGCSAAQQQAMPPALWARRSCATLFVLCHHPSITYNIPRLCVLCVPFAKKKKKKAP

SEQ ID NO: 46623 - protein, 198 aa, Sorghum bicolor
  Clone ID: SORBI-28MAY03-C104_40.pep
PLYQPTLPLPYFDRVAYSVQLLGIRVGGKALPIPASVLAPDHTGAGQTMVDSGTQFTFLLGDAYSALKAEFLKQTKPLLRALDDPSFAFQEALDTCIRVPAGRPPPSARLPPVTLLFNGAEMSVAGDRLLYKVPGEHRGADGVWCLTFGNADMVPLTAYVIGHHHQMNLWVEYDLERGRVGLAPVKCDVASERLGLML

SEQ ID NO: 46624 - protein, 228 aa, Sorghum bicolor
  Clone ID: SORBI-28MAY03-C104_41.pep
MAGEKKQGLQLLDFWVSPFGQRCRIALDEKGLPYEYLEEDLLAGNKSELLLHANPVHKKIPVLLHDGRPVCESLLIVQYLDEAFPAATPPLLPAAGDPYARAQARFWADYVDKKLYDCGTRLWKLKGDGHAQARTEMVEILRTLEGALGDGEFFGGEAFGFVDVALVPFTSWFLAYERFGDLSVEKECPRLAAWAKRCAERPSVAKNLYSSEKVYEFICGLKKRFGIE

SEQ ID NO: 46625 - protein, 148 aa, Sorghum bicolor
  unsure (1)..(148): unsure at all Xaa locations
  Clone ID: SORBI-28MAY03-C104_42.pep
MATTSQDSARHSSLLRYCSWNSGHEICNPCSSLCFTRSTKKSSPSSQVVSRLYLALDGVYRPIWAAFPNNPTRXRRLVVRQGPGRTGLSPSQASLSRELGPGPSLRTPXPDYNSGDEATRFSSWAGPGSLAVTRGILVSFFSSAYLYA

SEQ ID NO: 46626 - protein, 120 aa, Sorghum bicolor
  Clone ID: SORBI-28MAY03-C104_43.pep
LGNPSLIHAQSILAIWAVQVVLMGAVEGYRIAGGPLGEVVDPLYPGGSFDPLGLADDPEAFAELKVKELKNGRLAMFSMFGFFVQAIVTGKGPLENLADHLADPVNNNAWAYATNFVPGN

SEQ ID NO: 46627 - protein, 114 aa, Sorghum bicolor
  Clone ID: SORBI-28MAY03-C104_44.pep
MRPQVVLLVSLAVFVVLVALPLGKANEEKEAAAEGVDARRWRWPCCDECGVCTRSQPPICQCLDTSTSGCNPGCKACVKSISDGLYECKDRIVNFCKRRCTRPAAAAAAAAADA

SEQ ID NO: 46628 - protein, 132 aa, Sorghum bicolor
  unsure (1)..(132): unsure at all Xaa locations
  Clone ID: SORBI-28MAY03-C104_45.pep
ASCSESSVVSRFVFVLEIRIKRAFTLLFHTRFLFSLSSXLGHLRYLLTDVPPQPNSPPDNVFRPDRPGKAGPXSQKEGRCPASDPRNKXNNVKSSGISLAFKNSMVRGILQFTPGIAFCYVLHRCESRDIRC

SEQ ID NO: 46629 - protein, 358 aa, Sorghum bicolor
  Clone ID: SORBI-28MAY03-C104_46.pep
MSAFVGKYTDELIKTAKYLATPGKGILASDESTGTIGKRLSSINLENVESNRQALRELLFTAPGVFDYLSGVILFEETLYQKTSDGTPFVDVIRAAGAVPGIKVDKGTVEIAGTNGETAAQGLDSLGARCAKYYAAGARFAKWRAVLKVGPAEPSELAVRQNAEGLARYALICQEYGLVPIVEPEILTDGGHDIKTCAAVTERVLAAVYKSLNDHKVLLEGTLLKTNMVTPGSDSPKVGAEVIGEYTVAALRRTVPPAVPGVVFLSGGQSEEEATQNLDAMNKLEVLKPWTLSFSFGRALQQSTLKKWLGKKENVAAAQATFLVRCKANSEAGLGKYTGSGAGDAAASESLYVKGYKY

SEQ ID NO: 46630 - protein, 92 aa, Sorghum bicolor
  Clone ID: SORBI-28MAY03-C104_47.pep
MTKRTKKAGIVGKYGTRYGASLRKQIKKMEVSQHSKYFCEFCGKFAVKRKAVGIWGCKDCGKVKAGGAYTMNTASAVTVRSTIRRLREQTEA

SEQ ID NO: 46631 - protein, 271 aa, Sorghum bicolor
  unsure (1)..(271): unsure at all Xaa locations
  Clone ID: SORBI-28MAY03-C104_48.pep
MKNVAKCDTWCELQNPANHRVFERKLRPRPSGRGHVCLGVTRFRNPRLPLPSRPPPPSSSSSSPPPPPEGEGMGANGDEASRIIVPMAVEGTPEQLAFVQESKLQKRKENVDWAVRNRERKAAKRQRIRDEHKVVVKRPEDFVTAFRNKERDFLRVKTRLKVRKQPPVEALSSKLVFAIRIPGSVDLHPNIRKVLRKLRLTRVLTGVFLKATALTLKRLLIVEPFVTYGFPNLKNVKELIYKKGRGFLDKEPFPLTXHDLIEKALGDHGII

SEQ ID NO: 46632 - protein, 84 aa, Sorghum bicolor
  Clone ID: SORBI-28MAY03-C104_49.pep
MSCCGGNCGCGSGCKCGSGCGGCKMYPDMAEQQVTTTAKTLVMGVAPSSKGHAEGGFEAAAGAGAENDGCKCGPNCSCNPCTCK

SEQ ID NO: 46633 - protein, 226 aa, Sorghum bicolor
  Clone ID: SORBI-28MAY03-C104_50.pep
MAGEKKQGLQLLDFWVSPFGQRCRIALDEKGLSYEYLEQDLANKSELLLRANPVHKKIPVLLHDGRPVCESLIIVQYLDEAFPATPSLLPAAAGDAYARAQARFWADYVDKKLYDCGTRLWKLKGDGHLQARTEMVEILRTLEGALGDGEFFGGEAFGFVDVALVPFTSWFLAYERFGDLSVEKECPRLAAWAKRCAERPSVAKNLYPGEKVYEFICGLKKRFGIE

SEQ ID NO: 46634 - protein, 91 aa, Sorghum bicolor
  Clone ID: SORBI-28MAY03-C104_51.pep
KKKKKKNSRLVLSNCGCGSGCKCGSGCGGCKMYPDMAEQQVTTTAKTLVMGVAPSSKGHAEGGFEAAAGAGAENDGCKCGPNCSCNPCTCK

SEQ ID NO: 46635 - protein, 204 aa, Sorghum bicolor
  Clone ID: SORBI-28MAY03-C104_52.pep
MAAIAGGNKIRNAKLVLLGDVGAGKSSLVLRFVKGQFVEFQESTIGAAFFSQTLAVNDETVKFEIWDTAGQERYHSLAPMYYRGAAAAIVVYDITNAASFTRAKKWVQELQAQGNSNTIVALAGNKADLLEARQVPAEEAKAYAQENSLFFMETSAKTAINVNDVFYEIAKKLLQGQQVQNPQGGMVLNQRPPERMVSSSSCCA

SEQ ID NO: 46636 - protein, 159 aa, Sorghum bicolor
  Clone ID: SORBI-28MAY03-C104_53.pep
KLVRADEGLRKRMSFHTADVASLTDGLGKYDVVFLAALVGMAAEDKAKVVAHLGRHMADGAALVVRSAHGARGFLYPIVDPEDIRRGGFDVLAVYHPDDEVINSVIIARKTDAHAKGPQNGHAHARGAVPIVSPPCKCCKMEANALQKREEMATTELSI

SEQ ID NO: 46637 - protein, 175 aa, Sorghum bicolor
  Clone ID: SORBI-28MAY03-C104_54.pep
RRGVYRPFGDAAVDGIDFYIDNGAPDHYDELARRLDGYNRFYRGRKGVRLTASPRCGCPDWRVDRALQTGLFERIHVRFYGDDKCSYKNGGTWGIVEEWDKWTARYPKAEVYLGLAAAESGVPDGAQGTIAVYLKYLYYDLLPKVQKAPNYGGVMVWDRYSDKKTGYSGVVQGWA

SEQ ID NO: 46638 - protein, 239 aa, Sorghum bicolor
  Clone ID: SORBI-28MAY03-C104_55.pep
MLGQIVYNKLKERSEQFVARGLVRTEESKQKIGGASDVYIADIRDTDRLAPAVQGVDALIILTSAVPKMKPGFDPSKGGRPEFYYEDGMYPEQVDWVGQKNQIDAAKAAGVKHIVLVGSMGGTNPNHPLNSLGNGNILVWKRKAEQYLADSGVPYTIIRPGGLQDKDGGVRELIVGKDDELLQTDTKSIPRADVAEVCVQALQYEEAKFKAFDLASKPEGVGTPTKDFRALFSQITARF

SEQ ID NO: 46639 - protein, 210 aa, Sorghum bicolor
  Clone ID: SORBI-28MAY03-C104_56.pep
MEAQNVEVAALVQKIAALHADIAKLPSLSPSPVVDALFINLVMACVPPSPVDVTKLGPDAQRMREELIRLCSDAEGHLEAHYADMLAGFDNPLDHLGRFPYFSNYVNLSKLEYDLLVRYVPGLAPSRVAFVGSGPLPFSSLVLAVYHPDDEVINSVIIARKTDAHAKGPQNGHAHARGAVPIVSPPCKCCKMEANALQKREEMATTELSI

SEQ ID NO: 46640 - protein, 340 aa, Sorghum bicolor
  Clone ID: SORBI-28MAY03-C104_57.pep
MLVRSASTPVLGALLPSGSHSPAVSSPAVHFPESPAAAAYHPPPISCHLAGPGSGSDHERTRGLVGTGMRRTCSEDNLASLAGVRADDHHHHHLPPSGKGAPRARPVPLETIQSFRGRQASSTDDEEEDEEEDAYEVERELRFGQFSFAGGDGNGSTYSQEHPLFLARGLGIDRLGSGLLSADGGGGFGGSDGGGGGNLVASGNGGDRSGIEMHYKKMIEEDPCNGLFLRNYAQFLYQVKGDYRRAEEYYSRAILADPDDGELLSEYAKLVWDVHRDEERASSYFERAAKASPQNSHVLAAHAAFLWDTDDDEEGGGDVLSCYTGFAQPAHSSPLASATT

SEQ ID NO: 46641 - protein, 262 aa, Sorghum bicolor
  Clone ID: SORBI-28MAY03-C104_58.pep
MAASTMSISSTAMAGTPIKVGSFGEGRITMRKTAAKPKVAASGSPWYGPDRVKYLGLFSGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWAVQVVLMGAVEGYRIAGGPLGEVVDPLYPGGSFDPLGLADDPEAFAELKVKELKNGRLAMFSMFGFFVQAIVTGKGPLENLADHLADPVNNNAWAYATNFVPGN

SEQ ID NO: 46642 - protein, 131 aa, Sorghum bicolor
  Clone ID: SORBI-28MAY03-C104_59.pep
MASIAGSSALSFARPVKAINTNSLAFSPVKKGNTFLRLQPVPMRSVSCAAKKDTVDKVCEIVKKQLALPDNTDVCGESKFSELGADSLDTVEIVMGLEEHFDISVEESSAQTIATVEDAADLIDKLVAGKA

SEQ ID NO: 46643 - protein, 229 aa, Sorghum bicolor
  Clone ID: SORBI-28MAY03-C104_60.pep
MAALAASSTAAFAAKPRLPRARLSVACSATGDGNANSVSLASSVKTFSAALALSSVLLSSAATSPPPAAADIAGLTPCKESKAFAKREKNSIKKLTASLKKYAPDSAPALAINATIEKTKKRFENYGKFGLLCGADGLPHLIVSGDQRHWGEFITPGLLFLYIAGWIGWVGRSYLIAISGEKKPPMREIIIDVEFATRLLPRGSIWPVAAYRELINGDLVVDDKDIGYY

SEQ ID NO: 46644 - protein, 157 aa, Sorghum bicolor
  Clone ID: SORBI-28MAY03-C104_61.pep
AALEPAWPGIGSTPAAAMSKRGRGGTAGNKFRMSLGLPVAATVNCADNTGAKNLYIISVKGIKGRLNRLPSACVGDMVMATVKKGKPDLRKKVMPAVIVRQRKPWRRKDGVYMYFEDNAGVIVNPKGEMKGSAITGPIGKECADLWPRIASAANAIV

SEQ ID NO: 46645 - protein, 471 aa, Sorghum bicolor
  unsure (1)..(471): unsure at all Xaa locations
  Clone ID: SORBI-28MAY03-C104_62.pep
MDAVEDWGLRPLSEVDPEVYDLIEREKRRQRSGIELIASENFTSLAVMEALGSPLTNKYSEGMPGARYYGGNEVIDEVEELCRARALAAFRLDPERWGVNVQPYSGSPANFAAYTGLLQPHDRIMGLDLPSGGHLTHGYYTAGGKKISATSIYFQSLPYKVSSDTGYVDYDKLEEKAMDFRPKLIICGGSAYPREWDYARLRAIADKCGAMLLCDMAHISGLVAAQEALNPFEYSDVVTTTTHKSLRGPRSGMIFYRKGPKPPKKGQPEGALYDYEDKINFAVFPSLQGGPHNHQIAALAVALKQAMSPGFKAYIQQVKANTVALGNHLMSKGYKLVTDGTENHLVLWDLRPLGLTGNKVEMLCDLCNITLNKNAVFGDSSAMXPGGVRIGTPAMTSRGLVEKDFVQIAEYLHQAVTICLSIQEEHGKLLRDFKKGLVGNKDIENLRAEVEKFATSFEMPGFRVSDMKYTD

SEQ ID NO: 46646 - protein, 529 aa, Sorghum bicolor
  unsure (1)..(529): unsure at all Xaa locations
  Clone ID: SORBI-28MAY03-C104_63.pep
MAAAAAAASGVGFQLIGAAAATLLAAVLVAAVLGRRRRRARPQAPLVEAKPAPEGGCAVGDGRTDVIIVGAGVAGSALAYTLGKDGRRVHVIERDLTEPDRIVGELLQPGGYLKLIELGLEDCVEEIDAQRVLGYALFKDGRNTKLAYPLEKFHSDVAGRSFHNGRFIQRMRQKAASLPNVQLEQGTVTSLLEENGTVKGVQYKTKSGEELKAYAPLTIVCDGCFSNLRRALCSPKVDVPSCFVGXVLENCQLPHPNHGHVILANPSPILFYPISSTEVRCLVDVPGQKVPSIASGEMANYLKTVVAPQIPPEIYDSFIAAIDKGSIRTMPNRSMPAAPHPTPGALLMGDAFNMRHPLTGGGMTVALSDIVVLRNLLKPLHNLHDASSLCKYLESFYTLRKPVASTINTLAGALYKVFSASPDQARNEMRQACFDYLSLGGVFSNGPIALLSGLNPRPLSLVAHFFAVAIYGVGRLMLPLPSPKRMWIGARLISGACGIILPIIKAEGVRQMFFPATVPAYYRAAPMGE

SEQ ID NO: 46647 - protein, 229 aa, Sorghum bicolor
  Clone ID: SORBI-28MAY03-C104_64.pep
MAALAASSTAAFAAKPRLPRARLSVACSATGDGNANSVSLASSVKTFSAALALSSVLLSSAATSPPPAAADIAGLTPCKESKAFAKREKNSIKKLTASLKKYAPDSAPALAINATIEKTKKRFENYGKFGLLCGADGLPHLIVSGDQRHWGEFITPGLLFLYIAGWIGWVGRSYLIAISGEKKPAMREIIIDVELATRLLPRGFIWPVAAYRELINGDLVVDDKDIGYY

SEQ ID NO: 46648 - protein, 204 aa, Sorghum bicolor
  Clone ID: SORBI-28MAY03-C104_65.pep
MADAVDRLKTGFNKFKTEVYDKKPELFEPLKAGQSPKYMVFACSDSRVCPSVTLGLQPGEAFTVRNIAAMVPAYDKTKYTGIGSAIEYAVCALKVQVLVVIGHSCCGGIRALLSLQDGAPDTFHFVEDWVRIGFPAKIKVKKEHASVPFDDQCSILEKEAVNVSLDNLKTYPFVKEGLANGTLRLVGGHYNFVSGEFDTWEIKS

SEQ ID NO: 46649 - protein, 242 aa, Sorghum bicolor
  Clone ID: SORBI-28MAY03-C104_66.pep
TQVAPEAFRPRARLPGRHARKHHHPRASPSRSPPVAFSVPGCVAGEPTTANRILRQGERGEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSSNIASKS

SEQ ID NO: 46650 - protein, 131 aa, Sorghum bicolor
  Clone ID: SORBI-28MAY03-C104_67.pep
MSWQTYVDDHLMCEIDGQHLSAAAIFGLDGSLWAQSTGFPQLKPEEVAAITKDFDEPGTLAPTGLFVGGTKYMVIQGEPGAVIRGKKGTGGITIKKTGMALIIGIYDEPMTPGQCNMVVERLGDYLVEQGF

SEQ ID NO: 46651 - protein, 266 aa, Sorghum bicolor
  Clone ID: SORBI-28MAY03-C104_68.pep
MAAAATMALTSRALVGKPATTSTRDVFGEGRITMRKTAAKPKPAASGSPWYGADRVLYLGPFSGEPPSYLTGEFPGDYGWDTAGLSADPETFAKNRELEVIHCRWAMLGALGCVFPELLARNGVKFGEAVWFKAGSQIFSEGGLDYLGNPSLIHAQSILAIWACQVVLMGAVEGYRVAGGPLGEVVDPLYPGGSFDPLGLADDPEAFAELKVKEIKNGRLAMFSMFGFFVQAIVTGKGPLENLADHLADPVNNNAWAYATNFVPGK

SEQ ID NO: 46652 - protein, 172 aa, Sorghum bicolor
  unsure (1)..(172): unsure at all Xaa locations
  Clone ID: SORBI-28MAY03-C104_69.pep
MASSSSSPTKLLACLVAAALALAATVVAPCAAQNSPQDYVNPHNAARADVGVGPVSWDDTVAAYAQSYAAQRQGDCKLIHSGGPYGENIFWGSAGADWSASDAVASWVSEKQYYNHDTNSCADGKVCGHYTQVVWRDSTAIGCARVVCDNNAGVFIICSYNPPGQXVGQSPY

SEQ ID NO: 46653 - protein, 522 aa, Sorghum bicolor
  Clone ID: SORBI-28MAY03-C104_70.pep
MDKAYVAVLSFAFLFVLHYLVGRAGGNGRKGNNGKGNAAQQRLPPSPPAVPFLGHLHLVKTPFHEALAGLAARHGPVFSMRMGSRGAVVVSSPECAKECFTEHDVAFANRPRFATQELVSFGGAALATASYGPYWRNLRRVAAVQLLSAHRVACMSSVISAEVRAMVRRMSRAAAAAPDGAARVQLKRRLFEVSLSVLMETIAQTKTSRTEADADTDMSPEAHEFKQIVDEIVPHLGTANLWDYLPVLQWFDVFGVRNKIMAAVSRRDAFLRRLIDAERRRMDDGGDSDKKSMIAVLLSLQKSEPELYTDTMIMALCGNLFGAGTETTSSTTEWAMSLLLNHPEALKKAQAEIDAVVGNSRLITAEDVPRLGYLQCVINETLRMYPAAPLLLPHESAADCKVGGYDVPRGTLLIVNAYAIHRDPAVWEDPAEFRPERFEDGKAEGRLLMPFGMGRRKCPGETLALRTVGLVLGTLIQCIDWDRVDGLEIDMTAGGGLTMPRAVPLEATCKPRAAMRDVLMEL

SEQ ID NO: 46654 - protein, 230 aa, Sorghum bicolor
  Clone ID: SORBI-28MAY03-C104_71.pep
MSAFPVRGSTSSSSIVASLGSSRAPAPAPSSVRRRPSLIRNAPVVAVPATLVGMDAVERLKVGFQKFKTEVYDKKPELFEPLKAGQAPKYMVFACSDSRVCPSVTLGLQPGEAFTVRNIASMVPPYDKTKYSGTGSAIEYAVCALKVQVLVVIGHSCCGGIRALLSLKDGAPHNFHFVEDWGRIGSPAKAKVHKEHASVPFDDQCSILEKEAVNVSLANLKTYPFVKERL

SEQ ID NO: 46655 - protein, 471 aa, Sorghum bicolor
  Clone ID: SORBI-28MAY03-C104_72.pep
MDPVATWGLTPLAGADPEIYDLLEREKRRQRRGIELIASENFTSFAVMEALGSPLTNKYSEGMPGARYYGGNDVIDEIENLCRSRALAAFRLDAAFWGVNVQPYSGSPANFAAYTALLNPHDRIMGLDLPSGGHLTHGYYTAGGKKISATSIYFESLPYKVSATTGYIDYEKLEEKALDFRPKLIICGGSAYPRDWDYSRLRAIADKVGALLLCDMAHISGLVAAEEAANPFEYCDVVTTTTHKSLRGPRAGMIFYRKGPKPPKKGQPEGAVYDYEDKINFAVFPSLQGGPHNHQIAALAVALQQTMTPGFKAYAKQVKANAVAIGNYLMSKGYKMVTDGTENHLVLWDLRPLGLTGNKVEKLCDLCHITLNKNAVFGDSSALAPGGVRIGAPAMTSRGLVEKDFEQIGEFLHQAVTICLNIQKEYGKLLKDFNKGLLNNKDIENLKTQVEKFADSFDMPGFTLESMKYKE

SEQ ID NO: 46656 - protein, 321 aa, Sorghum bicolor
  Clone ID: SORBI-28MAY03-C104_73.pep
MSNAASCGESSFLLPLQWFISKAFLMATHTQHRASYHLIDMAGATMALTSRALVGKPATTSTRDVFGEGRITMRKTAAKPKPAASGSPWYGADRVLYLGPFSGEPPSYLTGEFPGDYGWDTAGLSADPETFAKNRELEVIHCRWAMLGALGCVFPELLARNGVKFGEAVWFKAGSQIFSEGGLDYLGNPSLIHAQSILAIWACQVVLMGAPASGSPWYGADRVLYLGPFSGEPPSYLTGEFPGDYGWDTAGLSADPETFAKNRELKVKEIKNGRLAMFSMFGFFVQAIVTGKGPLENLADHLADPVNNNAWAYATNFVPGK

SEQ ID NO: 46657 - protein, 265 aa, Sorghum bicolor
  Clone ID: SORBI-28MAY03-C104_74.pep
MAAATMALTSRALVGKPATTSTRDVFGEGRITMRKTAAKPKPAASGSPWYGADRVLYLGPFSGEPPSYLTGEFPGDYGWDTAGLSADPETFAKNRELEVIHCRWAMLGALGCVFPELLARNGVKFGEAVWFKAGSQIFSEGGLDYLGNPSLIHAQSILAIWACQVVLMGAVEGYRVAGGPLGEVVDPLYPGGSFDPLGLADDPEAFAELKVKEIKNGRLAMFSMFGFFVQAIVTGKGPLENLADHLADPVNNNAWAYATNFVPGK

SEQ ID NO: 46658 - protein, 245 aa, Sorghum bicolor
  Clone ID: SORBI-28MAY03-C104_75.pep
MAMASSSGLRSCSAVGVPSLLAPSSRWSSRLPFCANATTSGRVTMSAEWMPGQPRPAHLDGSSPGDFGFDPLGLATVPENFERFKESEVYHCRWAMLAVPGILVPEALGLGNWVKAQEWAAVPGGQATYLGNPVPWGSLPTILVIEFVAIAFAEHQRTMEKDPEKKKYPGGAFDPLGFSKDPAKFEEYKLKEIKNGRLAMLAFVGFCVQQSAYPGTGPLENLATHLADPWHNNIGDIIIPRSISP

SEQ ID NO: 46659 - protein, 229 aa, Sorghum bicolor
  Clone ID: SORBI-28MAY03-C104_76.pep
SGEASSATDRAQVPWKGTPGRVRAPSGPDPAAPRGAVNELGLLNYRAKHIFYPSSKRRFRCHDDYYWASVLQVEYTEYFSGQVSYAVAEAPKEALPHNCRPDFGAAWSTTLKFKVNESYSCRYMLGSNKADIHSDKLFNCTAEEPSTTELLKRILILFSEMYVSEDFSSERMLGYVAAGVVLGMLSSMFITVLFRGFYGLLLAAARWAYSKFIGLKELLSDSELMERFF

SEQ ID NO: 46660 - protein, 265 aa, Sorghum bicolor
  Clone ID: SORBI-28MAY03-C104_77.pep
MASSTMALSSTAFAGKAVNVPSSLFGEARVTMRKTAAKAKPAAASGSPWYGPDRVLYLGPLSGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWACQVVLMGAVEGYRIAGGPLGEVVDPLYPGGSFDPLGLADDPEAFAELKVKELKNGRLAMFSMFGFFVQAIVTGKGPLENLADHLADPVNNNAWAYATNFVPGK

SEQ ID NO: 46661 - protein, 537 aa, Sorghum bicolor
  unsure (1)..(537): unsure at all Xaa locations
  Clone ID: SORBI-28MAY03-C104_78.pep
MSAFPVRGSTSSSSIVASLGSSRAPAPAPAPSSVRRRPSLIRNAPVVAVPATXCKREDEQLIKSQTREKGREGHTTSIDTGXRRKKTQGDEQLPLPPXKEGGPGGGSEAVHRFNHLDSRSEPEAXQPPPPPSKGMDAVERLKVGFQKFKTEVYDKKPELFEPLKAGQAPKYMVFACSDSRVCPSVTLGLQPGEAFTVRNIASMVPPYDKTKYSGTGSAIEYAVCALKVQVLVVIGHSCCGGIRALLSLKDGAPHNFHFVEDWVRIGSPAKAKVHKEHASVPFDDQCSILEKEAVNVSLANLKTYPFVKERLAKGTLKLVGAHYDFVSGKFLTWEPVMDAVDRLKSGFEQFKIEVYDKKPELFEPLKSGQAPRYMVFACADSRVCPSVTLGLMPGEAFTVRNIAALVPGYDKTKYTGIGSAIEYAVCALKVQVLVVIGHSCCGGIRALLSLQDGAPDNFHFVEDWVKIGFPAKMKVKKENASVPFDDQCYILEKEAVNVSLENLKTYPFVKEGLANGTLKLVGGHYDFVKGEFLTWKV

SEQ ID NO: 46662 - protein, 312 aa, Sorghum bicolor
  Clone ID: SORBI-28MAY03-C104_79.pep
MASRRRHSCLGAPLVLALAFVLLSCLAGPATAKQTNQVTVFWGRNKDEGSLREACDTGLYTTVIISFYSVFGHGRYWGDLSGHQLGGVGADIKHCQQSKGILVLLSIGGGGHDYSLPSSQSAADVADNLWNAHLGGRRRGVYRPFGDAAVDGIDFYIDNGAPDHYDELARRLDGYNRFYRGRKGVRLTASPRCGCPDWRVDRALQTGLFERIHVRFYGDDKCSYKNGGTWGIVEEWDKWTARYPKAEVYLGLAAAESGVPDGAQGTIAVYLKYLYYDLLPKVQKAPNYGGVMVWDRYSDKKTGYSGVVQGWA

SEQ ID NO: 46663 - protein, 387 aa, Sorghum bicolor
  Clone ID: SORBI-28MAY03-C104_80.pep
MADQANQPTVLHKLGGQFHLSSSFSEGVRARNICPSVSSYERSFATRNYMTQSLFSPSMSVTGGINVPVMRTPLFANAPAEKGGKNFMIDFMMGGVSAAVSKTAAAPIERVKLLIQNQDEMIKSGRLSEPYKGIGDCFKRTIKDEGFSSLWRGNTANVIRYFPTQALNFAFKDYFKRLFNFKKDKDGYWKWFAGNLASGGAAGASSLFFVYSLDYARTRLANDAKAAKGGGDRQFNGLVDVYRKTLKSDGIAGLYRGFNISCVGIIVYRGLYFGLYDSIKPVVLTGNLQDNFFASFALGWLITNGAGLASYPIDTVRRRMMMTSGEAVKYKSSLDAFQQILKKEGPKSLFKGAGANILRAIAGAGVLSGYDQLQILFFGKKYGSGGA

SEQ ID NO: 46664 - protein, 262 aa, Sorghum bicolor
  Clone ID: SORBI-28MAY03-C104_81.pep
MAASTMSISSTAMAGTPIKVGSFGEGRITMRKTAAKPKVAASGSPWYGPDRVKYLGPFSGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWAVQVVLMGAVEGYRIAGGPLGEVVDPLYPGGSFDPLGLADDPEAFAELKVKELKNGRLAMFSMFGFFVQAIVTGKGPLENLADHLADPVNNNAWAYATNFVPGN

SEQ ID NO: 46665 - protein, 735 aa, Sorghum bicolor
  Clone ID: SORBI-28MAY03-C104_82.pep
RPAADAVALDEAHEHDLARPDGQDALRVHQVRVAQVVQPALREDLRAGLEPHRLAELDAVLGQDLREHAPQRAQHRPPRVDHLQLAVPRERLRVRRQPRRVPPVVAGELAGQVRRRLLRERAKVLGAVRAVPDALGSALDGAAHGDAAAGIGGGGGGAGDQGLPEEAGGLVKRRRGHRRSVCEHGAAQWSVRISFTVTRDTSGEQLGRGTKMTLYLKDDQLEYLEERRLKDLIKKHSEFISYPISLWIEKTTEKEISDDEDEEDKKDEEGKVEDVDEEKEEKEKKKKKIKEVSHEWQLVNKQKPIWMRKPEEITKEEYAAFYKSLTNDWEEHLAVKHFSVEGQLEFKAVLFVPKRAPFDLFDTRKKLNNIKLYVRRVFIMDNCEELIPEWLSFVKGIVDSEDLPLNISRETLQQNKILKVIRKNLVKKCIELFFEIAENKEDYNKFYEAFSKNLKLGIHEDSTNRTKIAELLRYHSTKSGDELTSLKDYVTRMKEGQNDIYYITGESKKAVENSPFLEKLKKKGYEVLYMVDAIDEYAIGQLKEFEGKKLVSATKEGLKLDESEDEKKKKEELKEKFEGLCKVIKEVLGDKVEKVVVSDRVVDSPCCLVTGEYGWTANMERIMKAQALRDSSMSGYMSSKKTMEINPENAIMEELRKRAEADKNDKSVKDLVMLLFETALLTSGFSLDDPNTFGSRIHRMLKLGLSIDEDEAPEADTDMPPLEDDAGESKMEEVD

SEQ ID NO: 46666 - protein, 217 aa, Sorghum bicolor
  Clone ID: SORBI-28MAY03-C104_83.pep
ARGPDRPKYLGPFSEQTPSYLTGEFPGDYGWDTAGLSADPETFARNRELEVIHSRWAMLGALGCVFPEILAKNGVKFGEAVWFKAGAQIFSEGGLDYLGNPNLVHAQSILAIWACQVVLMGFVEGYRVGGGPLGEGLDKVYPGGAFDPLGLADDPDTAAELKVKELKNGRLAMFSMFGFFVQAIVTGKGPIENLFDHVADPVANNAWAYATNFVPGN

SEQ ID NO: 46667 - protein, 84 aa, Sorghum bicolor; identical to SEQ ID NO: 46632
  Clone ID: SORBI-28MAY03-C104_84.pep

SEQ ID NO: 46668 - protein, 87 aa, Sorghum bicolor
  Clone ID: 7552900.pep
PGPLCLNFDSLSFSIPCCCFPSSHAPVYACDGAAAIAAVLPRALLFRFFQVDKMMAGCWFLCSKPAAPKEKRPAHFVLKKKKTRGGP

SEQ ID NO: 46669 - protein, 100 aa, Sorghum bicolor
  Clone ID: 30980014.pep
ARRRQAEGGRRRCLPPAPKPKAKLAAAKTAAPKPTKKDAAKPKKTAAAAKPKKAAAGTKRKAPEKKKVVAKPKKSPAAKAKAKPKTVKSPAAKKARKVAA

SEQ ID NO: 46670 - protein, 107 aa, Sorghum bicolor
  Clone ID: 30977664.pep
VWEAVVMEIVMTFGLVYTVYATAVDPKKGSLGTIAPIAIGFIVGANILVGGAFTGASMNPAVSFGPALVSWEWGYQWVYWVGPLIGPLIYELLFISQTHEQLPTTDY

SEQ ID NO: 46671 - protein, 104 aa, Sorghum bicolor
  unsure (1)..(104): unsure at all Xaa locations
  Clone ID: 30977531.pep
FKSGAERKDAAESPMNAYKAAQDIALADLAPTHPXIRLGLALNFSVFYYEILNSPDRACNLAKQAFDEAISELDSLGEESYKDSTLLPRKSPQRVSKMDFDLPT

SEQ ID NO: 46672 - protein, 162 aa, Sorghum bicolor
  Clone ID: 9296752.pep
PPAPRGVPQITVCFDIDANGILNVSAEDKTTGQKNKMVQDAEKYKSEDEEHKKKVEAKNSLENYAYNMRNTIKDEKIASKLAGDDKKKIEDAIDAAISWLDANQLAEADEFEDKMKELESLCNPIIAKMYQGAGADMGGAGGMDEDAPAGSGGPGPKIEEVD

SEQ ID NO: 46673 - protein, 196 aa, Sorghum bicolor
  Clone ID: 30977337.pep
AKQPLRRPLPSDAEDDTDDPDAGAGAESFKKSRNELKREARRAVKWGMDLASFSPPQIKRILSAASLEREVFDALMLVKKFGPDVREGKRRQFNYIGRLLRNAQPELMDTLIQASKDGDESKLHALLSEGTLLVEEEEVEDLPDEQEDNQEYIKIADRWFDGLLCKDISVTNEVYSVHSVEFDRQELRKLVKRAHM

SEQ ID NO: 46674 - protein, 113 aa, Sorghum bicolor
  Clone ID: 30976318.pep
MFDASHYEHCRHKYGAVGTFMSVYYKSRKGRKTEKEVQAIRNYYHDNHVIQDMLVPLYKVGDALEFVHREMEVYPLWLCPHRLYKLPVKTMVYPEPGFEHQHRQGDTSYADEA

SEQ ID NO: 46675 - protein, 156 aa, Sorghum bicolor
  Clone ID: 30976244.pep
VMEVTTVTITVAGRRPVVPVGRSKRVAEQVVSPWQILIFLTHAHPSSSICPSVGAERCCGSKQIQAVYFSTMATKKTKQCPQLTSLGCIGAKASLVKSETTGGAKARPPWAAGRAPTVQQSLGLPLRRWTRPRGRLLLAGQDRTKHYWPGAIEASY

SEQ ID NO: 46676 - protein, 216 aa, Sorghum bicolor
  unsure (1)..(216): unsure at all Xaa locations
  Clone ID: 30975502.pep
MASHIVGYPRMGPKRELKFALESFWDGKSTAEDLEKVATDLRASIWKQMADAGIKYIPSNTFSYYDQVLDTTAMLGAVPERYSWTGGXTKWFDTNYHFIVPELGPNTKFSYASHKAVNEYXEAKALGVDTVPVLIGPVSYLLLSKPAKGVEKGFPLPSPLSSILPVYKEVIAELKAAGASWIQFDEPTLVLDLDSNKLAAFSAAYAELESALSGLN

SEQ ID NO: 46677 - protein, 162 aa, Sorghum bicolor
  Clone ID: 14327992.pep
TPLSLGLETAGGVMTVLIPRNTTIPTKKEQVFSTYSDNQPGVLIQVYEGERTRTRDNNLLGKFELSGIPPAPRGVPQITVCFDIDANGILNVSAEDKTTGQKNKITITNEFEDKMKELESLCNPIIAKMYQGAGADMGGAGGMDEDAPAGSGGPGPKIEEVD

SEQ ID NO: 46678 - protein, 81 aa, Sorghum bicolor
  Clone ID: 30972521.pep
RPVRRRRRVQGLLPQDEGRLPQAFDEAISELDSLGEESYKDSTLIMQLLRDNLTLWTSDTNEDGGDEIKEAAAPKESTEGQ

SEQ ID NO: 46679 - protein, 73 aa, Sorghum bicolor
  Clone ID: LIB3480-031-P1-K1-B11.pep
SDSPAPMAVLSAADAPPVSAIGFEGYEKRLEITIVSELSNKDFDSYVLSESSLVIYPLKIGIKTWGTTKLLVT

SEQ ID NO: 46680 - protein, 88 aa, Sorghum bicolor
  Clone ID: 7553017.pep
RAPPRRLRLQHEEHKLPAEDKKKIEDAVDSAISWLDSNQLAEVDEFEDKMKELEGICGAGAGMGDAAGMDEDAPSGGSGAGPKIEEVD

SEQ ID NO: 46681 - protein, 85 aa, Sorghum bicolor
  Clone ID: 7553025.pep
PFACMVGFRSAPVVNTYVGVASEIVVQFSRGACEPARALQTWDQSLVNPGRCGWSLGGSKAKHALFCISKQSMLCYSVSCFFRCC

SEQ ID NO: 46682 - protein, 105 aa, Sorghum bicolor
  Clone ID: 7553033.pep
TRASFTSQVIIMNHPGQIGNGYAPVLDAELVTKIDRRSGKELEKEPKFLKNGDAGMVKMVPTKPMVVETFSEYHMRQTVAVGVIKSVEKKDPTGAKVTKAAAKKK

SEQ ID NO: 46683 - protein, 73 aa, Sorghum bicolor
  Clone ID: 7553062.pep
SVDFRCSDVSSTIDASLTMVMGDDMVKVVAWYDNEWGYSQRVVDLAHLVAAKCPLEDFCKDNPETDECKVYEA

SEQ ID NO: 46684 - protein, 74 aa, Sorghum bicolor
  Clone ID: LIB5052-001-A1-XP1-G11.pep
VPLLLPCCVVTLVHRVYLSSCCSSSSCPCVCCCCPSVFLIASCVSAVFVLKKKKKKKKKRKNYSGHLEIESPYS

SEQ ID NO: 46685 - protein, 67 aa, Sorghum bicolor
  Clone ID: 7553209.pep
VLRFWNSSGRWAFVSLVEFLHFDIQSTGQKSHCVSIRGDHRNLVRTSSESVVRRPGKAPEGTVPGPS

SEQ ID NO: 46686 - protein, 102 aa, Sorghum bicolor
  unsure (1)..(102): unsure at all Xaa locations
  Clone ID: 7553210.pep
MLSIQLRGFAAKGKLVKVKASYKLSDAAKKAAPKPKAKLAAAKTAAPKPTKXGPKPKKAAAGTKRKAPEKKVVAKPKKSPAAKAKAKPKTVKSPAAKKARKA

SEQ ID NO: 46687 - protein, 38 aa, Sorghum bicolor
  Clone ID: 7553214.pep
NKTPQKPFGGHTLNLYNSYYNLSNPFYAGTFRAFLAGG

SEQ ID NO: 46688 - protein, 106 aa, Sorghum bicolor
  Clone ID: 8088604.pep
EEVTKRVAQIKNLIEAAEQEYEKEKLNERIAKLAGGVAVIQVGAQTETELKEKKLRVEDALNATKAAVEEGIVVGGGCTLLRLAAKVDAIRCCGRRYQGAGGRAPR

SEQ ID NO: 46689 - protein, 149 aa, Sorghum bicolor
  Clone ID: 8088457.pep
IPTKKEQVFSTYSDNQPGVLIQVYEGERTRTRDNNLLGKFELSGIPPAPRGVPQITVCFDIDANGILNVSAEDKTTGQKNKITISWLDANQLAEADEFEDKMKELESLCNPIIAKMYQGAGADMGGAGGMDEDAPAGSGGPGPKIEEVD

SEQ ID NO: 46690 - protein, 95 aa, Sorghum bicolor
  Clone ID: 7553220.pep
TRIPIPFLEKKKEETLHMGGDHKKDDEHKKEEHKKAEEHHKKDGEHKEGIVEKIKDKITGEHGEKSGKDKKKKKEKKHGEGHDHDGHSSSSSDSD

SEQ ID NO: 46691 - protein, 56 aa, Sorghum bicolor
  Clone ID: 7553233.pep
GWRLREGGGGYGAGGYGGGGGGYGGPREGGGGYGGGGGYGGNRGDSGGNWRNSKLS

SEQ ID NO: 46692 - protein, 182 aa, Sorghum bicolor
  unsure (1)..(182): unsure at all Xaa locations
  Clone ID: 7660693.pep
GGVMTVLIPRNTXTIPTKKEQVFSPYSDNQPGVLIQVYEGERTRTRDNNLLGKFELSGIPPAPRGVPQITVCFDIDANGILNVSAEDKTTGQKNKITITNDKGRLSKEEIEKMVQDAEKYKSEDEEHKKKVEAKNSLENYAYNMRNTIKDEKIASKLAGDDKKKIEDAIGWLVNNVIVASVK

SEQ ID NO: 46693 - protein, 131 aa, Sorghum bicolor
  Clone ID: 7553235.pep
RCFVGGLAWATNNEIDSKVITDRETGRSRGFGFVTFSFEQSMLDAIENMNGKELDGRNITVNQAQSRGGGGGYGGPREGGGYGGGGGGYGGPREGGGGYGGGGYGGGGGGYGGPGGGYGGNRGDSGGNWRN

SEQ ID NO: 46694 - protein, 164 aa, Sorghum bicolor
  Clone ID: 9301956.pep
MSWFGHHHHNQPAPPASGPNQVFKIFCRANENYCLAVVLWEWCKGENQSWKILPWGPEANAAAGANGGVHTVRVFCKAGGEDYCLTVRNGTACLAPTNPRDEYQHWIKDMRHSTRVRDEEGYPAFALVNKVTGEALKHSTGQGHPVKLVPYNPEYQDESVLWTE

SEQ ID NO: 46695 - protein, 157 aa, Sorghum bicolor
  Clone ID: LIB3476-037-P1-K1-G11.pep
MSWFGHHHHNQPAPPASGPNQVFKIFCRANENYCLAVRDGAVVLAPTNPKDEHQHWYKDMRFSTRVKDEEGMPAFVKHSLGQSHPVKLAPFNPDQEDASVLWTESKDVGKGFRCIRMVNNTRLNFDAFHGDKDHGGVHDGTGVVLWEWCKGENQSWK

SEQ ID NO: 46696 - protein, 213 aa, Sorghum bicolor
  unsure (1)..(213): unsure at all Xaa locations
  Clone ID: 30947425.pep
MAAKLTRLHSLRERLGATFSSHPNELIALFSRYVNQGKGMLQRHQLXIRPRPGVWDYIRVNVSELAVEELSVSEYLAFKEQLVDGNSNSNFVLELDFEPFNASFPRPSMSKSIGNGVQFLNRHLSSKLFQDKESLYPLLNFLKAHNYKGTTMMLNDRIQSLRGLQSSLRKAEEYLLSVPQDTPYSEFNHRFQELGLEXGWGDTAKRVLDTLHL

SEQ ID NO: 46697 - protein, 92 aa, Sorghum bicolor
  unsure (1)..(92): unsure at all Xaa locations
  Clone ID: LIB3476-010-P1-K1-G2.pep
PQLHACVPPTQDPDRATAAPVHPPCRQGKVRLTKWYSPYTQKERTKVIRELSGLILTRGPKLCNFVEWRGTRLIPEDASLISDVXDADDNEL

SEQ ID NO: 46698 - protein, 157 aa, Sorghum bicolor
  Clone ID: 30161077.pep
KRKRRDKVYGNNVEIQAFAEMYNRPIHIYSYGAEPINIFQGSYNTDVPPIRLSYHHGNHYNSVVDPRRQTVGAGLGFSSRSVAGADRGSEDYFVLPDTVLTRSMQLLLAMGFSYIQVMEAYSIFGEDVDSMVCYLVETGGTGASAGGSNRRKGKAAE

SEQ ID NO: 46699 - protein, 177 aa, Sorghum bicolor
  Clone ID: 30944133.pep
RLLLLPCLPPPLPDLPPTPESRSTASPPPHRSRAARGSAGQRPAMGKEGASAGGGGGDGGMSESVIRKVLISYMYVAVWIFLSFSVIVYNKYILDPKMHMAFCSSLAVALVRVLRVVDLPSSPAMTSQLYVSSVVPIGALYSLSLWFSNSAYIYLSVSFIQMLKALMPVAGYSIGGA

SEQ ID NO: 46700 - protein, 183 aa, Sorghum bicolor
  unsure (1)..(183): unsure at all Xaa locations
  Clone ID: 30944125.pep
FEVKATAGDTHLGGEDFDNRMVNHFVQEFKRKNKKDITGNPRALRRLRTACERAKRTLSSTAQTTIEIDSLYEGIDFYSTITRARFEELNMDLFRKCMEPVEKCLRDAKMXQDFFNGKELCKNINPDEAVAYGAAVQAAILSGEGNEKVQDLLLLDVTPLSLGLETAGGVMTVLIPRNTTIPT

SEQ ID NO: 46701 - protein, 68 aa, Sorghum bicolor
  Clone ID: 30943762.pep
EILHLQLRNYLYSFQFLLDVKSWRASVHRYRAGKTRYAHFRQTDELLADSGWHCSLCCSSPCLSAGAE

SEQ ID NO: 46702 - protein, 106 aa, Sorghum bicolor
  Clone ID: 9847934.pep
NGKELCKNINPEGNEKVQDLLLLDVTPLSLGLETAGGVMTVLIPRNTTIPTKKEQVFSTYSDNQPGVLIQVYEGERTRTRDNNLLGKFELSGIPPAPRGVPQITVC

SEQ ID NO: 46703 - protein, 149 aa, Sorghum bicolor
  unsure (1)..(149): unsure at all Xaa locations
  Clone ID: 30940722.pep
MVLWVFGYGSLIWNPGFDFDDRILGFIKGYKRTFNLACIDHRGTPEHPARTCTLETDDEAICWGIAYCVKGGPEKERKAMQYLERRECEYDLKISIGFYKEGDPLKPAVTGVLVXIGNKYYLGPAPLQDMAKQIATANGPTGYNRDYLS

SEQ ID NO: 46704 - protein, 168 aa, Sorghum bicolor
  Clone ID: 30932993.pep
MENGGGKGDVPDDANEHCPGTQSEEAGKADACAGCPNQQICATAPKGPDPDVVAIVERLATVKHKLLVLSGKGGVGKSTFSAQLSFALAEMDHQVGLLDIDICGPSIPKMLGLEGQDIHQSNLGWSPVYVESNLGVMSIGFMLPNPDDAVIWRGPRKNGLIKQFLKDV

SEQ ID NO: 46705 - protein, 162 aa, Sorghum bicolor
  unsure (1)..(162): unsure at all Xaa locations
  Clone ID: 9850356.pep
MQPDANAPSHRLARVAAHLRPQMEEGAVAFALRPAVCRAKGGAPGFKVAILGAAGGIGQPLSLLMKMNPLVSVLHLYDVVNTPGVTADISHMDXQLDAALTGMDLVIIPAGVPRKPGMTRDDLFNINAGIVRTLCEGVSRCCPNAIVNLISNPVNSTVPIAA

SEQ ID NO: 46706 - protein, 176 aa, Sorghum bicolor
  Clone ID: 30939029.pep
MFGFGHHGHHHGENPPAHPPAHGGVHPPTFKIFCKADEGYCLTVRDGNVVLAPSNPRDEHQHWYKDMRFSNQIKDEEGNPAFALVNKATGLAIKHSLGQSHPVKLVPFNAPYGHGEPTVRIYCKADDGFSVTVRNGSVCLAPTNPRDEYQHWVKDMRHSNRIKDEEGYPAFALVNR

SEQ ID NO: 46707 - protein, 127 aa, Sorghum bicolor
  Clone ID: 30938615.pep
MNINYGYGAYAGSSLMNAAVPPGSFFLQSQLRVGTAMTVSSESAATVPPILPRNVAEKVPFSNLADVLAAFHISPSSAEATTVGDTLSLCGAPPSLAGEQKACATSLEDTVESATHMLVVGSSVRHG

SEQ ID NO: 46708 - protein, 92 aa, Sorghum bicolor
  Clone ID: 9854405.pep
LWYEHLGMLDDVFQHPESMECVQKVNRIADKYWDLYTSDDLEQDLPGHLLSYPIGVTADGTVTALPGMDNFPDTRARVLGNKTIYIPTILTT

SEQ ID NO: 46709 - protein, 136 aa, Sorghum bicolor
  unsure (1)..(136): unsure at all Xaa locations
  Clone ID: LIB3476-035-P1-K1-C9.pep
MGRKFFVGGNWKCNGTTDQVEKIVKTLNEGQVPPADVVEXLLGESNEFVGDKVAYALSQGLKVIACVGETLEQREAGSTMEVVAAQTKAIAEKISDWSNVVVAYEPVWAIGTGKVATPAQAQEVHASLRDWLKINV

SEQ ID NO: 46710 - protein, 134 aa, Sorghum bicolor
  Clone ID: 30963423.pep
VSRLDPDGKKFDKVSRVEARSEQLGMYMQLDVATDVYPLRAGEKFNMVLAPTLNLDGTPDTGYYTQAGRKTLADNYEYVMQGKLYKISEDTSSQNAKVEIYASFGGLLMLLRGDPSTAASFELDQRLFLLMRKV

SEQ ID NO: 46711 - protein, 107 aa, Sorghum bicolor
  Clone ID: 30952931.pep
MENGGGKGDVPDDANEHCPGTQSEEAGKADACAGCPNQQICATAPKGPDPDVVAIVERLATVKHKLLVLSGKGGVGKSTFSAQLSFALAEMDHQVGLLDIDICGPSI

SEQ ID NO: 46712 - protein, 56 aa, Sorghum bicolor
  unsure (1)..(56): unsure at all Xaa locations
  Clone ID: LIB3478-005-P1-K1-D5.pep
MGGGNGQKSKMARERNLEKNKGSKGSQLETNKKAMXHAEAKHPKTDVYQCFPHLKK

SEQ ID NO: 46713 - protein, 185 aa, Sorghum bicolor
  Clone ID: 30949468.pep
KELCKNINPDEAVAYGAAVQAAILSGEGNEKVQDLLLLDVTPLSLGLETAGGVMTVLIPRNTTIPTKKEQVFSTYSDNQPGVLIQVYEGERTRTRDNNLLGKFELSGIPPAPRGVPQITVCFDIDANGILNVSAEDKTTGQKNKITITNDKGRLSKEEIEKMVGWLVNNVIVASVKEYYGIILVR

SEQ ID NO: 46714 - protein, 136 aa, Sorghum bicolor
  Clone ID: 30968876.pep
ELLALLPQKVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFTEINKAFDLMAKGEGIRCIIRMEN

SEQ ID NO: 46715 - protein, 127 aa, Sorghum bicolor
  Clone ID: 30948781.pep
MAAADVEYRCFVGGLAWATNNETLEHAFANFGQVVDSKVITDRETGRSRGFGFVTFSSEQSMLDAIENMNGKELDGRNITASRCSRCRRGRAGDGDGGGRQPSPSPHGSTNGTGYTKLHAEPSAAGV

SEQ ID NO: 46716 - protein, 148 aa, Sorghum bicolor
  unsure (1)..(148): unsure at all Xaa locations
  Clone ID: 30969736.pep
MALNKEYTYAELEKEPYWPFEKLRISITGAGGFIASHIARRLKSEGHYIIASDWKKNEHMSEDMFCHEFHLVDLRVMDNCLKVTTGVDHVFNLAADIGXGMGFIQSNHSVIMYNNTMISFNMLEAARINGVKRFFYASSACIYPEFKQ

SEQ ID NO: 46717 - protein, 98 aa, Sorghum bicolor
  Clone ID: 30970248.pep
GLGFTGWSESSPPKAKWDRAKNVDVLGVELAGSAVQIPLVWNIQVSTWLRYYVYERLIQKGKKPGFLQLLGTQTASSEQFIPPRYPGFSKFCLYIAGA

SEQ ID NO: 46718 - protein, 196 aa, Sorghum bicolor
  Clone ID: 18063148.pep
ARGPFLQTAKWLPCSDLATSSSSAPSSPPRSLAPSAPPRKALIAGDSGTVTAGASGSAGIATSSGAGAAMSRSNWLSRWVSSCSDDAKTAFAAVTVPLLYGSSLAEPKSIPSKSMYPTFDIGDRILAEKVSYIFRDPEISDIVIFRAPPGLQAYGYSSGDVFIKRVVAKGGDYVEVHDSKLFVNGVVQDEDYVLEP

SEQ ID NO: 46719 - protein, 136 aa, Sorghum bicolor
  Clone ID: LIB5050-008-R1-XP1-F10.pep
MARTKQTARKSTGGKAPRKQLATKAARKSAPATGGVKKPHRFRPGTVALREIRKYQKSTELLIRKLPFQRLVREIAQDFKTDLRFQSSAVAALQEAAEAYLVGLFEDTNLCAIHAKRVTIMPKDIQLARRIRGERA

SEQ ID NO: 46720 - protein, 191 aa, Sorghum bicolor
  unsure (1)..(191): unsure at all Xaa locations
  Clone ID: 30975664.pep
APSSASTSVSPSRRASTARALPTSGSRSAATNACSSPSSSSCCCCCTTTTTTTSRTSSRGGGGGGMGXTVLRKVLLSYFYVAVWIFLSFSVYVYNKYILDPKMYNWPFPISLTMVHMGFCSSLAGVLVRVLRVVDLPTSPSMTPQXYTSSVVPIGALYAMSLWFSNSAYIYLSVSFIQMLKALMPIGVYSI

SEQ ID NO: 46721 - protein, 136 aa, Sorghum bicolor; identical to SEQ ID NO: 46719
  Clone ID: LIB5050-010-R1-XP1-A9.pep

SEQ ID NO: 46722 - protein, 102 aa, Sorghum bicolor
  Clone ID: 7554236.pep
YSVNARRNRSLTKEEVEAFWKQRPSRRSSEEGGGELASPLSSPPATATWQESPFGSSEKPAAAAVRVDGFLPGGGSGDDDDAAADSPSTSRDWWTRSSWAFL

SEQ ID NO: 46723 - protein, 116 aa, Sorghum bicolor
  Clone ID: 7217786.pep
HEGSVSTAAREVSFSDVLGAQLVAKATGENAVRAPAEAKLKVAINGFGRIGRNFLRCWHGREDSPLDVVVVNDSGGVRNASHLLKYDSMLGTFKADVKIVDDTTISVDGKPITIVS

SEQ ID NO: 46724 - protein, 132 aa, Sorghum bicolor
  Clone ID: 14089203.pep
HEGDTFQVILLESRDRIGGRVHTDYSFGFPVDLGASWLHGVCEENPLAPIIGRLGLPLYRTSGDDSVLFDHDLESYALYDTNGRQVPQELVEKIGKVFETILEETGKLREGTNEDMSIAKAIAIVMDRNPHF

SEQ ID NO: 46725 - protein, 159 aa, Sorghum bicolor
  Clone ID: 30944269.pep
MAKSEGPAIGIDLGTTPSYVAFTDTERLIGDAAKNQVAMNPTNTVFDAKRLIGRRFSDPSVQSDMKLWPFKVIPGPGDKPMIVVNYKGEEKQFAAEEISSMVLIKMREIAEAYLGSTIKNAVVTVPAYFNDSQRQATKDAGVIAGLNVMRIINEPTAAA

SEQ ID NO: 46726 - protein, 108 aa, Sorghum bicolor
  Clone ID: 30160862.pep
MGVVYYQYKSEKEICSMPVPHAFISVSELKQLIMTSGKHGRGRTRGRATEDIVISNAHTGEEYADERASVPQNTTVLVRRISIPGQLSEKIVLSPTRKVAEECSVPCK

SEQ ID NO: 46727 - protein, 93 aa, Sorghum bicolor
  Clone ID: 7553015.pep
MSDLDVQIPTAFDPFGSKDYVHVRIQQRNGRKSLTTVQGLKKEFSYSKILKDLKKEFCCNGTVVQDPEQRKNVSNFLVQAGIVKKEHIKIHGF

SEQ ID NO: 46728 - protein, 64 aa, Sorghum bicolor
  unsure (1)..(64): unsure at all Xaa locations
  Clone ID: 6672590.pep
KKINKGSIGHAFTVXYSYLKINKIKCSFYPFVQHKISVLVELIFGHLCYHLTDVPPQPNSPSEM

SEQ ID NO: 46729 - protein, 99 aa, Sorghum bicolor
  unsure (1)..(99): unsure at all Xaa locations
  Clone ID: 7552897.pep
MGTCGWRGVQPVLVSPMFGGTTDQKVVEENLEKLKKVLEVYEARLAKHKYLAGDFLSLADLNHAXASVLNAYPHVKAWWDGLMARPSVQKVAALMKPSA

SEQ ID NO: 46730 - protein, 140 aa, Sorghum bicolor
  Clone ID: 7552535.pep
NNLLGKFELSGIPPAPRGVPQITVTFDIDANGILNVSAEVKTTGQKNKITITNDKGRLSKEEIEKKIEDAVDSAISWLDSNQLAEVDEFEDKMKELEGICNPIIAKMYQGAGAGMGDAAGMDEDAPSGGSGAGPKIEEVD

SEQ ID NO: 46731 - protein, 42 aa, Sorghum bicolor
  Clone ID: 6859186.pep
LSRLVHPTSPVMLTTIGPQRAFLFLFFFGKINFLLKKKKRPI

SEQ ID NO: 46732 - protein, 55 aa, Sorghum bicolor
  Clone ID: 7536351.pep
ISKILFTVVVFQDCFFTTPTYSTPIKILHNFRLESSSIGSSFPADLAKPVPLAVS

SEQ ID NO: 46733 - protein, 109 aa, Sorghum bicolor
  Clone ID: LIB3478-046-P1-K1-B11.pep
MVKHNNVIPNGHFKKHWQNYVKTWFNQPARKQRRRIARQKKAVKIFPRPTAGPLRPIVQCQTLKYNMKSRAGRGFTLEELKAAGIPKKLAPTIGISVDHRRKNKSLEGL

SEQ ID NO: 46734 - protein, 60 aa, Sorghum bicolor
  unsure (1)..(60): unsure at all Xaa locations
  Clone ID: LIB5051-007-A1-XP1-D4.pep
RPGLLHLCYSCASILLTLSSSMNPLCVPVERFPILGXKKKKKKKKKKKKKKEKKKKKRPL

SEQ ID NO: 46735 - protein, 87 aa, Sorghum bicolor
  unsure (1)..(87): unsure at all Xaa locations
  Clone ID: LIB3480-029-P1-K1-D7.pep
MENGGGKGDVPDDANERCPGTQSEEAXKADACAGCPNQQICATAPKGSDPDVVAIVERLATVKHKLLVLSGKGGVGKSTFSSQLSWL

SEQ ID NO: 46736 - protein, 135 aa, Sorghum bicolor
  Clone ID: 9296300.pep
SRIHQVLDCSPTAKPRLLEPVYLVEIQAPENALGGIYGVLNQKRGHVFEEMQRPGTPLYNIKAYLPVIESFGFSSQLRAATSGQAFPQCVFDHWDMMGSDPLEAGSQAAQLVLDIRKRKGLKEQMTPLSEFEDKL

SEQ ID NO: 46737 - protein, 49 aa, Sorghum bicolor
  Clone ID: LIB5052-001-A1-XP1-H4.pep
RPGCVSEYPPLGRFAVRDMRQTVAVGVIKSVEKKDPTGAKVTKAAAKKK

SEQ ID NO: 46738 - protein, 74 aa, Sorghum bicolor
  Clone ID: LIB5047-003-R1-XP1-D10.pep
RPGLDLCAWGNDAAYEVIPRRVNCWLKTISKPPHRPWAFENFWKGSSSSEKGKPYKSCLSFILFILYTVIICFN

SEQ ID NO: 46739 - protein, 111 aa, Sorghum bicolor
  Clone ID: LIB5051-011-A1-XP1-H10.pep
MAAADVEYRCFVGGLAWATNNETLEQAFANFGQVIDSKVITDRETGRSRGFGFVTFSSEQSMLDAIENMNGKELDGRNITVNQAQSRGGGGGGGGYGGGGNRGDSGGNWRN

SEQ ID NO: 46740 - protein, 80 aa, Sorghum bicolor
  unsure (1)..(80): unsure at all Xaa locations
  Clone ID: LIB3476-035-P1-K1-C7.pep
MRSSWADSVANAEESAPATAAAANGSVVTHGNSRPTRSSYVPXHXRGRPAGAGVDTQAGLVAPAQGGPLPSAAAQPSGQG

SEQ ID NO: 46741 - protein, 111 aa, Sorghum bicolor
  Clone ID: LIB3478-014-P1-K1-B11.pep
TWRRASPSTRRSPSSCSSSSSPSLAPLALSVTVVASSTRRSPASTRPSAETMATEKLGIKVERNPPESRLSELGVRQWPKWGCDKSNFPWTYSAKETCYLLQGEGEVYPEG

SEQ ID NO: 46742 - protein, 125 aa, Sorghum bicolor
  unsure (1)..(125): unsure at all Xaa locations
  Clone ID: 9302327.pep
SERTKQSLVDVFHFDIQSTGQXITLRQHPXDHRNALFXLNSRIPLVRTSSESVVRRPGKAPEGTVPGPSPGRHAAARSRRVSSSSSPPAADGFGAGTPEPNPQSQSFSRSYGSVLPTSLAYIVPL

SEQ ID NO: 46743 - protein, 155 aa, Sorghum bicolor
  Clone ID: 9848480.pep
HEAEGINRGNMSFRVSLLTFLLFAVFGGMRPNLATTDGRSATVPSAGSAIIAYWQKMLPDSTMPSAIRDLLTPNNNADANKDNPYPIPATAFYGKEANNLNPTIFYRKEINRDDNPYVPVLAFHGKEVNNLNPVNNLPLSAFCGKEVNNLPVSAF

SEQ ID NO: 46744 - protein, 103 aa, Sorghum bicolor
  Clone ID: SORBI-28MAY03-C49_78.pep
MSDGQETDKNIEIWKIKKLIKALEAARGNGTSMISLIMPPRDQISRVTKMLGDEYGTASNIKSRVNRQSVLAAITSAQQRLKLYNKVPPNGLVLYTGTIVTED

SEQ ID NO: 46745 - protein, 228 aa, Sorghum bicolor
  Clone ID: SORBI-28MAY03-C49_79.pep
MAAAAAKKGLVLLDFWVSPFGQRCRIALAEKGIPYEYSEQELLGTKSDLLLRSNPVHKKIPVLLHDGRRVCESLVVLNYLEEAFPETTPKLLPDAAYARAQARFWAAYSDKVYEVGTRLWKLKGESQAQAQARAEIVQVLRNLDGELGDKRFFAGEAFGFVDVALVPFVPWLPSYERYGEFSVQEIAPGLAAWAPRCPERDSVAKSLHPPEKVDEFINLLKKTYGIDE

SEQ ID NO: 46746 - protein, 50 aa, Sorghum bicolor
  Clone ID: SORBI-28MAY03-C49_80.pep
FGHPDLAMGFFFGATVYPHWPTPAMMYPHCYDNVGPKIFQVPLYQFFNHG

SEQ ID NO: 46747 - protein, 124 aa, Sorghum bicolor
  Clone ID: SORBI-28MAY03-C49_81.pep
MEDDYVTIPYGLLLLAGGVAGYVKRGSAASLAAGGGFGAALLLAGALSAWAFARGAGGAAAIFATVLQIVCAVLLTVVMGIRYVKTRKIMPAGIIAAISALVLIFYVYKISTGGNKVYIPVAAE

SEQ ID NO: 46748 - protein, 202 aa, Sorghum bicolor
  Clone ID: SORBI-28MAY03-C49_82.pep
RLRTACERAKRTLSSTAQTTIEIDSPPKAAAPSIAEALLLATVCMVGLPVEVRVRDGSAYAGVLHTACVDAGYGVVLKKAKKIANGKGDANLSLGSFVDTLVVHPDDLVQVIAKGLSLPLKGVCKPLDSNMVAASGSLKPQTSHANDPKMSKTGNISPLTQPENCASVGLEKNTSVKKNGQNSGCTTSLSSSTGHVRPCFCV

SEQ ID NO: 46749 - protein, 99 aa, Sorghum bicolor
  Clone ID: SORBI-28MAY03-C49_83.pep
LHTQLIENGTFSSTSLSANLYIVFSIERTRGKASEFSEHTAAPGLQQGGLIMLRTPCTRRSRGCPCRSPPEGRRCLPGLPRPLGSAYPCASAVHMEPFS

SEQ ID NO: 46750 - protein, 176 aa, Sorghum bicolor
  Clone ID: SORBI-28MAY03-C49_84.pep
MEQCRQGKSAKGNDSIAYMRFFFRDPRQDDPPDVTSSESEDEDMTDATSSDDESEGGVGLGVHSTSGDPSPRQPSSADQSASRSNSRDNPMHHSTGSAAHRAMFGGSAPRSSVSSASSPRSEARDEPIELEAVISCTSDGLVVCLRRARPMLPGTMPIAQPTQQYNGVFAAPWATQ

SEQ ID NO: 46751 - protein, 158 aa, Sorghum bicolor
  Clone ID: SORBI-28MAY03-C49_85.pep
HEDEANIETHGFDDSSTFKHPTLEPIWANAMLDRVVSMVERDKNHACIIVWSLGNESSYGPNHVSMSGWIRGRDPTRLLHYEGGGSRTSSTDIVCPMYMRVWDIVKIAKDPSETRPLILCEYSHAMGNSNGNIDAYWMAIDNTFGLQGGFIWDWVDEG

SEQ ID NO: 46752 - protein, 60 aa, Sorghum bicolor
  Clone ID: SORBI-28MAY03-C49_86.pep
PEVAALSWLENPQCVFDHWDMMGSDPLEAGSQAAQLVLDIRKRKGLKEQMTPLSEFEDKL

SEQ ID NO: 46753 - protein, 175 aa, Sorghum bicolor
  Clone ID: SORBI-28MAY03-C49_87.pep
MSGPSQCSSQPQFMTSVGRSNRSNGPGTPLIESIDVDQIVIPEKNSWKNLFSYIGPGFLVSIAYIDPGNFETDLQAGAQYKYELLWIILVASCAALIIQSLAARLGVVTGKHLAEHCRAEYPKVTNFVLWILAELAVVACDIPEVIGTAFALNMLFRIPVWCGVLITGLSTLMLL

SEQ ID NO: 46754 - protein, 131 aa, Sorghum bicolor
  Clone ID: SORBI-28MAY03-C49_88.pep
NILVARGKESKSDSRSSGERNGSSLNRENGVVGEQYKLTSGGATTPSGLIAAAVAHAFALFVAVSVGANISGGHVNPAVTFGAFVGGNITLFRGLLYWVAQLLGSTVACFLLRFSTGGLATGTFGLTGVSV

SEQ ID NO: 46755 - protein, 80 aa, Sorghum bicolor
  unsure (1)..(80): unsure at all Xaa locations
  Clone ID: SORBI-28MAY03-C49_89.pep
MAKPGILGRSSAQKSNEGMRIIFSAVVGVMLGYLFGISFPTVNITKLHFPSSIISYIEDRDSGITTXTLLNHAWTSAATH

SEQ ID NO: 46756 - protein, 141 aa, Sorghum bicolor
  unsure (1)..(141): unsure at all Xaa locations
  Clone ID: SORBI-28MAY03-C49_90.pep
CSLRGGLASPPPPVRFGSGRVRQVLRGFRFVGERXEMAASDVEYRCFVGGLAWATDDNSLHSAFSTYGEVLESKIILDRETQRSRGFGFVTFSTEEAMRSAIEGMNGKELDDHRRRPLHARDHSPTGGKKFLGYFQCCIKA

SEQ ID NO: 46757 - protein, 109 aa, Sorghum bicolor
  Clone ID: SORBI-28MAY03-C49_91.pep
MATGGGNEQAPAEAEPLELVLFQVAECYVYLIPPRMTAASYRADEWNVNKWAWEGALKVVSKGEECIIKLEDKNTGELYARAFLREGEPHPVETCIDSSRYFVLRVEEI

SEQ ID NO: 46758 - protein, 214 aa, Sorghum bicolor
  Clone ID: SORBI-28MAY03-C49_92.pep
MSSSTIRKALGAVKDQTSIGLAKVTSNIAPELDVLIVKATSHDDEPAEERHIREILHLTSGSRAHVAAAVAGCSRRLSRTRDYVVALKSLMLVHRLLVDGDPCFHRELLHATRRGTRLLNLSDFRDEAHSGSWDHSAFVRTYALYLDQRLEFFLHERKQGSNNGSSSSHNGPSPRDRDRWGSPDPYGRRSPSYSSPPGYGGYDDYRERNGGNND

SEQ ID NO: 46759 - protein, 106 aa, Sorghum bicolor
  Clone ID: SORBI-28MAY03-C49_93.pep
MTRIFVQRGTAGSSSSSGRSGSQPAQQPAAAAREEELPLQPQPQLPELLAIDDTTEHLNEGSENSSSSNKPLRTDDTISESSSSAEERAAREKPPKDDSNVINPTF

SEQ ID NO: 46760 - protein, 169 aa, Sorghum bicolor
  Clone ID: SORBI-28MAY03-C49_94.pep
MQSSSQGRPHRRRSLQSPIPRPNPPPISPRPATMARTKQTARKSTGGKAPRKQLATKAARKSAPATGGVKKPHRFRPGTVALREIRKYQKSTELLIRKLPFQRLVREIAQDFKTDLRFQSSAVAALQEAAEAYLVGLFEDTNLCAIHAKRVTIMPKDIQLARRIRGERA

SEQ ID NO: 46761 - protein, 83 aa, Sorghum bicolor
  Clone ID: SORBI-28MAY03-C49_95.pep
FFFFFGQAENGHSCILIMVKLLSPQYNDTQAYLQKKKKGKLLLLMDKAKLDVIPTSGAPHPQRTLPLLFNPTQTKQPKKKSKI

SEQ ID NO: 46762 - protein, 185 aa, Sorghum bicolor
  unsure (1)..(185): unsure at all Xaa locations
  Clone ID: SORBI-28MAY03-C49_96.pep
MGRATMRWPQPALMLLVVAARLATVAVVVVRGEPQVPCYFVFGDSLVDNGNNNDIASLARANYPPYGIDFAGGATGRFSNGLTTVDAISRLLGFDDYIPAYAGASGDQLLTGVNFASAAAGIRDETGQQLGQRISFGGQLQNYQAAVQQLVSILGDEDSAANHLSQCIFXVGMGSNDYLNNYFMP

SEQ ID NO: 46763 - protein, 243 aa, Sorghum bicolor
  Clone ID: SORBI-28MAY03-C49_97.pep
KITNRSRYEFGNHPLLFRHPQEVIPFIEIPLGVELTYVDTLSSPRVLATHMPFSLLPNSITTCGCRIVYICRGPKDAFVSRWHFENKISREYSINVEDALDMFCEGFSPYGPFWEHCLEYWRESIASPDKVLFLKYEDMTSEPVKYVKRIASFLGVPFSIKEQEDGVPEEVVRLCSFEKLSGLHANQAAGDIARHGNMVIDKSVFFRKGIVGDWVNHISEEMGRKIDSVIEEKLKGSGLCFNV

SEQ ID NO: 46764 - protein, 158 aa, Sorghum bicolor
  Clone ID: SORBI-28MAY03-C49_98.pep
MAKSEGPAIGIDLGTTYSCVGVWQHDRVEIIANDQGNRTNTVFDAKRLIGRRFSDPSVQSGMKLWPFKVIPGPGDKPMIVVNYKGEEKQFAAEEISSMVLIKMREIAEAYLGSTIKNAVVTVPAYFNDSQRQGTKDAGVIAGLNVMRIINEPTAAAIA

SEQ ID NO: 46765 - protein, 91 aa, Sorghum bicolor
  Clone ID: SORBI-28MAY03-C49_99.pep
LFTLRLLVFGLVNTLLSIYVTRVRVRVSDTIRIGYANTYFLKIKPTKMVYPSIRIRVSDEYRIRIRHPLEYPCNIAFHPWCLTLHPCFPRG

SEQ ID NO: 46766 - protein, 83 aa, Sorghum bicolor
  Clone ID: SORBI-28MAY03-C49_100.pep
NTPTHASTRPHTHTIPQNYILSEDHRLGKLLPHQLANQTRAPPWADFSFCSSAYGVLATVSSCCSPPKGRFLRVTHPFATGNT

SEQ ID NO: 46767 - protein, 101 aa, Sorghum bicolor
  unsure (1)..(101): unsure at all Xaa locations
  Clone ID: SORBI-28MAY03-C49_101.pep
MAAADVEYRCFVGGLAWATNNETLEHAFANFGQVVDSKVITDRETGRRRLXGRREGGGGYGGGGYGGGGGGYGGRREGGGGYAGGGGYGGNRGDSGGNWRN

SEQ ID NO: 46768 - protein, 127 aa, Sorghum bicolor
  Clone ID: SORBI-28MAY03-C49_102.pep
MESVVNPKAYPLADAQLTMGILDIIQQAANYKQLKKGANEATKTLNRGISEFVVMAADTEPLEILLHLPLLAEDKNVPYVFVPSKQALGRACGVTRPVIACSVTSNEGSQLKLQIQGLKDSIEKLLI

SEQ ID NO: 46769 - protein, 157 aa, Sorghum bicolor
  Clone ID: SORBI-28MAY03-C49_103.pep
TRAAQARSLSLSADLLLLPPLALRLGLFRASAAPPRRRPATEGQSQARRRRRRLPPPSLASRLAPSPASSAHRPTTLRSFLVQSTDKMVNAIKGLFISCDIPMAQFIVNLNASMPPSERFIVHMLDPTNMFVQPHVAHMIRSKIGEFRDQNSYEKPQ

SEQ ID NO: 46770 - protein, 142 aa, Sorghum bicolor
  Clone ID: SORBI-28MAY03-C49_104.pep
PAVRRRHRYARVVLAPANPKDEYQHWIKDMRWSTSIKDEEGYPAFALVNKATGEAIKHSLGQSHPVRLVPYNPDFLDESVLWTESRDVGNGFRCIRMVNNIYLNFDALHGDKWHGGVRDGTDIVLWKWCEGDNQRWKIQPYY

SEQ ID NO: 46771 - protein, 125 aa, Sorghum bicolor
  Clone ID: SORBI-28MAY03-C49_105.pep
MCRPSQTPHLTMSSARIGPARPGLRAKRRGDAPLPTHGISKITLKVVVFHLRPRGEVGLRHLLVVPKACDRSPVVGILTRHDFMPEHILGLHPVLLKSRWKRLRWQRGAVAKYLRSLIEWVANSG

SEQ ID NO: 46772 - protein, 143 aa, Sorghum bicolor
  Clone ID: SORBI-28MAY03-C49_106.pep
ARGFRKCMEPVEKCLRDAKMDKSSVHDVVLVGGSTRIPKVQQLLQDFFNGKELCKSINPDEAVAYGAAVQAAILSGEGNEKVQDLLLLDVTPLSLGLETAGGVMTVLIPRNTTIPTKKEQVFSTYSDAPSGGSGAGPKIEEVD

SEQ ID NO: 46773 - protein, 124 aa, Sorghum bicolor
  Clone ID: SORBI-28MAY03-C49_107.pep
GRVFRKTKQWKRMFTKATFVGAGFTRKPPKYERFIRPTGLRFTKAHVTHPELKCTFNLDIISVKKNPNGPMYTSLGVMTRGTIIEVNVSELGLVTPAGKVVWGKYAQVTNNPENDGCINAVLLV

SEQ ID NO: 46774 - protein, 98 aa, Sorghum bicolor
  Clone ID: SORBI-28MAY03-C49_108.pep
MAILSPLATEVFIPVAAVIGIVFAVVQWVLVSRVKLSPTAAAASGGGKNGYGDYLIEEEEGLNDHNVVVKCAEIQNAISEGEPGDFSSDLGAAAGSSA

SEQ ID NO: 46775 - protein, 108 aa, Sorghum bicolor
  Clone ID: SORBI-28MAY03-C49_109.pep
TGQQLGGRIPFAGQVQNYQTAVQTLVSILGDQDTASDHLSRCIFSIGMGSNDYLNNYFMPAFYNRDQHIFWDAFHPSEAANIIVGRRSYRAESPNDVYPMDISTLASI

SEQ ID NO: 46776 - protein, 57 aa, Sorghum bicolor
  Clone ID: SORBI-28MAY03-C49_110.pep
MFQFAKFEKSKERRLATELGYGFPIGDPWITDALSPWPFASESVLPSQCPGIHPMHD

SEQ ID NO: 46777 - protein, 107 aa, Sorghum bicolor
  unsure (1)..(107): unsure at all Xaa locations
  Clone ID: SORBI-28MAY03-C49_111.pep
MTRHLATLRESXTPAVYPRLVEFLHFDIQSTXEITLRQHPXDHRNALFXLNSRIPLVRTSSESVVRRPGKAPEGTVPGPSPGRHAAARSRRVSSSSSPPAADGFGAG

SEQ ID NO: 46778 - protein, 163 aa, Sorghum bicolor
  Clone ID: SORBI-28MAY03-C49_112.pep
RSSRVLHQGKKRALGFSSLTEPKTGGKCALNSCYSFTSFRSLAAIATALHGSSRTAPSIHRLRLGLLGSLIPFAPLAFVSQCQCRPSRVLSPLVFFPISMHFTAPPEIPSAPTVLQLGSFHRLSRVEPWDLTADLKSHLQTLYAQSFRITLASSVLPRLLAQS

SEQ ID NO: 46779 - protein, 95 aa, Sorghum bicolor
  Clone ID: SORBI-28MAY03-C49_113.pep
MSGAGEEDKKPAEAGGAHINLKDGNEVFFRIKRSTQLKKLMNAYCDRQSVDMNAIAFLFDGRRLRGEQTPDELEMEDGDEIDAMLHQTGGSVPGA

SEQ ID NO: 46780 - protein, 72 aa, Sorghum bicolor
  Clone ID: SORBI-28MAY03-C49_114.pep
QSENTKASNSWRSFCYILGITNKLWTTMEGRSPFCYAPRRLITSIQALKLQQDHKYYTLGHLIDPCCRVEFA

SEQ ID NO: 46781 - protein, 152 aa, Sorghum bicolor
  Clone ID: SORBI-28MAY03-C49_115.pep
MIRPGSKESQNYDINNQRVHPQPIDENMTQNGDSMDTMIGRIFNNISPLKSAYIQLQEAHTPYDPDKIQEADKLVIEELTRLSELKHAYREKHPKPVAASPQDSRLLSEIQEQQNLLKTYEVMVKKFQSQIQTRDTEITHLQQQIDEAKLRK

SEQ ID NO: 46782 - protein, 168 aa, Sorghum bicolor
  Clone ID: SORBI-28MAY03-C49_116.pep
MSFRVSLLTFLLFAVFGGMRPNLATTDGRSATVPSAGSAIIAYWQKMLPDSTMPSAIRDLLTPNNNADDADHHVHEHRHIDGGHDHFDSRNIGFLFLEDALTPGSKVAPYIDPASSRGAPLLPRDVADSIPMSTKSFTDILRMFSPVSRAMAESIWYSLELCEHPRPI

SEQ ID NO: 46783 - protein, 122 aa, Sorghum bicolor
  Clone ID: SORBI-28MAY03-C49_117.pep
PRTHKGCWSIKTAGRWSWKSKSAKEYEETGWYDGQIWVKTPEVLARDRLLGSFSVKPVLNRVKFTLVGLAGSLILCILLYVNTENPKEPYVNTGGRAIPGVYSDTAARSFEPDAFCGEPDLS

SEQ ID NO: 46784 - protein, 95 aa, Sorghum bicolor
  Clone ID: SORBI-28MAY03-C49_118.pep
MPISKIAVGTHHEVYHPGALKAALAEFISTLIFVFAGQGSGVAFSESSTPTLATQARSAALVWPSVVCIFHWLSTDIKRAATEHEYRVESSTVSI

SEQ ID NO: 46785 - protein, 114 aa, Sorghum bicolor
  Clone ID: SORBI-28MAY03-C49_119.pep
HEVKMMEKSLPTMTYQAWRRDTQTGPPQYQSSSIFENATPEEVRDFFGDDEFRMSNKWDDMLIYHKTLEECQTTGTMKVHWVRKFPFFCSDREYIIARRIWKLGGAYYCVTKVK

SEQ ID NO: 46786 - protein, 68 aa, Sorghum bicolor
  Clone ID: SORBI-28MAY03-C49_120.pep
RDSHCPCLLSSETTAAAAKPKKAAAGTKRKAPEKKVVAKPKKSPAAKAKAKPKTVKSPAAKKARKVAA

SEQ ID NO: 46787 - protein, 99 aa, Sorghum bicolor
  Clone ID: SORBI-28MAY03-C49_121.pep
PEEKKAKAIPATFGDVSDPLIDDLDPLEMEQREKLVRRMWDVYTRTDNHVRLPRFWQEAFEAAYEELAGDDTLATDAAISEIARMSIHRPEVEQSWNKN

SEQ ID NO: 46788 - protein, 71 aa, Sorghum bicolor
  Clone ID: SORBI-28MAY03-C49_122.pep
PRTHKGCWSIKTAGRWSWKSKSAKECVTTHLPNHHAQGHPARPPHPWRARLGGRPADRPYRSWCSRCSGSL

SEQ ID NO: 46789 - protein, 95 aa, Sorghum bicolor
  Clone ID: SORBI-28MAY03-C49_123.pep
MAVSFLANEVSDLCIGKPAVRSLPLSAAAGDLAAALRRVARSGAAACVAVTGPARAVVGRVGLADVLCFLCTDPEALARPADVFSKPGSALLPKD

SEQ ID NO: 46790 - protein, 114 aa, Sorghum bicolor
  Clone ID: SORBI-28MAY03-C49_124.pep
TGWNSSRYLGSRELRPNVTPEVVKTWSFATAPATRSKSSAHTRPAKPIRDGSWVFAPPFEIPTVSTSRSVRVFTVNLSPRVRRSVRACAEPRMTTTEMEGDLRRRYSRACRRLV

SEQ ID NO: 46791 - protein, 68 aa, Sorghum bicolor
  unsure (1)..(68): unsure at all Xaa locations
  Clone ID: SORBI-28MAY03-C49_125.pep
KGLFYQYMSGFTARWKYYFIWSISEASIIISGLGFTGWSESSPPKAKWDRAKNVDVLGVELAGSAVXI

SEQ ID NO: 46792 - protein, 124 aa, Sorghum bicolor
  Clone ID: SORBI-28MAY03-C49_126.pep
MATRIQFENNCEVGVFSKLTNAYCLVAIGGSENFYSAFEAELADAIPVVKTSIGGTRIIGRLCVGNKNGLLLPHTTTDQELQHLRNCLPDQVVVQRIDERLSALGNCIACNDHVALTHPDLDKE

SEQ ID NO: 46793 - protein, 151 aa, Sorghum bicolor
  Clone ID: SORBI-28MAY03-C49_127.pep
MGSLMAGWDSPVLADDDKKVNARRNRSLTKEEVEAFWKQRRSRRSSEEGGGELASPLSSPPATATWQESPFGSSEKPAAVVRVDGGFLPGGGSVDDDDDAAADDSPSRSRDWWTRSSWAFLNEPPQEEPSARAQQRYTPQFHVARIATGNA

SEQ ID NO: 46794 - protein, 93 aa, Sorghum bicolor
  Clone ID: SORBI-28MAY03-C49_128.pep
MGFAVRVSALLFLLVTGAVTNDQVFTTSGVTFGRSSREPRYRVEFHPVDSPFHPENGQESVPMANHEGKHYKCFLPVEETKTMKSMLPQNATN

SEQ ID NO: 46795 - protein, 189 aa, Sorghum bicolor
  Clone ID: SORBI-28MAY03-C49_129.pep
MPKNKGKGGKNRKRGKNEADDDKRELVFKEDGQEYAQVTRMLGNGRCEAICVDGTRRLCHIRGKMHKKVWIAAGDIVLVGLRDYQDDKADVILKYMNDEARLLKAYGELPETLRLHRRRMPLGVRPGDLRAAAEAALVRAEVADLRAAADDARQVPAARSRRRPLQGDALGAAPADGGRVHGARRRVRL

SEQ ID NO: 46796 - protein, 200 aa, Sorghum bicolor
  Clone ID: SORBI-28MAY03-C49_130.pep
MDLILPYKIGDLAESKSLVSGYRGAWFRCKIHNMRVKFGYLECYLEYIDYPGEKKEWVRVFRKNSARSNQNSRESTQIMIRPSFPKWYFVHEVPEQLPNSDVTAIVDETWKIGDLVDWLTEGCYWSATITKLLNEDLVEVELPAPPIGEGQCYQANCSDLRPTLEWSLAKGWTVPLSQANGKGWHAARLLQHYKSESDDE

SEQ ID NO: 46797 - protein, 161 aa, Sorghum bicolor
  Clone ID: SORBI-28MAY03-C49_131.pep
MENGGGKGDVPDDANEHVVAIVERLATVKHKLLVLSGKGGVGKSTFSAQLSFALAEMDHQVGLLDIDICGPSIPKMLGLEGQDIHQSNLGWSPVYVESNLGVMSIGFMLPNPDDAVIWRGPRKNGLIKQFLKDVDWGEIDYLVVDAPPGTSDEHISIVQYL

SEQ ID NO: 46798 - protein, 103 aa, Sorghum bicolor
  Clone ID: SORBI-28MAY03-C49_132.pep
PNIESVNGTVSQNIAGGGIVSGSGSGNDVYQNRFPQREAALNKFRLKRKDRNFGKKVRYQSRKRLAEQRPRVRGQFVRQSGQEDQAAQDLRIKWFFPSLIVTH

SEQ ID NO: 46799 - protein, 136 aa, Sorghum bicolor
  Clone ID: SORBI-28MAY03-C49_133.pep
MARTKQTARKSTGGKTPRKQLATKAARKSAPATGGVKKPHRFRPGTVALREIRKYQKSTELLIRKLPFQRLVREIAQDFKTDLRFQSSAVAALQEAAEAYLVGLFEDTNLCAIHAKRVTIMPKDIQLARRIRGERA

SEQ ID NO: 46800 - protein, 121 aa, Sorghum bicolor
  Clone ID: SORBI-28MAY03-C49_134.pep
DQRGFIVQKSRRGDSCPRTYNDPYIPTCLHHCYNHTYMHGNGPESSAQNQDLIQRELQFLVTPLLLYHPPFSRRVDRATRALAAPVTWLLASRPGTDDLPCEPVTAACSFFGSPVFGLRAS

SEQ ID NO: 46801 - protein, 194 aa, Sorghum bicolor
  Clone ID: SORBI-28MAY03-C49_135.pep
MPALAKPASRPAKTAAAPKPKPAAAKPKAAAAGASHPPYFEMIKEAISALKERTGCSSHAIGKYMEDKHGASLPVNLMKMLSIQLRGFAAKGKLVKVKASYKLSDAAKKAAPKPKAKLAAAKTAAPKPTKKDAAKPKKTAAAAKPKKAAAGTKRKAPEKKKVVAKPKKSPVAKAKAKPKTVKSPAAKKARKVAA

SEQ ID NO: 46802 - protein, 120 aa, Sorghum bicolor
  unsure (1)..(120): unsure at all Xaa locations
  Clone ID: SORBI-28MAY03-C49_136.pep
LEKKYIKVVQWSRSDRKLLFDMVNTILSQILAPCLNMQXWVNTTRNLAPLWGSEGLLEKLLKVLVQRREQLAPSDTKPEKKGFDMKWPDIADCIDRAGRDIERMIKDDLLEELVLELLFS

SEQ ID NO: 46803 - protein, 114 aa, Sorghum bicolor
  Clone ID: SORBI-28MAY03-C49_137.pep
MASTAGYLARRTAQKERVRLLYRRALKDTLNWAVHRHLFYQDASDLRDKFEANRHVDNMDVIDRLIDDAEARYRNFQHPDPYIVPWAPGGTKFTRNPPPPQGIEIIYNYGKEDQ

SEQ ID NO: 46804 - protein, 88 aa, Sorghum bicolor
  Clone ID: SORBI-28MAY03-C49_138.pep
TQLSKSKSCNYCTGTLLLKVVRAFPGSMAWVTYFSAVAPGMSLVEKQWLVHGAHTSALQRLVLGPRLEAFSLPLLTLKKQGHLVSLNL

SEQ ID NO: 46805 - protein, 167 aa, Sorghum bicolor
  Clone ID: SORBI-28MAY03-C49_139.pep
LRPPLQLQLVSCGFGRRRIDAACRIAVDWLPNSEADQVMLGEQRMILALESASSSSSAPDLSLTLSGELPSVSSRNCVIQSLQVGWAQKGGGQVVEGLVNCYSKKKKKNNKIGGGGSWTPAAKSWASEMEGADESGEVEVDTAELIGVIGRELAISCLLRLPRVYYY

SEQ ID NO: 46806 - protein, 147 aa, Sorghum bicolor
  Clone ID: SORBI-28MAY03-C49_140.pep
MTSPMVATPVQLRTTGRLTFCCSSFPSAPGTATTTRRPRRFAAARASAETMATEKLGIKVERNPPESRLSELGVRQWPKWGCDKSKFPWTYSAKETCYLLQGKVKVYPEGHGEEFVEIAAGDLVVFPKGMSCTWDVAEAVDKHYNFE

SEQ ID NO: 46807 - protein, 231 aa, Sorghum bicolor
  Clone ID: SORBI-28MAY03-C49_141.pep
HEGKTIVLGGERGTVAWVDLWRGLFLCDVLEEPPVLRDLPLPEPTRGNWSRLLQQWIPNCLRDITINRHKDTIKYIEMEIWKPRVVKTMPNSYLEWARHNNSCSQVIIPGGWKATTWTMAIPVGSFADWRPDCEELAYPTISMDDDVVYLLSRTTPRNMRKLELVVAIDLRKKIVQGVAELDVQKDFIFMPSYCTSEICRFLRKSTYLIRLVHAKKMEQVMIMVMMVMTTR

SEQ ID NO: 46808 - protein, 170 aa, Sorghum bicolor
  unsure (1)..(170): unsure at all Xaa locations
  Clone ID: SORBI-28MAY03-C49_142.pep
NRQLPANHTDELGRVDFNFTTLVSTLHLRSPGFGCRSPRTTTADLIILLLLLAVTIHQDLHRRPLRPGSRPGFCSGRRALLLIGAWRSPRWPGVGRALQRHPFSGLVDSAGELLHTPXRISTSMTTRAVWHRNPASGSSRIASSAYQKWPTWSSRFHGTAHRSSRAVLPI

SEQ ID NO: 46809 - protein, 159 aa, Sorghum bicolor
  Clone ID: SORBI-28MAY03-C49_143.pep
VGGRGGRCKTRGASLGGAAVGADLGGFMVAFAGRKYAARSVPIFVSNTSVTVSSFTLVLEFNKGRLQNLHWKKDGCGACSGKSNFVCLGKQTCAIRTQSCKTQGPVDCSIGIQLAFSGTDKHESVLNSWYEVSNLRQYSLYGLYSNLKDTLSGQFNKIF

SEQ ID NO: 46810 - protein, 142 aa, Sorghum bicolor
  Clone ID: SORBI-28MAY03-C49_144.pep
HEERTLTVLSRVRNSLCKDGVADQGSLKVMLLCGSDLLESFSTPGVWIPDQVRTICKDFGVICIRREGKDVGTMIANSDILQECRDNIISVDEIVPNQISSSRVRDCIRRCLSIKYLTSDEVIEYIREHKLFMETEGVDTTL

SEQ ID NO: 46811 - protein, 125 aa, Sorghum bicolor
  unsure (1)..(125): unsure at all Xaa locations
  Clone ID: SORBI-28MAY03-C49_145.pep
MSSPGKVLRFDIQSTGQXITLRQHPXDHRNALFXLNSRIPLVRTSSESVVRRPGKAPEGTVPGPSPGRHAXARSRRVSSSSSPPAADGFGAGTPEPNPQSQSFSRSYGSVLPTSLAYIVPLARGC

SEQ ID NO: 46812 - protein, 139 aa, Sorghum bicolor
  Clone ID: SORBI-28MAY03-C49_146.pep
MPRRSSGRSAPRPAPRAAPVRNPPQPARQAPPPAPVRDGGGSILGGIGSTIAQGMAFGTGSAMAHRAVDAVMGPRTIQHETVVSEAAAAAPAAPAMNTDACGIHSKAFQDCLNNYGSDISKCQFYLDMLNECRRGGVSA

SEQ ID NO: 46813 - protein, 197 aa, Sorghum bicolor
  Clone ID: SORBI-28MAY03-C49_147.pep
MGRAAAMAVALLAALVAAAATLPGTASASPAEGVQPLSKIAVHKATVEMQPSAYVRATPSLLGEQGEDTEWVTVKYGWTDPSDDDWIGVFSPSEFNSSATCPNPWPAEEPYLCTAPIKYQFANYSENYIFWGKGSIRLQLINQRSDFSFALFTGGLDNPKLIAVSEPIAFKNPKAPVFPRLAQGKSHDEMTVTWTSG

SEQ ID NO: 46814 - protein, 187 aa, Sorghum bicolor
  Clone ID: SORBI-28MAY03-C49_148.pep
ISKLQFYGPCPLAPALTGQIQQRAGTDRGRRSAREKGQWQSSRGRLGIRANISMLSVSNSIAAGLPSYGLYAETRFLSQSYRKFAWKSSYKYLRIRAVQGNDGRRRLVDIIRIIPELSRDYFRSRSRRALFGGISLLGGFYVAQTISLSFGALGVNDVLAAVVCVLLTEYVTKFYYSRPKVTFPIAL

SEQ ID NO: 46815 - protein, 56 aa, Sorghum bicolor
  Clone ID: SORBI-28MAY03-C49_149.pep
TPSRGKTLFLKAPSFFQKKLLVCCALSCFIGLQNVVIFDLPLAYHLYLYCPNKWYL

SEQ ID NO: 46816 - protein, 58 aa, Sorghum bicolor
  Clone ID: SORBI-28MAY03-C49_150.pep
PRTHKGCWSIKTAGRWSWKSKSAKECVTTHLPNQLAPKMDGAEARDPHPAIWANAMPR

SEQ ID NO: 46817 - protein, 208 aa, Sorghum bicolor
  Clone ID: SORBI-28MAY03-C49_151.pep
MVKHNNVIPNGHFKKHWQNYVKTWFNQPARKQRRRIARQKKAVKIFPRPTAGPLRPIVQCQTLKYNMKSRAGRGFTLEELKAAGIPKKLAPTIGISVDHRRKNKSLEGLQANVQRLKTYKAKLVIFPRRARKVKAGDSTAEELATATQVQGDYMPITRGEKRSVEVVKVTEEMKSFAAYGKLRLERMNKKHLGARQKKAAEAEKEEKK

SEQ ID NO: 46818 - protein, 186 aa, Sorghum bicolor
  Clone ID: SORBI-28MAY03-C49_152.pep
MPISRIAVGTHHEVYHPGALKAALAEFISTLIFVFAGQGSGMAFSKLTSGGATTPSGLIAAAVAHAFALFVAVSVGANISGGHVNPAVTFGAFVGGNITLFRGLLYWVAQLLGSTVACFLLRFSTHRRRPRWRHLRAALHLPNPRAAPHHRLLSRPPATPHQAWVPFRAQLADHQFSRSLDLPLAV

SEQ ID NO: 46819 - protein, 71 aa, Sorghum bicolor
  unsure (1)..(71): unsure at all Xaa locations
  Clone ID: SORBI-28MAY03-C49_153.pep
MEVRVKILFTSLCHTDVYFWEAKGQTPVFPRIFGHEAGGIIXSVGEGVTDVAPGDHVLPVFTGECKECAHC

SEQ ID NO: 46820 - protein, 156 aa, Sorghum bicolor
  Clone ID: SORBI-28MAY03-C49_154.pep
HEDVEYRCFVGGLAWATNNETLEQAFANFGQVIDSKVITDRETGRSRGFGFVTFSSEQSMLDAIENMNGKELDGRNITVNQAQSRRRATAPTRDGARQEPASLRQPRLPAAPGAGDAHLHRRHHRGHPLRGRGAGAPPSRGLPPPPPRQDLRPPHH

SEQ ID NO: 46821 - protein, 79 aa, Sorghum bicolor
  Clone ID: SORBI-28MAY03-C49_155.pep
VKDWLLIAFSWSVIRDTVTPINLFGYGIAFLGVGYYNHVKLQALKAKEAQKKAAQADEEAGSLLQERDSHGDRKTDTQA

SEQ ID NO: 46822 - protein, 164 aa, Sorghum bicolor
  unsure (1)..(164): unsure at all Xaa locations
  Clone ID: SORBI-28MAY03-C49_156.pep
MKPVNVAEHNHHHHGLHSPTPASATKISIPVSSGEAALFGKGRYKXWALAAIALLALWSMFAASVTLRLSSGELAATFGDVSDPLIDDLDPLEMEQREKLVRRMWDVYTRTDNHVRLPRFWQEAFEAAYEELAGDDTLATDAGISEIARMSIHRPEVEQSWNKN

SEQ ID NO: 46823 - protein, 110 aa, Sorghum bicolor
  Clone ID: SORBI-28MAY03-C49_157.pep
VGRHGCSGEPCHGIGSSKWAIFGKQNWRCGMNRKPGYGAKLRANLEPTKGVGRLRQQDGGHGSRNPLRSVKPGDARVCHFLNNDDVLWAPAATTLGTQQGAAEDVVVAAQ

SEQ ID NO: 46824 - protein, 260 aa, Sorghum bicolor
  Clone ID: SORBI-28MAY03-C49_158.pep
SATLGLRHGPDSYRADEWNVNKWAWEGALKVVSKGEECIIKLEDKNTGELYARAFLREGEPHPVEPVIDSSRYFVLRVEENIDGRQRHAFIGLGFRERPEAYDFQAALHDHMKYLNKKKAAEEMVQHYEKQSSVDYSLKEGETLVLQIKNKETGTKTKSAFFEQGLNKLSLNEKTNTKEVPVSLKLPPPPPSPVSPTDPGVAASPFKAEFPPQEQPAAEPISRTSALPSKGEPTPELPAAAEKSEHETVDDDFGDFQAAG

SEQ ID NO: 46825 - protein, 114 aa, Sorghum bicolor
  Clone ID: SORBI-28MAY03-C49_159.pep
VGGRGGRCKTRGASLGGAAVGADLGGSSKYSNESSYGPNHVSMSGWIRGRDPTRLLHYEGGGSRTSSTDIVCPMYMRVWDIVKIAKDPSETRPLILCEYSHAMGNSNGNIDAYW

SEQ ID NO: 46826 - protein, 146 aa, Sorghum bicolor
  Clone ID: SORBI-28MAY03-C49_160.pep
GPAVGRAPHVARCPVRPRRPLKIRRTEYRPRPVVLITASGLQGEQPLAYNCESKNCPHFRKLFPEYVEKYNQLQQLENTAAEPVPQENPAPAPSPAVQQAPVVANRAQPLAEARRDKNQKKAVPFWMVLVMFSVFGAVMALPLMQL

SEQ ID NO: 46827 - protein, 92 aa, Sorghum bicolor
  Clone ID: SORBI-28MAY03-C49_161.pep
IAVKFAELVPKIDRRFGKELEKEPKFLKNGDAGMVKMVPTKPMVVEPFFEYPPFGRFAVRDMRQTVAVGVIKSVEKKAPTGAKVTKAPPKKK

SEQ ID NO: 46828 - protein, 95 aa, Sorghum bicolor
  Clone ID: SORBI-28MAY03-C49_162.pep
NQKIFCRANNTRPTPEGIPLCGRRTAVSISLQCYLVYYMQLQGRKLKGLFTAVRSRSCCTCSRLLLQYLQFRNCMQLQRTLLNIIVERDFRVVFI

SEQ ID NO: 46829 - protein, 222 aa, Sorghum bicolor
  Clone ID: SORBI-28MAY03-C49_163.pep
MAASDVEYRCFVGGLAWATDDNSLHSAFSTYGEVLESKIILSRDHSKIAQLADKCVLASSGFQGDIKALQKALTAKELIYEHNNNKKMSCPAMAQLLSNTLYYKRFFPYYAFNVLAGLDTQGKGCVFTYDAVGSYERTGYSAQGTGSALMMPVLDNQLKSPSPLLLPARDAVTPLSESDAVDLVKDVFASATERDIYTGDRLEIVVINSSGTHRECIELRKD

SEQ ID NO: 46830 - protein, 391 aa, Sorghum bicolor
  Clone ID: SORBI-28MAY03-C49_164.pep
KKGFQFPRTNLSATATATRVSKEGLVVFLFYNHHPHKQAFPVTAGALLGAGAGFLWAAQGAVMTSYPPPNRRGTYISLFWCLFNLGGVLGGLLPFSFNYNSGDDPKNVNDSTYIAFMAFMLVGAGLTVLVLPPARIVRDDGTKATRVTFSSPATEGVEILKLFANWKMLLVLPAAWASNFFYTYQFNNVNGGLFTLRTKGLNNVFYWGAQMIGSAGIGYFLDFGFASRRKRGLVGVVAVAVLGTAIWGGGLANQLKYRTVPLLHPIDFKDGHRYAGPFLLYFSYGLLDAMFQSLIYWIIGALANDSQILSRYVGFYKGVQSAGAAVAWQVDKQHTPLISQLIVNWGLMTISYPLLVLLVFLAVKDEDYSVSSVEEDGKEKDSKLSAPTSFH

SEQ ID NO: 46831 - protein, 143 aa, Sorghum bicolor
  Clone ID: SORBI-28MAY03-C49_165.pep
MATVLSSLRAPAAFSVLRVAPAPAPPATVALPATVARGARLRAQATYTVKLVTPEGEVELKVPDDVYILDQAEEEGIELPYSCRAGSCSSCAGKVVAGTVDQSDQSFLDDDQIASGWVLTCAAYPTSDVVIATHLEDELTAGS

SEQ ID NO: 46832 - protein, 143 aa, Sorghum bicolor
  Clone ID: SORBI-28MAY03-C49_166.pep
MASSKGEGPAIGIDLGTTYSCVGVWQHDRVEIIANDQGNRTTPSYVAFTDTERLIGDAAKNQVAMNPTNTVFDAKRLIGRRFSDPSVQADMKMWPFKVVPGPADKPMIVVTYKGEEKKFSAEEISSMVLTKMKEIAEAYLSTT

SEQ ID NO: 46833 - protein, 178 aa, Sorghum bicolor
  Clone ID: SORBI-28MAY03-C49_167.pep
MRSSWADSVANAEESAPATVTATAPAANHQNSRPTLSAYVPPHLRGRSGGPLPENKAAPAAAPAPADVRPATVQPSGYAAVVGGGSRWASPAVGGSGGGGGSAIVGPRQGGGGRGGGWNSRPGWDRRDREPNPFANTEAADVDFESQENTGINFDAYEDIPVETSGHDVPPPVNTFAE

SEQ ID NO: 46834 - protein, 132 aa, Sorghum bicolor
  Clone ID: SORBI-28MAY03-C49_168.pep
LQRSSMGLLALQRLMSLQRDRQRRQRQTRTPILNGWIAASSLGKRKGSSCQKDAHGDSKVAKRMRCSIPALPEDIWRHIHSLLPLRDAARAACLSHSFLRSWRCHPNLTLNMHILGSNANVPRENSSCIIDN

SEQ ID NO: 46835 - protein, 140 aa, Sorghum bicolor
  Clone ID: SORBI-28MAY03-C49_169.pep
MPALAKPASRPAKTAAAPKPKPAAAKPKAAAAGASHPPYFEMIKEAISALKERTGSSSHAIAKYMEDKHGASLPANFKKMLSIQLRGFAAKPKKAAAGTKRKAPEKKVVAKPKKSPAAKAKAKPKTVKSPAAKKARKVAA

SEQ ID NO: 46836 - protein, 181 aa, Sorghum bicolor
  Clone ID: SORBI-28MAY03-C49_170.pep
MEGWDKGTKSTVGEIPLLSTRAGPRDGEAWRQRLKEEYRALIAYTSVNKAKDNDWFRIAAANPEGTRWEGTCWYVHNLRRYEFPLQFDIPVAYPQVAPEIELPTLDGKTHKMYRGGKICLTVHFKPLWAKNCPRFGIAHALCLGLAPWLAAEVPILVDSGMVKHKDDEAAPSEASASAPPS

SEQ ID NO: 46837 - protein, 268 aa, Sorghum bicolor
  Clone ID: SORBI-28MAY03-C49_171.pep
MHPLELFLVVLVTTGAASAVYSHPAAAGTPAARFWEEALPGTPMPEAIADLIQQGIDHSPLVEHFTSSGHTPVMNINYGYGAYAGSSLMNAAVPPGSFFLQSQLRVGTAMTVSSESAATVPPILPRDVAQKVPFSNLADVLAAFHISPSSAEATTVSDTLSLCGAPPSLAGEQKACTTSLEDTVESATHMLVVGSSVRHGVVYLWAASSAAAVPPAAHHHQQQYVVQAVTSLDGDRHVGCHAMPFPYAVYYCHMTGRASKEYAVLLRG

SEQ ID NO: 46838 - protein, 195 aa, Sorghum bicolor
  Clone ID: SORBI-28MAY03-C49_172.pep
MALSAPIRISLIVSFFGILSFILGVIAENKKPASGTPIPGKDVVICKFPSDPTLAMGSLSIVALVVAAIVGHVAIFFPYSDKSVPRGALFQSTSLTVFFVVAELVSALAFAMLLWATITEGLHRSKNIHHDMNYQCPTAKTGLFGGAAFLALDAALFWLVCQMLALNARADYLDEDDNKGEYGQVYADEVDGSKV

SEQ ID NO: 46839 - protein, 222 aa, Sorghum bicolor
  Clone ID: SORBI-28MAY03-C49_173.pep
ARGFVFAGQGSGMAFSKLTSGGATTPSGLIAAAVAHAFALFVAVSVGANISGGHVNPAVTFGAFVGGNITLFRGLLYWVAQLLGSTVACFLLRFSTGGLATGTFGLTGVSVWEAVVMEIVMTFGLVYTVYATAVDPKKGSLGTIAPIAIGFIVGALKAALAEFISTLIFVFAGQGSGMAVSWEWGYQWVYWVGPLIGGGLAGVIYELLFISQTHEQLPTTDY

SEQ ID NO: 46840 - protein, 156 aa, Sorghum bicolor
  Clone ID: SORBI-28MAY03-C49_174.pep
AKPASVVSPACRRVLSLSPSPLSATAGAGWTTTSAAAALRQVPRTSPVSSPATSTTRHYLPRTAGSLSAGPTLISLAAPLRLGPSAQIFCSFPHSRSGSVPRIGSSARRRLPPRRRPATEGQSQARRRRRRLPPPSLASRLAPSPASSAHRPTTLR

SEQ ID NO: 46841 - protein, 153 aa, Sorghum bicolor
  Clone ID: SORBI-28MAY03-C49_175.pep
MSQLGTCSLPGAATYGTSIRRFGGSKFQQPKANHISFGQKVSAKATLRIMRCNATQTQTQSVQKKSSSATLQRDKKGKVQGPKLDDGSGGFPPFRFGKGGGGGGGGVGGSNYFGGFLLFSCVLLLDYLKEFEKYLLAQRHRAGDDGGNGLLQA

SEQ ID NO: 46842 - protein, 98 aa, Sorghum bicolor
  Clone ID: SORBI-28MAY03-C49_176.pep
ISGGEETYKDSPSNGERTGTSPVRLVPYNPEYVDESVLWTESRDVGHGFRCVRMVNNIYLNFDAFHGDKDHGGVHDGTTVVLWEWAKGDNQRWKILPW

SEQ ID NO: 46843 - protein, 210 aa, Sorghum bicolor
  Clone ID: SORBI-28MAY03-C49_177.pep
MKITALLVLKPSTSGAGSSSSGGESGPEAVVLANATDVSHFGYFQRSAAREFIVFVARTVAQRTQPGQRQSVQHEEYKVHSHNRNGLCAVAFMDDHYPVRSAFSLLNKVLDEYQKAFGDSWKSATADGTQEWAFLTDALTKFQDPAEADKLMKIQRDLDETKIILHKTIESVLARGERLDSLVEKSSDLSAASQMFYKQAKKTNSCCTIL

SEQ ID NO: 46844 - protein, 215 aa, Sorghum bicolor
  Clone ID: SORBI-28MAY03-C49_178.pep
MARTKQTARKSTGGKAPRKQLATKAARKSAPATGGVKKPHRFRPGTVALREIRKYQKSTELLIRKLPFQRLVREIAQDFKTDLRFQSSAVAALQEAAEAGSVALGEGEQAGEVSVALAYDGAGFDAAVYMSALRARRFGRWMLWTPRIGSTQDLIARNFAKLPVRVVCVADVQFKGRGRSKNVWESAPGCLMFSFTSQMQDARKLPLMQKLFVLP

SEQ ID NO: 46845 - protein, 50 aa, Sorghum bicolor
  Clone ID: SORBI-28MAY03-C49_179.pep
VVCKGFSPPVASLDSDLEAFSHNPAHGSFAPLAFQPSAMTNCVNQRFLSY

SEQ ID NO: 46846 - protein, 142 aa, Sorghum bicolor
  Clone ID: SORBI-28MAY03-C49_180.pep
LVPSEVSLRIAGAHNYKGTTMMLNDRIQSLRGLQSSLRKAEEYLLSVPQDTPYSEFNHRFQELGLEKGWGDTAKRVLDTLHLLLDLLEAPDPANLEKFLGTIPMMFNVVILSPHGYFGSFLRVFGQRWLVPIIGISCDFCFK

SEQ ID NO: 46847 - protein, 92 aa, Sorghum bicolor
  Clone ID: SORBI-28MAY03-C49_181.pep
IAVKFAELVPKIDRRSGKELEKEPKFLKTGDAGMVKMVPTKPMVVEPFSEYPPLGRFAVRDMRQTVAVGVIKSVEKKAPTGPKVTKAPPKKE

SEQ ID NO: 46848 - protein, 61 aa, Sorghum bicolor
  Clone ID: SORBI-28MAY03-C49_182.pep
DELNEEIADRVNKMLAVLDTNILWVNPDCGLKTRKYAEVKPALTNMVSAAKLIRTQLASAK

SEQ ID NO: 46849 - protein, 142 aa, Sorghum bicolor
  Clone ID: SORBI-28MAY03-C49_183.pep
MPKNKGKGGKNRKRGKNEADDEKRELVFKEDGQEYAQVTRMLGNGRCEALCIDGTKRLCHIRGKMHKKVWIAAGDIVLVGLRDYQDDKADVILKYMNDEARLLKAYGEIPDNVRLNEGVVDEEDAGAQDDYIQFEDEDIDKI

SEQ ID NO: 46850 - protein, 160 aa, Sorghum bicolor
  Clone ID: SORBI-28MAY03-C49_184.pep
SNHLVAGSLRSFPQAETEGKTVEAKKPIVVKYGLNHVTYLIEQNKAQLVVIAHDVDPIELVVWLPALCRKMEVPYCIVKGKARLGSIVHKKTASVLCLTTVKNEDKLEFSKILEAIKANFNDKFDEVRKKWGGGIMGSKSQAKTKAREKLIAKEAAQRMT

SEQ ID NO: 46851 - protein, 256 aa, Sorghum bicolor
  Clone ID: SORBI-28MAY03-C49_185.pep
DSFNSSIYDLILRLKGLPHLDGHAEPYMRQLTVGDVVAGPLRSFGGVEKVGSVVHTLRTTGHHAFPVVDEPPFSPGPPVLYGLVLRAHLLVLLKKREFLAAPERCRKEYVAGRFQAEDFDKRGSGKQDAIADVVLSPEEMEMYVDLHPFTNTSPYTVVETMSLAKALVLFREVGLRHLLVVPKACDRSPVVGILTRHDFMPEHILGLHPVLLKSRWKRLRWQRGAVAKYLRSLIEWVANSRMNEADTLLAGCCWLV

SEQ ID NO: 46852 - protein, 79 aa, Sorghum bicolor
  Clone ID: SORBI-28MAY03-C49_186.pep
FFFFFFSTTTGVIRKGFRLFSRLLQIDSNAICFGPYPDLLLQLPLHVEHMDASKRPPKHGRNIGTVRAFTPGTPLTIYL

SEQ ID NO: 46853 - protein, 300 aa, Sorghum bicolor
  unsure (1)..(300): unsure at all Xaa locations
  Clone ID: SORBI-28MAY03-C49_187.pep
MFGHHHHHGHGGHGQAPPPPPPHEQTLYKIFCRADEAYCLTVRNDTVVLASTNPRDESQHWYKDMRHSTKVKDAEGQPAFALVNRATGLAIKHSLGQSHPVKLVPYIPDYLDESVLWTESHDVGKGFRCIRMVNNIHLNFDAFHGDKDHGGVHDGTTVVXLWEWAKGPNQSWKLLPWGDEAYNAPRAPPGGPYPPPAAQPEPAYGGYRPPPGGPAAGGYAPPPPGPYPPPAPQQEPGYGGYRPQPPVHEPGYSGYPPAPGNPAPGYGPPAGYGYGNLPRVLASEPTVRVFCKAGDGYSLT

SEQ ID NO: 46854 - protein, 136 aa, Sorghum bicolor; identical to SEQ ID NO: 46719
  Clone ID: SORBI-28MAY03-C49_188.pep

SEQ ID NO: 46855 - protein, 126 aa, Sorghum bicolor
  unsure (1)..(126): unsure at all Xaa locations
  Clone ID: SORBI-28MAY03-C49_189.pep
SPVMDYLKSCWGPASPAGRPRRGSDATGRQDGLLWYKDGGQVVDGEFSMAVVQANNLLEDHSQVESGPLSTSEPGLQGTFVGVYDGHGGPERAXYINDHLFXHLRRFASEHRGMSADVIPKAFRAT

SEQ ID NO: 46856 - protein, 63 aa, Sorghum bicolor
  Clone ID: SORBI-28MAY03-C49_190.pep
MAAADVEYRCFVGGLAWATNNETLEHAFANFGGYGGRREGGGGYGGGGGYGGNRGDSGGNWRN

SEQ ID NO: 46857 - protein, 115 aa, Sorghum bicolor
  unsure (1)..(115): unsure at all Xaa locations
  Clone ID: SORBI-28MAY03-C49_191.pep
ALGFDGGLEKPPTDALRPIIPDNACILCLTAAAGTELADAYSSDTVIVSSPRKEVDDPXAFHLHAALLRQAFAHCGKFPTAASRRSLGRVSVPVWLIILSDQLLIIALVSYCLTK

SEQ ID NO: 46858 - protein, 125 aa, Sorghum bicolor
  Clone ID: SORBI-28MAY03-C49_192.pep
RRRQPPRPGSGNLNPIPFRATREIALSAGVTPSLRIGLPMCKCRSHGTFLLFGLQSSHLNICYYHQDLHRRPLRPGSRPGFCSGRRALLLIGAWRSPRWPGVGRALQRHPFSGLVDSAGELLHTP

SEQ ID NO: 46859 - protein, 219 aa, Sorghum bicolor
  Clone ID: SORBI-28MAY03-C49_193.pep
NGALLVGHFWQAICTRYGLSVGAKAAPVVRVLLILFFPVAYPISKLLDSLLGKGHFALMRRAELKTLVDMHGNEAGKGGELTHDETTIITGALELTQKIAKDAMTPISETFSLDINAKLDLHTMGMIMTRGHSRVPIYSGIPSNIIGLILVKNLITCRAEDEVPIRNVTIRKIPRVADDLPLYDILNEFQKGHSHMAVVVKRTKESASTEQKSTTADYK

SEQ ID NO: 46860 - protein, 265 aa, Sorghum bicolor
  Clone ID: SORBI-28MAY03-C49_194.pep
MSPASLAARLLRRAATTSSSPLSALARRGIRSSAPVPLPRRLPAATSSSAGTTARRFLASQSPASSSSSKSSADENLRRVIESEIECVVQSEESTADKHIDLPDDFPFEIIDNPGDQTITLQREIAGETIKAAIYTNFDTEEDLDDEDDKSDKDEESFKPAIQMVITIQKPEGPILEFDCNFNDDELAIENMRVVNRDNPDAENVYEGPRFPVLDESLQKALHRYLEVRGFKHSLHDWLYEYMMRKDEKEYVVWLKNMKEFIGAN

SEQ ID NO: 46861 - protein, 324 aa, Sorghum bicolor
  Clone ID: SORBI-28MAY03-C49_195.pep
YWNPPVTYLRPQIRLLLLPCLPPPLPDLPPTPESRSTASPPPHRSRAARGSAGQRPAMGKEGASAGGGGGDGGMSESVIRKVLISYMYVAVWIFLSFSVIVYNKYILDPKMYNWPFPISLTMVHMAFCSSLAVALVRVLRVVDLPSSPAMTSQLYVSSVVPIGALYSLSLWFSNSAYIYLSVSFIQMLKALMPVAVYSIGVLFKKETFKSSAMLNMLSISFGVAIAAYGEARFDARGVALQLAAVAFEATRLVLIQILLTSKGISLNPITSLYYVAPCCLAFLVVPWVFVELPKLREVGSFQPDLFVFGTNSLCAFALNLAVFL

SEQ ID NO: 46862 - protein, 206 aa, Sorghum bicolor
  Clone ID: SORBI-28MAY03-C49_196.pep
SARPTPGHLGERHAPTLHGDVKPDNILLGDGWVAKVSDFGCSTINDNVQVVPKGTLAYLDPEFLQDRQITEKTDVYSFGIVLIELLTGKNPLAEEWKKLTVMFQNSMRNGTLGDLLDADIVEEWSMGLIYEVAKLVSRCIAAPGKTRPDMRQVAKELRGFSDEMPESSEARVALGFEDRSRYSYTATEGETTGFSNLSALSTELAR

SEQ ID NO: 46863 - protein, 107 aa, Sorghum bicolor
  unsure (1)..(107): unsure at all Xaa locations
  Clone ID: SORBI-28MAY03-C49_197.pep
MGKEKTHINIVVIGHVDSGKSTTTGHLIYKLGGIDKRVIERFEKEAAEMNKRSFKYAWVLDKLKAERERGITIDIALXKFETTKYYCTVIDAPGHRDFIKNMITGTS

SEQ ID NO: 46864 - protein, 266 aa, Sorghum bicolor
  Clone ID: SORBI-28MAY03-C49_198.pep
MLRSRNKKKSEPDRPTTQPSPREGGAAWAVGAAAGLAPASHGGIGIGMAGRMVRSCVQTALKAANSVVGLAGMAVILYALWMLRAWYREVADHHLHQRLPVPWFIYAFLGLGIFLCLLTCSGHIAAETANGHCLSCYMIIVFVLIILEGTITMDVCLNSNWEEDFPPDPSGKFEDFKDFVKSNFEICEWVGLSVVAAQVLSIILGMVLRTLGPERETDYDSDDDTIVPARLPLLRNQAQHGLDYAEPNTSRRSDSWKLRILDKVNN

SEQ ID NO: 46865 - protein, 376 aa, Sorghum bicolor
  Clone ID: SORBI-28MAY03-C49_199.pep
TRRRWGYGVCAVGILCGLAVFLLGTRRYRFKKLVGSPLTQVAAVTAAAWTKRRLPLPSDPDLLYDVDAALAAGADVKGKEKLPHSKECRFLDHAAIIDGTGGDSAASKWALCTRTDVEEVKQVVRMLPIWATTIMFWTIHAQMTTFSVAQAEVMDRAIGGSSGFHIPAGSLTVFLIGSILLTVPVYDRLVAPLARRVTGNPHGLTPLQRVFVGLFLSVAGMAVAALVERHRQTAASAEHGVTLSVFLLMPQFVLVGAGEAFTYMGQLAFFLRECPKGMKTMSTGLFLSTCALGFFFSTLLVTIVHKVTGRHGGRGGWLADNLDDGRLDYFYWLLAVISAINLVIFTFAARGYVYKEKRLADAGIELADEESIAVGH

SEQ ID NO: 46866 - protein, 251 aa, Sorghum bicolor
  Clone ID: SORBI-28MAY03-C49_200.pep
IAGKLLASPIGAAPARRSVLSRRPGRQLRAAVALPKTKDWREDGIVSPVKNQGHCGSCWTFSTTGALEAAYTQATGKPISLSEQQLVDCGKPFNNFGCNGGLPSQAFEYIKYNGGLDTEESYPYKGVNGICDFKAENVGVKVLDSVNITLGAEDELKDAVALVRPVSVAFQVVNGFRQYKSGVYTSDSCGNTPMDVNHAVLAVGYGVENGVPYWLIKNSWGADWGDKGYFKMEMGKNMCGVATCASYPIVA

SEQ ID NO: 46867 - protein, 255 aa, Sorghum bicolor
  Clone ID: SORBI-28MAY03-C49_201.pep
MAAPLHARLLPLPLPPNPSPGLPPSGARRVLRHPRRCLATPPSRNGSSSSPETEWCPVPPEQRPVNEYEALAASLPFSWAEGDLRVYCSRLALTGAAVALFVGLPVAAFGGRGGAGGDALHLALGATGSGILAVTLAVVRMYLGWAYVGNRLLSATVEYEETGWYDGQIWVKTPEVLARDRLLGSFSVKPVLNRVKFTLVGLAGSLILCILLYVNTENPKEPYVNTGGRAIPGVYSDTAARSFEPDAFCGEPDLS

SEQ ID NO: 46868 - protein, 86 aa, Sorghum bicolor
  Clone ID: SORBI-28MAY03-C49_202.pep
MPISRIAVGTHHEVYHPGALKAALAEFISTLIFVFAGQGSGMAFSWEWGYQWVYWVGPLIGGGLAGVIYELLFISQTHEQLPTTDY

SEQ ID NO: 46869 - protein, 155 aa, Sorghum bicolor
  Clone ID: SORBI-28MAY03-C49_203.pep
PNLREALWPSREEARTQILSIWDQADIVKVSEVELEFLTGIDSVEDDVVMKLWRPTMKLLLVTLGDQGCKYYARDFHGAVPSFKVQQVDTTGAGDAFVGALLQRIVKDPSSLQDEKKLVESIKFANACGAITTTKKGAIPSLPTEAEVLQLIEKA

SEQ ID NO: 46870 - protein, 224 aa, Sorghum bicolor
  Clone ID: SORBI-28MAY03-C49_204.pep
MAASSAFLPELGTQVVVPVAAVVGIAFAVLQWVLVSKVKLTPEPPRRGDGSAGKSGGAGASEFLIEEEEGLNEHNVVVKCAEIQNAISEGATSFLFTEYKYVGLFMGIFAVLIFLFLGSVESFSTKSQPCHYSKGKTCKPALANAIFSTIAFVLGAVTSLVSGFLGMKIATYANARTTLEARKGVGKAFITAFRSGAVMGFLLAASALFVLYIAINLFGIYYGD

SEQ ID NO: 46871 - protein, 111 aa, Sorghum bicolor
  Clone ID: SORBI-28MAY03-C49_205.pep
VRAAELLQEIHEHMAILSEDPKIKIPESFDKAFQYAKDGNHFTTASSVKQALEPLKKCGVSDGEICMIANVGPETVEEVYALVPSLKANRSATEGSVTEVLAVLANIKAAK

SEQ ID NO: 46872 - protein, 142 aa, Sorghum bicolor
  Clone ID: SORBI-28MAY03-C49_206.pep
LWLRRWRRRLRRWPWRLRRWRWRLWRWRRRLRWWQPRRRWLRQLRWELEELSGGARAAKLSCSLLLPCCVVTLVHRVYLSSCCSSSSCPCVCCCCPSVFLIASCVSAVFVLVLSPVHQSSMNWAPGIDGCCVKYQSINKRKK

SEQ ID NO: 46873 - protein, 141 aa, Sorghum bicolor
  unsure (1)..(141): unsure at all Xaa locations
  Clone ID: SORBI-28MAY03-C49_207.pep
MAAVAPPPVPAPAAPAPAAAAAPAPAPATVPVADLCXLCKETTDLLQKLSLDPQPKAADATEPTAAAKKQGAVTSQPLSVAIPPERSITPVLQDFMDPNLFYLPAYYYGGYDSSMSEWDDYPRYLNSDGVEIAPAVYGDIY

SEQ ID NO: 46874 - protein, 171 aa, Sorghum bicolor
  unsure (1)..(171): unsure at all Xaa locations
  Clone ID: SORBI-28MAY03-C49_208.pep
MAIRITVSYSGYVAQNLAASLGHRFSSASASASGSRLLHDGAWRPFCIFTSTRQPEQHRNSGSGSDRHDGGDHNHPKPQAIAAGAHSLLLTRACLSSKSPPPSLAVGLLSVLAQRTGPTPGATGSAASLAGSSPISXRFHPTSFLPFLQTAKWLPCSDLATSSSSGPLPLP

SEQ ID NO: 46875 - protein, 122 aa, Sorghum bicolor
  Clone ID: SORBI-28MAY03-C49_209.pep
MDILYQCKEVLKIQKFRRMVSYAGFYCFTALITYAYTSNTTRAGISRADQYYASYPAGTELLTDTAKLYKAALGNCFEIDEWGPIEFSIMAKHFDRQGKPPYAYHAQYLAHLLSHGQLDGSG

SEQ ID NO: 46876 - protein, 132 aa, Sorghum bicolor
  Clone ID: SORBI-28MAY03-C49_210.pep
WLIPIGLIHLTYAGLHSSISYISMSLSDTGSIRLHLWLHAPSRTRFKLSETARTTIALGSLAPSIGATSRFPGTSVDHDNDNLMNARMISCQARTNAVNTATLLFLVLLQSKGTSRYKCLDAQFSLLFGLNH

SEQ ID NO: 46877 - protein, 257 aa, Sorghum bicolor
  Clone ID: SORBI-28MAY03-C49_211.pep
MARVLATVLVLAGAALLAAAGGASAKQGVWSIITRPMFQSMLSHRGDSGCQGAFYTYDAFIEAASKFPGFGTTGDDQTRRRELAAFFGQTSHETTGGWPTAPGGQFAWGYCRVKEQNPTDPPYYGRGPIQLTHEYNYRQAGQALNLNLVGNPDLVSSDPVVAFKTAIWFWMTPQSPKPSCHAVMTGSWTPSADDRAAGRLPGYGVTTNIINGGMECGKGQSTDAAKDRVGYYKRYSDMLRVRYGDNIACKDQKPYGG

SEQ ID NO: 46878 - protein, 238 aa, Sorghum bicolor
  Clone ID: SORBI-28MAY03-C49_212.pep
ARGWSRLLQQWIPNCLRDITINRHKDTIKYIEMEIWKPRVVKTMPNSYLEWARHNNSCSQVIIPGGWKATTWTMAIPVGSFADWRPDCEVEVKDVTVDASDPHHSDLLSKLTSSNTLQELAYPTISMDDDVVYLLSRTTPRNMRKLELVVAIDLRKKIVQGVAELDVQKDFIFMPSYCTSEICRFLRKSTCAKEELKQTENKAIKATEKEEGEPTEMHVKGPSSRKKYVKRPVNLFDA

SEQ ID NO: 46879 - protein, 68 aa, Sorghum bicolor
  Clone ID: SORBI-28MAY03-C49_213.pep
LPVPGSPVAGFPGTTRILRMGFQLSTFCFGILRRVALWRAQYDESCKLCSGGSYCLSLSSMVEPVGEA

SEQ ID NO: 46880 - protein, 140 aa, Sorghum bicolor
  Clone ID: SORBI-28MAY03-C49_214.pep
MAAAVARSGFRRMFSVSAFAPPKAPAPRPQADPSPNLFVSGLSKRTTTEGLRDAFAKFGEVVHARVVTDRVSGFSKGFGFVRYATTEEATKGIEGMDGKFLDGWVIFAEYARPRAPPEQAEMNSPPQQSWGASPGSWGSQ

SEQ ID NO: 46881 - protein, 245 aa, Sorghum bicolor
  Clone ID: SORBI-28MAY03-C49_215.pep
MATRIQFENNCEVGVFSKLTNAYCLVAIGGSENFYSAFEAELADAIPVVKTSIGGTRIIGRLCVGNKNGLLLPHTTTDQELQHLRNCLPDQVVVQRIDERLSALGNCIACNDHVALTHPDLDKETEEFIADVLGVEVFRQTIAGNILVGSYCAFSNRGGLVHPHTSVEDLDELSTLLQVPLVAGTVNRGSEVIAAGMTVNDWTAFCGSDTTATELSVIESVFKLREGQPTAIVEDMRKSLIDSYV

SEQ ID NO: 46882 - protein, 172 aa, Sorghum bicolor
  Clone ID: SORBI-28MAY03-C49_216.pep
VTVPLLYGSSLAEPKSIPSKSMYPTFDIGDRILAEKVSYIFRDPEISDIVIFRAPPGLQAYGYSSGDVFIKRVVAKGGDYVEVHDGKLFVNGVVQDEDYVLEPHNYELEPVLVPEGFVFVLGDNRNNSFDSHNWGPLPVRNIVGRSILRYWPPSKISDTIYDPDATRFAVPS

SEQ ID NO: 46883 - protein, 170 aa, Sorghum bicolor
  Clone ID: SORBI-28MAY03-C49_217.pep
MAAADVEYRCFVGGLAWATNNETLEQAFANFGQVIDSKVITDRETGRSRGFGFVTFSSEQSMLDAIENMNGKELDGRNITVNQAQSRGGGGGGGGYGGGGGGYGGRREGGGYGGGGGGYGGRREGGGGYGGGGYGGGGGGYGGRREGGGGYGGGGGYGGNRGDSGGNWRN

SEQ ID NO: 46884 - protein, 239 aa, Sorghum bicolor
  Clone ID: SORBI-28MAY03-C49_218.pep
MAEKGCLKRLQKEYHALCKEPPPQIVARPLPNDILEWHYVLEGSKGTPFEGGYYYGKLKFPPDYPFKPPSISMTTPSGRFAPHKRICLSMSDFHPESWNPMWSVASILTGLLSFMMDDALTTGSIKTSDAEKRRLAKASFAYNCESKNCPHFRKLFPEYVEKYNQLQQLENTAAEPVPQENPAPAPSPAVQQAPVVANRAQPLAEARRDKNQKKAVPFWMVLVMFSVFGAVMALPLMQL

SEQ ID NO: 46885 - protein, 158 aa, Sorghum bicolor
  Clone ID: SORBI-28MAY03-C49_219.pep
MPLPLPPFGWISPLQSLPPPVRRRRSEPNDLGRAHHRVLPGDGVPAGALVVVAAAVPVRVPVRAAKADKPGSGSGGGAVKTPSDFLKSIRGRPVVVKLNSGVDYRGILACLDGYMNIAMEQTEEYVNGQLKNKYGDAFIRGNNVLYISTSKRTLTDGA

SEQ ID NO: 46886 - protein, 189 aa, Sorghum bicolor
  Clone ID: SORBI-28MAY03-C49_220.pep
MAPMKLYGATVSWNVTRCVVALEEAGAEYQIVPIDFATAEHKSPEHLARNPFGQVPAFQDGDLHLWESRAICKYVARKNKAAELLREGNLQESAMVDVWLEVESNQYTAALNPILYECLVSPMFGGTTDQKVVEENLEKLKKVLEVYEARLATPHASVLNAYPHVKAWWDGLMARPSVQKVAALMKPSA

SEQ ID NO: 46887 - protein, 55 aa, Sorghum bicolor
  Clone ID: SORBI-28MAY03-C49_221.pep
FCAAEDAVATSPKFVFHCFEGVNMENAPPVKDRKMANFFCWEEVDAMEKDGVLDE

SEQ ID NO: 46888 - protein, 135 aa, Sorghum bicolor
  Clone ID: SORBI-28MAY03-C49_222.pep
NPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFTEINKAFDLMAKGEGIRCIIRMEN

SEQ ID NO: 46889 - protein, 127 aa, Sorghum bicolor; identical to SEQ ID NO: 46768
  Clone ID: SORBI-28MAY03-C49_223.pep

SEQ ID NO: 46890 - protein, 380 aa, Sorghum bicolor
  Clone ID: SORBI-28MAY03-C49_224.pep
MSWFGHHHHNQPAPPASGPNQVFKIFCRANENYCLAVRDGAVVLAPTNPKDEHQHWYKDMRFSTRVKDGEGMPAFALVNKATGLAIKHSLGQSHPVKLAPFNPDQEDASVLWTESKDVGKGFRCIRMVNNTRLNFDAFHGDKDHGGVHDGTGVVLWEWCKGENQSWKILPWGPEANAAAGANGGVHTVRVFCKAGGEDYCLTVRNGTACLAPTNPRDEYQHWIKDMRHSTRVRDEEGYPAFALVNKVTGEALKHSTGQGHPVKLVPYNPEYQDESVLWTESRDVGNGFRCVRMVNNIYLNFDAFHGDKAHGGVHDGTEIVLWKWCEGDNQPAPPASGPNQVFKIFCRANENYCLAVRDGAVVLAPTNPKDEHQHWYKDVR

SEQ ID NO: 46891 - protein, 231 aa, Sorghum bicolor
  unsure (1)..(231): unsure at all Xaa locations
  Clone ID: SORBI-28MAY03-C49_225.pep
MIRPGSKESQNYDINNQRVHPQPIDENMNQNGDSMDTMIGRIFNNISSLKSAYIQLQEAHTPYDPDKIQDADKLVIEELTRLSELKHAYREKHPKPVAASPQDSRLLSEIQEQQNLLKTYEVMVKKFQSQIQTRDTEITHLQQQIDEAKLRKSKLEKKLKQRGLLNKGSEGSDQEENYLFIGLTPKLVTSGGDYPFQVIHDFSKALINMXKAAGWDLDGAANAIEPGEFTQ

SEQ ID NO: 46892 - protein, 201 aa, Sorghum bicolor
  Clone ID: SORBI-28MAY03-C49_226.pep
MEVVVATAAAAPIAASLLEGPVLVWAGRLCLYYALLHVGLAGSPRNPFLSHEIGGEDGAGDSDLGFSKWAEKLRGGASGDKDAQDNRKLTSKWKPTTKGTLKRTYRVRSTDEGRRILKEIASVLSQDDHFVDASSHKGCQIRRESAHGESVCCYNVRALFDELPTPHLLLEITPFPAGQLTDNDYRKAERLEMVLRLSASI

SEQ ID NO: 46893 - protein, 312 aa, Sorghum bicolor
  unsure (1)..(312): unsure at all Xaa locations
  Clone ID: SORBI-28MAY03-C49_227.pep
MLIPKEELLPEPAPGVNPLDMPLMMQVTEFTCGGFVVGLISVHTIADGLGAGQFINAVADYARGGATAGAVTRPRITPIWARDVIPDPPXMPAPPPRLDLLDLVYFTTDLSPDHIAKVKSSYLESTGQRCSAFDVCVARTWQARVRALRLPDAAAPVHVCFFANTRHLLPATAAPASGFYGNCFYTVKATRPCGEVAAADVVDVVRAIRDAKARLAADFARWAAGGFDRDPYELTFTYDSLFVSDWTRLGFLEADYGWGTPTHVVPFSYHPFMAVAVIGAPPAPKPGARIMTMCVQEQHLPEFQEQMNQPCS

SEQ ID NO: 46894 - protein, 151 aa, Sorghum bicolor
  Clone ID: SORBI-28MAY03-C49_228.pep
MAAVAPPPVPAPAAPAPAAAAAPAPAPATVPVADQTTDLLQKLSLDPQPKAADATEPTAAAKKQGAVTSQPLSVAIPPERSITPVLQDFMDPNLFYLPAYYYGGYDSSMSEWDDYPRYLNSDGVEIAPAVYGDIYGYGYAPYGAYSPATSP

SEQ ID NO: 46895 - protein, 215 aa, Sorghum bicolor
  Clone ID: SORBI-28MAY03-C49_229.pep
MVLYFKARPDAGDYTIYMGADKNENEELIKYGLPEDVWFHVDKVSSAHVYLRLKKGETIDTISEGLLEDCAQLVKAHSIQGNKMNNVEVIYTPWSNLKKSPSMDVGQVGFHNPRMVHVLTVEKRVNEIINRLNKTRVERRADLKAEKEASNAAEKAERKMQLKEKKRKEEIERLEKEKWAEIRSYKGLMVAEKMTSNRQIASAGKSMQEMEDEFV

SEQ ID NO: 46896 - protein, 212 aa, Sorghum bicolor
  Clone ID: SORBI-28MAY03-C49_230.pep
MDRVPNGRPKVSNRPVVVLSDSDSDSEGFVEALTPVHSKSNGKASSASLKTGGKASAFSKGEASNGKAYSSGKGGKGSSSHAVPTKSDAELKLELDIPPNSRILMNCEAAELLQEIHEHMAILSEDPKIKIPESFDKAFQYAKDGNHFTTASSVKQALEPLKKCGICMIANVGPETVEEVYALVPSLKANRSATEGSVTEVLAVLANIKAAK

SEQ ID NO: 46897 - protein, 68 aa, Sorghum bicolor
  unsure (1)..(68): unsure at all Xaa locations
  Clone ID: SORBI-28MAY03-C49_231.pep
GKTNLSHDGLNPAHVPYWRGNNPNLAEFCFXSVGRADIEKSKSDVALNAWPPQASYPYGNYSDTSIAK

SEQ ID NO: 46898 - protein, 112 aa, Sorghum bicolor
  Clone ID: SORBI-28MAY03-C49_232.pep
MASLTMMASFAAVAVAAPSRRGSFAVVRAANKADHRCHQQEEPASARLAAAAAAEEPAEGRRAVMLAAAAAAVAAIGGAGAAMADPKKGSPEAKKKYAPICVTMPTAKICHN

SEQ ID NO: 46899 - protein, 87 aa, Sorghum bicolor
  Clone ID: SORBI-28MAY03-C49_233.pep
MANRWVRPEVYPLFAAMGVAVGICGFQLFRNITGNPEVRVNKAGRAAGVLENHEEGRRYAMHGLRSFVHEKTPEIMPAINKFFTDPK

SEQ ID NO: 46900 - protein, 321 aa, Sorghum bicolor
  Clone ID: SORBI-28MAY03-C49_234.pep
IGQLLIWDKRFLFKQIYWMAEAVYDMLSETLTKDEVYLFGNSPKDVDALVLGHALFVLNVLPETSVLRATLQKHARLVKYAEHHLFVLLGVPSGSFSRTLPYVAYDLCVMSGQVHCEHYIDLKVYKLKYHMLVPKVVLVGLDEDGCNPLPGETEDPKSFTIASERCKKCIRTMLKGLVINEALQICFEDFTEDNIVLTETGKVKFKNVTIISCLRRGPEFKRRLHRNFKCAANIIRDLFKLITPTGIQYNIPEDILHLLNVIEREFESRSMFPVHASLVPLTQCSFFFQKMYETIRSVLSFEELEQFWINYHMWMAGRKKL

SEQ ID NO: 46901 - protein, 88 aa, Sorghum bicolor
  Clone ID: SORBI-28MAY03-C49_235.pep
VFSTYPPVSVSGTGTLLLKVVRAFPGSMAWVTYFSAVAPGMSLVEKQWLVHGAHTSALQRLVLGPRLEAFSLPLLTLKKQGHLVSLNL

SEQ ID NO: 46902 - protein, 135 aa, Sorghum bicolor
  Clone ID: SORBI-28MAY03-C49_236.pep
LRQQLSTHPIFVVAICPMRDESYGPCSVPTITGFEFVSLTLCVSIKDLIIHPHQTADRSIIFHSHFSPEDGGTPKPNSSRCHASKITILKRNLILRECCRYGPSSIGQAVPLNPIVPSNSSNHPGTSYLITHGNC

SEQ ID NO: 46903 - protein, 261 aa, Sorghum bicolor
  Clone ID: SORBI-28MAY03-C49_237.pep
MSTPALATAAEGATRIILVHGTGHGGWCWYRVATLLRAAGHRVDAPDMAASGIDSRQLRDVPTFEDYTRPLLDALRALLPGEKAVLVGHSFGGMNIALAAEMFPEKVAAAVFVTAFLPDCTNPRSHVIEKVIGSDWMDTVTDAEHVPPSVFLGPEFLRHKLYQLSPPENYTLSQSLARVSSFYVPDLQSQTPFSESRYGAVRKVYVVCKHDLAITEAYQHTMIAGCPVEEVREIAAADHMPMFSTPAELAGHLAHVANKYA

SEQ ID NO: 46904 - protein, 177 aa, Sorghum bicolor
  Clone ID: SORBI-28MAY03-C49_238.pep
NILVARGKESKSDSRSSGERNGSSLNPITSLYYVAPCCLAFLVVPWVFVELPKLREVGSFQPDLFVFGTNSLCAFALNLAVFLLVGKTSALTMNVAGVVKDWLLIAFSWSVIRDTVTPINLFGYGIAFLGVGYYNHVKLQALKAKEAQKKAAQADEEAGSLLQERDSHGDRKTDTQA

SEQ ID NO: 46905 - protein, 136 aa, Sorghum bicolor; identical to SEQ ID NO: 46719
  Clone ID: SORBI-28MAY03-C49_239.pep

SEQ ID NO: 46906 - protein, 161 aa, Sorghum bicolor
  Clone ID: SORBI-28MAY03-C49_240.pep
MINFVLLISRQGKVRLTKWYSPYTQKERTKVIRELSGLILTRGPKLCNFVEWRGYKVVYRRYASLYFCMCIDADDNELEVLEIIHHFVEILDRYFGSVCELDLIFNFHKAYYILDEILIAGELQESSKKNVARLIAAQDSLVEAAKEEASSISNIIAQATK

SEQ ID NO: 46907 - protein, 144 aa, Sorghum bicolor
  Clone ID: SORBI-28MAY03-C49_241.pep
MATALSSLRAPAAFSLGIAAAPAPAAAATVVALPAAKPARGARLRAQATYNVKLITPDGEVELQVPDDVYILDQAEEEGIDLPFSCRAGSCSSCAGKVVSGTVDQSDQSFLDDAQVEGGWVLTCAAYPTSDVVIETHKEEDLVG

SEQ ID NO: 46908 - protein, 279 aa, Sorghum bicolor
  Clone ID: SORBI-28MAY03-C49_242.pep
MDLKDSLSRFKQQQERCQSSLASIAASSSKPKHRAQPAHAPNVPARPSQPVKFSNDTERLQHINSIRKSPVGAQIKLVIELLYKTRQAFTAEQINDATYVDIHGNKAVFDSLRNNPKVSYDGRRFSYKSKHDLKGKDQLLVLIRKFPEGLAVVEVKDAYPNVLEDLQALKAAGEVWLLSNMDSQEDIVYPNDPKAKIKVDDDLKQLFREIELPRDMVDIEKELQRNGFKPMTNTAKRRAAAQINGVKPKAKPKKKQREITKRTKLTNAHLPELFQNLNT

SEQ ID NO: 46909 - protein, 114 aa, Sorghum bicolor
  Clone ID: SORBI-28MAY03-C49_243.pep
KDMRHSNRIKDEEGYPAFALVNRVTGEAIKHSQGEGHPVKLVPYNPNYQDESVLWTESRDVGHGFRCIRMVNNIYLNFDAFHGDKDHGGVRDGTAVVLWKWCEGDNQRWKIVPW

SEQ ID NO: 46910 - protein, 232 aa, Sorghum bicolor
  Clone ID: SORBI-28MAY03-C49_244.pep
RRPLRCQRGWRARGLVVRAATVVSPKYTSIKPLGDRVLVKIKTSEAKSEGGILLPVSVQTRPQGGEVVAVGEGRSFGSNSIEISVPVGAQVVYSKYAGTELKFNDADHLILKEDDIIGILDSDDVKDMKPLNDRILIKVAEAEEQTAGGLLLTQATKEKPSVGTVVAVGPGPLGEDGSRNPLRITPGSNVMYSKYAGSEFKGEDGQYIVLRSSDVMAVLTSDSEAYSAIYEM

SEQ ID NO: 46911 - protein, 155 aa, Sorghum bicolor
  Clone ID: SORBI-28MAY03-C49_245.pep
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDATGKVTRLRKECPNAECGAGVFMANHFDRHYCGKCGLTYVYNQQA

SEQ ID NO: 46912 - protein, 155 aa, Sorghum bicolor
  Clone ID: SORBI-28MAY03-C49_246.pep
LPCDRFNGTSIVYSIACVCVLIWRDRRLFRWRRRKSKVVRVPEEEQEQERPSITRSSRRCCWCTARCGGSRRRTRRPGSASSSCACWRPGPLPPPAGWRGEPRALCRRSAVPGAPSRSRSQSRWGSSSSASQPSACIVSKSISQYSRLVLDRPQL

SEQ ID NO: 46913 - protein, 155 aa, Sorghum bicolor
  Clone ID: SORBI-28MAY03-C49_247.pep
TREMIKEAISALKERTGSSSHAIAKYMEDKHGASLPANFKKMLSIQLRGFAAKGKLVKVKASYKLSDAAKKAAPKPKAKLAAAKTAAPKPTKKDAAKPKKTAAAAKPKKAAAGTKRKAPEKKVVAKPKKSPAAKAKAKPKTVKSPAAKKARKVAA

SEQ ID NO: 46914 - protein, 261 aa, Sorghum bicolor
  Clone ID: SORBI-28MAY03-C49_248.pep
MGRVIRAQRKGAGSVFKSHTHHRKGPARFRSLDFGERNGYLKGVVTDVIHDPGRGAPLAKVTFRHPFRYKHQKELFVAAEGMYTGQFVYCGRRATLSIGNVLPLRGIPEGAVVCNVEHHVGDRGVFARASGDYAIVISHNPDNGTSRIKLPSGAKKIVPSSCRAMIGQVAGGGRTEKPMLKAGNAYHKYRVMRNCWPKVRGVAMNPVEHPHGGGNHQHIGHASTVRRDAPPGQKVGLIAARRTGRLRGQAAATAAKADKAT

SEQ ID NO: 46915 - protein, 357 aa, Sorghum bicolor
  Clone ID: SORBI-28MAY03-C49_249.pep
MGRDGGGGVAGGMSDSVLRKVLLSYFYVAVWIFLSFSVIVYNKYILDPKMYNWPFPISLTMVHMGFCSSLAVVLVRVLRVVDLPTSPSMTPQLYTSSVVPIGALYAMSLWFSNSAYIYLSVSFIQMLKALMPVAVYSIGVLFKKETFRSSSMLNMLSISFGVAIAAYGEARFDVRGVALQLAAVAFEATRLVLIQILLTSKGISLNPITSLYYVAPCCFCFLVVPWAFVELPRLRAVGTFQPDFFIFGTNSLCAFALNLAVFLLVGKTSALTMNVAGVVKDWLLIAFSWSVIRDTVTPINLFGYGIAFLGVGYYNHVKLQALKAKEAQKKAAQADEEAGSLLQERDGHGDRKSDNQA

SEQ ID NO: 46916 - protein, 130 aa, Sorghum bicolor
  Clone ID: SORBI-28MAY03-C49_250.pep
MVRVSVLNDALKSMYNAEKRGKRQVMIRPSSKVIIKFLTVMQRHGYIGEFEYVDDHRSGKIVVELNGRLNKCGVISPRFDVGVKEIEGWTARLLPSRQFGYIVLTTSAGIMDHEEARRKNVGGKVLGFFY

SEQ ID NO: 46917 - protein, 332 aa, Sorghum bicolor
  unsure (1)..(332): unsure at all Xaa locations
  Clone ID: SORBI-28MAY03-C49_251.pep
MAGAQETLVLAGVMRGHNGVVTAIATPIDNSDLIVSSSRDKSLLVWDLRNPVQAAGDGTTTADYGVPLRRLTGHSHFVQDVVLSSDGQFALSGSWDGDLRLWNLTTGETTCRFVGHEKDVLSVAFSADNRQIVSASRDRTIKLWNTLGECKYTIGGDLGGAEGHNGWVSCVRFXPNTYQPTIVSGSWDRSVKVWNLTNCKLRCTLQGHGGYVNAVAVSPDGSLCASGGKDHVTLLWDLTEGKRLYALDAGDIIHSLCFSPNRYWLCAATQESIKIWDLESKHVVQDLKPEVSSTKDQMLYCTCLSWSADGSTLYAGYTDGSIRIYKISAYGY

SEQ ID NO: 46918 - protein, 145 aa, Sorghum bicolor
  unsure (1)..(145): unsure at all Xaa locations
  Clone ID: SORBI-28MAY03-C49_252.pep
LQIAQRNSLDIDVDLALGFAAHYGKIETMGCLVEEGNAVGFLGPXMRAAERGCLQVVEWFVNHGCREMELCLALTAATSSSQIAVAAYLLPLVPQHVLAPLSIEIIKGLEVSLWRLQAGSRIGKWKGIAKAENSWPSWSTTSHDS

SEQ ID NO: 46919 - protein, 298 aa, Sorghum bicolor
  Clone ID: SORBI-28MAY03-C49_253.pep
MSMCEKDQNLPWGYDLFRDPFAPPNGYYGPPPGYCDGHCCDLHYGRAAHPDETQLHSSQLTYDLYNPSVGIYHPGSTHEHEHETVYVEPSSSSPDAAGDGYFEMEEEVGKRFYPMVPVPHVPKINGEIPSIDEATMDHERLTERLKLYELVEHKVQGDGNCQFRALSDQLYQSPDHHEFVREQIINQLKTNRDAYDGYVPMAYDDYLEKVARNGEWGDHVTLQAAADKYGVKIFVMTSFKDTCYIEIQPKVQKSNKVVLLSFWAEVHYNSIYPQNDAPRSQTATKRRRWWPFSQHHHH

SEQ ID NO: 46920 - protein, 197 aa, Sorghum bicolor
  Clone ID: SORBI-28MAY03-C49_254.pep
MYGRRASQLLKEIDSSEAGQLAPFNTDVFDQVIRECNEHNSQFQSLIRKMVEQNLDIETTRNEDHYGAAIHHLSLLRNKRCLMAYMYNRAEVIQSFRWKVGPVLPHDIQEKLHFSEKEYFKNHSAAIKSYISEMDIDLTVDMVPPKDPYIQVRVLEDIGEVSLGDHSVSLTKNSLHFLRRTDAEQFISQGLMEEFLE

SEQ ID NO: 46921 - protein, 164 aa, Sorghum bicolor
  Clone ID: SORBI-28MAY03-C49_255.pep
MPAGHGLRSRTRDLFARAFRKKGYIPLTTYLRTYKIGDYVDVKVNGAVHKGMPHKFYHGRTGRVWNVTKRAIGVEINKQVNGRIIRKRIHVRVEHVQPSRCTEEFRLRKAKNDQLKADAKARGEVIKTKRQPVGPKPGFMVDGATLETVTPIPYDVVNDLKGGY

SEQ ID NO: 46922 - protein, 130 aa, Sorghum bicolor; identical to SEQ ID NO: 46916
  Clone ID: SORBI-28MAY03-C49_256.pep

SEQ ID NO: 46923 - protein, 168 aa, Sorghum bicolor
  unsure (1)..(168): unsure at all Xaa locations
  Clone ID: SORBI-28MAY03-C49_257.pep
MAAVDTFLFTSESVNEGHPDKLCDQVSDAVLDACLAEDPDSKVACETCTKTNMVMVFGEITTKANVDYEKIVRETCRNIGFVSADVGLDADHCKVLVNIEQQSPDIAQGVHGHFTKRPEEIGAGDQGHMFGYATDETPELMPLSHVXLATKLGAKLTEVRKNGTCAWL

SEQ ID NO: 46924 - protein, 581 aa, Sorghum bicolor
  unsure (1)..(581): unsure at all Xaa locations
  Clone ID: SORBI-28MAY03-C49_258.pep
MEVDRRKNLQIGSKGKEEVQSKNQRREEPLASSEVDMDEPEAAESGDMVVDGNNGSSKESPVPPMDSKNSKGCAAKKRRSVSADFGAELDLDLGNGEESGAQQEERKLSRQDRVELCRSFQHAVSSHDWESAEGLVGMADAQGLNDVLCVAVDAIWFLSDKDELLAIVGLIRRIVSEGAKDFTRAALRTSFLASCVSACRGRSTSLADAVSFMGQKLHERLQESQGDEVLKAEASAKVHRFTEWALKCIGLHSRVRENRGKGNHDTVIEVQLQLSAFKTFLDLADNELTGKDFTEAFDAACFPLTLFSTTFDQGWASGISAAAVQGLLELLVEGGADNVNQCFLEAARYGSTELVRILLQIAQRNSLDIDVDLALGFAAHYGKIETMGCLVEEGNAVGFLGPLMRAAERGCLQVVEWFVNHGCREMELCLALTAATSSSQIAVAAYLLPLVPQHVLAPLSIEIIKAAGERSTGSLHGVDFLLRSDFLNDPTATYAVADSIARCTDXTVDAKLTSFMNEHWSEAAFSARFESAQQHFVNFMTIMQRGESPILLGDLPLELVIAMAYLPLYKECMSSIERLLP

SEQ ID NO: 46925 - protein, 155 aa, Sorghum bicolor
  Clone ID: SORBI-28MAY03-C49_259.pep
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDATGKVTRLRKECPNTECGAGVFMANHFDRHYCGKCGLTYVYNQKA

SEQ ID NO: 46926 - protein, 178 aa, Sorghum bicolor
  Clone ID: SORBI-28MAY03-C49_260.pep
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYL

SEQ ID NO: 46927 - protein, 292 aa, Sorghum bicolor
  Clone ID: SORBI-28MAY03-C49_261.pep
KPPSTSRDADIEMGMHQADASDNLKDFLKKVDAIESLIAKLTNLLNKLQTANEESKAVTKASSMKAIKQRMEKDIDEVGKIARQAKTKVDELEKDNLLNRQKPGCGKGSAVDRSREQTTGAVKKKLKERMDDFQTLREAIRQEYREVVERRVFTVTGNRPDEETIDDLIETGKSEQIFKDAIQHQGRGQILDTVAEIQERHDAVRDLERKLLELQQIFMDMAVLVEAQGDMINNIETHVSNATNHIQQGVTALQSAKKLQKNSRKWMCYAIILLLVIVVVIVVAVIQPWKKG

SEQ ID NO: 46928 - protein, 127 aa, Sorghum bicolor
  Clone ID: SORBI-28MAY03-C49_262.pep
MESVVNPKAYPLADAQLTMGILDIIQQAANYKQLKKGANEATKTLNRGISEFVVMAADTEPLEILLHLPLLAEDKNVPYVFVPSKQALGRACGVTRPVIACSVTSNEGSQLKQQIQGLKDSIEKLLI

SEQ ID NO: 46929 - protein, 101 aa, Sorghum bicolor
  Clone ID: SORBI-28MAY03-C49_263.pep
MSGIIHKIEETLHMGGDHKKDDEHKKEEHKKAEEHHKKDGEHKEGIVEKIKDKITGEHGEKSGEHKDKDHKEKKDKKKKKEKKHGEGHDHDGHSSSSSDSD

SEQ ID NO: 46930 - protein, 101 aa, Sorghum bicolor; identical to SEQ ID NO: 46929
  Clone ID: SORBI-28MAY03-C49_264.pep

SEQ ID NO: 46931 - protein, 294 aa, Sorghum bicolor
  Clone ID: SORBI-28MAY03-C49_265.pep
MGFAGRVSALLFLLVAGAVANDQVFTTSGVTFGRSSREPRYRVEFHPVDSPFHPENGQESVPMANHEGKRYKCFLPVEETKTMKSMLPQNATNVIVESERRIKPKEPDELLEVLKDQCFYRHEGWWSYEFCYHGKIRQVHVDDEKVIQEFVLGEYDDDATAAYHENSTSELANDDNHVKDISKRYHVHLYKNGTVCDLTDIPRETEVRFVCSEPTVLISSIKEISSCKYVVTIQSPMLCKNPLFQQEKRTLSIHCNELPAKAESNVVDDSLPKEAQISIIPDQDGLHDFPAYAT

SEQ ID NO: 46932 - protein, 289 aa, Sorghum bicolor
  unsure (1)..(289): unsure at all Xaa locations
  Clone ID: SORBI-28MAY03-C49_266.pep
HEGGPAWIKMMEKSLPTMTYQAWRRDTQTGPPQYQSSSIFENATPXEXVRDFFGDDEFRMSNKWDDMLIYHKTLEECQSTGTMKVHWVRKFRFFCSDXEYIIARRIWKLGGAYYCVTKGIPCSSVPRRNKPRRVDLYYSSWCIRAVESKRGNGGLTACEVLLFHHEDMGIPYEIAKLGIRQGMWGCVKKIEPGLRAYQEARAAGEPASRSALMARINTKVGDNFVRSLESNSDESEIVEAEEKPARNHVARFLVLGGAVALACTLDQGLLTKALIFGVARKFVGQRKTL

SEQ ID NO: 46933 - protein, 132 aa, Sorghum bicolor
  Clone ID: SORBI-28MAY03-C49_267.pep
FFIVLSCLISVSVNFSTFLVIGKTSPVTYQVLGHLKTCLVLTFGYVLLHDPFSWRNILGILIAVIGMVLYSYFCTRETQQKPAEVSPQVIQAKEGESNPLISDSLSAAENGGSATDDEPLKVPMWSSKYSKA

SEQ ID NO: 46934 - protein, 244 aa, Sorghum bicolor
  Clone ID: SORBI-28MAY03-C49_268.pep
MAAADATRTLLVALSLAVVACCFPQLAAADTNGVYEPCSDARIQRGDGFTFGVVFAGYNTFFSGNTQLSPCDRRLNLAASGQLALFRPKVDEISLLTINTTTGFNPASAGGFMVAFAGRKYAARSVPIFVSNTSVTVSSFTLVLEFNKGRLQNLHWKKDGCGACSGKSNFVCLGKQTCAIRTQSCKTQGPVDCSIGIQLAFSGTDKHESVLNSWYEVSNLRQYSLYGLYSNLKDTLSGQFNKIF

SEQ ID NO: 46935 - protein, 208 aa, Sorghum bicolor
  Clone ID: SORBI-28MAY03-C49_269.pep
MVKHNNVIPNGHFKKHWQNYVKTWFNQPARKQRRRIARQKKAVKIFPRPTAGPLRPIVQCQTLKYNMKSRAGRGFTLEELKAAGIPKKLAPTIGISVDHRRKNKSLEGLQANVQRLKTYKAKLVIFPRRARKVKAGDSTPEELATATQVQGDYMPITRGEKRSVEVVKVTDEMKEFAAYGKLRLERMNKKHLGARQKKAAEAEKEDKK

SEQ ID NO: 46936 - protein, 100 aa, Sorghum bicolor
  Clone ID: SORBI-28MAY03-C49_270.pep
AEANVGDFGAAAGSKDYVHVRIQQGNGRKSLTTVQGLKKEFSYSKILKDFKKEFCCNGTVVQDPELGQVIQLQGDQRKNVFNFLVQAGIVKKEHIKIHGF

SEQ ID NO: 46937 - protein, 86 aa, Sorghum bicolor
  Clone ID: SORBI-28MAY03-C49_271.pep
MVLQNDIDLLNPPAELEKLKHKKKRLVQSPNSFFMDVKCQGCFSITTVFSHSQTVVVCPGCQTVLCQPTGGKARLTEGCSFRRKGD

SEQ ID NO: 46938 - protein, 147 aa, Sorghum bicolor; identical to SEQ ID NO: 46806
  Clone ID: SORBI-28MAY03-C49_272.pep

SEQ ID NO: 46939 - protein, 317 aa, Sorghum bicolor
  Clone ID: SORBI-28MAY03-C49_273.pep
SSSFSWLELRTNGHVLLNPWGALVAEPFRPRRCLAGIEPSNPSAMAHAAAAAVLLRRPLLFLKEARLLSSLAAPLPGLRRHPRALRPAGRPLPSDAEDDTDDPDAGAGAESFKKSRNELKREARRAVKWGMDLASFSPPQIKRILSAASLEREVLDALMLVKKFGPDVREGKRRQFNYIGRLLRNAQPELMDTLIQASKDGDESKLHALLSEGTLLVEEEEVEDLPDEQEDNQEYIKIADRWFDGLLCKDISVTNEVYSVHSVEFDRQELRKLVKRAHMVQESTHNKDGEDSNVKLSGAKKTLMRFLRSLAMEAYAA

SEQ ID NO: 46940 - protein, 540 aa, Sorghum bicolor
  Clone ID: SORBI-28MAY03-C49_274.pep
MTRIFVQRGTAGSSSSSGRSGSQPAQQPAAAAREEELPLQPQPQLPELLAIDDTTEHLNEGSENSSSSNKPLRTDDTISESSSSAEERAAREKPPKDDSNVINPTFLVEELIGLQIPDQIEHGDSVPSGTSSSQMAGAASHPPPPPAPPPKPLLGNNGLRRMGPGSSNSVRIGSSRRPVAWPPVVARTSASGSRPSSPRSLVDGEGYNSADEQGPCYPSSYDDSERERMFEHDLRRVKGLEIRKMAEDGNCLFRAVADQVYGDAEAYDMARQMCVDYMERERDHFSQFITESFTLYCKRKRRDKVYGNNVEIQAFAEMYNRPIHIYSYGAEPINIFQGSYNTDVPPIRLSYHHGNHYNSVVDPRRQTVGAGLGFSSLRGTNNVDRDQVKAAIKAQQDQQIENALLAEGRFYSDLELTEREIERMVMEASRSEYLAKEKKLNIRESSTSGAEPSSSAAISGSSRSVAGADRGSEDYFVLPDTVLTRSMQLLLAMGFSYIQVMEAYSIFGEDVDSMVCYLVETGGTGASAGGSNRRKGKAAE

SEQ ID NO: 46941 - protein, 157 aa, Sorghum bicolor
  Clone ID: SORBI-28MAY03-C49_275.pep
MAKLYVQAFPPADLNKNTEWFMYPGVWTTYILIVFFSWLLVLSVFGCTPGTAWTVVNLFHFAITYHFFHWKKGTPFADDQGMYNGLTWWEQMDNGKQLTRNRKFLIVVPVVLYLIALHTTDYQQPMLFLNTLAVSVLVVAKLPNMHKVRIFGINAEN

SEQ ID NO: 46942 - protein, 208 aa, Sorghum bicolor
  Clone ID: SORBI-28MAY03-C49_276.pep
MVKHNNVIPNGHFKKHWQNYVKTWFNQPARKQRRRIARQKKAVKIFPRPTAGPLRPIVQCQTLKYNMKSRAGRGFTLEELKAAGIPKKLAPTIGISVDHRRKNKSLEGLQANVQRLKTYKAKLVIFPRRARKVKAGDSTVEELATVTQVQGDYMPITRGEKRSVEVVKVTDEMKSFAAYGKLRLERMNKKHQGARQKKAAEAEKDEKK

SEQ ID NO: 46943 - protein, 352 aa, Sorghum bicolor
  Clone ID: SORBI-28MAY03-C49_277.pep
MNSHAAGTSNGGSGDAAAGGAARRNTRMPKYSKFTQQELPACKPILTPKWVVSVFFIVGVIFVPIGVVSLIAARDVVEIIDRYDEACVPGNMTDDKLAYIQNETISKECIRNLTVTKDMKQPIFVYYELDNFYQNHRRYVKSRNDAQLRDASKANQTSACEPEKTTANGQPIVPCGLIAWSLFNDTYNFTRGTENLTVDKKDISWKSDREHKFGKDVYPSNFQNGALKGGATLNPKIPLSEQEDLIVWMRTAALPTFRKLYGRIHFDLKENDTITVRLNNNYNTYSFGGKKKLVLSTATWLGGKNDFLGFAYLIVGGLCIFLAFAFTLLYFVKPRKLGDHNYLSWNRHPAGR

SEQ ID NO: 46944 - protein, 194 aa, Sorghum bicolor
  Clone ID: SORBI-28MAY03-C49_278.pep
MPALAKPASRPAKTAAAPKPKPAAAKPKAAAAGASHPPYFEMIKEAISALKERTGSSSHAIAKYMEDKHGASLPANFKKMLSIQLRGFAAKGKLVKVKASYKLSDAAKKAAPKPKAKLAAAKTAAPKPTKKDAAKPKKTAAAAKPKKAAAGTKRKAPEKKKVVAKPKKSPAAKAKAKPKTVKSPAAKKARKVAA

SEQ ID NO: 46945 - protein, 256 aa, Sorghum bicolor
  Clone ID: SORBI-28MAY03-C49_279.pep
KDGELCLSGAKPEETLVEARSDTKNVIAKPSANRERVTSPSAIKSTQHASAFHTIQNQTSPANLVGKDKADEGISNAVKMSHPTEVPQSCVQHHHHVHYYLHVMTQKQSSIDRGSSDVQCGSSNVFDPPVEGHAANYSVNGGVSVGHNGCNGQNGTSTVPNIARPNIESVNGTVSQNIAGGGIVSGSGSGNDVYQNRFPQREAALNKFRLKRKDRNFGKKVRYQSRKRLAEQRPRVRGQFVRQSGQEDQAAQGSER

SEQ ID NO: 46946 - protein, 182 aa, Sorghum bicolor
  Clone ID: SORBI-28MAY03-C49_280.pep
MVKFTAEELRGIMDKKNNIRNMSVIAHVDHGKSTLTDSLVAAAGIIAQEVAGDVRMTDTRADEAERGITIKSTGISLYYEMTDESLKNYKGERDGNQYLINLIDSPGHVDFSSEVTAALRITDGALVVVDCIEGVCVQTETVLRQALGERIRPVLTVNKMDRCFLELQVEGEEAYQTFSRVI

SEQ ID NO: 46947 - protein, 173 aa, Sorghum bicolor
  unsure (1)..(173): unsure at all Xaa locations
  Clone ID: SORBI-28MAY03-C49_281.pep
MAQEGGLRLVSHPIAAHGGRLTRQYSAEGQGAKKDMSPPLEWYGVPEGTRSLALLAQDIDADPAVPWTHWVVANIPPTTKGLPEGFSGRXQGAAAPPREYGGLQEGINDWKQPGWRGPVPPSHGHRIQFKLYALDDELHLGNKVTRDKLLEAIQGHVLEETELVAVFQGVVSN

SEQ ID NO: 46948 - protein, 504 aa, Sorghum bicolor
  unsure (1)..(504): unsure at all Xaa locations
  Clone ID: SORBI-28MAY03-C49_282.pep
MAILSPLATEVFIPVAAVIGIVFAVVQWVLVSRVKLSPTAAAASGGGKNGYGDYLIEEEEGLNDHNVVVKCAEIQNAISEGATSFLFTEYQYVGIFMSIFAVVIFLFLGSVEGFSTKSQPCTYSKDKYCKPALFTALFSTVSFLLGAITSLVSGFLGMKIATYANARTTLEARKGVGKAFITAFRSGAVMGFLLASSGLVVLYITINVFKLYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGIDHDFTGMCYPLLVSSVGIIVCLITTLFATDFFEVKAVKEIEPALKKQLIISTALMTVGIAVISWLALPAKFTIYNFGTQKDVSNWGLFFCVAIGLWAGLIIGFVTEYYTSNAYSPVQDVADSCRTGAATNVIFGLALGYKSVIIPIFAIXAVSIYVSFSIAAMYGXIAVAALGMLSTIATGLAIDAYGPI

SEQ ID NO: 46949 - protein, 480 aa, Sorghum bicolor
  Clone ID: SORBI-28MAY03-C49_283.pep
MASRSAGQLFLALLLLAVVVAASASDADAAAGGAKWREEQARDRVPRVPGQAFNTSFAQYAGYVTVSEQRGAALFYWFFEADKDPASKPLVLWLNGGPGCSSIAFGLGEEVGPFHVNADGKGVHVNPYSWNKVANLLFLDSPVGVGYSYSNTSDDALKNGDARTATDSLAFLLKWLERFPQYKEREFYLTGESYAGHYVPQLAQAIKRHHEATGDKSINLKGYMVGNALTDDFHDHYGIFQFMWTTGLISDQTYKLLNVFCDYESFVHSSPQCDKILDIASTEAGNIDSYSIFTPTCHASFASSKNKVMKRLRSAGKMGEQYDPCTEKHSIVYFNLAEVQKALHVNPVIGKSKWETCSEAVNTHWGDCERSVLHIYHELIQYGLRIWVFSGDTDAVIPVTSTRYSIDALKLPTITPWHAWYDDDGEVGGWTQGYKGLNFVTVRGAGHEVPLHRPKQALTLIKSFLAGSPMPVQSSTHSDM

SEQ ID NO: 46950 - protein, 442 aa, Sorghum bicolor
  unsure (1)..(442): unsure at all Xaa locations
  Clone ID: SORBI-28MAY03-C49_284.pep
QYHSLFRTLDSVHHDDFHQPNFEGGSIKKGGPREPWHDIHSRLEGPIAWDVLYNFEQRWRKQGGKDLLVRLRDLSDIIIPPSPVMFPEDRETWNVQLFRSIDGGAAFGFPETPEEAARAGLVSGKDQIIDRSIQDAYINAIRRAKNFIYIENQYFLGSSYGWKAEGIKPEEIGALHLIPKELSLKIVSKIEAGERFTVYVVVPMWPEGVPESASVQAILDWQRRTMDMMYTDITQALQAKGIEANPKEYLTFFCLGNREVKQEGEYEPEEHPEPDTDYIRAQEARRFMIYVHTKMMIVDDEYIIIGSANINQRSMDGARDSEIAMGAYQPYHLATRQPARGQIHGFRMSLWYEHLGMLDDVFQRPESVECVQKVNRIAEKYWDLYSSDDLEQDLPGHLLMYPIGVTADGTVTELPGMENFPDTRXARVLGNKSDYLPPILTT

SEQ ID NO: 46951 - protein, 173 aa, Sorghum bicolor
  Clone ID: SORBI-28MAY03-C49_285.pep
MFLRRILTGGGGLAALRAARAVKETTGIVGLEVVPNAREVLIGLYTRTLKEIEAVPKDEGYRKAVESFTNHRLQICQEEGDWKTIEDRIGCGQVEELIEEAEDELKLIAKMIEWDPWGVPDDYECEVIEDDTPIPKHVPQHRPVALPEEFFKTLDAVKSDPALQGDAPPQVKA

SEQ ID NO: 46952 - protein, 457 aa, Sorghum bicolor
  Clone ID: SORBI-28MAY03-C49_286.pep
MGLEMEAMAASIGVSVPVLRFLLCFAATIPTGLLWRAVPGATGRHLYAGLTGATLSYLSFGPSSNLLFVVPMTLGYLAMLLSRRHAGLITFLGAFGFLIACHVYYMSGDAWKEGGIDATGALMVLTLKVISCAINYSDGILKEEGLRDAQKKYRLTKLPSLIEYFGYCLCCGSHFAGPVYEMKDYLDWTERKGIWASPTPSPLLPTLRALVQAGVCMGLYLYLSPKFPLSRFSEPLYYEWGFWHRLFYQYMSGFTARWKYYFIWSISEASIIISGLGFTGWSESSPPKAKWDRAKNVDVLGVELAGSAVQIPLVWNIQVSTWLRYYVYERLIQKGKKPGFLQLLGTQTVSAIWHGLYPGYIIFFVQSALMINGSRVIYRWQQAVSSSFLRGILAFLNFAYTLLVLNYSCIGFLVLSFKETLASYQSVYYVGTIVPIVFLLLGNVIKPARKAKARKTE

SEQ ID NO: 46953 - protein, 193 aa, Sorghum bicolor
  Clone ID: SORBI-28MAY03-C49_287.pep
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDDSLATVPFLILGNKIDIPYAASEEELRYHMGLSNFTTGKGKVNLGESNVRPLEVFMCSVVRKMGYGDGFKWVSQYIN

SEQ ID NO: 46954 - protein, 447 aa, Sorghum bicolor
  Clone ID: SORBI-28MAY03-C49_288.pep
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIHFVPISGFEGDNMIERSTNLDWYKGPTLLEALDLINEPKRPSDKPLRLPLQDVYKIGGIGTVPVGRVETGIIKPGMVVTFGPSGLTTEVKSVEMHHEALQEALPGDNVGFNVKNVAVKDLKRGYVASNSKDDPAKEAASFTSQVIIMNHPGQIGNGYAPVLDCHTSHIAVKFAELVTKIDRRSGKELEKEPKFLKNGDAGMVKMVPTKPMVVETFSEYPPLGRFAVRDMRQTVAVGVIKSVEKKDPTGAKVTKAAAKKK

SEQ ID NO: 46955 - protein, 149 aa, Sorghum bicolor
  Clone ID: SORBI-28MAY03-C49_289.pep
MGSLMAGWDSPVLADDDKKVNARRNRSLTKEEVEAFWKQRRSRRSSEEGGGELASPLSSPPATATWQESPFGSSEKPAAAAVRVDGFLPGGGSGDDDDAAADSPSRSRDWWTRSSWAFLNEPPQEEPSARAQQRYTPQFHVARIATGNA

SEQ ID NO: 46956 - protein, 649 aa, Sorghum bicolor
  Clone ID: SORBI-28MAY03-C49_290.pep
HEDEVIPAENGSHAWRYLEDLQNNIDLVLTEVFMPCLSGIGLLSKITSHKICKDIPVIMMSSNDSMSMVFKCLSKGAVDFLVKPLRKNELKNLWQHVWRRCHSSSGSGSESGIQTQKCAIPNTGDEYENDSDSNHDDEENDEDDDDDFSVGLNARDGSDNGSGTQSSWTKRAVEIDSPEPMSPDQLADPPDSTCAQVIHPKSEICSNKWLPTANKRNGKKHKENKDESMGRYLEIGAPRNSSAEYQSSLNDVSVNPTEKRHETHMPQCKSKKKMMAEDDCTDIPSEINTETADLISSIARNTEGQQAVRAVDAPDGPSKMPDGNDKNHDSHIVVTPHELGLKRLRTDGAADEIHDERNILKRSDQSAFTRYHTSVASNQGGARCGESSSPQDNSSEAVKTDSTCKMKSNSDAAPIKQGSNGSSNNDVGSSTKNVIAKPSANRERVTSPSAIKSTQHASAFHTIQNQTSPANLVGKDKADEGISNAVKMSHPTEVPQSCVQHHHHVHYYLHVMTQKQSSIDRGSSDVQCGSSNVFDPPVEGHAANYSVNGGVSVGHNGCNGQNGTSTVPNIARPNIESVNGTVSQNIAGGGIVSGSGSGNDVYQNRFPQREAALNKFRLKRKDRNFGKKVACFQLHACRSSYDLKSVIGI

SEQ ID NO: 46957 - protein, 236 aa, Sorghum bicolor
  unsure (1)..(236): unsure at all Xaa locations
  Clone ID: SORBI-28MAY03-C49_291.pep
MPISRIAVGTHHEVYHPGALKAALAEFISTLIFVFAGQGSGMAFSKLTSGGATTPSGLIAAAVAHAFALFVAVSVGANISGGHVNPAVTFGAFVGGNITLFRGLLYWVAQLLGSTVACFLLRFSTGGLATGTFGLTGVSVWEXAVVMEIVMTFGLVYTVYATAVDPKKGSLGTIAPIAIGFIVGANILVGGAFTGASMNPAVSFGPALVSWEWGYQGVYWVGPLIGGGLAGRIYQL

SEQ ID NO: 46958 - protein, 130 aa, Sorghum bicolor
  Clone ID: SORBI-28MAY03-C49_292.pep
MVRISVLNDALKSMYNAEKRGKRQVMIRPSSKVIIKFLTVMQRHGYIGEFEYVDDHRAGKIVVELNGRLNKCGVISPRFDVGVKEIEGWTARLLPSRQFGYIVLTTSAGIMDHEEARRKNVGGKVLGFFY

SEQ ID NO: 46959 - protein, 144 aa, Sorghum bicolor
  Clone ID: SORBI-28MAY03-C49_293.pep
MPKNKGKGGKNRKRGKNEADDDKRELVFKEDGQEYAQVTRMLGNGRCEAICVDGTRRLCHIRGKMHKKVWIAAGDIVLVGLRDYQDDKADVILKYMNDEARLLKAYGELPETLRLNEGVDVDGPEDGEEGSDYIQFEDEDIDKI

SEQ ID NO: 46960 - protein, 326 aa, Sorghum bicolor
  Clone ID: SORBI-28MAY03-C49_294.pep
MHPLELFLVVLVTTGAASAVYSHPAAAGTPAARFWEEALPGTPMPEAIADLIQQGIDHSPLVEHFTSSGHTPVMNINYGYGAYAGSSLMNAAVPPGSFFLQSQLRVGTAMTVSSESAATVPPILPRNVAEKVPFSNLADVLAAFHISPSSAEATTVGNTLSLCGAPPSLAGEQKACATSLEDTVESATHMLVVGSSVRHGVVYLWAASSAAAVPPAAHHHQQQYVVQAVTSLDGDRHVGCHAMPFPYAVYYCHMTGRPSKAYAVLLRSVTGGSSAPVTKAAICHLDTSNWDPAHPAFEMLHTRPGGEPVCHFMSYASLLFGEKAAN

SEQ ID NO: 46961 - protein, 430 aa, Sorghum bicolor
  unsure (1)..(430): unsure at all Xaa locations
  Clone ID: SORBI-28MAY03-C49_295.pep
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIHFVPISGFEGDNMIERSTNLDWYKGPTLLEALDLINEPKRPSDKPLRLPLQDVYKIGGIGTVPVGRVETGIIKPGMVVTFGPSGLTTEVKSVEMHHEALQEALPGDNVGFNVKNVAVKDLKRGYVASNSKDDPAKEAASFTSQVIIMNHPGQIGNGYAPVLDCHTSHIAVKFAELVTKIDRRSGKELEKEPKFLKNGDAGMVKXGRFAVRDMRQTVAVGVIKSVEKKDPTGAKVTKAAAKKK

SEQ ID NO: 46962 - protein, 649 aa, Sorghum bicolor
  Clone ID: SORBI-28MAY03-C49_296.pep
MAGKGDGPAIGIDLGTTYSCVGVWQHDRVEIIANDQGNRTTPSYVAFTDSERLVGDAAKNQVAMNPINTVFDAKRLIGRRFSDASVQSDVKLWPFKVIPGSGDKPMIGVQFRGEEKQFSAEEISSMILNKMKDTAEAYLGTTIKNAVVTVPAYFNDSQRQATKDAGVISGLNVMRIINEPTAAAIAYGLDKKSSSDGEKNVLIFDLGGGTFDVSLLTIEEGIFEVKATAGDTHLGGEDFDNRLVNHFVQEFKRKNKKDITGNPRALRRLRTACERAKRTLSSTAQTTIEIDSLYEGIDFYTTITRARFEELNMDLFRKCMEPVEKCLRDAKMDKSSVHDVVLVGGSTRIPRVQQLLQDFFNGKELCKSINPDEAVAYGAAVQAAILTGEGNEKVQDLLLLDVSPLSLGLETAGGVMTVLIPRNTTIPTKKEQVFSTYSDNQPGVLIQVYEGERARTKDNNLLGKFELSGIPPAPRGVPQITVCFDMDANGILNVSAEDKTTGQKNKITITNDKGRLSKEEIEKMVQEAEKYKAEDEEHKKKVDAKNSLENYAYNMRNTIRDDKIASKLPEADKKKIDDAIEGAINWLDNNQLAEVDEFEDKMKELEGICNPIIAKMYQGAAGPDMAGGMDQDAPPAGGSGAGPKIEEVD

SEQ ID NO: 46963 - protein, 201 aa, Sorghum bicolor
  Clone ID: SORBI-28MAY03-C49_297.pep
GPNMVVDMCKGVQYLNEIKDSVVAGFQWASKEGALAEENMRGICFEVCDVVLHADAIHRGGGQVIPTARRVIYASQLTAKPRLLEPVYLVEIQAPENALGGIYGVLNQKRGHVFEEMQRPGTPLYNIKAYLPVIESFGFSSQLRAATSGQAFPQCVFDHWDMMGSDPLEAGSQAAQLVLDIRKRKGLKEQMTPLSEFEDKL

SEQ ID NO: 46964 - protein, 346 aa, Sorghum bicolor
  Clone ID: SORBI-28MAY03-C49_298.pep
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIHFVPISGFEGDNMIERSTNLDWYKGPTLLEALDLINEPKRPSDKPLRLPLQDVYKIGGIGTVPVGRVETGIIKPGMVVTFGPSGLTTEVKSVWLILCFLEGYLVGTLNIVIPVIARATKLCWQCLSGRFSTVIFVKTRVLDTNFLLFLDRTSGVSQWF

SEQ ID NO: 46965 - protein, 164 aa, Sorghum bicolor
  Clone ID: SORBI-28MAY03-C49_299.pep
MPAGHGLRSRTRDLFARPFRKKGYIPLTTYLRTYKIGDYVDVKVNGAVHKGMPHKFYHGRTGRVWNVTKRAIGVEINKQVNGRIIRKRIHVRVEHVQPSRCTEEFRLRKAKNDQLKADAKARGEVISTKRQPLGPKPGFMVEGATIETVTPIPYDVVNDLKGGY

SEQ ID NO: 46966 - protein, 396 aa, Sorghum bicolor
  Clone ID: SORBI-28MAY03-C49_300.pep
MASHIVGYPRMGPKRELKFALESFWDGKSSAEDLEKVATDLRSSIWKQMSEAGIKYIPSNTFSYYDQVLDTTAMLGAVPERYSWTGGEIGLSTYFSMARGNATVPAMEMTKWFDTNYHFIVPELGPSTKFTYASHKAVSEYKEAKALGIDTVPVLVGPVSYLLLSKPAKGVEKSFSLLSLLGSILPIYKEVVAELKAAGASWIQFDEPTLVKDLDAHELAAFSSAYAELESAFSGLNVLIETYFADIPAESYKTLTSLSGVTAYGFDLIRGAKTLDLIRSSFPSGKYLFAGVVDGRNIWADDLAASLSTLQSLEAVAGKDKLVVSTSCSLMHTAVDLVNETKLDDEIKSWLAFAAQKVVEVNALAKALAGQKDEAYFAANAAAQASRRSSPRVTNE

SEQ ID NO: 46967 - protein, 261 aa, Sorghum bicolor
  Clone ID: SORBI-28MAY03-C49_301.pep
MGRVIRAQRKGAGSVFKSHTHHRKGPARFRSLDFGERNGYLKGVVTDVIHDPGRGAPLAKVTFRHPFRCKHQKELFVAAEGMYTGQFVYCGRRATLSIGNVLPLRGIPEGAVVCNVEHHVGDRGVFARASGDYAIVISHNPDNGTSRIKLPSGAKKIVPSSCRAMIGQVAGGGRTEKPMLKAGNAYHKYRVKRNCWPKVRGVAMNPVEHPHGGGNHQHIGHASTVRRDAPPGQKVGLIAARRTGRLRGQAAATAAKADKAT

SEQ ID NO: 46968 - protein, 87 aa, Sorghum bicolor; identical to SEQ ID NO: 46899
  Clone ID: SORBI-28MAY03-C49_302.pep

SEQ ID NO: 46969 - protein, 348 aa, Sorghum bicolor
  Clone ID: SORBI-28MAY03-C49_303.pep
MENGGGKGDVPDDANEHCPGTQSEEAGKADACAGCPNQQICATAPKGPDPDVVAIVERLATVKHKLLVLSGKGGVGKSTFSAQLSFALAEMDHQVGLLDIDICGPSIPKMLGLEGQDIHQSNLGWSPVYVESNLGVMSIGFMLPNPDDAVIWRGPRKNGLIKQFLKDVDWGEIDYLVVDAPPGTSDEHISIVQYLQATGIDGAIIVTTPQQVSLIDVRKEITFCKKVGVPVLGVVENMSGLRQPLSDLRFIKSDEAGETDATEWALNYIKEKAPELLSVMACSEVFDSSKGGAEKMCHEMGVPFLGKVPMDPQLCKAAEEGRSCFADQKCSASAPALQNIVKKLIKTE

SEQ ID NO: 46970 - protein, 408 aa, Sorghum bicolor
  unsure (1)..(408): unsure at all Xaa locations
  Clone ID: SORBI-28MAY03-C49_304.pep
MDLLLVPSSSSTHPIRSRRSELLPTNHTLSLSRRSAHPSGQLLHTTPHHTSPHLTSPHTHSLSPPASSLACSSLSLACLDRNALGMASEVWLSPASRLPSLSTNAPPRFRSNPPATTTASFFSPRPRPARGALPLLRVRRRLRATDQQGQVQEQDDEVVDSNILPYCNIDRKQKKTLGEMEQEFLQACQAFYFDQKAIMSNEEFDNLKEELMWEGSSVVMLSXDEQKLLEASMAYAAGSPIMSDAEFDQLKLKLKTDGSVIVMEGPRCSLRSHKVYSDLNVDYLKMFLLNVPATTVALGLFFFIDELTGFEINVFQLPEPFGFIFTWFAALPLILFLAQLLTKAIVQDFIILKGPCPNCGTENLSFFGTILSVSSGGTTNKVKCANCSTELEYDSKSRVITLPEASSA

SEQ ID NO: 46971 - protein, 379 aa, Sorghum bicolor
  Clone ID: SORBI-28MAY03-C49_305.pep
MATAGKVIKCKAAVAWEAGKPLSIEEVEVAPPQAMEVRVKILFTSLCHTDVYFWEAKGQTPVFPRIFGHEAGGIIESVGEGVTDVAPGDHVLPVFTGECKECAHCRSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFTEINKAFDLMAKGEGIRCIIRMEN

SEQ ID NO: 46972 - protein, 447 aa, Sorghum bicolor
  Clone ID: SORBI-28MAY03-C49_306.pep
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYDEIVKEVGSYLKKVGYNPDKIPFVPISGFEGDNMIERSTNLDWYKGPTLLEALDQINEPKRPSDKPLRLPLQDVYKIGGIGTVPVGRVETGLIKPGMVVTFGPTGLTTEVKSVEMHHESMQEALPGDNVGFNVKNVAVKDLKRGYVASNSKDDPAKEAASFTAQVIIMNHPGQIGNGYAPVLDCHTSHIAVKFSELLTKIDRRSGKELESAPKFLKNGDAGFVKMIPTKPMVVETFSEYPPLGRFAVRDMRQTVAVGVIKSVEKKDPTGAKVTKAAAKKK

SEQ ID NO: 46973 - protein, 172 aa, Sorghum bicolor
  Clone ID: SORBI-28MAY03-C49_307.pep
MAQRDKKEEPTELRAPEITLCANNCGFPGNPATQNLCQSCFSAATASRSSSPSSPTSSSSASAVSQPRPAALVDAAAVELLASADAAAVGQSMVVVAAAPAATAARSSAVNRCSSCRKRVGLTGFRCRCGELFCGAHRYSDRHDCCFDYKAVGRDAIARENPVVRAAKIVRF

SEQ ID NO: 46974 - protein, 164 aa, Sorghum bicolor
  Clone ID: SORBI-28MAY03-C49_308.pep
QTHFLNSMTTALVASSEAFHFFRWGKHWYTSVFGCLASACSRHFTSVVVHMNVCMHTLHWMLMAFLLVSSWLPLDPLFFSKLRSRAILDFWPLPPPMVDGPGDDRWQQLRAPRPAAGPRRSALGLWFTGSGEGGWAEISDGSERRGVAQREFFLIFPGPAGPGR

SEQ ID NO: 46975 - protein, 428 aa, Sorghum bicolor
  Clone ID: SORBI-28MAY03-C49_309.pep
ARGTKLDSEIKSWLAFAAQKVVEVDALAKALAGQKDEAYFAANAAAQASRKSSPRVTNEEVQKAAAALKGSDHRRATTVSARLDAQQKELNLPVLPTTTIGSFPQTVELRRVRREYKAKKISEEEYISAIKEEISKVVKLQEELDIDVLVHGEPERNDMVEYFGEQLSGFAFTANGWVQSYGSRCVKPPIIYGDVSRPNPMTVFWSKTAQSMTARPMKGMLTGPVTILNWSFVRNDQPRFETCYQIALAIKKEVEDLEAAGIQVIQIDEAALREGLPLRKSEHAFYLDWAVHSFRITNCGVQDTTQIHTHMCYSNFNDIIHSIIDMDADVITIENSRSDEKLLSVFREGVKYGAGIGPGVYDIHSPRIPTTEEIADRVNKMLAVLDTNILWVNPDCGLKTRKYTEVKPALTNMVSATKLIRTQLASAK

SEQ ID NO: 46976 - protein, 491 aa, Sorghum bicolor
  unsure (1)..(491): unsure at all Xaa locations
  Clone ID: SORBI-28MAY03-C49_310.pep
MSFRVSLLTFLLFAVFGGMRPNLATTDGRSATVPSAGSAIIAYWQKMLPDSTMPSAIRDLLTPNNNADANKDNPYPIPASAFYGKEANSLNPTIFYGKATNGDDNPYPIPATAFYEKEANNRNPTIFGKGTNGDDNPYPIPATAFYGKEANNLNPTIFYRKEINRDDNPYVPVLAFHGKEVNNLNPVNNLPLSAFCGKEVNNLPVSAFSGKATIGPVHVSKMNIADDADHHVHEHRHIDGGHDHFDSRNIGFLFLEDALTPGSKVAPYIDPASSRGAPLLPRDVADSIPMSTKSFTDILRMFSPVSRAMAESIWYSLELCEHPRPIKGEKRGCVTSIESMVDFAASMLGTSDLRAFSSPXVPVEGRNASKVYTVLAVRAITSPGDTMTCHGIPFPYKVFLCHALVPTKVYSVTVESDDDDGVEEKERMEEALVVCHLNTAEFDPMKMPPRVKPGDAPVCHFLNNDDVLWAPAATTLGTQQGAAEDVVVAAQ

SEQ ID NO: 46977 - protein, 354 aa, Sorghum bicolor
  Clone ID: SORBI-28MAY03-C49_311.pep
APLPPPPPPQPPPPRRLPLQPLPTRAARATETVVVDERVASHVDPFLVEALDNPRHRLMVLRMELDIQNFMQNPQLQEFEFQNYPTSYLRCAAHRVAQHYGLETIVADSLVEGSVSRIVARKTPESRYPAIALSEVPSRQARNDHEAAEKLKFVIYQRPKAFQNGSADSRNMNGAPKTVEERIEEYNKARARIFNGSISADSDAASVLGTLSTGRDEAVNVEPSVDEIKISTMNSRSRVAVFKDTEKDRSDPDYDRNYTRYVRNPVPDFNLSPGAFNFVVPQFMQYGVGYMQSPGMSTNQPTVYFGQPDLAMGSSSGATVYPHWPTPAMMYPHCYDNVGPMISQVPLYQSFNHG

SEQ ID NO: 46978 - protein, 515 aa, Sorghum bicolor
  unsure (1)..(515): unsure at all Xaa locations
  Clone ID: SORBI-28MAY03-C49_312.pep
SKDEKHFEKKKRQKQHDENVQKVVKRLKQRNPKKDGLVCTARKPWIAVGMRNVDYKRARHFEVDLSSFRNILEIDKERMVAKVEPLVNMGQITRATCPMNLALAVVAELDDLTVGGLINGYGIEGSSHLYGLFSDTVVAMEVVLADGRVVRATKDNEYSDLFYGIPWSQGTLGFLVSAEIKLIPIKEYMKLTYIPVKGSLKEIAQAYADSFAPRDGDPAKVPDFVEGMVYTESEGVMMTGVYASKEEAKKKGNKINCVGWWFKPWFYQHAQTALKRGEFVEYIPTREYYHRHTRCLYWEGKLILPFGDQFWFRFLLGWLMPPKVSLLKATQGEAIRNYYHDNHVIQDMLVPLYKVGDALEFVHREMEVYPLWLCPHRLYKLPVKTMVYPEPGFEHQHRQGDTSYAQMFTDVGVYYAXPGAVLRGEEFNGAEAVHRLEQWLIENHSYQPQYAVSELNEKDFWRMFDASHYEHCRHKYGAVGTFMSVYYKSKKGRKTEKEVQEAEAAILEPAYADEA

SEQ ID NO: 46979 - protein, 387 aa, Sorghum bicolor
  Clone ID: SORBI-28MAY03-C49_313.pep
MAMATAKLSSPATSLLAGGRTRRSAPARRATVIRAAAGSYSDELVSTAKSVASPGRGILAIDESNATCGKRLSSIGLDNTEPNRQAYRQLLLTTAGLGEYISGAILFEETLYQSTTDGKKFVDCLKEQNIMPGIKVDKGLVPLPGSNNESWCQGLDGLASRCAEYYKQGARFAKWRTVVSIPCGPSALAVKEAAWGLARYAAIAQDNGLVPIVEPEIFLDGDHGIERTLEVAEKVWSEVFFYLAENNVLFEGILLKPSMVTPGAEHKEKASPEAIAKHTLTMLRRRVPPAVPGIMFLSGGQSEVEATLNLNAMNQSPNPWHVSFSYARALQNSVLKTWQGRPENVEAAQKALLARAKANSLAQLGRYTGEGESDEAKKGMFQKGYTY

SEQ ID NO: 46980 - protein, 318 aa, Sorghum bicolor
  Clone ID: SORBI-28MAY03-C49_314.pep
MSSSAENDPTVTERGASSKDKHEDGDKEQGGGGFIDKVKDFIHDIGEKIEEAVGFGKPTADVCGIHIPHISLHRADLVVDVLIKNPNPVPIPLVDIDYLIDSDGRKLVSGLIPDAGTIHAHGQETVKIPVSLVFDDIRSTYKDIQPGSIIPYLVRVVLLVDVPIIGRIKIPIQKDGEIPIPYKPDVDVEKIKFHHFSFEETTATLHLKLENKNDFDLGLNLLEYEMWLGDDSIASAELTQTAKIEKQGITRMQVPFSFRPKDFGSAVWDMIRGRGTGYTIKGKIDVDTPFGNMKLPISKEGGTTCIKKDDDDDDDDDN

SEQ ID NO: 46981 - protein, 139 aa, Sorghum bicolor; identical to SEQ ID NO: 46812
  Clone ID: SORBI-28MAY03-C49_315.pep

SEQ ID NO: 46982 - protein, 447 aa, Sorghum bicolor
  Clone ID: SORBI-28MAY03-C49_316.pep
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIHFVPISGFEGDNMIERSTNLDWYKGPTLLEALDLINEPKRPSDKPLRLPLQDVYKIGGIGTVPVGRVETGIIKPGMVVTFGPSGLTTEVKSVEMHHEALQEALPGDNVGFNVKNVAVKDLKRGYVASNSKDDPAKEAASFTSQVIIMNHPGQIGNGYAPVLDCHTSHIAVKFAELVTKIDRRSGKELEKEPKFLKNGDAGMVKMVPTKPMVVETFSEYPPLGRFAVRDMRQTVAVGVIKSVEKKDPTGAKVTKAAPKKK

SEQ ID NO: 46983 - protein, 258 aa, Sorghum bicolor
  Clone ID: SORBI-28MAY03-C49_317.pep
MAPKRGGRAPVPAKKKTDKVVNPLFEKRPKQFGIGGALPPKKDLHRFVKWPKVVRIQRQRRILKQRLKVPPALNQFTRTLDKNLATNLFKMLLKYRPEDKAAKKERLLKRAQAETEGKTVEAKKPIVVKYGLNHVTYLIEQNKAQLVVIAHDVDPIELVVWLPALCRKMEVPYCIVKGKARLGSIVHKKTASVLCLTTVKNEDKLEFSKILEAIKANFNDKFDEVRKKWGGGIMGSKSQAKTKAREKLIAKEAAQRMT

SEQ ID NO: 46984 - protein, 266 aa, Sorghum bicolor
  Clone ID: SORBI-28MAY03-C49_318.pep
MSPSEPTREESVYMAKLAEQAERYEEMVEFMERVARSAGGAGGGEELSVEERNLLSVAYKNVIGARRASWRIISSIEQKEEGRGNEAHAASIRAYRSKIEAELARICDGILALLDSHLVPSAGAAESKVFYLKMKGDYHRYLAEFKSGAERKDAAESTMNAYKAAQDIALADLAPTHPIRLGLALNFSVFYYEILNSPDRACNLAKQAFDEAISELDSLGEESYKDSTLIMQLLRDNLTLWTSDTNEDGGDEIKEAAAPKESTEGQ

SEQ ID NO: 46985 - protein, 476 aa, Sorghum bicolor
  Clone ID: SORBI-28MAY03-C49_319.pep
MRGWGLLVLSLHVLSCLVSGVASGRTSSYVRTEFPSTDIPLDSEWFAIPKGYNAPQQVHITQGDYDGKAVIVSWVTPEEPGPSEVFYGKEKQYDQKSEGTTTNYTFYDYKSGYIHHCLVDGLEYNTKYYYKIGSGDSAREFWFETPPAIDPDASYTFGIIGDLGQTFNSLSTLQHYEKTGGQTVLFVGDLSYADRYEHNDGIRWDSWGRFVERSTAYQSWIWNTGNHEIEYRPDLGETSTFKPYLHRYMTPYLASKSSSPMWYAVRRASAHIIVLSSYSPFVKYTPQWWWLKNEFKRVDREKTPWLIVLMHSPMYNSNEAHYMEGESMRAAFEKWFVKYKVDLVFAGHVHAYERSYRISNVNYNITSGNRYPVPNKSAPVYITVGDGGNQEGLASRFYDPQPDYSAFREASYGHSLLQLKNRTHAVYQWNRNHDGNPVPADTVVFHNQYWTSSTRRRRLKKNHFHLENLEDLISLF

SEQ ID NO: 46986 - protein, 192 aa, Sorghum bicolor
  Clone ID: SORBI-28MAY03-C49_320.pep
MYTARKKIQKEKGLEPSEFEDSVAQAFFDLENGNQELKSDLKDLYINNAIQMDVAGSRKAVVIHVPYRLRKAFRKIHVRLVRELEKKFSGKDVVIVATRRIVRPPKKGSAVQRPRTRTLTAVHDGILEDVVYPAEIVGKRVRYRLDGAKIIKIFLDPKERNNTEYKLETYTAVYRRLCGKEVVFEYPMTENA

SEQ ID NO: 46987 - protein, 151 aa, Sorghum bicolor
  Clone ID: SORBI-28MAY03-C49_321.pep
MATVLSSLRAPASTFPSSLRVAAAPAAPATVALLPAAGNKVPGMAARGARLRAQATYNVKLVTPEGEVELQCPDDVYILDQAQEEGIDLPYSCRAGSCSSCAGKVVAGSVDQSDQSFLDDDQIAAGWVLTCHAYPTSDVVIATHLEDELTG

SEQ ID NO: 46988 - protein, 147 aa, Sorghum bicolor
  Clone ID: SORBI-28MAY03-C49_322.pep
MASLAAAVSVQPVAVKGLSGSSISGRKLAVASRPSSSARAACRSTRRAAVVAKYGDKSVYFDLEDIGNTTGQWDLYGSDAPSPYNPLQSKFFETFAAPFTKRGLLLKFLLLGGGSLLAYVSASASPDLLPIKKGPQQPPQPGPRGKI

SEQ ID NO: 46989 - protein, 766 aa, Sorghum bicolor
  Clone ID: SORBI-28MAY03-C49_323.pep
MAAAAILPELATQVLIPVAAAVGIAFAVVQWVLVSKVRLTPERRADGGAAKSGPSDYLIEEEEGLNDHNVVVKCAEIQNAISEGATSFLFTEYKYVGLFMGIFAILIFLFLGSVEGFSTKSQPCHYSKGKTCKPALANAIFSTIAFVLGAVTSLVSGFLGMKIATYANARTTLEARKGVGKAFITAFRSGAVMGFLLAASGLLVLYIAINLFGIYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTPMVYPLLVSSVGIIACLVTTLFATDFFEIKAVSEIEPALKKQLIISTVVMTIGIALISWLGLPYTFTIFNFGEQKTVQSWQLFLCVAVGLWAGLVIGFVTEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDSAGNTTAAIGKGFAIGSAALVSLALFGAFVSRAAISTVDVLTPKVFIGLIVGAMLPYWFSAMTMKSVGSAALKMVEEVRRQFNTIPGLMEGTTKPDYATCVKISTDASIKEMIPPGALVMLTPLIVGILFGVETLSGVLAGALVSGVQIAISASNTGGAWDNAKKYIEAGASEHARTLGPKGSDPHKAAVIGDTIGDPLKDTSGPSLNILIKLMAVESLVFAPFFAAHGGILFKWL

SEQ ID NO: 46990 - protein, 579 aa, Sorghum bicolor
  Clone ID: SORBI-28MAY03-C49_324.pep
MASTFGATSTVGLMAAPAGKNVRLQRRANFRVKAAKELYFNKDGSAIKKLQTGVNKLADLVGVTLGPKGRNVVLESKYGSPKIVNDGVTVAREVELEDPVENIGAKLVRQAAAKTNDLAGDGTTTSVVLAQGLIAEGVKVVAAGANPVQITRGIEKTAKALVEELRKLSKDVEDSELADVAAVSAGNNYEIGNMIAEAMSKVGRKGVVTLEEGRSSENFLYVVEGMQFDRGYISPYFVTDSEKMSAEYENCKLLLVDKKITNARDLINVLEEAIRGAYPILIIAEDIEQEALATLVVNKLRGSLKIAAIKAPGFGERKTQYLDDIAILTGATVIRDEVGLSLDKADKSVLGTAAKVVLTKESTTIVGDGSTQEEVTKRVAQIKNLIEAAEQEYEKEKLNERIAKLAGGVAVIQVGAQTETELKEKKLRVEDALNATKAAVEEGIVVGGGCTLLRLAAKVDAIKDTLENDEQKVGAEIVRRALSYPLKLIAKNAGVNGSVVTEKVLSNDNFKYGYNAATGQYEDLMAAGIIDPTKVVRCCLEHAASVAKTFLTSDVVVVDIKEPEAAPLANPMDNSGYGY

SEQ ID NO: 46991 - protein, 253 aa, Sorghum bicolor
  Clone ID: SORBI-28MAY03-C49_325.pep
MGRKFFVGGNWKCNGTTDQVEKIVKTLNEGQVPPADVVEVVVSPPYVFLTVVKSLLRPEFHVAAQNCWVKKGGAFTGEVSAEMLVNLGVPWVILGHSERRALLGESNEFVGDKVAYALSQGLKVIACVGETLEQREAGSTMEVVAAQTKAIAEKISDWSNVVVAYEPVWAIGTGKVATPAQAQEVHASLRDWLKINVSPEVAESTRIIYGGSVTAANCKELGAQPDVDGFLVGGASLKPEFIDIINAATVKSA

SEQ ID NO: 46992 - protein, 630 aa, Sorghum bicolor
  Clone ID: SORBI-28MAY03-C49_326.pep
MAWSSGGVAATMAAALVAALVALAGRASASPAEGIQPLSKIAVHKATVEIQSSAFVEATPSLLGEQGEDTEWVTVKYGWTDPSDDDWIGVFSPSEFNSSATCPNPWPAEEPYLCTAPIKYQFANYSENYIFWGKGSIRLQLINQRSDFSFALFTGGLDNPKLIAVSEPIAFKNPKAPVFPRLAQGKSHDEMTVTWTSGYDISEAYPFVEWGALLVAAAGAAAPPQQTTRAPAGTLTFNQGSMCGEPARTVGWRDPGFIHTAFLRDLWPNKEYYYRIGHELHDGSVVWGKPYSFRAPPSPGQKSLQRIIVFGDMGKAERDGSNEYAAYQPGSLNTTDALISDLDNYDIVFHIGDMPYANGYISQWDQFTAQVAPITARKPYMVASGNHERDWPDTAAFWDVEDSGGECGVPAETYYYYPAENRANFWYKVDYGMFRFCVADSEHDWRIGTPQYEFIEHCLSTVDRKHQPWLIFATHRVLGYSSNAWYAGEGSFEEPEGRENLQRLWQKYRVDIAYFGHVHNYERTCPMYQSQCMTSEKSHYSGTMNGTIFVVAGGGGCHLSSYTTAIPKWSIYRDHDFGFTKLTAFNHSSLLFEYMKSSDGKVYDSFTIHRDYRDVLRCVHDSCFPTTLAT

SEQ ID NO: 46993 - protein, 364 aa, Sorghum bicolor
  Clone ID: SORBI-28MAY03-C49_327.pep
MEVRRLLCVVAVVVSCWALAAPVARCDPQVPCYFIFGDSLVDNGNNNYIVSLARANYPPYGIDFAGGPSGRFTNGLTTVDVIAQLLGFDNFIPPFAATSGDQLLGGANFASAAAGIRAETGQQLGGRIPFAGQVQNYQTAVQTLVSILGDQDTASDHLSRCIFSIGMGSNDYLNNYFMPAFYNTGSRYTPEQYADSLIADYRRYLQTLYSYGARKVVMIGVGQVGCAPNELARYSADGVTCVDRIDDAIQMFNRRLVGLVDEFNALPGAHFTFINAYNIFDDILANAASYGFTVTNAGCCGVGRNNGQVTCLPYQAPCANRDQHIFWDAFHPSEAANIIVGRRSYRAESPNDVYPMDISTLASI

SEQ ID NO: 46994 - protein, 203 aa, Sorghum bicolor
  unsure (1)..(203): unsure at all Xaa locations
  Clone ID: SORBI-28MAY03-C49_328.pep
AFISFFSWVDLLMRKKTSLPSCPLTLRLMWAPPASAGFLSSSPAPDIVDEGSELSSGRGQFPGDRSIGGGGGRRGFGARXRPPRRLQRQGAAGVRDAAAGVRRRGVRGGGLVRRAGVRGAGRARGRRGRGAPEGARRGRRVPPRGRATHRRAARHGARHRPRRDVRRRRLGVGAAAVPAAPDVVGVVLVTNKLPPATPCHAGR

SEQ ID NO: 46995 - protein, 177 aa, Sorghum bicolor
  Clone ID: SORBI-28MAY03-C49_329.pep
PFVKVLDQKFGIIKGTMTTTHSYTGDQRLLDASHRDLRRARAAALNIVPTSTGAAKAVSLVLPNLKGKLNGIALRVPTPNVSVVDLVVQVSKKTLAEEVNQASGDAAANELSGILEVCDVPLVSVDFRCSDVSSTIDASLTMVMGDDMVKVISWYDNEWGYSQRVVDLADICAIKWK

SEQ ID NO: 46996 - protein, 261 aa, Sorghum bicolor
  Clone ID: SORBI-28MAY03-C49_330.pep
MASAELSREENVYMAKLAEQAERYEEMVEFMEKVAKTVDSEELTVEERNLLSVAYKNVIGARRASWRIISSIEQKEEGRGNEDRVTLIKDYRGKIETELTKICDGILKLLESHLVPSSTAPESKVFYLKMKGDYYRYLAEFKTGAERKDAAENTMVAYKAAQDIALAELAPTHPIRLGLALNFSVFYYEILNSPDRACSLAKQAFDEAISELDTLSEESYKDSTLIMQLLRDNLTLWTSDISEDPAEEIREAPKRDSSEGQ

SEQ ID NO: 46997 - protein, 181 aa, Sorghum bicolor
  Clone ID: SORBI-28MAY03-C49_331.pep
QLQVVKAIENAIPVRQALPVAAAESSDPAWEEELKAMEAQKAEIDLAAAAQVRRELWCGLVYLVVQTAGFMRLTFWELSWDVMEPICFYVTSMYFMAGYAFFLRTKKEPSFEGFFESRFAAKQKRVMRARGFDLRRYEELRRAGGGVPTPVPPPLQQARTTPCASAGAQESGHCHSYCHCH

SEQ ID NO: 46998 - protein, 252 aa, Sorghum bicolor
  Clone ID: SORBI-28MAY03-C49_332.pep
HEGDNMIERSTNLDWYKGPTLLEALDLINEPKRPSDKPLRLPLQDVYKIGGIGTVPVGRVETGIIKPGMVVTFGPSGLTTEVKSVEMHHEALQEALPGDNVGFNVKNVAVKDLKRGYVASNSKDDPAKEAASFTSQVIIMNHPGQIGNGYAPVLDCHTSHIAVKFAELVTKIDRRSGKELEKEPKFLKNGDAGMVKMVPTKPMVVETFSEYPPLGRFAVRDMRQTVAVGVIKSVEKKDPTGAKVTKAAAKKK

SEQ ID NO: 46999 - protein, 337 aa, Sorghum bicolor
  Clone ID: SORBI-28MAY03-C49_333.pep
MSWFGHHHHNQPAPPASGPNQVFKIFCRANENYCLAVRDGAVVLAPTNPKDEHQHWYKDMRFSTRVKDEEGMPAFALVNKATGLAIKHSLGQSHPVKLAPFNPDQEDASVLWTESKDVGKGFRCIRMVNNTRLNFDAFHGDKDHGGVHDGTGVVLWEWCKGENQSWKILPWGPEANAAAGANGGVHTVRVFCKAGGEDYCLTVRNGTACLAPTNPRDEYQHWIKDMRHSTRVRDEEGYPAFALVNKVTGEALKHSTGQGHPVKLVPYNPEYQDESVLWTESRDVGNGFRCVRMVNNIYLNFDAFHGDKAHGGVHDGTEIVLWKWCEGDNQRWKILPW

SEQ ID NO: 47000 - protein, 268 aa, Sorghum bicolor
  Clone ID: SORBI-28MAY03-C49_334.pep
MAQSMLMSTSVNGGRALPSLQAGRPAPYPRLPLPSSSSGYRHSKSVSVKTLALFGKSKVKTAPSKKAAAPKPKPKVEDGIFGTSGGIGFTKENELFVGRVAMLGFAASLLGEAITGKGILAQLNLETGIPIYEAEPLLLFFILFTLLGAIGALGDRGRFVDEEVTGLDKAVIQPGKGFRGALGLSEGGPLFGFTKSNELFVGRLAQLGVAFSIIGEIITGKGALAQLNIETGVPINEIEPLVIFNVLFFFVAAINPGNGRFIIGEDEE

SEQ ID NO: 47001 - protein, 196 aa, Sorghum bicolor
  Clone ID: SORBI-28MAY03-C49_335.pep
MAYNGRDQRYGGGIATPGYAPPVPYGMSQVNIEGNGCGRPLPPQPTVKVYCRANPNYAMTIRDGRVVLAPANPKDEYQHWIKDMRWSTSIKDEEGYPAFALVNKATGEAIKHSLGQSHPVRLVPYNPDFLDESVLWTESRDVGNGFRCIRMVNNIYLNFDALHGDKWHGGVRDGTDIVLWKWCEGDNQRWKIQPYY

SEQ ID NO: 47002 - protein, 388 aa, Sorghum bicolor
  Clone ID: SORBI-28MAY03-C49_336.pep
MEAGYCNRKKTDGICEGVCDSELGSKSVLSMSRLKCALRGFDLRVLLILLIGVPILIFAIYVHGQKVTYFLRPIWEKPPKPFTIRPHYYHENVSMANLCKLHGWKVRETPRRVFDAVLFSNELDILDIRWHELSPYVSEFVLLESNSTFTGIKKDLHFKENRQRFDFAESRLTYGMIGGRFVKGENPFVEESYQRVALDQLIKIAGIQDDDLLIMSDVDEIPSGHTINLLRWCDDIPEILHLQLRNYLYSFQFLLDDKSWRASVHRYRAGKTRYAHFRQTDELLADSGWHCSFCFRYINDFIFKMKAYSHVDRIRFKYFLNPKRIQHVICEGADLFDMLPEEYTFQEIIAKLGPIPSTFSAVHLPAYLLEQNDRYRYLLPGNCIRESG

SEQ ID NO: 47003 - protein, 334 aa, Sorghum bicolor
  Clone ID: SORBI-28MAY03-C49_337.pep
MAGAQESLSLVGTMRAHNGEVTAIATPIDNSPFIVSASRDKSVLLWDLENPVHSTPESGVTADYGVPKRRLTGHSHFVQDVVLSSDGMFALSGSWDGELRLWDLSTGATTRRFVGHGKDILSVAFSVDNRQIISASRDKTIKLWNTLGECKYTIGGDLGGGEGHNGWVSCVRFSANTFQPTIVSGSWDRTVKVWNLTNCKLRCTLDGHGGYVNAVAVSPDGSLCASGGKDGVTLLWDLAEGKRLYSLDAGSIIHSLCFSPNRYWLCAATQDSVKIWDLESKHVVQDLKPDIQISKNQILYCSSMNWSADGSTLYTGYTDGSIRVWKISAYGYAG

SEQ ID NO: 47004 - protein, 844 aa, Sorghum bicolor
  unsure (1)..(844): unsure at all Xaa locations
  Clone ID: SORBI-28MAY03-C49_338.pep
MVKFTAEELRGIMDKKNNIRNMSVIAHVDHGKSTLTDSLVAAAGIIAQEVAGDVRMTDTRADEAERGITIKSTGISLYYEMTDESLKNYKGERDGNQYLINLIDSPGHVDFSSEVTAALRITDGXALVVVDCIEGVCVQTETVLRQALGERIRPVLTVNKMDRCFLELQVEGEEAYQTFSRVIENANVIMATYEDKLLGDVQVYPEKGTVAFSAGLHGWAFTLTNFAKMYASKFGVDESKMMERLWGENFFDPATKKWTTKNTGSPTCKRGFVQFCYEPIKQIINTCMNDQKEKLWPMLQKLNVTMKSDEKELIGKALMKRVMQTWLPASTALLEMMIFHLPSPAKAQKYRVENLYEGPLDDVYATAIRNCDPEGPLMLYVSKMIPASDKGRFFAFGRVFSGKVATGMKVRIMGPNYVPGQKKDLYVKSVQRTVIWMGKKQESVEDVPCGNTVAMVGLDQFITKNATLTNEKEVDACPIRAMKFSVSPVVRVAVQCKVASDLPKLVEGLKRLAKSDPMVLCTIEESGEHIIAGAGELHLEICLKDLQEDFMGGAEIIVSPPVVSFRETVLEKSCRTVMSKSPNKHNRLYMEARPLEEGLAEAIDDGRIGPRDDPKVRSQILSQEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPENALGGIYGVLNQKRGHVFEEMQRPGTPLYNIKAYLPVIESFGFSSQLRAATSGQAFPQCVFDHWDMMGSDPLEAGSQAAQLVLDIRKRKGLKEQMTPLSEFEDKL

SEQ ID NO: 47005 - protein, 601 aa, Sorghum bicolor
  unsure (1)..(601): unsure at all Xaa locations
  Clone ID: SORBI-28MAY03-C49_339.pep
MAKSEGPAIGIDLGTTYSCVGVWQHDRVEIIANDQGNRTTPSYVAFTDTERLIGDAAKNQVAMNPTNTVFDAKRLIGRRFSDPSVQSDMKLWPFKVIPGPGDKPMIVVNYKGEEKQFAAEEISSMVLIKMREIAEAYLGSTIKNAVVTVPAYFNDSQRQATKDAGVIAGLNVMRIINEPTAAAIAYGLDKKATSAGEKNVLIFDLGGGTFDVSLLTIEEGIFEVKATAGDTHLGGEDFDNRMVNHFVQEFKRKHKKDLSGNPRALRRLRTACERAKRTLSSTAQTTIEIDSLFEGIDFYSTITRARFEELNMDLFRKCMEPVEKCLRDAKMDKSSVHDVVLVGGSTRIPKVQQLLQDFFNGKELCKSINPDEAVAYGAAVQAAILSGEGNEKVQDLLLLDVTPLSLGLETAGGVMTVLIPRNTTIPTKKEQVFSTYSDNQPGVLIQVYEGERARTKDNNLLGKFELSGIPPAPRGVPQITVTFDIDANGILNVSAEDKTTGQKNKITITNDKGRLSKEEIEKMVQEAEKYKAEDEEVKKKVDAKNTLENYAYNMRNTIXICNPIIAKMYQGAGAGMGDAAGMDEDAPSGGSGAGPKIEEVD

SEQ ID NO: 47006 - protein, 342 aa, Sorghum bicolor
  Clone ID: SORBI-28MAY03-C49_340.pep
DELNENRNLVWNKRVKARLILISSTNTNREHALLAFTLGVKQMICCCNKMDATTPKYSKARYDEIVKEVSSYLKKVGYNPDKIHFVPISGFEGDNMIERSTNLDWYKGPTLLEALDLINEPKRPSDKPLRLPLQDVYKIGGIGTVPVGRVETGIIKPGMVVTFGPSGLTTEVKSVEMHHEALQEALPGDNVGFNVKNVAVKDLKRGYVASNSKDDPAKEAASFTSQVIIMNHPGQIGNGYAPVLDCHTSHIAVKFAELVTKIDRRSGKELEKEPKFLKNGDAGMVKMVPTKPMVVETFSEYPPLGRFAVRDMRQTVAVGVIKSVEKKDPTGAKVTKAAAKKK

SEQ ID NO: 47007 - protein, 372 aa, Sorghum bicolor
  Clone ID: SORBI-28MAY03-C49_341.pep
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIHFVPISGFEGDNMIERSTNLDWYKGPTLLEALDLINEPKRPSDKPLRLPLQDVYKIGGIGTVPVGRVETGIIKPGMVVTFGPSGLTTEVKSVEMHHEALQEALPGDNVGFNVKNVAVKDLKRGYVASNSKDDPAKEAASFTSQVIIMNHPGQIGNGYAPVLDCHTSHIAVKFAELVTKAAAKKK

SEQ ID NO: 47008 - protein, 351 aa, Sorghum bicolor
  Clone ID: SORBI-28MAY03-C49_342.pep
MFGFGHHGHHHGENPPAHPPAHGGVHPPTFKIFCKADEGYCLTVRDGNVVLAPSNPRDEHQHWYKDMRFSNQIKDEEGNPAFALVNKATGLAIKHSLGQSHPVKLVPFNPEYQDESVLWTESGDVGKGFRCIRMVNNIRLNFDAFHGDKDHGGVHDGTTVVLWEWAKGDNQSWKILPWGDEAYAGGSGGAAANAPYGHGEPTVRIYCKADDGFSVTVRNGSVCLAPTNPRDEYQHWVKDMRHSNRIKDEEGYPAFALVNRVTGEAIKHSQGEGHPVKLVPYNPNYQDESVLWTESRDVGHGFRCIRMVNNIYLNFDAFHGDKDHGGVRDGTAVVLWKWCEGDNQRWKIVPW

SEQ ID NO: 47009 - protein, 166 aa, Sorghum bicolor
  unsure (1)..(166): unsure at all Xaa locations
  Clone ID: SORBI-28MAY03-C49_343.pep
MAASDVEYRCFVGGLAWATDDNALHSAFSTYGEVLESKIILDRETQRSRGFGFVTFSTEEAMRSAIEGMNGKELDGRNITVNEAQSRGGRGGGGGGGYGGGRGGXGGGYGRRDGGGGGYGGGGGGYGGGRGGYGGGGGGYGGGGGGYGGGSRGGGGYGNSDGNWRN

SEQ ID NO: 47010 - protein, 608 aa, Sorghum bicolor
  Clone ID: SORBI-28MAY03-C49_344.pep
MAKGEGPAIGIDLGTTYSCVGVWQHDRVEIIANDQGNRTTPSYVAFTDTERLIGDAAKNQVAMNPTNTVFDAKRLIGRRFSDPSVQSDMKLWPFKVVAGPADKPMIVVNYKGEEKQFSAEEISSMVLTKMKEIAEAYLGSTIKNAVVTVPAYFNDSQRQATKDAGVISGLNVMRIINEPTAAAIAYGLDKKATSSGEKNVLIFDLGGGTFDVSLLTIEEGIFEVKATAGDTHLGGEDFDNRMVNHFVQEFKRKHKKDISGNPRALRRLRTACERAKRTLSSTAQTTIEIDSLYEGIDFYTTITRARFEELNMDLFRKCMEPVEKCLRDAKMDKSSVHDVVLVGGSTRIPKVQQLLQDFFNGKELCKSINPDEAVAYGAAVQAAILSGEGNEKVQDLLLLDVTPLSLGLETAGGVMTVLIPRNTTIPTKKEQVFSTYSDNQPGVLIQVYEGERARTKDKTTGQKNKITITNDKGRLSKEEIEKMVQEAEKYKAEDEEVKKKVDAKNTLENYAYNMRNTIKDDKIASKLPAEDKKKIEDAVDSAISWLDSNQLAEVDEFEDKMKELEGICNPIIAKMYQGAGAGMGDAAGMDEDAPSGGSGAGPKIEEVD

SEQ ID NO: 47011 - protein, 283 aa, Sorghum bicolor
  unsure (1)..(283): unsure at all Xaa locations
  Clone ID: SORBI-28MAY03-C49_345.pep
MALAPSKILGTQLNFAGSSRYATAAPTAGAQKIVSLFSKKPAQKPKPVPVSSSSPDISDELAKWYGPDRRIYLPDGLLDRSEVPEYLTGEVPGDYGYDPFGLGKKPEDFAKYQAYELIHARWAMLGAAGAVIPEACNKFGANCGPEAVWFKTGALLLDGNTLNYFGNSIPINLVVAVIAEVVLVGGAEYYRIINGLDLEDKLHPGGPFDPLGLASDPDQAAILKVKEIKNGRXLAMFSMLAFFIQAYVTGEGPVENLAKHLSDPFGNNLLTVISGAAERTPSL

SEQ ID NO: 47012 - protein, 843 aa, Sorghum bicolor
  Clone ID: SORBI-28MAY03-C49_346.pep
MVKFTAEELRGIMDKKNNIRNMSVIAHVDHGKSTLTDSLVAAAGIIAQEVAGDVRMTDTRADEVERGITIKSTGISLYYEMTDESLKNYKGERDGNQYLINLIDSPGHVDFSSEVTAALRITDGALVVVDCIEGVCVQTETVLRQALGERIRPVLTVNKMDRCFLELQVEGEEAYQTFSRVIENANVIMATYEDKLLGDVQVYPEKGTVAFSAGLHGWAFTLTNFAKMYASKFGVDESKMMERLWGENFFDPATKKWTTKNTGSPTCKRGFVQFCYEPIKQIINTCMNDQKEKLWPMLQKLNVTMKADEKELIGKALMKRVMQTWLPASTALLEMMIFHLPSPAKAQKYRVENLYEGPLDDVYATAIRNCDPEGPLMLYVSKMIPASDKGRFFAFGRVFSGKVATGMKVRIMGPNYVPGQKKDLYVKSVQRTVIWMGKKQESVEDVPCGNTVAMVGLDQFITKNATLTNEKEVDACPIRAMKFSVSPVVRVAVQCKVASDLPKLVEGLKRLAKSDPMVLCTIEESGEHIIAGAGELHLEICLKDLQEDFMGGAEIIVSPPVVSFRETVLEKSCRTVMSKSPNKHNRLYMEARPLEEGLAEAIDEGRIGPRDDPKVRSQILSQEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPENALGGIYGVLNQKRGHVFEEMQRPGTPLYNIKAYLPVIESFGFSSQLRAATSGQAFPQCVFDHWDMMGSDPLEAGSQAAQLVLDIRKRKGLKEQMTPLSEFEDKL

SEQ ID NO: 47013 - protein, 802 aa, Sorghum bicolor
  unsure (1)..(802): unsure at all Xaa locations
  Clone ID: SORBI-28MAY03-C49_347.pep
MAAKLTRLHSLRERLGATFSSHPNELIALFSRYVNQGKGMLQRHQLLAEFDALFDSDKEKYAPFEDFLRAAQEAIVLPPWVALAIRPRPGVWDYIRVNVSELAVEELSVSEYLAFKEQLVDGNSNSNFVLELDFEPFNASFPRPSMSKSIGNGVQFLNRHLSSKLFQDKESLYPLLNFLKAHNYKGTTMMLNDRIQSLRGLQSSLRKAEEYLLSVPQDTPYSEFNHRFQELGLEKGWGDTAKRVLDTLHLLLDLLEAPDPANLEKFLGTIPMMFNVVILSPHGYFAQSNVLGYPDTGGQVVYILDQVRALENEMLLRIKQQGLDITPKILIVTRLLPDAVGTTCGQRLEKVIGTEHTDIIRIPFRNENGILRKWISRFDVWPYLETYTEDVASEIMLEMQAKPDLIVGNYSDGNLVATLLAHKLGVTQCTIAHALEKTKYPNSDIYLDKFDSQYHFSCQFTADLIAMNHTDFIITSTFQEIAGSKDTVGQYESHIAFTLPGLYRVVHGIDVFDPKFNIVSPGADMSVYYPYTETDKRLTAFHPEIEELIYSDVENDEHKFVLKDKNKPIIFSMARLDRVKNMTGLVEMYGKNARLRELANLVIVAGDHGKESKDREEQAEFKKMYSLIDEYNLKGHIRWISAQMNRVRNAELYRYICDTKGAFVQPAFYEAFGLTVIESMTCGLPTIATCHGGPAEIXVDGVSGLHIDPYHSDRAADILVNFFEKCKADPSYWDKISQGGLQRIYEKYTWKLYSERLMTLTGVYGFWKYVSNLERRETRRYLEMFYALKYRSLASAVPLSYD

SEQ ID NO: 47014 - protein, 381 aa, Sorghum bicolor
  Clone ID: SORBI-28MAY03-C49_348.pep
MESGAPSGPFLVSSPADEMAQRRLLALAAVLALALAGTAAADNSDFADSNTIRSVTDRAASALESTVFGALGRTRDALRFARFAVRYGKSYESAAEVQKRFRIFSESLQLVRSTNRKGLSYRLGINRFSDLSWEEFRATRLGAAQNCSATLAGNHRMRAAAVALPKTKDWREDGIVSPVKNQGHCGSCWTFSTTGALEAAYTQATGKPISLSEQQLVDCGKPFNNFGCNGGLPSQAFEYIKYNGGLDTEESYPYKGVNGICDFKAENVGVKVLDSVNITLGAEDELKDAVALVRPVSVAFQVVNGFRQYKSGVYTSDSCGNTPMDVNHAVLAVGYGVENGVPYWLIKNSWGADWGDKGYFKMEMGKNMCGVATCASYPIVA

SEQ ID NO: 47015 - protein, 480 aa, Sorghum bicolor
  Clone ID: SORBI-28MAY03-C49_349.pep
MVKICCIGAGYVGGPTMAVIALKCPDIEVVVVDISKPRIEAWNSDTLPIYEPGLDDVVKQCRGKNLFFSTDVEKHVAEADIIFVSVNTPTKTRGLGAGKAADLTYWESAARMIADVSKSDKIVVEKSTVPVKTAEAIEKILTHNSKGINYQILSNPEFLAEGTAIEDLFKPDRVLIGGRETPEGRKAVQALKDVYAHWVPEDRILTTNLWSAELSKLAANAFLAQRISSVNAISALCEATGANVSEVAYAVGKDTRIGPKFLNASVGFGGSCFQKDILNLVYICECNGLPEVAHYWKQVIKINDYQKSRFVNRVVSSMFNTVAGKKIAVLGFAFKKDTGDTRETPAIDVCKGLLGDKAQISIYDPQVTEDQIQRDLAMNKFDWDHPMHLQPTSPTAVKQVSCVWDAYEATKGAHGLCILTEWDEFKTLDYQKIFDNMQKPAFVFDGRNIVDPEKLREIGFIVYSIGKPLDAWLKDMPAVA

SEQ ID NO: 47016 - protein, 483 aa, Sorghum bicolor
  Clone ID: SORBI-28MAY03-C49_350.pep
MANNSSFGENGRRKPHTPTAIVIGGGFAGLAAADALRNASFQVILLESRDRIGGRVHTDYSFGFPVDLGASWLHGVCEENPLAPIIGRLGLPLYRTSGDDSVLFDHDLESYALYDTNGRQVPQELVEKIGKVFETILEETGKLREGTNEDMSIAKAIAIVMDRNPHFRQEGIAHEVLQWYLCRMEGWFATDADSISLQGWDQEVLLPGGHGLMVRGYRPVINTLAKGLDIRLNHKVVEIVRHRNRVEVTVSSGKTFVADAAVVAVPLGVLKAQTIKFEPRLPDWKEEAIRELTVGIENKIVLHFGQVFWPNVEFLGVVSSSTYGCSYFLNLHKATGHPVLVYMPAGRLARDIEKMSDEAAAQFAFSQLKKILPNAAEPINYLVSHWGSDENSLGSYTFDGVNKPRDLYEKLRIPVDNLFFAGEATSLKYTGTVHGAFSTGVMAAEECKMRVLERFRELDMLEMCHPAMGEDSPVSVPLLISRL

SEQ ID NO: 47017 - protein, 379 aa, Sorghum bicolor
  Clone ID: SORBI-28MAY03-C49_351.pep
MATAGKVIKCRAAVAWEAGKPLSIEEVEVAPPQAMEVRVKILFTSLCHTDVYFWEAKGQTPVFPRIFGHEAGGIVESVGEGVTDLAPGDHVLPVFTGECKECAHCKSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGIDLNANRFEEAKKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFTEINKAFDLMAKGEGIRCIIRMEN

SEQ ID NO: 47018 - protein, 215 aa, Sorghum bicolor
  Clone ID: SORBI-28MAY03-C49_352.pep
MAPMKLYGATVSWNVTRCVVALEEAGAEYQIVPIDFATAEHKSPEHLARNPFGQVPAFQDRDLHLWESRAICKYVARKNKAAELLREGNLQESAMVDVWLEVESNQYTAALNPILYECLVSPMFGGTTDQKVVEENLEKLKKVLEVYEARLAKHKYLAGDFLSLADLNHVSVTLCLLATPHASVLNAYPHVKAWWDGLMARPSVQKVAALMKPSA

SEQ ID NO: 47019 - protein, 446 aa, Sorghum bicolor
  unsure (1)..(446): unsure at all Xaa locations
  Clone ID: SORBI-28MAY03-C49_353.pep
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDXLKEVSSYLKKVGYNPDKIHFVPISGFEGDNMIERSTNLDWYKGPTLLEALDLINEPKRPSDKPLRLPLQDVYKIGGIGTVPVGRVETGIIKPGMVVTFGPSGLTTEVKSVEMHHEALQEALPGDNVGFNVKNVAVKDLKRGYVASNSKDDPAKEAASFTSQVIIMNHPGQIGNGYAPVLDCHTSHIAVKFAELVTKIDRRSGKELEKEPKFLKNGDAGMVKMVPTKPMVVETFSEYPPLGRFAVRDMRQTVAVGVIKSVEKKDPTGAKVTKAAAKKK

SEQ ID NO: 47020 - protein, 396 aa, Sorghum bicolor
  Clone ID: SORBI-28MAY03-C49_354.pep
MAAVDTFLFTSESVNEGHPDKLCDQVSDAVLDACLAEDPDSKVACETCTKTNMVMVFGEITTKANVDYEKIVRETCRNIGFVSADVGLDADHCKVLVNIEQQSPDIAQGVHGHFTKRPEEIGAGDQGHMFGYATDETPELMPLSHVLATKLGAKLTEVRKNGTCAWLRPDGKTQVTVEYRNEGGAMVPIRVHTVLISTQHDETVTNDEIAADLKEHVIKPVIPEQYLDEKTIFHLNPSGRFVIGGPHGDAGLTGRKIIIDTYGGWGAHGGGAFSGKDPTKVDRSGAYIARQAAKSIVANGLARRAIVQVSYAIGVPEPLSVFVDTYGTGTIPDKEILKIVKENFDFRPGMIIINLDLKKGGNGRYLKTAAYGHFGRDDPDFTWEVVKPLKAEKPSA

SEQ ID NO: 47021 - protein, 486 aa, Sorghum bicolor
  Clone ID: SORBI-28MAY03-C49_355.pep
ARGVIAGLNVLRIINEPTAAAIAYGLDKKATSVGEKNVLIFDLGGGTFDVSLLTIEEGIFEVKATAGDTHLGGEDFDNRMVNHFVQEFKRKNKKDITGNPRALRRLRTACERAKRTLSSTAQTTIEIDSLYEGIDFYSTITRARFEELNMDLFRKCMEPVEKCLRDAKMDKSSVHDVVLVGGSTRIPRVQQLLQDFFNGKELCKNINPDEAVAYGAAVQAAILSGEGNEKVQDLLLLDVTPLSLGLETAGGVMTVLIPRNTTIPTKKEQVFSTYSDNQPGVLIQVYEGERTRTRDNNLLGKFELSGIPPAPRGVPQITVCFDIDANGILNVSAEDKTTGQKNKITITNDKGRLSKEEIEKMVQDAEKYKSEDEEHKKKVEAKNSLENYAYNMRNTIKDEKIASKLAGDDKKKIEDAIDAAISWLDANQLAEADEFEDKMKELESLCNPIIAKMYQGAGADMGGAGGMDEDAPAGSGGPGPKIEEVD

SEQ ID NO: 47022 - protein, 444 aa, Sorghum bicolor
  Clone ID: SORBI-28MAY03-C49_356.pep
MATHAALAASRIPTSARLHSRAASRQRVDFADFSGLRPGSCSVSTAAREVSFSDVLGAQLVAKATGENAVRAPAEAKLKVAINGFGRIGRNFLRCWHGREDSPLDVVVVNDSGGVRNASHLLKYDSMLGTFKADVKIVDDTTISVDGKPITIVSSRDPLKLPWAELGIDIVIEGTGVFVDGPGAGKHIQAGAKKVIITAPAKGADIPTYVVGVNEGDYDHSVADIISNASCTTNCLAPFVKVLDEEFGIVKGTMTTTHSYTGDQRLLDASHRDLRRARAAALNIVPTSTGAAKAVALVLPQLKGKLNGIALRVPTPNVSVVDLVINTVKTGITADDVNAAFRKAADGPLNGVLSVCDVPLVSVDFRCSDVSSTIDASLTMVMGDDMVKVVAWYDNEWGYSQRVVDLAHLVAAKWPGAAAAGSGDPLEDFCKDNPETDECKVYEA

SEQ ID NO: 47023 - protein, 212 aa, Sorghum bicolor
  Clone ID: SORBI-28MAY03-C49_357.pep
MAEEAAKKVEVEVTKDKEPEAAPAEAVPEAAAKEDVAEEKAVIPATEPPAAEEKPPADDSKALAIVEKVADEPAPEKPAAEKQGGSNDRDLALARVETEKRNSLIKAWEENEKTKAENKAAKKVSAILSWENTKKANIEAQLKKIEEQLEKKKAEYAEKMKNKVAMIHKEAEEKRAMVEAKRGEEVLKAEEMAAKYRATGHAPKKLIGCFGA

SEQ ID NO: 47024 - protein, 203 aa, Sorghum bicolor
  unsure (1)..(203): unsure at all Xaa locations
  Clone ID: SORBI-28MAY03-C49_358.pep
GKTNLSHDGLNPAHVPYWRVNNPNLAEFCFXSVGRADIEESKSDVALNAWPPQASYPYGNYSDTSIAKXIDRPCFHSLYSYLKINKIKXAFTLLFNTRFLFLLSSSXGHLCYHLTDVPPQPNSPSEMFSISFFIREKYKXIYGSGISRLFFYNSHLFYTHKNTSQFQTRVKLNRVFFPXADLAKPVPLAVSSLDGKXGQWESR

SEQ ID NO: 47025 - protein, 766 aa, Sorghum bicolor
  Clone ID: SORBI-28MAY03-C49_359.pep
MASHIVGYPRMGPKRELKFALESFWDGKSTAEDLEKVATDLRASIWKQMADAGIKYIPSNTFSYYDQVLDTTAMLGAVPERYSWTGGEIGFDTYFSMARGNATVPAMEMTKWFDTNYHFIVPELGPNTKFSYASHKAVNEYKEAKALGVDTVPVLIGPVSYLLLSKPAKGVEKGFPLLSLLSSILPVYKEVIAELKAAGASWIQFDEPTLVLDLDSNKLAAFSAAYAELESALSGLNVLVETYFADVPAESYKTLTSLSGVTAYGFDLVRGTQTLGLVTSAGFPAGKYLFAGVVDGRNIWADDLATSLSTLQSLEAVVGKDKLVVSTSCSLMHTAVDLVNETKLDSEIKSWLAFAAQKVVEVDALAKALAGQKDEAYFAANAAAQASRKSSPRVTNEEVQKAAAALKGSDHRRATTVSARLDAQQKELNLPVLPTTTIGSFPQTVELRRVRREYKAKKISEEEYISAIKEEISKVVKLQEELDIDVLVHGEPERNDMVEYFGEQLSGFAFTANGWVQSYGSRCVKPPIIYGDVSRPNPMTVFWSKTAQSMTSRPMKGMLTGPVTILNWSFVRNDQPRFETCYQIALAIKKEVEDLEAAGIKVIQIDEAALREGLPLRKAEHAFYLDWAVHSFRITNCEIQDTTQIHTHMCYSNFNDIIHSIIDMDADVITIENSRSDEKLLSVFREGVKYGAGIGPGVYDIHSPRIPSTEEIADRVNKMLAVLDTNILWVNPDCGLKTRKYAEVKPALTNMVSAAKLIRTQLASAK

SEQ ID NO: 47026 - protein, 250 aa, Sorghum bicolor
  Clone ID: SORBI-28MAY03-C49_360.pep
MPISRIAVGTHHEVYHPGALKAALAEFISTLIFVFAGQGSGMAFSKLTSGGATTPSGLIAAAVAHAFALFVAVSVGANISGGHVNPAVTFGAFVGGNITLFRGLLYWVAQLLGSTVACFLLRFSTGGLATGTFGLTGVSVWEAVVMEIVMTFGLVYTVYATAVDPKKGSLGTIAPIAIGFIVGANILVGGAFTGASMNPAVSFGPALVSWEWGYQWVYWVGPLIGGGLAGVIYELLFISQTHEQLPTTDY

SEQ ID NO: 47027 - protein, 448 aa, Sorghum bicolor
  unsure (1)..(448): unsure at all Xaa locations
  Clone ID: SORBI-28MAY03-C49_361.pep
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIHFVPISGFEGDNMIERSTNLDWYKGPTLLEALDLINEPKRPSDKPLRLPLQDVYKIGGIGTVPVGRVETGIIKPGMVVTFGPSGLTTEVKSVEMHHEALQEALPGDNVGFNVKNVAVKDLKRGYVASNSKDDPAKEAASFTSQVIIMNHPGQIGNGYAPVLDCHTXSHIAVKFAELVTKIDRRSGKELEKEPKFLKNGDAGMVKMVPTKPMVVETFSEYPPLGRFAVRDMRQTVAVGVIKSVEKKDPTGAKVTKAAAKKK

SEQ ID NO: 47028 - protein, 115 aa, Sorghum bicolor
  Clone ID: SORBI-28MAY03-C49_362.pep
MSDLDVQIPTAFDPFAEANAGDSGAAAGSKDYVHVRIQQRNGRKSLTTVQGLKKEFSYSKILKDLKKEFCCNGTVVQDPELGQVIQLQGDQRKNVSNFLVQAGIVKKEHIKIHGF

SEQ ID NO: 47029 - protein, 713 aa, Sorghum bicolor
  unsure (1)..(713): unsure at all Xaa locations
  Clone ID: SORBI-28MAY03-C49_363.pep
MAAVAPPPAPAPAAPAPAAAAAAAPAPAPATVPVADQTTDLLQKLSLDPQPKAADATEPTAAAKKQGAVTSQPLSVAIPPERSITPVLQDFMDPNLFYLPAYYYGGYDSSMSEWDDYPRYLNSDGVEIAPAVYGDIYGYGYAPYGAYSPATSPAPTVDGQMFGAQHYQYXPTAYFQPPTPVPSTTQSDLQSSNNTEKPAAKADPAKTTANGVPNGTAHSNSGTVPLASSQQNSSLTPDGTYRAPLLGGVPSAGYLDMTYGYDSTGAHFAWYDGSAYANGQQRTTTTNHYPSSTFSGNGSSARNQNKSSTTPQMQGMQNRRPTTTSATPTYTNRMYPSSRPYTQYGNSIKTGLPYGSNGYDSRIYGRWGVGMDNRYRPRGRNGYYGYGNESQDGTIELNRGPRSGRFKNQKLYGHTVTIAVKGQSLPSGESKNDSAVPDRAQFNRDDFPVQYDAAKFFVIKSYSEDDIHKSVKYNVWASTTNGNKKLDAAYQEAQSKGSACPIFLFFSVNTSGQFVGVAEMTGAVDFEKTLEYWQQDKWNGSFSVKWHIVKDVPNNILKHIILENNENKPVTNSRDTQEIHLEQGLQMLKIFKDHVSKTSILDDFTFYESRQKLMQDKRSKQQQVQKQVWDSRTPISVTSEQQQEAANGKPNPSDVPNGVTAEVKAVKAPAEKPVLANGVTNGVTTTPAVSYAAKVAQTATGKPILANGVAKTG

SEQ ID NO: 47030 - protein, 145 aa, Sorghum bicolor
  Clone ID: SORBI-28MAY03-C49_364.pep
ADPKGRGNPGRQRDLACCPAPRAAPVRNPPQPARQAPPPAPVRDGGGSILGGIGSTIAQGMAFGTGSAMAHRAVDAVMGPRTIQHETVVSEAAASAPAAPAMNTDACGIHSKAFQDCLNNYGSDISKCQFYLDMLNECRRGGVSA

SEQ ID NO: 47031 - protein, 389 aa, Sorghum bicolor
  Clone ID: SORBI-28MAY03-C49_365.pep
MLVTLMNLLRACWRPSNRHARTGSDVTGRQDGLLWYKDAGQHVNGEFSMAVVQANNLLEDQCQIESGPLSFLDSGPYGTFVGVYDGHAGAETACYINEHLFQNLKRFASEQNAMSADVLKKAYEATEDGFFSVVTKQWPIKPQIAAVGSCCLVGVICGGVLYVANVGDSRAVLGRHVKATGEVLAVQLSAEHNVSIESVRKELQSMHPEDRHIVVLKHNVWRVKGLIQVCRSIGDAYLKKQEFNREPLYAKFRLREPFNKPILSSEPSICVQPLQPHDQFLIFASDGLWEHLTNQEAVDIVHSSPRSGCARRLIRAALQEAAKKREMRYSDLKKIDRGVRRHFHDDITVIVVFLDSSLVSRASTHRGPTLSLRGGGASAGLRSNTLAPT

SEQ ID NO: 47032 - protein, 170 aa, Sorghum bicolor; identical to SEQ ID NO: 46883
  Clone ID: SORBI-28MAY03-C49_366.pep

SEQ ID NO: 47033 - protein, 397 aa, Sorghum bicolor
  Clone ID: SORBI-28MAY03-C49_367.pep
MAVLSAADAPPVSAIGFEGYEKRLEITFSEAPVFADPHGRGLRALSRAQIDSVLDLARCTIVSELSNKDFDSYVLSESSLFIYPLKIVIKTCGTTKLLLTIPRILELAEELSMPLAAVKYSRGTFIFPGAQPAPHRSFSEEVAALNRYFGGLKSGGNAYVIGDPARPGQKWHIYYATEYPEQPVVNLEMCMTGLDKKKASVFFKTNADGNTTCAKEMTKLSGISEIIPEMEICDFDFEPCGYSMNAIHGSAFSTIHVTPEDGFSYASYEVMGFDATALSYGDLVKRVLRCFGPLEFSVAVTIFGGRGQAGTWGKQLGAEVYDCNNMVEQELPGGGLLIYQSFCAAEDAVATSPKSVLHCFEGVNMENAPPVKDRKLANLLCWEEVDAMEEKDGVLDE

SEQ ID NO: 47034 - protein, 457 aa, Sorghum bicolor
  unsure (1)..(457): unsure at all Xaa locations
  Clone ID: SORBI-28MAY03-C1789_1.pep
MDPTKFRPSSSHDTTVTTTNAGAPVWNDNEALTVGPRGPILLEDYHLIEKVAHFARERIPERVVHARGASAKGFFECTHDVASLTCADFLRSPGVRTPVIVRFSTVIHERGSPETIRDPRGFAVKFYTREGNWDLLGNNFPVFFIRDGIKFPDVIHAFKPNPRSHVQEYWRVFDFLSHLPESLHTFFFLFDDVGVPTDYPHXEEAALVGGRNHSHATQDLYDSIAAGSFPEWKLFVQVMDPDTEDQYDFDPLDDTKTWPEDLLPLQPVGRLVLDKNVDNFFNENEQLAFGPGLVVPGIYYSDDKMLQCRVFAYADTQRYRLGPNYLMLPVNAPRCAHHNNHYDGAMNFMHRDEEVDYYPSRHAPLRQAPPVPIPARPVVGKRQKETIRKPNDFKQPGERYRSWDADRQERFVRRFADSLGHPKVSQELRSIWIDLLSKCDASLGMKIATRLNMKPNM

SEQ ID NO: 47035 - protein, 98 aa, Sorghum bicolor
  Clone ID: SORBI-28MAY03-C3050_3.pep
MAKRLLPSLNRVLVEKLVQPKKTAGGILLPETSKQLNAAKVVAVGPGERDKAGNLIPVALKEGDTVLLPEYGGTEVKLAADKEYLLLREHDILGTLVD

SEQ ID NO: 47036 - protein, 589 aa, Sorghum bicolor
  unsure (1)..(589): unsure at all Xaa locations
  Clone ID: SORBI-28MAY03-C3050_1.pep
MCGILAVLGCSDWSQARRARVLACARRLKHRGPDWSGLYQHEGNFLAQQRLAIVSPLSGDQPLFNEDRTVVVVANGEIYNHKNIRKQFTGTHNFTTGSDCEVIIPLYEKYGENFVDMLDGVFAFVLYDTRDRTYVAARDAIGVNPLYIGWGSDGSVWISSEMKALNEDCVRFEIFPPGHLYSSAAGGFRRWYNPQWFQEQVPRTAPYQPLVLRDAFEKAVIKRLMTDVPFGVLLSGGLDSSLVASVTKRHLVKTEAAEKFGTELHSFVVGLEGSPDLKAAREVADYLGTIHHEFHFTVQDGIDAIEEVIYHDETYDVTTIRASTPMFLMARKIKSLGVKMVLSGEGSDELLGGYLYFHFAPNKEEFHKETCRKVKALHQYDCLRDRSKRFSLMMIDDACRYIIITIIKXKIVEARRAGEERRRRNPLDSRLRHMMMMMVDHYMGNRNQNPRTTNAAAGTRATKPSSXKLTEQQVTDAMTRKATHTVPSNAHVNKEAYYYRMIFERLFPQDSARETVPWGXSIACSTPAAIEWVEQWKASNDPSGRFISSHDSATDNTGGGKLAVVANGGHGAANGTVNGGNDVAVAIAV

SEQ ID NO: 47037 - protein, 235 aa, Sorghum bicolor
  unsure (1)..(235): unsure at all Xaa locations
  Clone ID: LIB5049-012-R1-XP1-H9.pep
MGKDDVIESGAAGGEFAAKDYTDPPPAPLIDAAELGSWSLYRAVIAEFIATLLFLYITVATVIGYKHQTDATASGADAACGGVGVLGIAWAFGGMIFVLVYCTAGISGGHINPAVTFGLFLARKVSLVRALLYIVAQCLGAICGVGLVKAFQSAYFDRYGGGANSLASGYSRGTGLGAEIIGTFVLVYTVFSATDPKRNARDSHVPVLAPLPXRFAVFMVHLATIPVTGNGINPA

SEQ ID NO: 47038 - protein, 167 aa, Sorghum bicolor
  unsure (1)..(167): unsure at all Xaa locations
  Clone ID: LIB3476-051-P1-K1-H12.pep
HASGGGEFAAKDYTDPPPAPLIDAAELGSWSLYRAVIAEFIATLLFLYITVATVIGYKHQTDATASGADAACGGVGVLGIAWAFGGMIFVLVYCTXRALLYIVAQCLGAICGVGLVKAFQSAYFDRYGGGANSLASGYSRGTGLGAXIIGTFVLVYTVFSATDPKRN

SEQ ID NO: 47039 - protein, 90 aa, Sorghum bicolor
  unsure (1)..(90): unsure at all Xaa locations
  Clone ID: LIB3481-017-P1-K1-E11.pep
MGKDDVIAEFIATLLFLXITVATEIGYKHQTDATASGADAACGGVGVLGIAWAVLLAAYADAVYGVPPRRRRERTMKGRALLCSWSGPGS

SEQ ID NO: 47040 - protein, 216 aa, Sorghum bicolor
  Clone ID: SORBI-28MAY03-C1051_3.pep
MDSSVHVVPSTDEVDEAIQPPDDDMGISSAAWVEVEHQELEVTDSGENVVAEDVTSPGIAPLPSSSPRVRHSLSQMLQADSNEPEIIEWGNAENPPAIVFHKDSPKGFKRLLKFARKNKGDNNANGWASPSVVSEGEDELEEPRGTSDSANSSRRTFDGSKTNSILSAQSTTGSFNSMNSDKLRERPGAATSTKASRSFFSLSNFRSSRSNESKLR

SEQ ID NO: 47041 - protein, 76 aa, Sorghum bicolor
  Clone ID: SORBI-28MAY03-C1051_2.pep
MSCGCGSSCNCGSSCKCGKKYPDLEEKSTAAQATVVLGVAPEKTAAAEFEAAAESGAETSHGCGCGDSCKCNPCNC

SEQ ID NO: 47042 - protein, 249 aa, Sorghum bicolor
  Clone ID: SORBI-28MAY03-C1051_1.pep
PPRSAASSRMTYRMYTYQYQGGKRCRGVSGFVVWRTASSRRARSVTPGMVVESSRVVFLSVGRCAMCCDCEAGSSGVGRPTGDCHYKQGDRAACGRRRVFGCVGWMLCSALVRFRSDVLPPRSRVLHSCCCFTFVLYSLQSYYHVIKLQFLPGREAQPKRLCTTPFDRYLFLSFFVFAPKDKQDVLQLRIKLQLRLKLQVRQEVPRPGGEEHRGAGHRRPGCRPGEDSCCRVRGRGGVRRRDLPRLQLR

SEQ ID NO: 47043 - protein, 261 aa, Sorghum bicolor
  unsure (1)..(261): unsure at all Xaa locations
  Clone ID: SORBI-28MAY03-C2186_1.pep
MASSRIPLLCLLGLLLVASPAIADDSSGIYYQLALLWPGAYCEQTNAGCCKPTTGVSPARDFYITGLTVYNATTNAALTECSNQAPYNPNLITGIGLEQYWINIKCPANNGQRSWKNAWKKAGACSGLDEKAYFEKALSFRSKINPLVRLKQNGIEDDFELYGLKAIKKVFKSGINAEPVIQCSKGPFDKYMLYQLYFCANGNGTFIDCPAPAKYTCSNSVLFHPYKKWMLKQQLSDESADFYDSADPFVLPGLAXWTTDL

SEQ ID NO: 47044 - protein, 101 aa, Sorghum bicolor
  Clone ID: SORBI-28MAY03-C59_4.pep
GRDLSKLVEMDGGRDGMLEYIHFFGCVCSWRGVNLVFCHSLPSVNWLVSETCTSVGYRGSSYIQSFALRQLGLFCEPIMMELYLLLISTYLSTYLLSNSCV

SEQ ID NO: 47045 - protein, 95 aa, Sorghum bicolor
  Clone ID: SORBI-28MAY03-C59_3.pep
MVLDSLSSPHRRSQNTSFVSSAKKPQSSRDDSWSALVERHRFLLTTLLVLAFLCTIYLYFAVTLGASDACIGLAGAERIECQARSVLQHGKLKFR

SEQ ID NO: 47046 - protein, 152 aa, Sorghum bicolor
  Clone ID: SORBI-28MAY03-C59_2.pep
MEYGQQGQHGHGTTGRVDQYGNPVGAGTGGMGTGTGGMGQLGEHGGAGMGGGQFQPAREEHKTGGILHRSGSSSSSSSEDDGMGGRRKKGIKEKIKEKLPGGHKDNQHATATGGGAAYGQQEHTGAGTYGTEGTGEKKGIMDKIKEKLPGQH

SEQ ID NO: 47047 - protein, 145 aa, Sorghum bicolor
  Clone ID: SORBI-28MAY03-C59_1.pep
MAFMRSHSNASSGMGVAPNIRETFVELQMKKAYRYVIFKIEEKQKQVVVEKTGATTESYDDFLASLPENDCRYALYDFDFVTGENVQKSKIFFIAWSPSTSRIRAKMLYSTSKDRIKHELDGFHYEIQATDPTEVDIEVLRERAH

SEQ ID NO: 47048 - protein, 111 aa, Sorghum bicolor
  unsure (1)..(111): unsure at all Xaa locations
  Clone ID: LIB5051-011-A1-XP1-F12.pep
GRDLSKLVEMDGGRDGMLEYIHFFGCVCSWRGVNLVCSHSLPSVNWLVSETCTSVGYRGSSYIQSFALRQLGLFCEPIMMELYLLLXKKKKKKKKKKKKKKKRKKKKKKAP

SEQ ID NO: 47049 - protein, 105 aa, Sorghum bicolor
  Clone ID: LIB5047-002-R1-XP1-A11.pep
GRDLSKLVEMDGGRDGMLEYIHFFGCVCSWRGVNLVCSHSLPSVNWLVSETCTSVGYRASSYIQSFALRQLGLFCEPIMMELYLLLISTYLSTYLLNKKKKKKGP

SEQ ID NO: 47050 - protein, 92 aa, Sorghum bicolor
  Clone ID: LIB3478-002-P1-K1-G5.pep
YAYRNLLTNTTRGASSSSRATPSSTEGSRPSTGSFKGEPASVSPLPENLNVHLCRVGRAMTDELQPAASGPNIGITPGRQPTPARGRMHTAG

SEQ ID NO: 47051 - protein, 179 aa, Sorghum bicolor
  Clone ID: SORBI-28MAY03-C22185_2.pep
MLHEQQAPPSPPPEVEAAPPPVPSAPSPARNHHHHDGDGDVHDVEVTTFRDIHPLTPDVPTPPARTRSWDTASHRSFSSEEQFMTMSREFTAMVAAGATMQTGGGANGNGGYDGDQLTSIGEDELEETNPLAIVPDSHPIATPARSRASAAASASGLEVVPAPTPTPQQPPAHVEASQV

SEQ ID NO: 47052 - protein, 374 aa, Sorghum bicolor
  Clone ID: SORBI-28MAY03-C22185_1.pep
RVFLASIHSVSTKGSALSRAPQPTSARKLGGGDREVEREWQARQGVPTMFALGLRLGVLAPIPRSDEAGVVCCGMRGDSRAPARTVLRMDTSNVITAMRLCAPGQGALRAVGGSGLRDTVGAADDVRSSIAGSPAAAASWVRNNIQAYPSVSFRYVCVGNEVAGGAAQNLAPAMENVHAALAAAGLGHIKVTTSVSQAILGVYSPPSAAQFTAEAQGFMGPVLQFLSRTGSPLMANIYPYLAWACNPSAMDISHGAVAGPGTEGHGRASGYQHLFDTGRDAFDVAMGRNGGSGVPLVVSESGWPSGGGVQATPANARVYNQYLVNHVRRGTPRHPGAIETYLFSMFNENQKESGVEQNWGLFYPNMQRVYPISF

SEQ ID NO: 47053 - protein, 160 aa, Sorghum bicolor
  Clone ID: SORBI-28MAY03-C535_3.pep
MASSSMAAVACATGTALSPSTATAQRPSVQGRLVFPAAPSRSHSLRLRAAGRRSTRASKVVVAALADPLKVMISGAPASGKGTQCELIKTKFGLVHISAGDLLRAEIAAGSDNGKAAKDFMEKGQLVPDEIVVNMVKERLLQPDAQENGWLLDGCPRSYS

SEQ ID NO: 47054 - protein, 318 aa, Sorghum bicolor
  Clone ID: SORBI-28MAY03-C535_1.pep
LHSFASGARARACARPEASSLAAGRCRTLRSFPFRSTPRLPLSPYRLPTHTQTATPHLPHPPVHVLLLPMSPPLELDYIGLSPQPAAAAAAADADDDLKGTELRLGLPGSGSPDRRVAAATATTLELLPAKGAKRGFSDEAPPPSPAAAAGKGKKVAEEEDDDKKVAATPQPAAKAQVVGWPPIRSYRKNTMATTQLKGSKEDTEAKQGQGFLYVKVSMDGAPYLRKIDLKTYKNYKDLSTALEKMFSGFSTGKDGLSEYRKDGEYVLTYEDKDGDWMLVGDVPWEMFADSCRRLRIMKGSDAIGLAPRAADKSKNRN

SEQ ID NO: 47055 - protein, 109 aa, Sorghum bicolor
  Clone ID: LIB3481-042-Q6-K1-H7.pep
LSKIYHLNTLRGGMKKSLQGLRRDLMIQKKSTCLYWLLVRVMSNAIAGSIVKQDIIAYLGIKGGLQSVFLWSSTRQARSACFMMRLLAISKLFSAYMIMFKSTDTCISI

SEQ ID NO: 47056 - protein, 142 aa, Sorghum bicolor
  Clone ID: LIB3478-009-P1-K1-F10.pep
HVFPVSPLAPLRRRRSSWHPLPWPPSPAPPAPPSRRRPRRPRGRLSRAASSSPPRPPAPTLSGSGSHTVSKDGAPYLRKIDLKTYKNYKDLSTALEKMFSGFSTGKDGLSEYRKDGEYVLTYEDKDGDWMLVGDVPWEMFAD

SEQ ID NO: 47057 - protein, 260 aa, Sorghum bicolor
  Clone ID: SORBI-28MAY03-C14368_1.pep
MDSGAVQHGCAHYSRGCSVVAPCCGQVFARRHCHNDAKNSLEVDPRDRHEIPRHEIEKVVCSLCSKEQDVQQNCSNCGACMGKYFCEICKFFDDDVSKGQYHCDGCGICRTGGVDNFFHCDTCGCCYSNVLKDSHHCIERAMHHNCPVCFEYLFDSTKDISVLQCGHTIHLECMNEMRAHHHFSCPVCSRSACDMSATWRKLDEEVAATPMPDIYLKKMVWILCNDCSATSSVRFHVLGQKCPGCSSYNTRETRAACPRT

SEQ ID NO: 47058 - protein, 227 aa, Sorghum bicolor
  Clone ID: SORBI-28MAY03-C6402_1.pep
MAVSFANVNSEAGLKKLDEYLLTHSYITGYQASKDDLAVYSSFSAAPSSKYINVARWFTHIDALLRLSGVTAEGLGVKVESSAVPSASTPDVAEAPAADDDDDDDVDLFGEETEEEKKAAEERAAAAKASGKKKESGKSSVLLDVKPWDDETDMAKLEEAVRSVQMEGLLWGASKLVPVGYGIKKLQIMMTIVDDLVSVDTLIEDHLCAEPVSEYVQSCDIVAFNKI

SEQ ID NO: 47059 - protein, 284 aa, Sorghum bicolor
  Clone ID: SORBI-28MAY03-C676_1.pep
MGQALGLVQVDQSTVAIKESFGKFDEILEPGCHFLPWCIGKQIAGYLSLRVQQLDVRCETKTKDNVFVNVVASVQYRALADKASDAFYRLSNTREQIQSYVFDVIRASVPKMNLDDAFEQKNEIAKAVEDELEKAMSMYGYEIVQTLIVDIEPDEHVKRAMNEINAAARLRLAATEKAEAEKILQIKRAEGDAESKYLAGLGIARQRQAIVDGLRDSVLAFSENVPGTSAKDVMDMVLVTQYFDTMKEIGASSKSSSVFIPHGPGAVRDIAAQIRDGQLQASLL

SEQ ID NO: 47060 - protein, 71 aa, Sorghum bicolor
  unsure (1)..(71): unsure at all Xaa locations
  Clone ID: LIB3481-043-Q6-K1-A7.pep
VRRRVLAFSXDGPGTSAKXVMDMVLVTQYFDTMKEIGASSKSSSVFIPHGPGAVRDIAAQIRDGQLQASLL

SEQ ID NO: 47061 - protein, 564 aa, Sorghum bicolor
  Clone ID: SORBI-28MAY03-C404_1.pep
STPSAASTRHLPFYPVVLRSALSYIRGEGNWHRVSKGAPEQILDLCHCKEDLRRKVHGIIDKYAERGLRSLAVARQEVPEKNKESPGGPWQFVGLLPLFDPPRHDSAETIRKALVLGVNVKMITGDQLAIGKETGRRLGMGTNMYPSSALLGQNKDSTLEALPVDELIEKADGFAGVFPEHKYEIVKRLQEKKHIVGMTGDGVNDAPALKKADIGIAVADATDAARSASDIVLTEPGLSVIISAVLTSRCIFQRMKNYTIYAVSITIRIVLGFMLIALIWKYDFSPFMVLIIAILNDGTIMTISKDRVKPSPLPDSWKLKEIFATGIVLGSYLAIMTVIFFWAMHKTDFFSDKFGVRSIRDSEHEMMSALYLQVSIVSQALIFVTRSRSWSFVERPGLLLVTAFLLAQLVATFLAVYANWGFARIKGIGWGWAGVVWLYSIVFYFPLDLIKFFIRFVLSGRAWDNLLENKTAFTTKKDYGREEREAQWATAQRTLHGLQPPEAATNTLFNDKSSYRELSEIAEQAKRRAEIARLRELNTLKGHVESVVKLKGLDIDTIQQNYTV

SEQ ID NO: 47062 - protein, 110 aa, Sorghum bicolor
  Clone ID: LIB3480-042-P1-K1-D4.pep
KDGYQTIPSYSSIWWYSALQLGLLSQISHTVLLFSIHHRKIFLSVIIRDDSVAIRRGRAPKVFFVDIDRSRRLSHRVVLLDGVDVQPLELHHRLHVALEGVELPQPRDLS

SEQ ID NO: 47063 - protein, 484 aa, Sorghum bicolor
  Clone ID: SORBI-28MAY03-C11622_1.pep
MAPASSVAVENLNPKVLKCEYAVRGEIVIHAQRLQQQLQTQPGSLPFDQILFCNIGNPQSLGQQPVTFFREVLALCDHPCLLEKEETKSLFSADAISRAKQILATIPGRATGAYSHSQGIKGLRDAIAAGITSRDGFPANADDIFITDGASPGVHMMMQLLIRNEKDGILCPIPQYPLYSASIALHGGALVPYYLDEKTGWGLEISDLKKQLEDARSKGIDVRALVVINPGNPTGQVLAEDNQYDIVKFCKNEGLVLLADEVYQENIYVDNKKFNSFKKIARSMGYGEDDLPLVSFQSVSKGYYGECGKRGGYMEITGFSAPVREQIYKVASVNLCSNITGQILASLVMNPPKVGDESYASYKAEKDAILQSLARRAKALEDAFNKLEGISCNKAEGAMYLFPQIHLPQKAIEAAKAAEKAPDAFYALRLLESTGIVVVPGSGFGQVPGTWHIRCTILPQEDKIPAVITRFKAFHEAFMAEYRD

SEQ ID NO: 47064 - protein, 184 aa, Sorghum bicolor
  Clone ID: SORBI-28MAY03-C5865_1.pep
HHIFFFLFFSPTHAETLDSTLTCCILPRLFKAATSLRSTNNYRNSSNNYQRRDNHPARWSRPIDPATADASFSHRRHRPAPDRTTGNVAISPDLKPVPDPTRHARAFGVSPGSDPRAPSSIHQDERRRIQQSDLSLRNMKQTEFPGKSKRTQLTEGARAILDPEEEEEVACRRGARRTMVWCFG

SEQ ID NO: 47065 - protein, 91 aa, Sorghum bicolor
  Clone ID: SORBI-28MAY03-C2631_2.pep
MAKQQQAVALLMMLVLAAETASAASCNAGQLTVCASAMLSGAAPSAACCSNLKAQQGCLCQFAKNPAYARYVNSPNARKTVASCGVALPRC

SEQ ID NO: 47066 - protein, 92 aa, Sorghum bicolor
  Clone ID: SORBI-28MAY03-C2631_1.pep
MAKQQQQAMALLMMLVLAAETASAASCNAGQLTVCASAMLSGAAPSAACCSNLKAQQGCLCQFAKNPAYARYVNSPNARKTVASCGVALPRC

SEQ ID NO: 47067 - protein, 455 aa, Sorghum bicolor
  unsure (1)..(455): unsure at all Xaa locations
  Clone ID: SORBI-28MAY03-C1425_1.pep
MKSSERLLLLLLVVLVVASSSLLSAVIAEQQTCPADLDSKCDGGASDDWEGEFFPGVPKIKYEGPTSKNPLAYKWYNKEEVILGKKMKDWMRFSVAFWHTFRGTGADPFGAPTKAWPWEDGTNSLAMAKRRMRAHFEFMEKLGVDKWCFHDRDIAPDGKTLDXFMHPRYMHGAATSPEVKVYAYAAAQVKKALEVTHYLGGENYVFWGGREGYQTLLNTDMKRELDHLANFLQAAVDHKKKIGFKGTLLIEPKPQEPTKHQYDWDVATTFAFLQKYGLTGEFKINVECNHATLSGHSCHHELETARINGLLGNIDANTGDPQVGWDTDQFMTDIAEATLVMSSVVKNGGLAPGGFNFDAKLRRESTDVEDMFLAHISGMDTLARGLRNVAKLIEDGSLDDLVRKRYQSFDSEIGALIEAGKGDFETLEKKVLEWGEPTVPSGKQELAEILFQSAL

SEQ ID NO: 47068 - protein, 151 aa, Sorghum bicolor
  Clone ID: SORBI-28MAY03-C117_2.pep
RERLVQESDIPKLNYVKACIREAFRLHPVAPFNVPHVALADTTIAGYRVPKGSHVILRRPRKSTTKCSSTTCASPPAGVGNPPLPPGPVPWPVVGNLPEMLLNKPAFRWIHQMMREMGTDIACVKLGGVHVVSITCPEIVREVLRKHDSNF

SEQ ID NO: 47069 - protein, 558 aa, Sorghum bicolor
  Clone ID: SORBI-28MAY03-C117_1.pep
MATMEVEAAAATVLAAPLLSSSAILKLLLFVVTLSYLARALRRPRKSTTKCSSTTCASPPAGVGNPPLPPGPVPWPVVGNLPEMLLNKPAFRWIHQMMREMGTDIACVKLGGVHVVSITCPEIAREVLRKQDANFISRPLTFASETFSGGYRNAVLSPYGDQWKKMRRVLTSEIICPSRHAWLHDKRTDEADNLTRYVYNLATKAATGDVAVDVRHVARHYCGNVIRRLMFNRRYFGEPQADGGPGPMEVLHMDAVFTSLGLLYAFCVSDYLPWLRGLDLDGHEKIVKEANVAVNRLHDTVIDDRWRQWKSGERQEMEDFLDVLITLKDAQGNPLLTIEEVKAQSQDITFAAVDNPSNAVEWALAEMVNNPEVMAKAMEELDRVVGRERLVQESDIPKLNYVKACIREAFRLHPVAPFNVPHVALADTTIAGYRVPKGSHVILSRTGLGRNPRVWDEPLRFYPDRHLATAASDVALTENDLRFISFSTGRRGCIAASLGTAMSVMLFGRLLQGFTWSKPAGVEAVDLSESKSDTFMATPLVLHAEPRLPAHLYPSISI

SEQ ID NO: 47070 - protein, 394 aa, Sorghum bicolor
  unsure (1)..(394): unsure at all Xaa locations
  Clone ID: SORBI-28MAY03-C15429_1.pep
PRQPATLISPSIPCRQPPLVPHTPHYTALLQQETNKSLLAMATTAASSLLKSSFAGSRLPSAPRAPSSVVVSTGGAPRTAAISASISSSNPPYDLTSFKFSPIKESIVSREMTRRYMTDMITHADTDVVIVGAGSAGLSCAYELSKDPTVRVAIVEQSVSPGGGAWLGGQLFSAMVVRKPAHLFLDELGVAYDEAADDYVVVKHAALFTSTVMSAVLARPNVKLFNAVAVDXMNHGAHACMDPNVMEALVAVSPGAHAGPVPAAGVKRLQDIGMISDVPGMATGVKRLQDIGMIAAVPGMKALDMNAAEDAIVRLTREVVPGMIVTGMEVAEIDGAPRMGPTFGAMMISGQKAAHLALKALGRPNAVDGTIPKVSPALREEFVIASKDDEVVDA

SEQ ID NO: 47071 - protein, 157 aa, Sorghum bicolor
  Clone ID: SORBI-28MAY03-C3119_1.pep
MTAPQAAMAGQPVNAAAVDERLLVDQEANHHPQPENNGDNSCFPWPTVLGFLILSFNAAMAIIRSQGDVMAIAFVGFAYAILVALFVCLRMYERARAGSSKREWLKIAVWILTTLLTFSFSYKVAAIMPAPMAVVVWLMAFATIAGGFVAFFVYKEK

SEQ ID NO: 47072 - protein, 138 aa, Sorghum bicolor
  Clone ID: SORBI-28MAY03-C1238_3.pep
MSLIRRGSAFDPFSLDLWDPFQGFPFGSGSSSLFPSFGGTNSETAAFAGARIDWKETPEAHVFKADVPGLKKEEVKVEVEDGNVLQISGERNKEQEEKTDTWHRVERSSGKFLRRFRLPENAKTEQISASMENGVLTV

SEQ ID NO: 47073 - protein, 166 aa, Sorghum bicolor
  Clone ID: SORBI-28MAY03-C1238_2.pep
MSLVRRSNVFDPFSLDLWDPLDNMFRSIVPSAASGDSETAAFANARIDWKETPEAHVFKADLPGVKKEEVKVEVEDGNVLVISGQRSREKEDKNDKWHRVERSSGQFTRRFRLPENAKTEEVKAGDENSVLTVTVPKADVMKRRIQSRRMRNRRAMNKRRATGRGE

SEQ ID NO: 47074 - protein, 152 aa, Sorghum bicolor
  Clone ID: SORBI-28MAY03-C1238_1.pep
MSLVRRSNVFDPFSMDLWDPFDNMFRSIVPSAASGDSETAAFANARIDWKETPEAHVFKADLPGVKKEEVKVEVEDGNVLVISGQRSREKEDKNDKWHRVERSSGQFTRRFRLPENAKTEEVKAGLENGVLTVTVPKAEVKKPEVKSIQISG

SEQ ID NO: 47075 - protein, 191 aa, Sorghum bicolor
  Clone ID: SORBI-28MAY03-C24509_1.pep
MYARTMSHLTPIPWPPPRRPHSLAFSGSSAAGSAAAGSSAAAGAGAAASGSAAAGSVSAAGAAASSSLTSSTAAGSASFGASSSAAAAAGAASGSAAAGSASGSAATGSGSAGAAGSSTTLASSAGAASSGTAGSASAGAGAASSGTTAGAGVSTTGASSVATTVGVWTSAVAIGDDEKADDDYTKDWLAG

SEQ ID NO: 47076 - protein, 407 aa, Sorghum bicolor
  Clone ID: SORBI-28MAY03-C10217_1.pep
SGPPPAMASNGIAPRDVCVVGVARTPMGGFLGALSSLPATKLGSIAIEAALKRANVDAALVQEVFFGNVLSANLGQAPARQAALGAGIPNTVVCTTVNKVCASGMKATMFAAQTIQLGINDIVVAGGMESMSNAPKYIAEARKGSRFGHDTLVDAMLKDGLWDVYNDCAMGMCAELCADNHALTSVVRDTFAVQSNVRGIAARDSSAFAWDIVPFEVPVGRGQPPVLMEKDESLDKFDPANLRDRPPSLVLMSGQEAPGLGPSISDGAAALVLVTRPPALVLGLPGPARTRGYADAALAPVLFTTTPALAIPKAIANAGLESSHVDFYEINEAFSAVALANQKLLGIPSEKTNVHGGAVSLGHPLGCSGARILVTLLGVLRVKGGKIGVAGVCNGGGGASALVVELA

SEQ ID NO: 47077 - protein, 118 aa, Sorghum bicolor
  unsure (1)..(118): unsure at all Xaa locations
  Clone ID: LIB3478-011-P1-K1-F9.pep
AFSAVALANQKLLGIPSEKINVHGGAVSLGHPLGCSGARILVTLIGVLRAKSGKIGVAGVCNGGGGASALVXSSSHKKSRPCKIENAEYISTQMDSFTIWESIKKVLTNISCYCQLVI

SEQ ID NO: 47078 - protein, 307 aa, Sorghum bicolor
  Clone ID: SORBI-28MAY03-C39808_1.pep
MAAPAFGGRRRPASAAALLAVATLVVVFLAGPAMAAGNKTGQVTVFWGRNKAEGTLREACDSGLYTMVIMSFLDVYGPNGKYHLDLSGHPIAGIGDDIKHCQFVGVPVSLSIGGFGSGYSLPSKQAALDLFDYLWNAFFGGSKPGVHRPFGDVWLDGVDLFLEHGTNATDRYDVLALELAKHNIRGGPGKPLHLTATPRCEFPPAGYLKRALDTGIFERVHVRIYDDADCEAYWHLAWDRWTAAYPATRFYVGMTASETTHGWVHPKNVYYDVAPSVQKADNYGGFMIWERYADTLSNYTSMVKYYA

SEQ ID NO: 47079 - protein, 429 aa, Sorghum bicolor
  Clone ID: SORBI-28MAY03-C28811_1.pep
MTGTVSKLAAPRPAAAPLRPASLRTAALAFAPSPRRVTVSVAGRARSPIIAMASAKEGNGAPTKKTALHDLYELQGLSPWYDNLCRPVTDLLPLIASGVRGVTSNPTIFQKAISSSSAYDDQFKQLISGGKDAESAYWELVIKDIQDACKLFEPIYNETDGADGYVSVEVSPRLANDTQGTVEAAKWLHKVVNRPNVYIKIPATAECVPSIQEVIANGISVNVTLIFSIARYEAVIDAYLDGLEASGLSDLSRVTSVASFFVSRVDSLIDKMLEKIGTPEALALRGKAAVAQAKLANQLYQKKFSGPRWEALAKKGAKKQRLLWASTGVKNPAYPDTLYVDSLIGPDTVNTMPDQALQAFIDHGTVSRTVDANVSEAEGVYSALEKLGIDWDAVGKQLELEGVDSFKKSFDSLLVSLQEKGNSLKTASV

SEQ ID NO: 47080 - protein, 296 aa, Sorghum bicolor
  Clone ID: SORBI-28MAY03-C6121_2.pep
TLKLWLKKKKKKKKKGAAARDQIIEFLNSKNNVGSDGDNRNEDSKARPPQEVSLNGSTSDEHSKKIKLEDVSCPLCTEMLYQPAVLNCGHVYWVSCLSSLNEETLKCHVCGSPHPGDFPNVCLDLDHFLEEYFPAEYESRGQKVQFKKDQCNREASSSGTSVRKGSTRALHDEGMLNIHIGVGCDSCGVYPIRGKRYKCQDCTELIGFDLCEACYNSSSKLPGRFNQRHTPDHRMEVDNSALLRGILRHHGMPEEGPEGLMMEEAVVAPGAFLQILVDTQGMEEGALLWGPRRGGH

SEQ ID NO: 47081 - protein, 381 aa, Sorghum bicolor
  Clone ID: SORBI-28MAY03-C6121_1.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 47082 - protein, 643 aa, Sorghum bicolor
  Clone ID: SORBI-28MAY03-C10406_1.pep
MMGGGLMMDQSVVFPGVHNFVDLLQQNGDKNLGFGSLMPQTSSGDQCVMGEGDLVDPPPESFPDAGEDDSDDDVEDIEELERRMWRDRMKLKRLRELQQSRGKDSIAGGGGLADGSSKPRQSQEQARRKKMSRAQDGILKYMLKMMEVCRAQGFVYGIIPEKGKPVSGASDNLRAWWKEKVRFDRNGPAAIAKYQADNAVPGAENELTSGAASPHSLQELQDTTLGSLLSALMQHCDPPQRRYPLEKGVPPPWWPTGDEEWWPELGIPKDQGPPPYKKPHDLKKAWKVSVLTAVIKHMSPDIEKIRRLVRQSKCLQDKMTAKEISTWLAVVKQEEELYLKLHPGALPPASTGGIASAISFNTSSSEYDVDIIDECKGDEAGNQKTGVTDPTAFNLGAAILSDKFLVQTPMKEETADVEFIQKRNAPAAAEPELMLNNRVYTCNNVQCPHSDYSYGFLDRNTRNSHQYTCKYNEPIPQSTENKPPPAPPQSQAFQPAFNQPNQSLNNLDFSLPMDGQRSIAELMNMYDNNFMTNKNMSSDSVTIMERPNAMPQRIQMDEGFFGQGNGVFDDVNSMMQQQQQAPVQQQQQQQQQQFFIRDDTPFVSQMGDITSTSEFRFGSGFNMSSTVDYPGAAQKNDGTNWFY

SEQ ID NO: 47083 - protein, 239 aa, Sorghum bicolor
  Clone ID: SORBI-28MAY03-C588_1.pep
MASSSMLSATTVPLQGAAGLSEFSGLRSSASLPMRRNATSDDFMSAVSFRTHAVGTSGGSRRAPTEAKLKVAINGFGRIGRNFLRCWHGRGDASPLEVIAINDTGGVKQASHLLKYDSTLGIFDADVKPVGDNAISVDGKVIKVVSDRNPSNLPWGEMGIDLVIEGTGVFVDREGAGKHIQAGAKKVLITAPGKGDIPTYVVGVNADQYDPDEPIISNASCTTNCLAPFVKVLDQKFGI

SEQ ID NO: 47084 - protein, 56 aa, Sorghum bicolor
  Clone ID: LIB3481-001-Q6-K1-H6.pep
MASSSMLSATTVPLQGAAGLSEFSGLRSSASLPMRRNATSDDFMSAGGFRTHAVRA

SEQ ID NO: 47085 - protein, 130 aa, Sorghum bicolor
  Clone ID: SORBI-28MAY03-C12610_1.pep
MVCYYGNEAKEERVDGGDHPVVVLKPAVDAIVAGLRAAGSNPRRTLFLDDSERNITAGKALGLRTALVGKRVRSKDADYALENIGALRRVIPEIWGVVAGGESERSDHSIDKMPMRSDLDSIIQPTSIQA

SEQ ID NO: 47086 - protein, 84 aa, Sorghum bicolor
  Clone ID: LIB5047-009-R1-XP1-F2.pep
MKSSTLLTILVLQALLVSAAMAKGQGPKKACCKECTSWSGVYTCDDLLTKCAATCKQCVPVSTDKGTRYRCRDFLPEGCPCKTN

SEQ ID NO: 47087 - protein, 332 aa, Sorghum bicolor
  Clone ID: SORBI-28MAY03-C437_2.pep
MAKDPMRVLVTGAAGQIGYALVPMIARGVMLGADQPVILHMLDIPPAAEALNGVKMELVDAAFPLLKGVVATTDVVEACTGVNVAVMVGGFPRKEGMERKDVMSKNVSIYKAQASALEAHAAPNCKVLVVANPANTNALILKEFAPSIPEKNVTCLTRLDHNRALGQISERLSVQVSDVKNVIIWGNHSSTQYPDVNHATVKTSTGEKPVRELVADDEWLNGEFITTVQQRGAAIIKARKLSSALSAASSACDHIRDWVLGTPEGTFVSMGVYSDGSYGVPSGLIYSFPVTCSGGEWKIVQGLPIDEFSRKKLDATAQELSEEKTLAYSCLE

SEQ ID NO: 47088 - protein, 223 aa, Sorghum bicolor
  Clone ID: SORBI-28MAY03-C437_1.pep
MAALLARQAAQALRARQTAQLLPAASAMQGHLRTYMNAGIPKRFKEDEEKEQLAKDVAKDWNAVFERSINTLFLTEMVRGLMLTLKYFFDRNVTINYPFEKGPLSPRFRGEHALRRYESGEERCIACKLCEAICPAQAITIEAEEREDGSRRTTRYDIDMTKCIYCGFCQEACPVDAIVEGPNFEFATETHEELLYDKEKLLENGDRWETEIAENLRSESLYR

SEQ ID NO: 47089 - protein, 362 aa, Sorghum bicolor
  unsure (1)..(362): unsure at all Xaa locations
  Clone ID: SORBI-28MAY03-C25378_1.pep
MAQLAKTLLLVALVAMSAVELCRAIEFDERDLASDEALWDLYERWQTHHHVHRHHGEKGRRFGTFKENVRFIHAHNKRGDRPYRLSLNRFGDMGREEFRSTFADSRINDLRRAESPAAPAVPGFMYDGVTDLPPSVDWRKEGAHGAVTAVISPRRCGSCWAFSTVVAVEGISPSRTGSPVSRSEQGPGAGXLENAFEFIKSYGGVTTESAYPYRASNGTCDSVRSRRRHLRRLASHPRVPTGSEDALAKAVANQPVSVAIDAGGQAFQFYSEGVFTGDCGTDLDHGVAAVGYGVSDDGTAYWIVKNSWGPSWGEGGYIRMQRGAGNGGLCGIAMEASFPIKTSPNPARKPRRALISRDTSSQ

SEQ ID NO: 47090 - protein, 149 aa, Sorghum bicolor; identical to SEQ ID NO: 46168
  Clone ID: SORBI-28MAY03-C1723_3.pep

SEQ ID NO: 47091 - protein, 149 aa, Sorghum bicolor; identical to SEQ ID NO: 46168
  Clone ID: SORBI-28MAY03-C1723_2.pep

SEQ ID NO: 47092 - protein, 149 aa, Sorghum bicolor; identical to SEQ ID NO: 46168
  Clone ID: SORBI-28MAY03-C1723_1.pep

SEQ ID NO: 47093 - protein, 429 aa, Sorghum bicolor
  Clone ID: SORBI-28MAY03-C81_1.pep
MGLSTAYSPVGSHLAPAPLGHRRSAQLHRPRRALLATVRCSVDAAKQVQDGVATAEAPATRKDCFGVFCTTYDLKAEDKTKSWKKLVNIAVSGAAGMISNHLLFKLASGEVFGQDQPIALKLLGSERSFQALEGVAMELEDSLYPLLREVSIGIDPYEVFEDVDWALLIGAKPRGPGMERAALLDINGQIFADQGKALNAVASKNVKVLVVGNPCNTNALICLKNAPDIPAKNFHALTRLDENRAKCQLALKAGVFYDKVSNVTIWGNHSTTQVPDFLNAKIDGRPVKEVIKDTKWLEEEFTITVQKRGGALIQKWGRSSAASTAVSIADAIKSLVTPTPEGDWFSTGVYTTGNPYGIAEDIVFSMPCRSKGDGDYELATDVSMDDFLWERIKKSEAELLAEKKCVAHLTGEGNAYCDVPEDTMLPGEV

SEQ ID NO: 47094 - protein, 272 aa, Sorghum bicolor
  Clone ID: 21181.pep
GVFQDVDWALLIGAKPRGPGMERAALLDINGQIFADQGKALNAVASRNVKVLVVGNPCNTNALICLKNTPNIPAKNFHALTRLDENRAKCQIALKAGVFYDKVSNVTIWANHSTTQVPDFLNAKIDGRPVKEVIQDTKWLEEEFTMTVQKRGGVLIQKWGRSSAASTAVSIVDAIKSLVTPTPEGEWFSTGVYTTGNPYGIAEDIVFSMPCRSKGDGDYQLATDVSMDDFLWERIKKSEAELLAEKKCVAHLTGEGDAFCDLPEDTMLPGEN

SEQ ID NO: 47095 - protein, 355 aa, Sorghum bicolor
  Clone ID: SORBI-28MAY03-C6325_1.pep
MAGALQPPPQLLPLLLALLLVSAAAPQVVGVGVGDNSLRIIQEDIIETVNNHPSAGWTASRNPYFSNYTIAQFKHILGVKPAPKNVLSDVPVKTYPRSLELPKEFDARSAWSRCSTIGNILDQGHCGSCWAFGAVECLQDRFCIHFNTSILLSVNDLLACCGFMCGDGCDGGYPIMAWRYFVQNGVVTDECDPYFDQVGCKHPGCEPAYDTPKCEKKCKVQNQVWQEKKHFSIDAYRINSDPHDIMAEVYKNGPVEVAFTVYEDFAHYKSGVYKHITGGIMGGHAVKLIGWGTSDAGEDYWLLANQWNRGWGDDGYFKIIRGTNECGIEEDVVAGMPSTKNMVPNFGSAVGTAVV

SEQ ID NO: 47096 - protein, 65 aa, Sorghum bicolor
  Clone ID: LIB3478-039-P1-K1-F8.pep
NHNIHILVLINVIPPSLNKVMWHQQHNDLWNELVYKLHTPYWLFNNSILKILQLIPTASEAKRNC

SEQ ID NO: 47097 - protein, 239 aa, Sorghum bicolor
  Clone ID: SORBI-28MAY03-C709_2.pep
CHPRSAQLFVCKAQQKQQQDAAAVDQSDVSRRAALALFAGVAAVGAKVSPAAAAYGEAANVFGKPKTNTEYIAYNGDGFKLLIPSKWNPSKEREFPGQVLRYEDNFDANSNVSVIIQPTSKKTITEYGSPEEFLSQVDFLLGKQAFGGSTDSEGGFETGAVATANVLESSTPVVDGKQYYSVSVLTRTADGDEGGKHQLITATVSDGKLYICKAQAGDKRWFKGARKGVEKAAASFSVA

SEQ ID NO: 47098 - protein, 616 aa, Sorghum bicolor
  unsure (1)..(616): unsure at all Xaa locations
  Clone ID: SORBI-28MAY03-C709_1.pep
MVGVYYLVSNDDSMLVDSIHEDHVDPNALTNFRISEPLRQSLRSKGIKALFPIQATTFDLVLDGNDLVGRARTGQGKTLAFVLPILESLVNGAHKASRRTEHGRTPSVIVLLPTRELANQVHADFEFYGATFGLSACCVYGGSPYRPQEMALRRGVDIVVGTPGRVKDFIVKGTLNLKNLKFRVLDEADEMLNMGFVDDVELILGKVEDATKVQTLLFSATLPDWVNKLSMRFLKVDRKTVDLVGNEKLKASASVKHLALPCNKAARAQVIPDIIRCYSHGGRTIIFTETKDSASELSGLIPGSRALHGDVVQAQREVILAGFRGGKFQVLVATNVAARGLDINDVQLIIQCEPPRDVEAYIHRSGRTGRAGNTGVAVMLYEPRYKYSVNRLERESGVKFEHISAPQPTDVAQSAGSEAADAISSVSDSVIPVFRQQAEQLLSSSSLSAADLLAKALAKAVGYTDIKKRSLLXSMEDYTTLHLQTGRPMWSPGFAFTILKRFMPEEKLADVNGATPTADGTGVVFDVPAADLEDYIQAPGNPGHVAIGGGKQTQPSPVREQAPANSGAGRCGRGGGGRLSGGGARGRCGGGGRGRRGGGRGFSGRGGGGNRFNRRN

SEQ ID NO: 47099 - protein, 118 aa, Sorghum bicolor
  Clone ID: LIB3478-055-Q6-K1-A5.pep
GRVGEYGSPEEFLSQVDFLLGKQAFGGSTDSEGGFETGAVATANVLESSTPVVDGKQYYSVSVLTRTADGDEGGKHQLITATVSDGKLYICKAQAGDKRWFKGARKGVEKAAASFSVA

SEQ ID NO: 47100 - protein, 159 aa, Sorghum bicolor
  Clone ID: SORBI-28MAY03-C55_2.pep
MASNSWTLEIPSPVAAPRLFRAAVMDWHNLAPKVASHVVTSAHPVEGDGGVGSVRQFNFTSFMPFSFMKEKLESLDMDKCECKSTLVEGGGIGVAVETAASHIKVEPAAGGGSVVKVESTYKLLPGVDVKGEEVKAKEAVTAIFKGAEAYLVANPDAYN

SEQ ID NO: 47101 - protein, 161 aa, Sorghum bicolor
  unsure (1)..(161): unsure at all Xaa locations
  Clone ID: SORBI-28MAY03-C55_1.pep
MASANSSTLEIPSPVAAPRLFRAAVMDWHTLAPKVNSHVVASAHPVEGDGGVGSVRQFNFTXSFMPFSFMKERLDFRDVDKCECKNTLVEGGNIGVAIETAASHIKVEPAAGGGSVVKVESTYKLLPGVDAKDEEAKVKEALTAIFKAAEAYLVANPDAYN

SEQ ID NO: 47102 - protein, 160 aa, Sorghum bicolor
  Clone ID: LIB5121-011-A1-PF1-A11.pep
MASASSWTLEIPSPVAAPRLFRAAVMDWHTLAPKVASHVVASAHPVEGDGGVGSVRQFNFTSSMPFSFMKERLDFLDVDKCECKNTLVEGGGIGVAIETAASHIKVEPTADGGSVVKVESTYKLLPGMDEKDEEAKAKEALTAIFKGAEAYLVANPDAYN

SEQ ID NO: 47103 - protein, 117 aa, Sorghum bicolor
  Clone ID: LIB5121-005-A1-PF1-H7.pep
MASANSWTLEIPSPVAAPRLFRAAVIDWHTLAPKVASHVVTSAHPVEGDGGVGSVRQFNFTSFMPFSFMKERLDFLDVDKCECKNTLVEGGGLGVAIETAASHIKVEPAANGGSVVN

SEQ ID NO: 47104 - protein, 350 aa, Sorghum bicolor
  Clone ID: SORBI-28MAY03-C7760_1.pep
MAQKETNGSNGEHISTRPPPTPSPLRFSKFFQANLRILVTGGAGFIGSHLVDKLMENEKHEVIVADNLFTGSKDNLKKWIGHPRFEFIRHDVTQPLLVEVDQIYHLACPASPIFYKHNPVKTIKTNVIGTLNMLGLAKRVGARILLTSTSEVYGDPLEHPQTEAYWGNVNPIGVRSCYDEGKRVAETLMFDYHRQHGIEIRIARIFNTYGPRMNIDDGRVVSNFIAQAVRGEPLTVQRPGTQTRSFCYVADMVDGLIKLMNGNNTGPINLGNPGEFTMLELAENVKELINPDVTVTMTENTPDDPRQRKPDITKAKEVLGWEPKIVLKDGLVLMEDDFRERLAVPKKTKA

SEQ ID NO: 47105 - protein, 109 aa, Sorghum bicolor
  Clone ID: SORBI-28MAY03-C198_2.pep
MASGELACTYAALILSDDGIAITAEKIATIVKAANIKVESYWPALFAKLLEKRNVEDLILSVGSGGGAAPVAAAAPAGGAAAAAAPAAEEKKEEVKEESDDDMGFSLFD

SEQ ID NO: 47106 - protein, 109 aa, Sorghum bicolor; identical to SEQ ID NO: 47105
  Clone ID: SORBI-28MAY03-C198_1.pep

SEQ ID NO: 47107 - protein, 305 aa, Sorghum bicolor
  unsure (1)..(305): unsure at all Xaa locations
  Clone ID: SORBI-28MAY03-C533_2.pep
EWPRRRRPSRPPTSPASPTSAAPRRWPLPPSHSSFASAARAAAXQRVVAMAGSGKFFVGGNWKCNGTKDSISKLVSELNAATLETDVDVVVAPPFIYIDQVKNSLTGRIEVSAQNVWIGKGGAYTGEISAEQLVDIGVQWVILGHSERRHIIGEDDEFIGKKAAYALSQNVKLIACIGELLEEREAGKTFDVCFTQMKAFADSISNWADVVIAYEPVWAIGTGKVATPEQAQEVHAAVRDWLKTNVSPEVASSTRIIYGGSVNAANCAELAKKEDIDGFLXWGAFLKAPDFATIGNSLSPSLSTW

SEQ ID NO: 47108 - protein, 382 aa, Sorghum bicolor
  Clone ID: SORBI-28MAY03-C533_1.pep
MRSPRGVGSGCYRGAGGQDQHVDLIPGIPDDVAVDCLARVPHASHRAMRRVCRGWRSAASTPAFASARAQADANEDLVYLMQFGNPSAAADDAEPKGDDGPANTPAYGVAVYNVTTGEWRRDRGAPPVVPVFAQCAAVGTRLAVLGGWDPRTFEPVADVHVLDAATGRWRRGAPMRSARSFFACAEAGGKIYVAGGHARHKNALKTAEAYDPRADAWDPLPDMSEERDECDGMATVAGDRFLAVSGYRTARQGGFERDAEWFDPAARAWRRLERVRAPPSAAHVVVKGRVWCIEGNAVMEWMGTRRGWREVGPYPPGLKAGTARAVCVGGGEKVVVTGALDGEGGGGRHALWVFDVKTKSWTVVRPPPEFAGFVFSVASVRI

SEQ ID NO: 47109 - protein, 250 aa, Sorghum bicolor
  Clone ID: SORBI-28MAY03-C1247_1.pep
MVSPDTIRTAIGVIGNGTALVLFLSPVPTFIRIWKKGSVEQYSPIPYVATLLNCMMWVLYGLPVVHPHSMLVITINGTGMAIQLTYVTLFLLYSAGAVRRKVFLLLAAEVAFVGAVAALVLTLAHTHERRSMIVGILCVLFGTGMYAAPLSVMKMVIQTKSVEYMPLFLSLASLVNGICWTAYALIRFDLYITIPNGLGVLFAVAQLVLYAMYYKNTQKIIEARKRKTDQVAMTEVVVDGSGRASNNNTY

SEQ ID NO: 47110 - protein, 198 aa, Sorghum bicolor
  unsure (1)..(198): unsure at all Xaa locations
  Clone ID: SORBI-28MAY03-C4830_2.pep
MAETPTYQILVRLLDGRTRCLRFSTPTVSGTVLLDAVAWISRVPADALRLVTGRIDVSPSSVLTSAADGQFPYASALLRLRGGKGGFGSLLRGAASKAGQKKTSNFDACRDINGRRLRHVNAERRLEEWKAEAADRQLEKLAENFIKKKAKEAGRSGGPSAAEVDKYLEKYRXDAEICVNAGEESVRASLGKRKTAPK

SEQ ID NO: 47111 - protein, 336 aa, Sorghum bicolor
  Clone ID: SORBI-28MAY03-C4830_1.pep
RPSPSLAPPPRALATAPQPHPHPPSLAPPTTARARVSCRHRHRDVRPPWPRPPRIRSSCVSSTGAPDVSASPRPPFPARRSATPSRPSLASPLTPCASSPASSTSLPPPCARQGVLASSPTRPPSSACQKETTGSAASSDRHRPRRGRSSAETWMHEAKAEAADPDLAKLADNFSKKKAKEAARSGGPSLAALDKCLEKYRKDAEICVNAVEESVRASLGKRKTAPKLPSGADAKKLKIWLGKNKVEEDESDSDSDIDSDVDDENSEDHENTDAKSVLVDDGNCSNGSSKNEKLELGSVSGSHSEGESAGREGLSTYPSRRRRRRRRRSSSSTRRW

SEQ ID NO: 47112 - protein, 91 aa, Sorghum bicolor
  unsure (1)..(91): unsure at all Xaa locations
  Clone ID: LIB5052-003-A1-XP1-C11.pep
MVKFLKPGKAVILLQGRFAGRKKVIRKDSAKKTAKKSRVKCFIKLVNFTHLMPTRXSTRDKKVAACKTAKARLEERFKTGKNRWFFTKLRF

SEQ ID NO: 47113 - protein, 137 aa, Sorghum bicolor
  Clone ID: LIB5049-006-R1-XP1-C12.pep
MVKFLKPGKAVILLQGRFAGRKAVIVRVFEEGTRDRPYGHCLVAGLAKYPKKVIRKDSAKKTAKKSRVKCFIKLVNFTHLMPTRYTLDVDLKDVASGGPDALSTRDKKVEACKTAKYRLEERFKSGKNRWFFTKLRF

SEQ ID NO: 47114 - protein, 247 aa, Sorghum bicolor
  Clone ID: SORBI-28MAY03-C1076_1.pep
MEDERSTQQHQGGEVQENAAEVKDRGLLDSLLGRKKHEDQDKKQEEELATGMEKVTVAEPEKKEEEHEAAGERKESLLAKLHRSSSSSSPSSDEEEEVIDENGEIVKRKNTHAHHHQEEEHKPQHFPAPAPPPHVETHVHQHDHGVVVQKVEDDVKTETPPPAPEEEKKGLLDKIKEKLPGGHKKPEDAAAAAPAVHAPAPAPHAEEVSSPDGKEKKGLLGKIMDKIPGYHKGEDHKDAAGEHKTSS

SEQ ID NO: 47115 - protein, 113 aa, Sorghum bicolor
  Clone ID: LIB3478-044-P1-K1-C6.pep
ENNKLDLESTLKELNNTILGRSTRTRTRSEEEELATGMEKVTVAEPEKEEEEHEACCEKNESLVAKLHRSSCSSSSSSDQEKEAIDENGEIVKRKKKNGLKEKIKEKLPVHHK

SEQ ID NO: 47116 - protein, 167 aa, Sorghum bicolor
  Clone ID: SORBI-28MAY03-C705_1.pep
MLVYQDLLSGDELLSDSFQYKEIFDGVLWEVEGKWVVKGAVDVDIGANPSAEGGEDEGVDDQTERVVDIVDTFRLQEQPTFDKKTFVTNIKRYIKNLTGKLEPEKADEFKKGIEGATKFLLSKLKDLQFFVGESMHDDGSLVFAYYKEGATDPTFLYFAHGLKEIKC

SEQ ID NO: 47117 - protein, 71 aa, Sorghum bicolor
  Clone ID: LIB3481-059-Q6-K1-D6.pep
LSPKVARLQLPFAILITYRHIRKLHSFLNSVILNRHRLYFIFSEFAGMLSYVPFFFMKKTSEMELGATMPY

SEQ ID NO: 47118 - protein, 180 aa, Sorghum bicolor
  unsure (1)..(180): unsure at all Xaa locations
  Clone ID: SORBI-28MAY03-C181_2.pep
MGNPEKLMNQIFDLKFTSKSLQRQARKCEKEEKEQKLKXKKAIEKGNMDGARIYCENAIRKRTEHMNYLRLASRLDAVVARLDXAKMQDIGKSMQYIVTTXAPPDLQKHGLISMGDQAYFMXGAMAGPTSLSXPETEDNSLMQQVADDYGLEVSVCLTQAAAHVIPVAKDNENVDEDDLS

SEQ ID NO: 47119 - protein, 360 aa, Sorghum bicolor
  Clone ID: SORBI-28MAY03-C181_1.pep
MSCSHLSTAWSSSALASSASTTQRRGSSAPRSGLVVRCSLRELRTRIDSVKNTQKITEAMKLVAAAKVRRAQEAVVSSRPFSEALVEVLYNMNQEIQTEDIDLPLTRTRPVKKVALVVLTGERGLCGSFNNNVLKKAEARIEELKQLGLQYSVISVGKKGNAYFQRRPYIPLERDLEVNGVPTVKDSQSICDLVYSLFVSEEVDKVELLYSKFVSLVRSDPIIQTLLPMSPKGEICDINGVCVDATEDELFRLTTKEGKLTVEREKVKIETQPFSPVVQFEQDPVQILDALLPLYLNSQILRALQESLASELAARMSAMSSATDNAIELAKNLSIAYNRQRQAKITGEILEIVAGAEALA

SEQ ID NO: 47120 - protein, 138 aa, Sorghum bicolor
  Clone ID: LIB5049-010-R1-XP1-B4.pep
RPGRVASRLDAVVARLDTQAKMQVIGKSMQSIVKSLDSALATGNLQKMSETMDNFERQFVNMEVQAEFMEGAMAGSTSLSTPETEVNSLMQQVADDYGLEVSVGLPQAAAHAIPAAKDKEKVDEDDLSRRLAELKARG

SEQ ID NO: 47121 - protein, 369 aa, Sorghum bicolor
  Clone ID: SORBI-28MAY03-C340_1.pep
ANARQVPQLAPGLVSSQAAMNFGGNGNATTIRCKYCSACLTVIPGERAIQCAQCNCVTRIRRGDRIPPARPPAHVPPAFQRARGKKRAVLIGITYAGMRRGCGELRGPINDVKCMRNLLCQRFGFPSECIIMLTDDQRDPFRLPTKENIRMAMHWLVQGCSYGDSLVFHFSGLGAQVADDDGDEADGYDEAICPLDAFQRGPILDDEINEAIVRPLVHGVRLHAVVDACYSATVLDLPYVCHMSRNGFWQWEDESPPSGAWKGTSGGHAVLISGYSEGKSNFAMMPDAYASVGAMTHSFIRALECEPRGVTYGRLLTSMRAIMKNRGGGHDLQGPIGAPIHTVANFSGVQEPNLSSSEMFDIHRKPFVL

SEQ ID NO: 47122 - protein, 263 aa, Sorghum bicolor
  Clone ID: SORBI-28MAY03-C44_2.pep
MARGLKKHLKRLNAPKHWMLDKLGGAFAPKPSPGPHKARECLPLILILRNRLKYALTYREVISILMQRLVMVDGKVRTDKTYPSGFMDVVSIPKTGENFRLLYDTKGRFRLHSIRDDEAKFKMCKVRSVQFGQKGIPFLNTYDGRTIRYPDPLIKANDTIKIDLETNKIVDFIKFDVGNVVMVTGGRNTGRVGVIKSREKHKGSFETIHVEDSLGHQFATRMGNVFTIGKDKKPWVSLPKGKGIKLSIIEEARKRNAEAAAEA

SEQ ID NO: 47123 - protein, 264 aa, Sorghum bicolor
  Clone ID: SORBI-28MAY03-C44_1.pep
MARGLKKHLKRLNAPKHWMLDKLGGAFAPKPSSGPHKSRECLPLILIIRNRLKYALTYREVISILMQRHVLVDGKVRTDKTYPAGFMDVISIPKTNENYRLLYDTKGRFRLHPIRDEDAKFKLCKVRSVQFGQKGIPYLNTYDGRTIRYPDPLIKANDTIKIDLETNKIVDFIKFDVGNVVMVTGGRNTGRVGVIKNREKHKGSFETIHVEDSLGHQFATRMGNVFTIGKGNKPWVSLPKGKGIKLSIIEEQRKRDAAAQAAAA

SEQ ID NO: 47124 - protein, 365 aa, Sorghum bicolor
  Clone ID: SORBI-28MAY03-C54610_1.pep
MASQASNVVRPSDAELLQAQADLWRVSLSYLTPMSLRCAVELGIPTAIHRHGGAASAADLITALSLPSTKLPFLRRLLRLLAVAGVFTVDKTTAEDRYCINPVSYLLVDGIPHEVHINHTSLVLTCTSTRYLDAALGLAEWFKKDVVTPPFQELHGAALFHESMESLDPDYHNMANEALDAHDNFGIEIALREFRDLFEGIQSMTYCCGTCGDDKFARAIVQAYPHIKCTVLAPPKMIANKPADGVMINYVEGDMFSFIPPAQTVMLKLVLHHWTDEDCVNILAACRKAIPSREDGGKVIVGDIVIDYSGPMLETHLLMDIGMMTMTKGRQRDENEFREIFMKAGFSDYKILKKFGARVAFEVYP

SEQ ID NO: 47125 - protein, 129 aa, Sorghum bicolor
  Clone ID: SORBI-28MAY03-C7832_2.pep
MASRRVSLLLGVLLSYSAAVAVAVAAANFNQEFDITWGDGRGKIQDNGQLLTLTLDRTSGSGFQSRHEYLFGKIDMQLKLVPGNSAGTVTAYYLSSQGNTHDEIDFEFLGNVLGEPYTLHTNVFTQGQG

SEQ ID NO: 47126 - protein, 357 aa, Sorghum bicolor
  unsure (1)..(357): unsure at all Xaa locations
  Clone ID: SORBI-28MAY03-C7832_1.pep
MRSTSLVACVAWACVEAVADGGVFDRATEMTWSXGRGMVAYGGAGLDLTLQRTSGSGCRSKSDXLLGKIGVQVKLMPGNTGGTVTTFXLCSPGPGYDAIAFDFFGSFSGEPNTLPANVSAAGPAQREHPLGISHDEIDFEFLGNVSGEPYTVHTNVYSQGNREWEQQEARGVXFPRTQPMRLYASLWNADDWATQGGRVKADWTQAPFVASFRGFSADACVWANGKQQCPVGTMAAAATGGRRGGPGSWWNQQLSDMSYRRMRWVQRKFMASDYCTDCPAXAPEGVPAEYKLHWGCNHGSKEEWTKTEPPYVHYPSSINPRPWWKRVRSEGSFLYWRIMYGFAIGVSTIENLARISS

SEQ ID NO: 47127 - protein, 662 aa, Sorghum bicolor
  Clone ID: SORBI-28MAY03-C1359_1.pep
MDRVRGSAFLLGVLLAGSLFAFSVAKEETKKLGTVIGIDLGTTYSCVGVYKNGHVEIIANDQGNRITPSWVAFTDSERLIGEAAKNQAAVNPERTIFDVKRLIGRKFEDKEVQRDMKLVPYKIINKEGKPYIQVKIKDGENKVFSPEEISAMILGKMKDTAEAYLGKKINDAVVTVPAYFNDAQATKDAGVIAGLNVARIINEPTAAAIAYGLDKKGGEKNILVFDLGGGTFDVSILTIDNGVFEVLATNGDTHLGGEDFDQRIMEYFIKLIKKKYSKDISKDNRALGKLRREAERAKRALSNQHQVRVEIESLFDGTDFSEPLTRARFEELNNDLFRKTMGPVKKAMEDAGLQKSQIHEIVLVGGSTRIPKVQQLLRDYFDGKEPNKGVNPDEAVAFGAAVQGSILSGEGGDETKDILLLDVAPLTLGIETVGGVMTKLIPRNTVIPTKKSQVFTTYQDQQTTVSIQVFEGERSMTKDCRLLGKFDLSGIPPAPRGTPQIEVTFEVDANGILNVKAEDKGTGKSEKITITNEKGRLSQEEIDRMVKEAEEFAEEDKKVKERIDARNQLETYVYNMKNTVGDKDKLADKLESEEKEKVEEALKEALEWLDDNQSAEKDEYVEKLKEVEAVCNPIVSAVYQRSGGAPGGGDSEGGVDDDHDEL

SEQ ID NO: 47128 - protein, 377 aa, Sorghum bicolor
  Clone ID: SORBI-28MAY03-C2572_1.pep
MHGRGTMKKAAAAFLAALLLWSAVAAVSGQPQPGPNNKQTADNNPRLQKAYVALQALKRSITEDPKNLTANWCGPDVCAYFGVYCTTAPDDPHSQTVAGLDLNHGDLAGTFPEELGLLADLALLHLNSNRFAGGLPESLPKLRLLHELDVSNNRLTGGFPQHILCLPNIKYVDLRFNSLCGAVPAALFDKPLDAIFLNDNHFDFELPDNLGNSPASVVVLANLRLRGCIPESIGRMAGTLNELVVLNAGLRSCIPQEVGWLRELTVLDLSFNELQGMLPESMAGMHELQQLDVAHNELWGHIPEGVCALPSLRNFTYSYNYFCTEPRRCLDIRRVDDRQNCIAGRPDQRPTDQCLAFLHRPPVHCDEHGCFGPPTHY

SEQ ID NO: 47129 - protein, 148 aa, Sorghum bicolor
  Clone ID: SORBI-28MAY03-C845_2.pep
QYPYAGYIPNRPSVSRKPMPAPGSEEYAELGKNPEKVFVRTITSQFQTLVGISLLEILSSHSSDEVYLGQRDTPEWTSDAKAQEAFRRFGARLTEIESRVMTMNADPSLKNRNGPAKFPYTLLYPNTSDKNGDAAGITAKGIPNSISI

SEQ ID NO: 47130 - protein, 712 aa, Sorghum bicolor
  Clone ID: SORBI-28MAY03-C845_1.pep
REYVIIRHDQQGYVGVFHNVKGGNELYCLLFLIKQKIGLAAADAGAYHRRVRGAGDDRGNLRPVLGDPAVPARPRHLTAGDTVKKLHRHGVGRPARHQEEDDGRRGERVGHPVLAAAGGHPIKAGGHGNIPTVRASVDRGPGQFHSSQDLSLRDEGGINLPKIQGLEHMPMRFTFQLVKDLLPAGGHYLLNLPIPAIIKESKDAWRTDEEFAREVLAGVNPVVITRLTEFPPKSTLDPSKYGDHTSTITAEHIEKNLEGLTVQQALDGNRLYILDHHDRFMPFLIDVNNLEGNFIYATRALFFLRADGRLAPLAIELSEPYIDDGLTTAKSTVYTPTSTTGAEAWVWHLAKAYVAVNDSGWHQLISHWLNTHAVMEPFVIATNRQLSVTHPVHKLLHPHFRDTMTINALARQTLINGGGIFELTVFPRQYALDMSSVVYKDWNFTEQGLPADLVKRGVAVEDPSSPYKVRLLIQDYPYASDGLAIWHAIEQWVGEYLAIYYPDDAALRGDEELQAWWKEVREVGHGDLKDAAWWPKMQAVSELASACTTIIWIASALHAAVNFGQYPYAGYLPNRPTVSRRRMPEPGSKEYEELERYPERGFIHTITSQIQTIIGISLIEILSKHSSDEVYLGQRDTPEWTSDAKAKAAFKRFSDALVAIEGKVVGENRDPQLKNRNGPAEFPYMLLYPNTSDHSGAAAGLTAKGIPNSISI

SEQ ID NO: 47131 - protein, 97 aa, Sorghum bicolor
  Clone ID: LIB3476-025-P1-K1-F9.pep
DAWVRKQFPLELVKDVLPVGGDYLLKLAMPQIIKEDKTGWMTDEEFGREILAGVNPMIVRRLTEFPPRSTLDPSKYGDHTSTITEAHLENKLEGATV

SEQ ID NO: 47132 - protein, 73 aa, Sorghum bicolor
  Clone ID: LIB3476-057-P1-K1-F6.pep
THPVHKLLLPNYRDTMNINSNARQMLVNAGGLFETTVFPRQYAFEMSAVIYKNWNFTEQALPDDLIKRLIWRV

SEQ ID NO: 47133 - protein, 198 aa, Sorghum bicolor
  Clone ID: SORBI-28MAY03-C6866_2.pep
MSHRKFEHPRHGSLGFLPRKRSPRHHGKVKSFPRDDPKKACHLTAFLGYKAGMTHIVREVEKPGSKLHKKETCEAVTIIETPPLVIVGLVAYVKTPRGLRTLNTVWAQHLSEEVRRRFYKNWCKSKKKAFSKYALKYDNDAGKKEIQLQLEKMKKYASVVRVIAHTQIKKMKGLKQNKAHLMEIQVNGGTIADKVDYG

SEQ ID NO: 47134 - protein, 389 aa, Sorghum bicolor
  Clone ID: SORBI-28MAY03-C6866_1.pep
MSHRKFEHPRHGSLGFLPRKRSSRHRGKVKSFPRDDPKKPCHLTAFVGYKAGMTHIVREVEKPGSKLHKKETCEAVTIIETPPLVIVGLVAYVKTPRGLRTLNSVWAQHLSEEVRRRFYKNWCKSKKKAFTKYALKYDSDAGKKEIQLQLEKMKKYASVIRVIAHTQIKKMKGLKQKKAHLMEIQVNGGTIADKVDYGYKFFEKEVPVDAVFQKDEMIDIIGVTKGKGYEGVVTRWGVTRLPRKTHRGLRKVACIGAWHPARVSYTVARAGQNGYHHRTEMNKKVYKIGKAGQESHDASTEFDRTEKDITPMGGFPHYGIVKGDYLMIKGCCVGPKKRVVTLRQSLLKQTSRLALEEIKLKFIDTSSKFGHGRFQTTDEKQKFYGKQKA

SEQ ID NO: 47135 - protein, 510 aa, Sorghum bicolor
  Clone ID: SORBI-28MAY03-C1085_1.pep
MGTRGIALVLLAAALLQALLPASAAAEGLVRVALKKQPIDQNGRVAARLSAEERQRLLLRGANALGSGSDDCDVIALKNYMNAQYFGEIGVGTPEQKFTVIFDTGSSNLWVPSSKCYFSIACYFHSRYKSGQSSTYKKNGKPAAIQYGTGSIAGFFSEDSVTLGDLVVKDQEFIEATKEPGLTFMVAKFDGILGLGFQEISVGNATPVWYNMVKQGLISDPVFSFWFNRHADDGEGGEIVFGGMDSSHYKGDHTYVPVTQKGYWQFNMGDVLVDGVSTGFCAGGCAAIADSGTSLLAGPTAIITEINEKIGAAGVVSQECKTVVSQYGQQILDLLLAETQPAKVCSQVGLCTFDGTHGVSAGIRSVVDDEAGKSNGGLKSDPMCSACEMAVVWMQNQLAQNKTQELILNYINQLCERLPSPMGESAVDCASLGSMPDIAFTIGGKKFKLKPEQYILKVGEGQAAQCISGFTAMDIPPPRGPLWILGDVFMGVYHTVFDYGKLRVGFAESA

SEQ ID NO: 47136 - protein, 125 aa, Sorghum bicolor
  Clone ID: LIB3480-043-P1-K1-B2.pep
KFSKGTGDITAIIVTPDGKFNTAGAIVAKSECWTLLKGGATSYAEGKSDLFFESNSTAEIMAESIALQGFSFEEWNAHREEVVAKERKNISGCIGHHASASCTELLPCTLATCTEEKKNKKKKKK

SEQ ID NO: 47137 - protein, 583 aa, Sorghum bicolor
  Clone ID: SORBI-28MAY03-C381_1.pep
MGLFTVTKKATTPFEGQKPGTSGLRKKVTVFQQPHYLQNFVQSTFNALPADQVKGATIVVSGDGRYFSKDAVQIITKMAAANGARRVWVGLNSLMSTPAVSAVIRERVGADGSKATGAFILTASHNPGGPTEDFGIKYNMGNGGPAPESVTDKIFSNTTTISEYLISEDLPDVDISVVGVTSFSGPEGPFDVDVFDSSVDYIKLMKTIFDFEAIKKLLTSPKFTFCYDALHGVAGAYAKHIFVEELGADESSLLNCVPKEDFGGGHPDPNLTYAKELVERMGLGKSSSNVEPPEFGAAADGDADRNMILGKRFFVTPSDSVAIIAANAVQSIPYFASGLKGVARSMPTSAALDVVAKNLNLKFFEVPTGWKFFGNLMDAGMCSICGEESFGTGSDHIREKDGIWAVLAWLSIIAFKNKDNLGGDKLVSVEDIVRQHWATYGRHYYTRYDYENVDAGAAKELMANLVSMQSSLSDVNKLIKEIRSDVSEVVAADEFEYKDPVDGSVSKHQGIRYLFGDGSRLVFRLSGTGSVGATIRVYIEQYEKDSSKIGRDSQDALAPLVDVALKLSKMQEYTGRSAPTVIT

SEQ ID NO: 47138 - protein, 171 aa, Sorghum bicolor
  Clone ID: SORBI-28MAY03-C3087_1.pep
MEHKETGCQAPEGPILCINNCGFFGSAATMNMCSKCHKEMIMKQEQAKLAASSIDSIVNGNDAVMEPVVAGNTVVAAAPIELQTMNVQPADVAGPSEGAAVISKGKVGPNRCSTCRKRVGLTGFNCRCGNLYCALHRYSDKHDCKFDYRTAARDAIAKANPVVKADKLDKI

SEQ ID NO: 47139 - protein, 56 aa, Sorghum bicolor
  Clone ID: SORBI-28MAY03-C1601_2.pep
MERMSSSLQSWVEEHKLSTIGAVWATAVGASGSFSLRHSPSRQPSLGRCHARMLPH

SEQ ID NO: 47140 - protein, 233 aa, Sorghum bicolor
  Clone ID: SORBI-28MAY03-C1601_1.pep
MEGKEEDVRLGANKYSERQPIGTAAQGTDDKDYKEPPPAPLFEPGELKSWSFYRAGIAEFVATFLFLYISILTVMGVSKSTSKCATVGIQGIAWSFGGMIFALVYCTAGISGGHINPAVTFGLFLARKLSLTRAVFYIIMQCLGAICGAGVVKGFQQGLYMGNGGGANVVAPGYTNGDGLGAEIVGTFVLVYTVISATDDDKNASEAHVPILAPLAASYHVVIIRAIPFKSRD

SEQ ID NO: 47141 - protein, 105 aa, Sorghum bicolor
  Clone ID: LIB3476-048-P1-K1-F3.pep
TAGVGRRRVPRACASSTPGCTRRRSPSPSGAEPRSRTTTAAAAPGSSGRRSWTTASTPSCRPPPTPTATRTSAGAGSKDKEEEKERQERGTNNNKLVAIMGGWPG

SEQ ID NO: 47142 - protein, 306 aa, Sorghum bicolor
  unsure (1)..(306): unsure at all Xaa locations
  Clone ID: SORBI-28MAY03-C5596_1.pep
MAAAPAGGGARALSQREQDIQMMLAADVHLGTKNCDFQMERYVYKRRTDGIYIINLGKTWEKLQLAARVIVAIENPQDIIVQSARPYGQRAVLKFAQYTGAHAIAGRHTPGTFTNQLQTSFSEPRLLILTDPRTDHQPIKESALGNIPTIAFCDTDSPMRYVDIGIPANNKGKQSIGXLFWLLARMVLQMRGTILPGHKWDIMVDLFFYRDPEEAKEQEEEEALVAPDYGAVAEYTAPGGENWGGADWGTGEAAAPPAGIPAAGADWAAAPAPPVDGVWDAAAPPPAATGWEEGAAPVAAPTPNWG

SEQ ID NO: 47143 - protein, 166 aa, Sorghum bicolor
  Clone ID: LIB5052-011-A1-XP1-F6.pep
MIQSTYRSSLSNFLQPIKESALGNIPTIAFCDTDSPMRYVDIGIPANNKGKQSIGCLFWLLARMVLQMRGTILPGHKWDIMVDLFFYRDPEEAKEQEEEEALVAPDYGAVAEYTAPGGENRGGADWGTGEAAAPPAGIPAAGADWAAAPGPDTPHIIHDLHKDKIL

SEQ ID NO: 47144 - protein, 394 aa, Sorghum bicolor
  Clone ID: SORBI-28MAY03-C147_1.pep
MAAESFLFTSESVNEGHPDKLCDQVSDAVLDACLAQDPDSKVACETCTKTNMVMVFGEITTKATVDYEKIVRDTCREIGFVSDDVGLDADRCKVLVNIEQQSPDIAQGVHGHFTKRPEEIGAGDQGHMFGYATDETPELMPLSHVLATKLGARLTEVRKNGTCAWLRPDGKTQVTVEYVNEGGAMVPVRVHTVLISTQHDETVTNDEIAADLKEHVIKPVIPEKYLDEKTIFHLNPSGRFVIGGPHGDAGLTGRKIIIDTYGGWGAHGGGAFSGKDPTKVDRSGAYIARQAAKSIVASGLARRCLVQVSYAIGVPEPLSVFVDSYGTGSIPDKEILKIVKENFDFRPGMITINLDLKKGGNRFIKTAAYGHFGRDDADFTWEVVKPLKFDKASA

SEQ ID NO: 47145 - protein, 295 aa, Sorghum bicolor
  unsure (1)..(295): unsure at all Xaa locations
  Clone ID: SORBI-28MAY03-C30850_1.pep
MATGGGKAAALLLGLLLLLCVLRHGAAQRYNAIWSFGDSISDTGNLCVGGGPSRTATAQPSIGEAWLGRPSGNPPIRRGCSYLAARIFGXLIVCCLFRANXPCASSSSRFVYTVMSSDGFVIWLXNYSWEVGGFGVLGTMNKCVMXAVCNFLNXKNTVGEIPTVVGEFGGNDYNAALFAGRSMAEVRGYVPRVVSKLVRGLETIVRSGAVDVVVPGVLPIGCFPIYLTLYGTSNAADYDRDGCLRSYNGLSYYHNALLKRSLASLQRTYPHARIMYADFYTQVTHMIRAPHNFGE

SEQ ID NO: 47146 - protein, 121 aa, Sorghum bicolor
  Clone ID: SORBI-28MAY03-C1239_2.pep
MLDKLWDDVVAGPHPETGLEKLRKAATARPILIDKDADAGAAGSYKRTQSMPSTPTTPVTPSSSSTTTTPRGASNVWRSVFHPGSNLATKGMGANLFDRPQPNSPTVYDWLYSDETRSNHR

SEQ ID NO: 47147 - protein, 184 aa, Sorghum bicolor
  Clone ID: SORBI-28MAY03-C1239_1.pep
MGLAYYYHQRLVLLAVVAFLCAGLFPQALGKGHGGAVNPAVAGICSRTPFPEVCKSTAGRHASKYPVIDNLAVLNMQVEAFSKRTAQARQHVAKSARTIPPAQKQALTFCDTMYMNTQDTIGAAQRAITFKDTSTAKIMLQLAVQDFDSCDRPFTQAGIPNPMGKFDKELNQMANNCMTLANMI

SEQ ID NO: 47148 - protein, 114 aa, Sorghum bicolor
  Clone ID: LIB5121-009-A1-PF1-A6.pep
MENRKEEQQGAAVGWMTVPAFGDWDVKNGAVPDYSMDFSKIREMRKQNKRELSRASLGGDEDLLQQQQQQQSSKAQPPKSSAVVADDHHRRPLHDDSPTGRKKFLSYFHCCIRA

SEQ ID NO: 47149 - protein, 135 aa, Sorghum bicolor
  Clone ID: LIB5121-010-A1-PF1-A6.pep
RKKEDAGQAVGRRGGGASPGDGPREAPQGRHCPPHPHRQRRGCRSRGELQADAVDAVDPDDAGDAVVADYSMDFSKIREMGKQNKCELSRASLGGDEDLLQQQQQQQSSKGQPPKSSAVDADDHHRRPLHDDSPT

SEQ ID NO: 47150 - protein, 364 aa, Sorghum bicolor
  Clone ID: SORBI-28MAY03-C1134_1.pep
MAGTVTVPGASVPSTPLLKDELDIVIPTIRNLDFLEMWRPFFQPYHLIIVQDGDPTKTIKVPEGFDYELYNRNDINRILGPKASCISFKDSACRCFGYMVSKKKYIYTIDDDCFVAKDPTGKDINALEQHIKNIMSPSTPFFFNTLYDPYREGADFVRGYPFSLREGTHTAVSHGLWLNIPDYDAPTQLVKPKERNERYVDAVMTIPKGTLFPMCGMNLCFDRDLIGPAMYFGLMGDGQPIGRYDDMWAGWCVKVICDHLSLGVKTGLPYIWHSKASNPFVNLRKEYKGIFWQEDIIPFFQNVTIPKDCDTVQKCYIYLSGQVKEKLGTIDPYFVKLADAMVTWIEAWDELNPATPATENGKAK

SEQ ID NO: 47151 - protein, 124 aa, Sorghum bicolor
  unsure (1)..(124): unsure at all Xaa locations
  Clone ID: LIB3476-034-P1-K1-C6.pep
QHIKNMVSASTLFFFNTLYDPYREGADYVRGYPFSLREGTHTAVFHGLWLNIPDYDAPTQLVKPKERNXRYVDAVMTIPKGTLFPMCGMNLCFDRDLIGPSMYXFGLMGDGQPIGRYDDMSAGW

SEQ ID NO: 47152 - protein, 372 aa, Sorghum bicolor
  Clone ID: SORBI-28MAY03-C36731_1.pep
MAASSHAIAPTDAELLQAQADLWRHSLYYLTSMALKCAVELHIPTAIHNLGGATTLPDLVTALSLPKTKLPFLGRIMRLLVTSGIFASDGANGDGAAAEAVYRLNPLSWLLVEGVESEDHTYQKYFVLATVSQHYVDAGLSLADWFRKDLPEPLPSPFECLHGVPLAHESTKLLDEELDRIVEEGVAAHDNLAIGTIIRECSDIFSGLHSLTYCCGRQGNISATAIIKAFPDIKCTVLNLPRVIETAPADDAVSSVTGDLFHTIPPAQAVMLKLVLHFWSDEDCVKILEQCRKAIPSREEGGKVIIIEILLGPYMGPIMYEAQLLMDMLMMVNTRGRQRTENDWRQIFTKAGFSDYKIVKKIGARGVIEVYP

SEQ ID NO: 47153 - protein, 98 aa, Sorghum bicolor
  Clone ID: SORBI-28MAY03-C10950_4.pep
MAKQAVAMLVSVALLVVVVVAVTSAGGASAQQCNVSLLAVCAPAVISGSAPTAPCCANLRAQQPCFCQYARNPAYSSYISSPNARRTLTSCGIAVPSC

SEQ ID NO: 47154 - protein, 98 aa, Sorghum bicolor; identical to SEQ ID NO: 47153
  Clone ID: SORBI-28MAY03-C10950_3.pep

SEQ ID NO: 47155 - protein, 223 aa, Sorghum bicolor
  Clone ID: SORBI-28MAY03-C10950_2.pep
MADQFILGRPIGEGAPGEHGAGTGLSGGHGIASAANTQSGKYAEEERSGFNAGLGGEHASGGIPHGHSGSAHPIADKFTSGSHSHTDGSGLTGSSGGKLDNSLDNYGGQAGSGSHGSHSGALGAGAAGLGAGALGAGAASGHRGQEAVSGEYAGSGTNDALTGESHATRTGAGVGPLGENTSSGVGAGAGAGAGGLATAKSGVDTTGVDVDSFKYGTGVGAAG

SEQ ID NO: 47156 - protein, 370 aa, Sorghum bicolor
  Clone ID: SORBI-28MAY03-C10950_1.pep
MAKQAVAMLESVALLGAVAAPSTSAGRASKKKKTSTPDPPPRHQAKKQARSCSPLNQQLKQLPRLIIETSSTVSTMATNLKWAPVLALLLVAAMVGSTSAGNIAVYWGQNGNEGTLADTCNSGLYAYVILAFLTTFGNGQTPVLNLAGHCDPGSGGCTGLSSDIQTCQSQGIKVLLSIGGATGSYGLSSTDDANSVADYLWNSYLGGSDGSTRPLGAAVLDGVDFDIENGQSAHYDDLATALKGKGSVLLSAAPQCPYPDASLGAALQTGQFDNVWIQFYNNPGCAYANGDDTNLVNAWSTWTSSVTAGSFYLGLPASTQAAGSGYIEPGTLTGTVLPAIKGVGKYGGIMVWNRFYDVQNNYSAQVKDSV

SEQ ID NO: 47157 - protein, 435 aa, Sorghum bicolor
  Clone ID: SORBI-28MAY03-C14178_1.pep
MASEKHFKYVILGGGVAAGYAAREFAKQGVKPGELAIISKEAVAPYERPALSKGYLFPQNAARLPGFYVCVGSGGERLLPEWYSEKGIELILSTEIVKADLSTKTLTSAAGANFTYEILLIATGSSVIKLTDFGTPGADSNNILYLREIDDADKLVAAIQAKKGGKAVVVGGGYIGLELSAALKINDFDVTMVFPEPWCMPRLFTADIAAFYEAYYTNKGVKVLKGTLAVGFDADANGDVTAVKLKDGTVLEADIVVVGVGGRPLTTLFKGQVAEEKGGIKTDAFFETSVPGVYAIGDVATFPLKMYNELRRVEHVDHSRKSAEQAVKAIKGKESGEPVPEYDYLPYFYSRSFDLGWQFYGDNVGETILFGDSDPTSSKPKFGSYWIKDGKVLGAFLEGGSPDENKAIAKVAKTQPPVANLEELKKEGLQFASKI

SEQ ID NO: 47158 - protein, 407 aa, Sorghum bicolor
  Clone ID: SORBI-28MAY03-C120_1.pep
MAASAMELSLLNPAATHRHLGGLPLARRSVVRFRRVSASAAAAAPPKSSGPKKRGKTEIQETLLTPRFYTTDFDEMERLFNAEINKQLNQAEFDALLQEFKTDYNQTHFVRNPEFKAAADKMEGPLRQIFVEFLERSCTAEFSGFLLYKELGRRLKKTNPVVAEIFSLMSRDEARHAGFLNKGLSDFNLALDLGFLTKARKYTFFKPKFIFYATYLSEKIGYWRYITIFRHLKANPEYQVYPIFKYFENWCQDENRHGDFFSALLKAQPQFLNDWKAKLWSRFFCLSVYVTMYLNDCQRTAFYEGIGLDTKEFDMHVIIETNRTTARIFPAVLDVENPEFKRKLDRMVVINQKIIAIGESDDIPLVKNLKRIPLIAALVSEIIAAYLMPPIESGSVDFAEFEPQLVY

SEQ ID NO: 47159 - protein, 117 aa, Sorghum bicolor
  Clone ID: SORBI-28MAY03-C2355_3.pep
RCGFVCWVGDRTGSCFSSLGSPNLCVPVPCFMLLASRLTHHHHGVLQIERSYSATHKVQLDLNSKFSIYSCNLERTNLFKSMYVHLPKVTRKRHQSSNFTHLHCSVHTFHSSNACLP

SEQ ID NO: 47160 - protein, 262 aa, Sorghum bicolor
  Clone ID: SORBI-28MAY03-C2355_2.pep
IPILQVTKDGCPIIFHDNFIFTQEDGKISQKRVTDIHLEDFLQYGPQNEQGKVGKPLLRRLKDGRMVNWNVQSEDALCTLEEAFEKVNTRLGFNVELKFDDSLEYQEEELTRILQAILKVIFEHAKDRPILFSSFQPDAAQLMRKLQGTYPVYFLTNGGTELYTDVRRNSLEEAVNLCLASGMQGIVSEARGIFRHPAAVPKIKEANLSLLTYGTLNNVPEAVYMQHLMGVNGVIVDLVPEITDAVSELIALPEPDLEVDNL

SEQ ID NO: 47161 - protein, 165 aa, Sorghum bicolor
  Clone ID: SORBI-28MAY03-C2355_1.pep
TGTPLNLSLYRDNQEIDTDTSGIFSHPAAVPKIKEANLSLITYGTLNNVPEAVYMQHLMGVNVVIDDLVPHLSDLIIIEISSNNYQYKEIIDRLGAEDRSSKRATLRRLPVVHRDPDLAGNGNVPAQHQIQRANHADQDPPSTQTVRPRLASSRFAISSFEPTSS

SEQ ID NO: 47162 - protein, 533 aa, Sorghum bicolor
  Clone ID: SORBI-28MAY03-C5466_1.pep
MMGGRALLLLLVSALLVQIRASDPLLYEPFDEDFEGRWVVSKKDEYQGVWKHAKSDGHEDYGLLVSEKARKYAIIKELDEPVTLKDGTVVLQFEVRLQNGLECGGAYIKYIRPQDAGWDAKEFDNETPYTIMFGPDKCGSTNKVHFILKHKNPKTGKYVEHHLKFPPSVPYDKLSHVYTAILKPDNEVRILVDGEEKKKANFLSADDFEPALIPSKTIPDPDDKKPEDWDERAKIPDPDAVKPDDWDEDAPMEIVDEEATKPEGWLDDEPEEIDDPEAAKPEDWDDEEDGEWEAPKIDNPKCEEAPGCGEWKRPMKQNPAYKGKWHAPMIDNPNYKGIWKPQEIPNPEYFELDKPDFDPIAAIGIEIWTMQDGILFDNILIADDEKVATSILEKTWKPKYDVEKEKEKAEEAAAGADGLSEFQKKIFDVLYKIADVPFLAPYKTKIIDVIEKGEKQPNITIGILVSVVIVFVTVLFRILFGGKKPAVPVKPAAEAKKPKATETDGAGSSGDKDEKEDEKEETAAPRRRTRRET

SEQ ID NO: 47163 - protein, 225 aa, Sorghum bicolor
  Clone ID: SORBI-28MAY03-C547_1.pep
MDSEHWISRLAAAKRFYAAQLGHSDRAGMEELDMDEEVRPEFACPYCYEDHDVGSLCAHLEEEHPFEPQAAACPVCSEMVTKDMVNHITMQHGYLFKNRRRLRRFIIPGSQALSLLSRDLREAHLQVLLGGGHRSSNNNSTTNISADPLLSSFGLSFPTSDAEQTSKSTLSIPDDATMIKETPAQARKLSIDSSLTSEEREQKRKQASVRATFVQDLLLSTLFGD

SEQ ID NO: 47164 - protein, 117 aa, Sorghum bicolor
  Clone ID: SORBI-28MAY03-C10057_2.pep
RKSGGADDGEYGFSRDDDDSEMYRKEEKEHKHKEHLGEMGALAAGAFALYERHEAKKDPEHAQRHKIEEGVAAVAALGSGGFAFHEHHDKKEAKDAAEDAEEESGRGEGKKKHHFFG

SEQ ID NO: 47165 - protein, 339 aa, Sorghum bicolor
  Clone ID: SORBI-28MAY03-C10057_1.pep
ELPANGGWSNRKYSATNNCKQSSTILFNTRLRERWLTSTAAAATAGPAPATTTTAATTASPGLMTTAVAKVATTSPAATTTAAAVAAMGTTGPAATTTAVAPAAVGTTSPARTTTTVGTTNRAPTTTSTAAVAPAAGTTASPLAMTRTPAAPGTTASPLATTTHTPASGTTASPLATTHTPAAGTTESPLGGTRGGRVRRVRVTRGTRTEGGRGRGRGRRGGVRTRRGEEEAPLLRLMMELLLLFATPTSSMHACMHAAASWRIKKLSVSVYVCMYDDVPVSLCSYTVMVCLCMLLALCTVESTCSVCLFGAWLRTYGVHGCMCICLISCFSLLCGIYM

SEQ ID NO: 47166 - protein, 116 aa, Sorghum bicolor
  Clone ID: LIB3478-054-Q6-K1-B3.pep
PATTTTAATTASPGLMTTAVAKVATTSPAATTTAAAVAAMGTTGPAATTTAVAPAAVGTTSPARTTTTVGTTNRAPTTTSTAAVAPAAGTTASPLAMTRTPAAPGTTASPLATTTH

SEQ ID NO: 47167 - protein, 492 aa, Sorghum bicolor
  Clone ID: SORBI-28MAY03-C25_1.pep
MDPYKHRPSSGSNSSFWTTNSGAPVWNNNSALTVGQRGPILLEDYHLIEKLAQFDRERIPERVVHARGASAKGFFEVTHDISHLTCADFLRAPGVQTPVIVRFSTVVHERGSPETLRDPRGFAVKFYTREGNFDLVGNNMPVFFIRDGMKFPDMVHAFKPNPKTNLQENWRIVDFFSHHPESLHMFTFLFDDVGIPLNYRHMEGFGVNTYTLINRDGKPHLVKFHWKPTCGVKCLLDDEAVTVGGTCHSHATKDLYDSIAAGNYPEWKLYIQTIDLDHEDKFDFDPLDVTKTWPEDIIPLQPVGRMVLNKNIDNFFAENEQIAFCPAIIVPGIHYSDDKLLQTRIFSYADTQRHRLGPNYLMLPVNAPKCAHHNNHHEGFMNFMHRDEEVNYFPSRFDPTRHAEKVPIPSRVLTGCREKCIIEKENNFKQAGERFRSFDPARQDRFIQRWVDALSDPRVTHEHHTIWINYWSQCDASLGQKLASRLNLKPNM

SEQ ID NO: 47168 - protein, 149 aa, Sorghum bicolor
  Clone ID: SORBI-28MAY03-C497_10.pep
MAPKAEKKPAAKKPAEEEPAAEKAPAGKKPKAEKRLPAGKSAGKEGGDKKGKKKAKKSVETYKIYIFKVLKQVHPDIGISSKAMSIMNSFINDIFEKLAAEAAKLARYNKKPTITSREIQTSVRLVLPGELAKHAVSEGTKAVTKFTSS

SEQ ID NO: 47169 - protein, 137 aa, Sorghum bicolor
  unsure (1)..(137): unsure at all Xaa locations
  Clone ID: SORBI-28MAY03-C497_9.pep
MAPKAEKKPAEKKPPEEKAEKKPRAGETRPRQGPAREKTQPKSHEHCPPPTSKFAIRRFPPRVRRSIXRLLMAPKAEKKPAEKKPAEEKAAKLARYNKKPTITSREIQTSVRLVLPGELAKHAVSEGTKAVTKFTSS

SEQ ID NO: 47170 - protein, 151 aa, Sorghum bicolor
  Clone ID: SORBI-28MAY03-C497_8.pep
MAPKAEKKPAAKKLAEEEPAAEKAPAGKKPKAEKRLPAGKSAGKEGGGEGKRGRKKGKKSVETYKIYIFKVLKQVHPDIGISSKAMSIMNSFINDIFEKLAAEAAKLARYNKKPTITSREIQTSVRLVLPGELAKHAVSEGTKAVTKFTSS

SEQ ID NO: 47171 - protein, 149 aa, Sorghum bicolor
  Clone ID: SORBI-28MAY03-C497_6.pep
MAPKAEKKPAAKKPAEEEPAAEKAPAGKKPKAEKRLPAGKSAGKEGGDKKGKKKAKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 47172 - protein, 153 aa, Sorghum bicolor
  Clone ID: SORBI-28MAY03-C497_5.pep
MAPKAEKKPAAKKPAEEEPATEKAEKAPAGKKPKAEKRLPAGKSAGKEGGEGKKGKKKAKKSVETYKIYIFKVLKQVHPDIGISSKAMSIMNSFINDIFEKLAAESAKLARYNKKPTITSREIQTSVRLVLPGELAKHAVSEGTKAVTKFTSS

SEQ ID NO: 47173 - protein, 151 aa, Sorghum bicolor
  Clone ID: SORBI-28MAY03-C497_4.pep
MAPKAEKKPAAKKPVEEESAAPAEKAPAGKKPKAEKRLPAGKSASKEGGEKRGRKKGKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 47174 - protein, 152 aa, Sorghum bicolor
  Clone ID: SORBI-28MAY03-C497_3.pep
MAPKAEKKPAAKKPAEEEPSTEKAEKAPAGKKPKAEKRLPSGKSAGKEGGEKKGKKKAKKSVETYKIYIFKVLKQVHPDIGISSKAMSIMNSFINDIFEKLAAEAAKLARYNKKPTITSREIQTSVRLVLPGELAKHAVSEGTKAVTKFTSS

SEQ ID NO: 47175 - protein, 148 aa, Sorghum bicolor
  Clone ID: SORBI-28MAY03-C497_2.pep
MAPKAEKKPAEKKPAAEEKAEKAPAGKKPKAEKRLPASKSSGKEGGEKKGKKKAKKSVETYKIYIFKVLKQVHPDIGISSKAMSIMNSFINDIFEKLAGEAAKLARYNKKPTITSREIQTSVRLVLPGELAKHAVSEGTKAVTKFTSN

SEQ ID NO: 47176 - protein, 218 aa, Sorghum bicolor
  Clone ID: SORBI-28MAY03-C497_1.pep
MAVFSDLHTADGLKTLEAHLAGKTYVSGDAITKDDIKVFAAVPSKPGAEFPNAARWYETISAAVASRFPGKPVGVNLPAGSAPAAAAPAAEAEDDDDLDLFGDETEEDKKAADERAAAKASSKKKESGKSSVLMDVKPWDDETDMKKLEEAVRSVQMEGLTWGASKLVPVGYGIKKMTIMLTIVDDLVSVDSLIEDHLTEEPINEYVQSCDIVAFNKI

SEQ ID NO: 47177 - protein, 155 aa, Sorghum bicolor
  Clone ID: LIB5050-008-R1-XP1-B7.pep
MAPKAEKKPASKKPAEEEPSEKAAPAEKAPAGKKPKAEKRLPAGKSSAGKEGGEKKGRKKGKKSVETYKIYIFKVLKQVHPDIGISSKAMSIMNSFINDIFEKLAAESAKLARYNKKPTITSREIQTSVRLILPGELAKHAVSEGTKAVTKFTSS

SEQ ID NO: 47178 - protein, 48 aa, Sorghum bicolor
  Clone ID: LIB5051-006-A1-XP1-E12.pep
GPFFFFFFKLVSDIWYRFAYIKRLTAGHSSAVRASILIEIITCRTRTE

SEQ ID NO: 47179 - protein, 105 aa, Sorghum bicolor
  unsure (1)..(105): unsure at all Xaa locations
  Clone ID: LIB3476-025-P1-K1-C3.pep
MAPKAEKKPAAKKPAEEEPAAEKAEKTPAGKKPKAEKRLPAGKSSAGKDGEGKKGKKKAKKSVETYKIYIFKVLKQVHPDIGIXSKAMSIMNSFINDIFEKLAGE

SEQ ID NO: 47180 - protein, 90 aa, Sorghum bicolor
  Clone ID: SORBI-28MAY03-C155_2.pep
PGTLPFFFFFFGTTHPNSNTSQITTHNKYPWLRQNTCLKTWGGQPEKVTAAQDALLLRAKANSLAQLGKYTSDGEAAEAKEGMFVKNYSY

SEQ ID NO: 47181 - protein, 389 aa, Sorghum bicolor
  Clone ID: SORBI-28MAY03-C155_1.pep
MVAASLLKSSFLPKKSEWGATRQAAASPRPATVSVVVRASAYADELVKTAKTIASPGRGILAMDESNATCGKRLASIGLENTEANRQAYRTLLVTAPGLGQYISGAILFEETLYQSAVDGRKIVDILVEQGIVPGIKVDKGLVPLAGSNNESWCQGLDGLASREAAYYQQGARFAKWRTVVSIPNGPSELAVKEAAWGLARYAAISQDNGLVPIVEPEILLDGEHGIERTFEVAQKVWAETFYAMAENNVMFEGILLKPSMVTPGAEAKDRATPEQVAEYTLKLLHRRIPPSVPGIMFLSGGQSEVEATQNLNAMNQGTNPWHVSFSYARALQNTCLKTWGGQPEKVTAAQDALLLRAKANSLAQLGKYTSDGEAAEAKEGMFVKNYSY

SEQ ID NO: 47182 - protein, 807 aa, Sorghum bicolor
  Clone ID: SORBI-28MAY03-C445_1.pep
MRKWALSSALLLLFLLTTLPDPAKKLQVNAEESRDDLANPPKVEEKLGAVPHGLSTDSDVAQREAESISRKTLRSSAEKFEFQAEVSRLMDIIINSLYSNKDIYLRELISNASDALDKIRFLSLTDKEVLGEGDTAKLEIQIKLDKEKKILSIRDRGIGMTKEDLIKNLGTIAKSGTSAFVEKMQSGGDLNLIGQFGVGFYSVYLVADYVEVVSKHNDDKQYVWESKADGSFAISEDTWNEPLGRGTEIRLHLRDEAKEYLEEDKLKDLVKKYSEFINFPIYLWSTKEVDVEVPADEGETSDEEDSTPETTEEETEEDEEKEKKPKTKTIKETTSEWELLNDVKAVWLRSPKEVTDEEYSKFYHSLAKDFGDDKPMGWSHFTAEGDVEFKALLFIPPKAPHDLYESYYNSNKSNLKLYVRRVFISDEFDDLLPKYLSFLRGIVDSDTLPLNVSREMLQQHSSLKTIKKKLIRKALDMIRKLAEEDPDEYSNKDKTDEEKSEVEEKKGQYAKFWNEFGKSIKLGIIEDATNRNRLAKLLRFESSKSDGKLASLDEYISRMKPGQKDIFYITGSSKEQLEKSPFLERLTKKNYEVIFFTDPVDEYLMQYLMDYEDKKFQNVSKEGLKLGKDSKLKELKESFKELSDWWKKALESENVDSVKISNRLHNTPCVVVTSKYGWSANMEKIMQAQTLSDSSKQAYMRGKRVLEINPRHPIIKELRDKVAQDNESEELKHTARLVYQTALMESGFNLPDPKEFASSIYKSVQKSLDLSPDATVEEEDEAEEQPEIEEKESTKEESEPSYDKDEL

SEQ ID NO: 47183 - protein, 414 aa, Sorghum bicolor
  Clone ID: SORBI-28MAY03-C21_1.pep
MAFNKIQVANPVVEMDGDEMTRVFWKSIKDKLIFPFVDLDIKYFDLGLPYRDETDDKVTVEAAEATLKYNVAIKCATITPDEARVKEFGLKAMWKSPNGTIRNILNGTVFREPIICKNIPRLVPGWTKPICIGRHAFGDQYRATDAVIKGPGKLKLMLVFEGKEEQIDLEVFNFTGAGGVALSMYNTDESIRAFAEASMTTAYEKKWPLYLSTKNTILKKYDGRFKDIFQEVYEAGWKSKFEAAGIWYEHRLIDDMVAYALKSEGGYVWACKNYDGDVQSDFLAQGFGSLGLMTSVLVCPDGKTIEAEAAHGTVTRHFRVHQKGGETSTNSIASIFAWTRGLAHRAKLDDNARLLDFALKLEAACVGTVESGKMTKDLALLVHGSASVTRSHYLNTEEFIDAVATELRSRLGAN

SEQ ID NO: 47184 - protein, 234 aa, Sorghum bicolor
  Clone ID: SORBI-28MAY03-C1644_2.pep
MARQQQVASMLAAALLVATFASIPTSVHSIGVCYGMLGNNLPSSSDVVQLYRSKGIKGMRIYSPSQSALDALRNSGLAVIVDTGNGNELSQLARSASYAASWVQSNVKPYYPAVNIKYIAVGNEVQGGATQSILPAIRNLDAALARAGLSAIKCSTSVRFDVIANSYPPSSGSFAQGYMADVAGYLAGTGAPLLVNVYPYFSYRDNPRDISLGYATFQPGTTVRDNGNGLTYTN

SEQ ID NO: 47185 - protein, 337 aa, Sorghum bicolor
  Clone ID: SORBI-28MAY03-C1644_1.pep
MARQQQVASMLAAALLVATFASIPTSVHSIGVCYGMLGNNLPSSSDVVQLYKSKGIKGMRIYSPSQSALNALRNSGLAVIVDTGNGNELSQLARSASYAASWVQSNVKPYYPAVNIKYIAVGNEVQGGATQSILPAIRNLDAALARAGLSAIKCSTSVRFDVIANSYPPSSGSFAQGYMADVARYLAGTGAPLLVNVYPYFSYRDNPRDISLGYATFQPGTTVRDNGNGLTYTNLFDAMVDAVVAALEKAGAGGVRIVVSESGWPSAGGSGASVDNARKYNQGLINHVGRGTPKRRGTLETFIFAMFNENQKTGDPTEKNFGLFYGNKQPVYPISFN

SEQ ID NO: 47186 - protein, 147 aa, Sorghum bicolor
  Clone ID: LIB5121-012-A1-PF1-E1.pep
MARQQQVASMLAAALLVATFASIPTSVHSIGVCYGMLGNNLPSSSDVVQLYKSKGIKGMRIYSPSQSALNALRNSGLAVIVDTGNGNELSQLARSASYAASWVQSNVKPYYPAVNIKYIAVGNEVQGGATQSILPAIRNLDAALTRA

SEQ ID NO: 47187 - protein, 476 aa, Sorghum bicolor
  Clone ID: SORBI-28MAY03-C4020_1.pep
MAAAAAAAVSVDEKLDKLRAEVAKLDQISENEKSGFLSLVSRYLSGEAEQIEWSKIQTPTDEVVVPYDTLASPPEDLEETKKLLDKLVVLKLNGGLGTTMGCTGPKSVIEVRNGFTFLDLIVIQIESLNKKYGCSVPLLLMNSFNTHDDTQKIVEKYSNSNIEIHTFNQSQYPRIVTEDFLPLPSKGNSGKDGWYPPGHGDVFPSLNNSGKLDILLAQGKEYVFVANSDNLGAIVDIKILNHLINNQNEYCMEVTPKTLADVKGGTLISYEGRVQLLEIAQVPDEHVNEFKSIEKFKIFNTNNLWVNLKAIKRLVEAEALKMEIIPNPKEVDGVKVLQLETAAGAAIRFFDKAIGINVPRSRFLPVKATSDLLLVQSDLYTLVDGFVIRNPARANPANPSIELGPEFKKVANFLARFKSIPSIVELDNLKVSGDVWFGSGITLKGKVTITAKSGVKLEIPDGAVLENKDVNGPEDL

SEQ ID NO: 47188 - protein, 104 aa, Sorghum bicolor
  Clone ID: LIB3476-030-P1-K1-H7.pep
SSVGVIRVASSCDMSLGKTGDAKHRLKILRAIDILVLKYSSIWNLQLHSRLGSDCHLALEIAPTICIRHFSFFFLNKNQALFSNTDATTQRVWSGMTIYKTTSD

SEQ ID NO: 47189 - protein, 314 aa, Sorghum bicolor
  Clone ID: SORBI-28MAY03-C37056_1.pep
MAAPTLMQCLVAISLLSCVAHAQLSTTFYASSCPNLQSIVRRAMIQALSNDQRMGASLLRLFFHDCFVQGCDGSILLDAGGEKTAGPNANSARGFEVIDTIKTNVEAACPGVVSCADILALAARDGTNLLGGPTWNVPLGRRDSTTASASLANSNLPQSTASLGTLISLFSRQGLSARDMTALSGAHTIGQARCTTFRSRIYGDTNINASFAAALRQQTCPQSGGDGNLAPMDVQTPTRFDTDYYTNLLSQRGLFHSDQELFNGGSQDALVRQYSANPSLFNSDFMAAMIKMGNVGVLTGTAGQIRRNCRVVNS

SEQ ID NO: 47190 - protein, 487 aa, Sorghum bicolor
  Clone ID: SORBI-28MAY03-C803_1.pep
MGLVKEGVDMEEGTLEIGMEYRTVSGVAGPLVILDKVKGPKYQEIVNIRLGDGTTRRGQVLEVDGEKAVVQVFEGTSGIDNKYTTVQFTGEVLKTPVSLDMLGRIFNGSGKPIDNGPPILPEAYLDISGSSINPSERTYPEEMIQTGISTIDVMNSIARGQKIPLFSAAGLPHNEIAAQICRQAGLVKTLEKGKHAEGGEDDNFAIVFAAMGVNMETAQFFKRDFEENGSMERVTLFLNLANDPTIERIITPRIALTTAEYLAYECGKHVLVILTDMSSYADALREVSAAREEVPGRRGYPGYMYTDLATIYERAGRIEGRTGSITQIPILTMPNDDITHPTPDLTGYITEGQIYIDRQLHNRQIYPPINVLPSLSRLMKSAIGEGMTRRDHSDVSNQLYANYAIGKDVQAMKAVVGEEALSSEDLLYLEFLDKFERKFVTQGAYDTRNIFQSLDLAWTLLRIFPRELLHRIPAKTLDQYYSRDASH

SEQ ID NO: 47191 - protein, 206 aa, Sorghum bicolor
  unsure (1)..(206): unsure at all Xaa locations
  Clone ID: SORBI-28MAY03-C579_2.pep
MQILVFFLQVGAPARVGLVAPVDVVVPPGNTGLDPSQTSFFQVLNIPTKINKGTVEIITPVELIKKGDKVGSSESALLAKLGIRPFSYGLQVTNVYEDGSVFSPEVLDLSEEDPRERGGSDLIELFATGVSMVASLSLAISYPTLAAVPHMXDKIKEYLKDPNKFAVAAPVAGADSGAAAAPKEEEKAPEPEEESDEEMGFSLFDD

SEQ ID NO: 47192 - protein, 319 aa, Sorghum bicolor
  Clone ID: SORBI-28MAY03-C579_1.pep
MAIKRTKAEKKIAYDKKLCSLLDEYTKVLIALADNVGSKQLQDIRRGLRGDSVVLMGKNTLIRRCIKAYAEKTGNHTFDPLMDLLVGNVGLIFTKGDLKEVREEVAKYKVGAPARVGLVAPVDVVVPPGNTGLDPSQTSFFQVLNIPTKINKGTVEIITPVELIKKGDKVGSSESALLAKLGIRPFSYGLQVTNVYEDGSVFSPEVLDLSEEDLIEKFATGVSMVASLSLAISYPTLAAVPHMFINGYKNVLAVAVETDYSYPHADKIKEYLKDPSKFAVAAPVAGADSGAAAAPKEEEKAPEPEEESDEEMGFSLFDD

SEQ ID NO: 47193 - protein, 65 aa, Sorghum bicolor
  Clone ID: LIB5047-010-R1-XP1-C2.pep
RPGPGNSYPHADKIKEYLKDPSKFAVAAPVAGADSGAAAAPKEEEKAPEPEEESDEEMGFSLFDD

SEQ ID NO: 47194 - protein, 557 aa, Sorghum bicolor
  Clone ID: SORBI-28MAY03-C9654_1.pep
MQHIMAFTRLLVVLLGAAFPLLLLFSPAVASELGVSYGRVANDLPDPSSVVKLLGDNGITMVRIYDANSNVLSSLANTGIKVMVMLPNENLADAASSSDKALQWVQNNVAAYYPATNIHGVAVGNEVFNSKPDQNLNLVPAMTNIQKALAQLNLADAIKVTTPIAFNAVAVSWPPSSGAFGDDIAQLVMKPMLQFLQQTGSYLSVNYYPYLTYMAQPDTFNLDYVLGNNPNPGAVDPDTQFKYNSLLDAQRDATYYAMDKLGASYSNMAVHHTEHGAPSGGSLRGGGGGHRRLLQAGGVATIANAQTYINNLMNRVLSGNTGTPHRPNADMNVYIFALFNEDQKGTGAGDVEQHFGLFYPNMQKVYEFDFRGGGVPPAPGAESWCVANASVGESWLQAALEYACGHGADCSAIQPGAACFEPDTVVAHASYAFNSYYQRNGRSNGTCDFNGAGYIVYQEPAGTCDPNASWCVANAEVGDARLQNALDYACGNGADCSAIQPGGQCFQPDTKPSHASYAFNSYYQHKGRASGTCDFSGAASVVYQQPKVGNCVLPSSG

SEQ ID NO: 47195 - protein, 319 aa, Sorghum bicolor
  Clone ID: SORBI-28MAY03-C103_1.pep
MAATASFPVVNMEKLETEEKATAMEIIRDACENWGFFELLNHGISHELMDEVERLTKAHYANFREAKFQEFAARTLEAGDKGADVKDVDWESTFFVRHLPASNLADLPDVDDHYRQVMKQFASEIQKLSEKLLDLLCENLGLEPGYLKSAFAGSNGPTFGTKVSAYPPCPRPDLVDGLRAHTDAGGIILLFQDDQVSGLQLLKDGEWVDVPPMRHAIVVNIGDQLEVITNGRYKSVMHRVLTRPDGNRMSIASFYNPGADAVIFPAPALVGAAGAEEERAGQATYPRFVFEDYMNLYVRHKFEAKEPRFEAMKSAIATA

SEQ ID NO: 47196 - protein, 144 aa, Sorghum bicolor
  unsure (1)..(144): unsure at all Xaa locations
  Clone ID: LIB3476-019-P1-K1-F5.pep
MDEVEKLTEDHYKRVREQRFLDFASKTLADAKAAENLDWESTFFVRHLPDSNLAEIPDLDDGYRRVMKRFASELEALAERLLDLLCENLGLEGGYLARAFPGRSTGXXAFGTKXEQLXACPRPDLVSGLATHRAGGLFCCQATA

SEQ ID NO: 47197 - protein, 274 aa, Sorghum bicolor
  Clone ID: SORBI-28MAY03-C929_2.pep
PTRPKSTYESITKGNPMWNELSVSTSTLYPWDPTSTYIHEPPYFKDMTMTPPGPRPVKDAYCLLNFGDSITTDHISPAGNIHPDSPAAKYLKERGVERKDFNSYGSRRGNDEIMARGTFANIRLVNKFLKGEVGPKTIHVPSGEKLAVFDAAMKYKNEGHDTIILAGAEYGSGSSRDWAAKGPMLQGVKAVIAKSFERIHRSNLAGMGIIPLCFKAGEDADTLGLTGHERYTVHLPTNVSEIKPGQDVTVTTDNGKSFTCTLKFDTEGELAYYH

SEQ ID NO: 47198 - protein, 697 aa, Sorghum bicolor
  unsure (1)..(697): unsure at all Xaa locations
  Clone ID: SORBI-28MAY03-C929_1.pep
MATDTETFAFQAEINQLLSLIINTFYSNKEIFLRELISNSSDALDKIRFESLTDKSKLDAQPELFIHIVPDKASNTLSIIDSGIGMTKSDLVNNLGTIARSGTKEFMEALAAGADVSMIGQFGVGFYSAYLVAERVVVTTKHNDDEQYVWESQAGGSFTVTRDTSGEQLGRGTKITLFLKDDQLEYLEERRLKDLVKKHSEFISYPISLWTEKTTEKEISDDEDEEEKKDAEEGKVEDVDEEKEEKEKKKKKIKEVSHEWSLINKQKPIWMRKPEEITKEEYAAFYKSLTNDWEEHLAVKHFSVEGQLEFKAVLFVPKRAPFDLFDTKKKQNNIRLHGDRVFIMDNCGELIXGYMSSKKTMEINPENPIMDELRKRAEADKNDKSVKDLVMLLFETSLLTSGFSLEDPNTFGTRIHRMLKLGLSIDEDESAEADAEMXRWRTTPARARWRRSTKPAGCHSIRPLLDAFGPYRFCVASYGNVDQLFIRVSIRVWYLLNSFSVLVMQLQYLXGWLTNIIEGLKLDETEDEKKRKEELKEKFEGLCKVIKEVLGDKVEKVVVSDRVVDSPCCLVTGEYGWTANMERIMKAQALRDSSMAGYMSSKKTMEINPENPIMDELRKRAEADKNDKSVKDLVMLLFETSLLTSGFSLDDPNTFGTRIHRMLKLGLSIDEDESAEAEAEMPPLEDDAGESKMEEVD

SEQ ID NO: 47199 - protein, 145 aa, Sorghum bicolor
  unsure (1)..(145): unsure at all Xaa locations
  Clone ID: LIB3476-056-P1-K1-H7.pep
KSGDELTSLKDYVTRMKEGQNDIYYITGESKKAVENSPFLEKLKKRGYEVLYMVDAIDEYAVGQLKEFEGKKLVSATKEGLKLDETEDEKKRKEELKEKFDGLCKVIKEVLGDKVEKVVXSDRVVDSPCCLVTGEYGWTANMERI

SEQ ID NO: 47200 - protein, 160 aa, Sorghum bicolor
  Clone ID: SORBI-28MAY03-C2666_1.pep
MSDSEEHHFESKADAGASKTYPQQAGTVRKNGFLVIKGRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDIGPK

SEQ ID NO: 47201 - protein, 97 aa, Sorghum bicolor
  unsure (1)..(97): unsure at all Xaa locations
  Clone ID: LIB3481-031-P1-K1-H6.pep
MSDSEEHHFESKADAGASKTYPQQAGTVRKNGFLVIKGRPCKVVEVSTSKTGKHGHGQMPLCAIDIFNGEKAXDIGPFSHNWDIPHVNRTEYQLIDI

SEQ ID NO: 47202 - protein, 148 aa, Sorghum bicolor
  Clone ID: SORBI-28MAY03-C121_5.pep
MENCNNGPAAADNFKVVVPEHPLISHWVSVLRDRFTPSHAFRSAMGELGRLLIYEATRDWLPTVTREIQTPVGTAVVESVSEMEPIMIVPILRAGLALADLATSILPSTKTFHLGMSNETTLLPSVYLNKLPDRFPKGCHMHTFWILC

SEQ ID NO: 47203 - protein, 177 aa, Sorghum bicolor
  unsure (1)..(177): unsure at all Xaa locations
  Clone ID: SORBI-28MAY03-C121_3.pep
VLSFGNDDLVYFRGLKLTRTSSKLFIMDELDERELVFAWEDKDTIIDQLRRIDISDRDDQGPSQEGGSLTRSPDAAIGILMRILQNAPGLRERLLLPGPSAPVPQEPSLQRVVTEEHGSSASSSTGVPSVLLRSRTAADALEELNKYKEIRESILNRXQGHSCSTKLLEEKPADGDP

SEQ ID NO: 47204 - protein, 98 aa, Sorghum bicolor
  Clone ID: SORBI-28MAY03-C121_2.pep
MAALPLATAEVCDANPHLIMNGELRALQPIFQIYGRRQVFAGPIVTLKVYEDNVLIREFLEEKGHGRVLVVDGGGSMRCAILGGNPVQQAQNNGWAGY

SEQ ID NO: 47205 - protein, 340 aa, Sorghum bicolor
  unsure (1)..(340): unsure at all Xaa locations
  Clone ID: SORBI-28MAY03-C121_1.pep
MGKYACIGVMDEVEAIIFVETHLLFLGTVGEQVWIIMLTNGTTEGSMGLTGHMDALGAVALSSNEKWLAYGLLHGKINGRKTDKGTVMCSLAGSVLDFESVKWHPWGHLIIVXLEVCIVWMXNGVLVAILYTFERHSNQVTFGDISPNLKLIYTELANASLMIREPXVHIGDRVFEXHCCHPDRLSSLXIHSASQLFVSASXFILVHIMTVKSGLIVGLLLGHTNSIECVGISSSYGWVATGSMDQKLIIWDLTRQSSRCICEHDEGVTSLAWLGSSRYVASGCIDGKVRIWDSLSGDCAREFSGHADVVQSLAITADGNTMVSASSDGSARVFDISMFK

SEQ ID NO: 47206 - protein, 90 aa, Sorghum bicolor
  Clone ID: LIB3476-017-P1-K1-E10.pep
MAALPLATAEVCDANPHLIMNGELRALQPIFQIYGRRQVFAGPIVTLKVYEDNVLIREFLEEKGHGRVLVVDRGGSMRCAILGGNPVQQA

SEQ ID NO: 47207 - protein, 71 aa, Sorghum bicolor
  Clone ID: LIB3478-024-P1-K1-B6.pep
PRVRLMTLVMKWLGYIQPSYLPLPELVEGAFFANLSIVGMNVSLMWNSAGFYQIAKLCIIPVLCILEIIFY

SEQ ID NO: 47208 - protein, 119 aa, Sorghum bicolor
  unsure (1)..(119): unsure at all Xaa locations
  Clone ID: SORBI-28MAY03-C1324_9.pep
PADSVTLTVLPSVPPSPRNVGXRKGWYGLGKGGGKCYRKXLRDNLXMNSAIRRLERRGGVKRISGLIYEETRGVLKIFLENVIRDAVTYTEHARRKTVTAMDVVYALKRQGRTLYGFGG

SEQ ID NO: 47209 - protein, 135 aa, Sorghum bicolor
  Clone ID: SORBI-28MAY03-C1324_8.pep
AGLGRAGRKSPIFLAPNPLKPPLLRAAPPFVVMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 47210 - protein, 130 aa, Sorghum bicolor
  Clone ID: SORBI-28MAY03-C1324_7.pep
APAGLGNSSLPTHQIPNSKPHLPVRATMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 47211 - protein, 140 aa, Sorghum bicolor
  Clone ID: SORBI-28MAY03-C1324_6.pep
KKKKKRCGLAGRGRRQVFISKIHLHNLLSTSSSSLSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 47212 - protein, 139 aa, Sorghum bicolor
  Clone ID: SORBI-28MAY03-C1324_5.pep
PAGFRNPSVPKLPRTPEKKIPQLFVSVSEEVAAAAAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 47213 - protein, 133 aa, Sorghum bicolor
  Clone ID: SORBI-28MAY03-C1324_4.pep
MWPGRRRNSQAHPRQQQTDRKIPNPISAAKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 47214 - protein, 103 aa, Sorghum bicolor
  Clone ID: SORBI-28MAY03-C1324_3.pep
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 47215 - protein, 103 aa, Sorghum bicolor; identical to SEQ ID NO: 47214
  Clone ID: SORBI-28MAY03-C1324_2.pep

SEQ ID NO: 47216 - protein, 189 aa, Sorghum bicolor
  Clone ID: SORBI-28MAY03-C1324_1.pep
MAGGAIVNTGGGKDYPGKLTLFVLLTCIVAATGGLIFGYDIGISGGVTSMDPFLEKFFPEVFRKKQEAKTNQYCKYDNQLLQTFTSSLYLAALVASFFAATVTRVLGRKWSMLVGGLTFLVGAALNGAAQNVAMLIIGRILLGVGVGFANQSVPVYLSEIKPARLPGMQKIGLQLKMTIGAVPAEPPNP

SEQ ID NO: 47217 - protein, 128 aa, Sorghum bicolor
  Clone ID: LIB5052-006-A1-XP1-C1.pep
AGRAPIFISKSPPNLLSTSSSSLSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 47218 - protein, 92 aa, Sorghum bicolor
  Clone ID: LIB5048-011-R1-XP1-E10.pep
RDPLHHPTTSNRNRKIPNPLGFAANMSGRGKGGKGLGKGGAKRHRKVLRDNIQGITKPAIRRLARRGGVKRISGLIYEETRGVLKIFLENDI

SEQ ID NO: 47219 - protein, 179 aa, Sorghum bicolor
  Clone ID: SORBI-28MAY03-C2378_1.pep
TDHEIIHLLDSEANFVCGVWTDRHGWIRSGLEASGVPGDAVHVRRLAELAAEVVARLAREHRFWPVVGQVVPLHRVHPPARLRRRRGELGLREHLPDARVAAEQVAGLHREHREARAVVDLRRLRDDDGGSGGTDAPPCGRDAGHRRAPRRRPGLDRQHGREPNGSSGSLHFLISTSCA

SEQ ID NO: 47220 - protein, 131 aa, Sorghum bicolor
  Clone ID: SORBI-28MAY03-C141_2.pep
LIHGRWAMLATLGALSVEWLTGVTWQDAGKVELVDGSSYLGQPLPFSISTLIWIEVLVIGYIEFQRNAELDPEKRLYPGLAYFDHVGLAMVPVLGFRLQLDATKHARLAMVAFHVFDLIHTTIFDTFGACS

SEQ ID NO: 47221 - protein, 288 aa, Sorghum bicolor
  Clone ID: SORBI-28MAY03-C141_1.pep
MASSVAAAASTFLGTRLSDPAPQNGRIVARFGFGKPKKAAAPKKVSKISSDRPLWFPGAVAPDYLDGTLVGDYGFDPFGLGKPVEYLQFDLDSLDQNLAKNEPGVVIGTRFESSDVKSTPLQPYSEVFGLQRFRECELIHGRWAMLATLGALSVEWLTGVTWQDAGKVELVDGSSYLGQPLPFSISTLIWIEVLVIGYIEFQRNAELDPEKRLYPGGSYFDPLGLAADPEKKERLQLAEIKHARLAMVAFLGFAVQAAATGKGPLNNWATHLSDPLHTTIFDTFGASS

SEQ ID NO: 47222 - protein, 129 aa, Sorghum bicolor
  Clone ID: SORBI-28MAY03-C6203_2.pep
MQIFVKTLTGKTITLEVESSDTIDNVKAKIQDKEGIPPDQQRLIFAGKQLEDGRTLADYNIQKESTLHLVLRLRGGIIEPSLQALARKYNQDKMICRKCYARLHPRAVNCRKKKCGHSNQLRAKKKIKN

SEQ ID NO: 47223 - protein, 264 aa, Sorghum bicolor
  unsure (1)..(264): unsure at all Xaa locations
  Clone ID: SORBI-28MAY03-C6203_1.pep
MLAIFQKQVAHAPQELNSPRGGAASNKPRNPDEILRDFHAAHPTNAISTSFSGGAALACVGPTSAGTGTGTGTYPRMFCGLDDIYCVFLGRLDNLSGLIRQYGLCGRSTNEALLVIEAYRTLRDRGPYPADQXSSRTSRGPSPSSSSTTAPAPCSPRWAGTXDGVPLYWGVAADGSAVISDDRDVVKRGCGKSYAPFPAGCMFHSEGGLKSFEHPMNRLKAMPRVDSEGAMCGATFKVDTFTKINSMPRVGSATNWAAAWEDAI

SEQ ID NO: 47224 - protein, 183 aa, Sorghum bicolor
  Clone ID: LIB3480-050-P1-K1-G3.pep
DDIEDNLQSPLISRQATSVEGKEIAAPHGSIMGAVGRSSSLQGGEAVSSMGIGGGWQLAWKWTEREGEDGEKEGGFQRIYLHEEGVQGRGSILSLPGGDVPPGGEFVQAAALVSQPALYSKELLEQRLIFAGKQLEDGRTLADYNIQKESTLHLLRLRGGIIEPSLQALARKYNQDKMIWRKC

SEQ ID NO: 47225 - protein, 118 aa, Sorghum bicolor
  Clone ID: LIB3476-017-P1-K1-D5.pep
PRVRQGRGSILSLPGGDVPPGGEFVQAAALVSQPALYSKELLEQRAAGPAMMHPSEAVAKGPRWADLFEPGVKHALFVGIGIQILQQFAGINGVLYYTPQILEQAGGCVLLSNIGLSA

SEQ ID NO: 47226 - protein, 332 aa, Sorghum bicolor
  Clone ID: SORBI-28MAY03-C3375_1.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKA

SEQ ID NO: 47227 - protein, 202 aa, Sorghum bicolor
  Clone ID: SORBI-28MAY03-C3548_1.pep
MCGAQPFCFDIDRPPFLCVFSLLMGANLTCAWEMKKRVSWNVPVSVYERFMTDMTFSFQGKGIWVDLSQAIMYCDLQTTDSVIGFDCIKLPVGCELNLEDALDCEESMKMSRTMGCVRGSIWFVCIRRGEHNADDLVTMWTLELPWGQWKNEARFPVRELWRSCFRRQGQCTDQESGSVVTGVKAKVACLLLDPGFLLPDCS

SEQ ID NO: 47228 - protein, 83 aa, Sorghum bicolor
  Clone ID: LIB3481-024-P1-K1-E12.pep
MATYEPKNILITGAAGFIASHVANRLVRNYPHYKIVVLDKLDYCSSLKNLNPSRASPNLKFVKGDIASADLVNYLLVTESIDT

SEQ ID NO: 47229 - protein, 261 aa, Sorghum bicolor
  Clone ID: LIB5121-005-A1-PF1-H10.pep
NSNPRPPRVLVASTAPPSRSPPPRRGRRHRDRDRPAVVPRTRPTTPTPPARDARARPRTSFASATGLRPGSALPPLRPSWISATAPRQRTIRQGWRLTSPRTFSSPVLLVLLHRMSPTAWLGTTMLFLQREDLRDLPYYLVYDHKNASLSMISYIPDPLEVIGMLKPVPKRTSDGAYELFLMARESHDGLPMAFDIDRPPFLCVFSLLMGANLTCAWEMKKRVSWNVPVSVYERFMTDMTFSFQGRVFGLICPKPSCTVTC

SEQ ID NO: 47230 - protein, 74 aa, Sorghum bicolor
  Clone ID: LIB5052-007-A1-XP1-D5.pep
SRVRERGDRCQGKSCVSSAGSGFFVARLLLVVGFMFLSTRSFFRALFPFCYGCLRLPLISCKSLGTYLLIVLHL

SEQ ID NO: 47231 - protein, 109 aa, Sorghum bicolor
  Clone ID: LIB3476-060-P1-K1-G4.pep
PTRPVLLGDDPLVSSSLAIRISPEAHERFNSELDGRARKNCRPHYLNSNMTARASIILMDEEQDLMIMMLFLQREDLRDLPYIPDPPEVIGMLKPVPKRTSDGAYELFL

SEQ ID NO: 47232 - protein, 267 aa, Sorghum bicolor
  unsure (1)..(267): unsure at all Xaa locations
  Clone ID: SORBI-28MAY03-C63_1.pep
MANAPPRILAVLGALGLALLCAAAVXGLCAAAPLNCGCQAGYCCSKFGYCGTTDEYCGDGCQSGPCRSGGGSSGGGNVGGVVTDAFFNGIKNQAGSGCEGKNFYTRSAFLSAADAYKGFGGGSVAGKREIAAFFAPITHETGHFCYISEINKNNGYCDSSDRQWPGAAGQKSRGPATLEIPWXYHYGPAGRAIGFDGLRXIAFKTALWYWTNNVHGVMSQGFGATIRAINGALECNGKNTAQMNARVGYYKQYCRQLGVDPGPNLTC

SEQ ID NO: 47233 - protein, 129 aa, Sorghum bicolor
  Clone ID: LIB3481-033-P1-K1-H2.pep
VRPSKNYCDANNTEWPCQAGKGYYGRGPLQISWNYNYGPAGQSIGFDGLGDPDAVARSAVVAFRAALWYWMNSVHGVFVSGQGFGATIRAINGALECDGKNPDSVNDRVAYYKQFCQDFGVDPGSNLTC

SEQ ID NO: 47234 - protein, 125 aa, Sorghum bicolor
  Clone ID: LIB3480-034-P1-K1-E10.pep
KDNAYCDSSYTQWPCAAGQKYYGRGPLQISWNYNYGPAGQSIGFDGLGNPDAVAQDAVIAFKAALWFWMNNVHGVMPQGFGATIRAINGALECNGNNPAQMNARVGYYKQYCQQFGVDPGSNLTC

SEQ ID NO: 47235 - protein, 45 aa, Sorghum bicolor
  Clone ID: LIB5121-006-A1-PF1-F3.pep
FLFFFVFFFFFFFFFIFFFFFFFFFFFFFFFRGNMHIIQLLHYSG

SEQ ID NO: 47236 - protein, 79 aa, Sorghum bicolor
  unsure (1)..(79): unsure at all Xaa locations
  Clone ID: LIB3480-034-P1-K1-C10.pep
MKQLYYMHVASKQCVRLQIACTLYGCSEGLKTEPKVLMGLSRRIACKKCGDLHLWIYTXELNHKARWCQDCKEFHQAKD

SEQ ID NO: 47237 - protein, 38 aa, Sorghum bicolor
  Clone ID: SORBI-28MAY03-C1115_3.pep
RPGRGGSILASLSTFQQMWISKEEYDESGPAIVHRKCF

SEQ ID NO: 47238 - protein, 380 aa, Sorghum bicolor
  unsure (1)..(380): unsure at all Xaa locations
  Clone ID: SORBI-28MAY03-C1115_2.pep
GLLMWVTSLHPVRKRFFELFFYTHQLYVVFIVFLAFHVGNFLFSISAGVVFLFMLDRFLRFWQSRAKVDIVSAACRPCGTVELVFSKPPGLRYNALSFIFIQVRELSFLQWHPFSVSSSPMDGRYHMSVLIKVLGTWTEKLRSIITDVQDKNRGDSELQCGRMTACVEGPYGHESPYHLMYENLILVAGGIGISPFLAILSDIIHRIEEGKQCMPKNVLVLWSVKKWQXLSLLSAVDAQTISSSVSDRLKLDIQAFVTQESLPPLEDGIVVDDRKVPGMFVKNGSTMSGLVGTGDNFWAAMYFLASTLGFLLAFTLVEAYYVKPHNVVAWWYRSLLFMLCMVAGVALPGGLVVLLWHLSEKQRMEGDKWDAVCDSQSPGA

SEQ ID NO: 47239 - protein, 377 aa, Sorghum bicolor
  Clone ID: SORBI-28MAY03-C1115_1.pep
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTSAEREIVRDIKEKLAYIALDYEQELETAKNSSSVEKSYELPDGQVITIGAERFRCPEVLFQPSMIGMEAAGIHETTYNSIMKCDVDIRKDLYGNIVLSGGSTMFPGIADRMSKEITSLAPSSMKIKVVAPPERKYSVWIGGSILASLSTFQQMWISKEEYDESGPAIVHRKCF

SEQ ID NO: 47240 - protein, 68 aa, Sorghum bicolor
  Clone ID: LIB3478-035-P1-K1-E11.pep
ENVTQESLPPLEDGIVVDDRKVPGMFVKNGSTMSGLVGTGDNFWAAMYFLASTLGFLLAFTLVEAYYV

SEQ ID NO: 47241 - protein, 256 aa, Sorghum bicolor
  unsure (1)..(256): unsure at all Xaa locations
  Clone ID: SORBI-28MAY03-C4518_1.pep
LEDGRTLRNWXIQKESTLHLVLRLRGGMQIFVKTLYNIQKELALHLLLRLRGVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 47242 - protein, 246 aa, Sorghum bicolor
  Clone ID: SORBI-28MAY03-C51_1.pep
MAGKGDGPAIGIDLGTTYSCVGVWQHDRVEIIANDQGNRTTPSYVAFTDSERLIGDAAKNQVAMNPINTVFDAKRLIGRRFSDASVQSDIKLWPFKVISGPGEKPMIVVQHKGEEKQFAAEEISSMVLIKMREIAEAYLGSTIKNAVVTVPAYFNDSQRQATKDAGVIAGLNVLRIINEPTAAAIAYGLDKKATSVGEKNVLIFDLGGGTFDVSLLTIEEGIFEVKATAGDTHLGGEDFDNRMVNH

SEQ ID NO: 47243 - protein, 127 aa, Sorghum bicolor
  unsure (1)..(127): unsure at all Xaa locations
  Clone ID: SORBI-28MAY03-C1160_2.pep
SPFSTLAHTPNFSVSTGQRPRVPPPPPPPPPQQQLPPPPPPPPLPPPPLHPPPPLPPXPDPPPPPPPPPPPPPPGGLGQEPPHLQPHASAKPNKRRFRASSEATKATFFAISLPPRTPTYVRSTQQS

SEQ ID NO: 47244 - protein, 485 aa, Sorghum bicolor
  Clone ID: SORBI-28MAY03-C1160_1.pep
MALSVEKTSSGREHKVKDLSQADFGRLEIELAEVEMPGLMACRAEFGPSKPFAGARISGSLHMTIQTAVLIETLTALGAEVRWCSCNIFSTQDHAAAAIARDSAAVFAWKGETLEEYWWCTERCLDWGEGGGPDLIVDDGGDATLLIHEGVKAEEEYEKTGKIPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLTLEDVVSEADIFVTTTGNKDIIMVDHMRKMKNNAIVCNIGHFDNEIDMLGLETYPGVKRITIKPQTDRWVFPETKTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRY

SEQ ID NO: 47245 - protein, 151 aa, Sorghum bicolor
  Clone ID: SORBI-28MAY03-C211_2.pep
RPEQKPACLMPPLVETSPEFASGGLAEADGLSGFDVPDMELASFAADMESLLMGVHDGFDDLGFLDEEKPQVNADAYLEAMAAPVPEREDKKRKRPEMILKLNYDGFHRPQGPWWLHWVQPLRAPRRRQSQEGPPEGEHQKPPRVHGQHHV

SEQ ID NO: 47246 - protein, 332 aa, Sorghum bicolor
  Clone ID: SORBI-28MAY03-C211_1.pep
MAASLQAAATLMQPAKIGGRAHSASLPSRPSSHLARAFGVDAGAARITCSLQSDIRDVASKCVDAAKLAGFALATSALLVSGASAEGTPRRLTYDQIQSLTYMEVKGTGTANQCPTIDGGVEAFPFKAGKYQMKKLCLEPTSFTVKAEGIAKNAPPEFQKTKLMTRLTYTLDEIEGPLEVGSDGTLKFEEKDGIDYAAVTVQLPGGERVPFLFTVKQLVATGKPESFGGPFLVPSYRGSSFLDPKGRGGSTGYDNAVALPAGGRGDEEELLKENIKNAAASTGNITLSVTKSNPETGEVIGVFESVQPSDTDLGAKAPKDVKIQGIWYAQLE

SEQ ID NO: 47247 - protein, 190 aa, Sorghum bicolor
  Clone ID: LIB3478-057-Q6-K1-D4.pep
MESLLMGVHVGFDDLGFLYEEKLVGFALATSALLVSGASAEGTPRRLTYDQIQSLTYMEVKGTGTANQCPTIDGGVEAFPFKAGKYQMKKLCLEPTSFTVKAEGIAKNAPPEFQKTKLMTRLTYTLDEIEGPLEVGSDGTLKFEEKDGIDYAAVTVQLPGGERVPFLFTVKQLVATRKPESFGGPFLVPS

SEQ ID NO: 47248 - protein, 444 aa, Sorghum bicolor
  Clone ID: SORBI-28MAY03-C470_1.pep
MAQTSLPPGFRFHPTDVELVSYYLKRKIMGKKLIVDAISEVDLYKFPPWDLPDKSSLRSKDLEWFFFCPRDKKYPNGSRTNRATPNGYWKTSGKDRNIMLNSRTVGMKKTLIFHEGKAPKGDRTDWVMYEYKMEDEDLVSSGFSKDAYVLCKIFKKSGLGPRIGEQYGAPFNEAEWDNPEAESSMFPLMASSEVVNPIEGPRAQPAAPAGALQEPPLHNSSATCAGEESSFDYATANTCADDITFGYTVASSAIQDIPAQMSGDGVVSVNNISNEANDMYSPHDCDGFLLEELSRFLNDSPGECSGLPPMSEAEAHAFEVSSFGLYNELSGLVGLGGVENTSNVETTDYQLPPDRELSADDYMELTDLLAPDPSFPTEFPAEDSQYMQYPLAHFNGHYDVPTMSGPLEPTMPSIFDAFPPSNNGVLATDVVANYMDPTMQFPFS

SEQ ID NO: 47249 - protein, 294 aa, Sorghum bicolor
  Clone ID: SORBI-28MAY03-C68_1.pep
MHVLVVPVYRNRNNSPFINFQGLLVSSGLTNDHEDMIGMFESWWHHGLISDETRDSGLKVCPGTSFMHPTPECTEVWNKALAEQGNINPYTIYTPTCDREPSPYQRRFWAPHGRAAPPPLMLPPYDPCAVFNSINYLNLPEVQTALHANVSGIVEYPWTVCSNTIFDQWGQAADDLLPVYRELIQAGLRVWVYSGDTDSVVPVSSTRRSLAALELPVKTSWYPWYMAPTEREVGGWSVQYEGLTYVSPSGAGHLVPVHRPAQAFLLFKQFLKGEPMPAEEKNDILLPSEKAPFY

SEQ ID NO: 47250 - protein, 286 aa, Sorghum bicolor
  Clone ID: SORBI-28MAY03-C476_2.pep
MGFPSSSLAAAALVLLALLAGGGECREAQFDATDAAGAGAENFNTSDAAVYWGPWQKARATWYGQPNGAGPDDNGGACGFKHTNQYPFMSMGSCGNQPLFKDGKGCGSCYKIRCTKDRSCSGRAETVIITDMNYYPVSKYHFDLSGTAFGRLAKPGLNDKLRHSGIIDIEFTRVPCEFPGLKIGFHVEEYSNPVYFAVLVEYEDGDGDVVQVDLMESKTAHGPPTGRWTPMRESWGSIWRMDTNHRMQPAFSIRIRNESGKTLVARNVIPANWRPNTFYRSFVQYQ

SEQ ID NO: 47251 - protein, 267 aa, Sorghum bicolor
  unsure (1)..(267): unsure at all Xaa locations
  Clone ID: SORBI-28MAY03-C476_1.pep
MATCTSPVLARGALLFSLLATCGSRATQGSFNASDFTADPDWEAARAAGHGALTRAGPGDEGRACGFKDVNLPPVSAMTFCGNDPLFKDGKGCGSWYQIRCQNNDACSDNPEPVIITDMNYYPVSKXHSDFSGTAFGERASPGRHDELRHARIIAVQFKRVPCDYPGEMKKFXVQKSSHPPYLSLLVDFEGXAGNVVQVDLLEAXNSGSWTPMRESGRSIWMLVSGHRLTAPFALRITNESGNTLVAHEVIPDNWVPNTYYRSLVQS

SEQ ID NO: 47252 - protein, 101 aa, Sorghum bicolor
  Clone ID: LIB5048-009-R1-XP1-F7.pep
PGITFRVQHGSNPMYLAVLIEHENQDGDVVQADIMQNNSGYWEPMHESWGSIWRIDPNRPLRGPFSIRITNESGKQLVAKNIIPANYVADVDYRSYVQYTN

SEQ ID NO: 47253 - protein, 221 aa, Sorghum bicolor
  Clone ID: SORBI-28MAY03-C17466_2.pep
MEINLLHVTGPSHASLPVPDSYAVPQLPQAKATPTDITLPLIDLSRSRGELRRAILDAGKEFGFFQVINHGVPEQVLQDVEAVSEEFFQLPAADKAHFYSDDTNRPNRLFSGSTYKTSKRLYWMDCLRLARAFPGGDSKKEWPEKPEELRNVYENYTALMRGLGLELLHMLCEGLGLPSDYFDGDQSAGDMILSVIRYPPCPTPDVTLGLPPHCDRNLITL

SEQ ID NO: 47254 - protein, 347 aa, Sorghum bicolor
  Clone ID: SORBI-28MAY03-C17466_1.pep
MENLLHVTPSHVSLLNSYAVPQLPQAKATPTDISLPVIDLSRSRDEVCRAILDAGKEFGFFQVINHGIPEQVLQDMESVSEEFFQLPAADKAHFYSEDTNRPNRLFSGSTYKTSKRLYWMDCLRLARTFPGSDCKKEWPEKPEELRNVFENYTALMNVFENYTALMRGLGMEMLHMLCQSLGLPSDYFDEDHRPGAWPPSVIRYPPCPTPDVTLGLPPHCDRNLITRVLSGSVPGLQVFYKGDWIMVKPIRDSFVINFGLHLEVVTNGIIKSVEHRVITNSVQARTSVVITINGTEDCLIGPAGELLGENKPPRYRTVTLRDFMRIYNKSLENPDAAIKERMKPFMI

SEQ ID NO: 47255 - protein, 165 aa, Sorghum bicolor
  Clone ID: SORBI-28MAY03-C874_2.pep
VTRLKADNPLYGSSLIDYAHIEQWMDFATTEVDANTGKWLYPRMGFYPYAAVTEESAIAALKRAFGSLNTHLASNTFLVGHSVTLADIVLTCNLYLGFSRILTKSFTSEFPHVERYFWTMVNQPNFKKVIGDVKQAEAVPPVPKKAAPAKEQKPKEAKKEAQKEA

SEQ ID NO: 47256 - protein, 417 aa, Sorghum bicolor
  Clone ID: SORBI-28MAY03-C874_1.pep
MALVLHSGAGNKNAFKALIAAEYSGVKVELTKDFEMGVSNKTPEFLKMNPLGKVPVLETPDGAVFESNAIARYVARLKDDNPLFGSSRIEQAHVEQWVDFAATEVDPGVAWYLYPRLGFIPYAHTTEETAIASLKRSLGALNTHLASNTYLVGHSVTLADIVLTCNLYHGIARILTKSFTSDFPHVERYFWTMVNQPNFKKVIGEVKQAESVPPVQKKAAPPKEPKAKDVKKEAPKEAPKPKVVEAPAEEEAPKPKPKNPLDLLPPSKMVLDDWKRLYSNTKTNFREVAIKGFWDMYDPEGYSLWFCDYKYNDENTVSFVTLNKVGGFLQRMDLARKYAFGKMLVIGSEAPFKLKGLWLFRGQEVPKFVMDEVYDMELYEWTKVDISDEAQKERVNAMIEDQEPFEGEALLDAKCFK

SEQ ID NO: 47257 - protein, 90 aa, Sorghum bicolor
  unsure (1)..(90): unsure at all Xaa locations
  Clone ID: SORBI-28MAY03-C1320_5.pep
MANPRVFFDMTVGGAAAGRIVMELYANEVPNTNGSQXVICTVDTPWLDGKHVVFGQVVEGMDVVKAIEKVGSRSGSTSKEVKIADCGQLS

SEQ ID NO: 47258 - protein, 203 aa, Sorghum bicolor
  Clone ID: SORBI-28MAY03-C1320_3.pep
MLRHAARRLVSRTAAAAPARRALATAEVPAEAGEDSTFVEAWRKVAPNLEPPTTPLSLMKPRPPTPATIPTKLTVNFVLPYKSEIANKEVDMVIVPATTGQMGVLPGHVATIAELKPGVLSVHEGNDVTKYFVSSGFAFVHANSIADIVAVEAVPVDQIDPALVQKGLADFTAKLGSASTDLEKAEAHIGVDVHSALNAALTG

SEQ ID NO: 47259 - protein, 172 aa, Sorghum bicolor
  Clone ID: SORBI-28MAY03-C1320_2.pep
MANPRVFFDMTVGGAAAGRIVMELYANEVPKTAENFRALCTGEKGVGKSGKPLHYKGSTFHRVIPQFMCQGGDFTRGNGTGGESIYGDKFPDEKFVRNHTAPGVLSMANAGPNTNGSQFFICTVDTPWLDGKHVVFGQVVEGMDVVKAIEKVGSRSGSTSKEVKIADCGQLS

SEQ ID NO: 47260 - protein, 171 aa, Sorghum bicolor
  Clone ID: SORBI-28MAY03-C1320_1.pep
MANPRVFFDMTVGGAPAGRIVMELYANEVPRTAENFRALCTGEKGVGKSGKPLHYKGSTFHRVIPDFMCQGGDFTRGNGTGGESIYGEKFPDEKFVRKHTGPGVLSMANAGPNTNGSQFFICTVPTPWLDGKHVVFGQVVEGMDVVKAIEKVGSRSGSTAKEVKIANCGQI

SEQ ID NO: 47261 - protein, 164 aa, Sorghum bicolor
  Clone ID: LIB5048-003-R1-XP2-A10.pep
MLRHAARRLVSRTAAAAPARRALATAEVPAECRRGLHVRGGVEKGRPQPGATIHRPIPDFMWHGGDFTNGNGTGGESIYGEKFPDEKFVRKHTEPGVLSMANAGPNTNGSQIFICTVPTPWLDGKHVVFGQVVEGMDVFQAIENDGSHSGSTAKEVKIANCGQI

SEQ ID NO: 47262 - protein, 143 aa, Sorghum bicolor
  unsure (1)..(143): unsure at all Xaa locations
  Clone ID: LIB3478-035-P1-K1-A10.pep
GERLREGSEERERVRVRGGADAEFLLHPAAAGRIVMELYANEVPKTAENFRALCTGEKGVGKSGKPLHYKGSTFHRVIPQFMCQGGDFTRGNGTGGESIYGDKFPDEKFVRNHTAPXVLSMANAGPNTNGSQFFICTVDTPWL

SEQ ID NO: 47263 - protein, 411 aa, Sorghum bicolor
  unsure (1)..(411): unsure at all Xaa locations
  Clone ID: SORBI-28MAY03-C2488_1.pep
MAVTITWVKARQIFDSRGNPTVEVDIGLSDGSYARGAVPSGASTGIYEALELRDGGSDYLGKGVLKAVSNVNSIIGPAIVGKDPTEQVEIDNFMVQQLDGTSNEWGWCKQKLGANAILAVSLAVCKAGAMVKKIPLYQHIANLAGNKTLVLPVPAFNVINGGSHAGNKLAMQEFMILPTGASSFKEAMKMGVEVYHNLKSIIKKKYGQDATNXGMDVAASAFYSEKDKTYDLNFKEENNDGSNKISGDSLKDLYKSFVSEYPIVSIEDPFDQDDWTTYAKLTDEIGQQVQIVGDDLLVTNPTRVAKAINEKTCNALLLKVNQIGSVTESIEAVRMSKRAGWGVMASHRSGETEDTFIADLSVGLATGQIKTGAPCRSERLAKYNQLLRIEEELGDAAVYAGAKFRAPVEPY

SEQ ID NO: 47264 - protein, 146 aa, Sorghum bicolor
  Clone ID: LIB5048-011-R1-XP1-G3.pep
ESCFRIRAMLDDAEEHWNIREESAKLRLKELKELAYDIEDVVDEYEYEVLHRSTGLYRTGKRKHREETEAYPVDTGIVEVPNDLVLQARKLIRRLDDIKYYSDRLSLSENDGERRYTPDISSVRHTSSVVFEKDILGRDQDKEKII

SEQ ID NO: 47265 - protein, 86 aa, Sorghum bicolor
  Clone ID: LIB3476-030-P1-K1-D8.pep
QRPDPRSPSVICKSLVAGGVAGGVWTLASATAATRGVPCRAAHPLGEALGIGREPRTHLAFLSSILFFLLSSVITAFCSGEMVFAH

SEQ ID NO: 47266 - protein, 45 aa, Sorghum bicolor
  Clone ID: LIB3480-010-P1-K1-G7.pep
KQEVVCFLLRTHQNQSGQRYYIECGPPLITQKKQFFFVCSHDKIT

SEQ ID NO: 47267 - protein, 307 aa, Sorghum bicolor
  Clone ID: SORBI-28MAY03-C19058_1.pep
MAVARSKRPASSLLPAVAALVAVAGLLSLAGPAAATGKTGQVTVFWGRNKAEGTLREACDTGTYTIVVISFLSVFGQGGNKPPTLDLSGHPIAGIGDDIKHCQSKSIMVFLSIGGFGDHYSLPSAKAATDLADYLWYAYFPAPTPRAGVHRPFGDAYVDGLDFFLDRGSPAYYDVLAKRLWSYNKQFRARTPVQLSATPRCAFPDRQVQRVLATGLVTRINVRFYGDAHCAAYWQQEWDKWTAAFPEDSIYVGLPASEQTVGYVHPKNLYYGVVPVVQKAANYGGFMIWDRYADKKTNYSSYAIEWA

SEQ ID NO: 47268 - protein, 81 aa, Sorghum bicolor
  Clone ID: SORBI-28MAY03-C9424_3.pep
IQHAINPPVCYHTTLFYFSWLASFITCTGMYLRGRFHHLADLVAVGGHADGERHGTQFASRYILARPVFFFFFFFLSLVSP

SEQ ID NO: 47269 - protein, 148 aa, Sorghum bicolor
  Clone ID: SORBI-28MAY03-C9424_2.pep
MLQQASTALSSTTHTHTRLKLTATMAVVSRKTSTMVAAVAVVVALLLASASSASAAITCGQVGTALAPCIPYATGRASALPSSCCSGVRSLNGQARSSSDRQAACRCLKSLANSVKSVNMGTVATIPGKCGVSVPFPISMSTDCNKVS

SEQ ID NO: 47270 - protein, 124 aa, Sorghum bicolor
  Clone ID: SORBI-28MAY03-C9424_1.pep
MAVVNRKTSTMVAAVAVVVALLLASASSASAAITCGQVGTALAPCIPYATGRASALPSSCCSGVRSLNGQARSSSDRQAACRCLKSLANSVKSVNMGTVATIPGKCGVSVPFPISMSTDCNKVS

SEQ ID NO: 47271 - protein, 170 aa, Sorghum bicolor
  Clone ID: SORBI-28MAY03-C1381_3.pep
PLRSVTTPLQSAMKGAKSKGAAKADAKLAVKSKGAEKPAKGRKGKAGKDPNKPKRAPSAFFVFMEEFRKEFKEKNPKNKSVAAVGKAAGDRWKSLSESDKAPYVAKANKLKLEYNKAIAAYNKGESTAAAKKAPAKEEEEEDEEESDKSKSEVNDEDDDEGSDEDEDDDE

SEQ ID NO: 47272 - protein, 155 aa, Sorghum bicolor
  Clone ID: SORBI-28MAY03-C1381_2.pep
MASLSSATITAPSAFAAPAARAVARRSSFTVRASLGKAAGTAAVAVAASALLAGGAMAQEVLLGANGGVLVFEPSEFTVKAGDTITFKNNAGYPHNVVFDEDEVPSGVDATKISQEEYLNAPGETYSVTLTVPGTYGFYCEPHQGAGMVGKVTVN

SEQ ID NO: 47273 - protein, 117 aa, Sorghum bicolor
  Clone ID: SORBI-28MAY03-C1381_1.pep
IEYLVSKAAEDLKLRIIEHNILVVSKYYSRITLKRLADLLCLSLQEAEKHLSDMVNSKALIAKIDRPMGVVSFQTTKDCNGVLNSWATNLEKLLDLVEKSCHQIHKETMIHKAVLKA

SEQ ID NO: 47274 - protein, 165 aa, Sorghum bicolor
  Clone ID: LIB3476-028-P1-K1-C9.pep
LEICRCYKAIYDIPAIKEDPTKWIPILRKICWYLVLAPHDPMQSSLLNATLEDKNLSEIPNFRLLLKQLVTMEVIQWTNLWEFFKEEYEKEENLLGGALGAKASEDLKLRIIEHNILVVSKYYARVTLKRLADLLCLTLQEAEKHLSDMVNSKALIAKIDRPMGV

SEQ ID NO: 47275 - protein, 125 aa, Sorghum bicolor
  Clone ID: LIB3476-060-P1-K1-G12.pep
QDYVRAQILSRKISTRVFEADPSKEKKKPKEGDNIVQDAPADIPSLLELKRVYYELMIRYYMHNNDYLEICRCYKAIYDIPAIKEDPTKWIPILRKICWYLVLAPHDPMQSSLLNATLEDKNLSE

SEQ ID NO: 47276 - protein, 66 aa, Sorghum bicolor
  unsure (1)..(66): unsure at all Xaa locations
  Clone ID: LIB3481-009-Q6-K1-D1.pep
SYVTEDMLKQVFTPXGEVVHVKIPVGKRCGFVQYANRSSAEEALVILQGTLVGGQNVRLSWXRNPS

SEQ ID NO: 47277 - protein, 463 aa, Sorghum bicolor
  Clone ID: SORBI-28MAY03-C8141_1.pep
MEKAIDRQRVLLAHLLPSASASASSAQPQLAASACAAGDSAAYQRTSSFGDDVVVVAAYRTPICKAKRGGFKDTYPEDLLTVVLKAVLDNTRINPADIGDIVVGTVLGPGSQRAIECRTAALFAGFPETVPVRTVNRQCSSGLQAVADVAAAIKAGYYDIGIGAGLESMSINSMGWEGQVNPRITELQKAQDCLLPMGITSENVAHRYGVTRQEQDQAAAESHRRAAAATASGKFKDEIVPVPTKIVDPKTGEEKKVVISVDDGVRPGTTASGLAKLKPVFKKDGTTTAGNSSQVSDGAGAVLLMKRSVALKKGLPILGVFRSFAAVGVDPAVMGVGPAVAIPAAVKSAGLEIGDIDLFELNEAFASQFVYCCNKLGLDRSKVNVNGGAIALGHPLGATGARCVATLLNEMKRRGRDCRFGVVTMCIGSGMGAAAVFERGDAVDGLSNVRDTQTQNFLSRDAK

SEQ ID NO: 47278 - protein, 464 aa, Sorghum bicolor
  Clone ID: SORBI-28MAY03-C302_1.pep
MGASTTTSLAAAAAALLLLVSLAAAADMSIISYGERSEEETRRMYAEWMATHGRTYNAIGEEERRYQVFRDNLRIIDEHNAAADAGVHSFRLGLNRFADLTNEEYRATYLGVRTKPQRERKLSARYHADDNEDLPESVDWRTKGAVAEVKDQGSCGSCWAFSTIAAVEGINQIVTGDLISLSEQELVDCDTSYNQGCNGGLMDYAFEFIINNGGIDTESDYPYKGTDGRCDANKKNAKVVTIDSYEDVPANSEKSLQKAVANQPVSVAIEAGGNAFQLYSSGIFTGKCGTALDHGVTAVGYGTENGKDYWIVKNSWGSSWGESGYIRMERNIKDSSGKCGIAVEPSYPLKEGANPPNPGPTPPSPTPEPSVCDNYYSCPESTTCCCIYEYGKYCFAWGCCPLEGATCCDDHYSCCPHDYPICNVQQGTCLMGKDSPLSVKATKRTLAKPHWAFSGNTDGMKSSA

SEQ ID NO: 47279 - protein, 414 aa, Sorghum bicolor
  Clone ID: SORBI-28MAY03-C8236_1.pep
MAGMAPEGSQFDAKHYDSKMQELLSTGETEEFFTSYDEVFESFDDMGLQENLLRGIYAYGFEKPSAIQQRGIVPFCKGLDVIQQAQSGTGKTATFCSGILQQLDYGLVECQALVLAPTRELAQQIEKVMRALGDYLGVKVHACVGGTSVREDQRILASGVHVVVGTPGRVFDMLRRQSLRPDNIKMFVLDEADEMLSRGFKDQIYDIFQLLPAKIQVGVFSATMPPEALEITRKFMNKPVRILVKRDELTLEGIKQFYVNVEKEDWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDERMLFDIQKFYNVVIEELPANVADLL

SEQ ID NO: 47280 - protein, 157 aa, Sorghum bicolor
  Clone ID: SORBI-28MAY03-C5359_1.pep
MASKVELVVEVKSPADKLWAALRDSTELFPKIFPEQYKSIETVEGDGKSAGTVRLLKYTEAVPMLTFAKEKLEVADDENKVVSYSVVDGELVDFYKNFKITLKVAKAAAAEGEGEAGAVVNWSMEFDKANDQVPDPDVIKETATKTFHDLDDYLLKN

SEQ ID NO: 47281 - protein, 143 aa, Sorghum bicolor
  unsure (1)..(143): unsure at all Xaa locations
  Clone ID: LIB5051-006-A1-XP1-F4.pep
MASKVELVVEVKSPADKLWAALRDSTELFPKIFPEQYKSIETVEGDGKSAGTVRLLKYTEAVPMLTFAKEKLEVADDENKVVSYSVVDGELVDSYKNFKITLKVXVNWSMEFDKAKDQVPDPDVIKETATKTFHDLDDYLLKN

SEQ ID NO: 47282 - protein, 165 aa, Sorghum bicolor
  unsure (1)..(165): unsure at all Xaa locations
  Clone ID: SORBI-28MAY03-C146_3.pep
TDSTAPAPEAKTLPRPLQAATAAAESAGEAKGFLEKYPALVTGFFFFMWYFLNVIFNILNKKIYNYFPYPYFVSLIHLVVGVAYCLVGWSVGLPKRAPINANLLKLLFXVALCHGIGHVTSNVSFAAVAVSFTHTIKAWSRAVLWAGLWHACMHVGCWTVIINKR

SEQ ID NO: 47283 - protein, 182 aa, Sorghum bicolor
  unsure (1)..(182): unsure at all Xaa locations
  Clone ID: SORBI-28MAY03-C146_2.pep
MACSTASLAGTLLALALMFQASLAGRRLTALVQEPAITMKYHKGALLTGPIAVNFIWYGDFSAPQRAVITDFVSSLSAPPAAVQPEPSVATWFKTARKYYASSKVRFPALRLGSHVVDQNCSLGKRLTERDLLRLAAKGGPSRAINLVLTAADVAVDGFCMSRCXTHGAAPRSRSGRFAYVW

SEQ ID NO: 47284 - protein, 406 aa, Sorghum bicolor
  Clone ID: SORBI-28MAY03-C146_1.pep
MSAAGTLSGGAAGLSGLLRLRRRAAPAPAIAAPSLHPAGTIKCTAVPDAAPIVWGRQLRPALLLPAALLPSSQPAKKHNLRPAAAAAESAGEAKGFLEKYPALVTGFFFFMWYFLNVIFNILNKKIYNYFPYPYFVSLIHLVVGVAYCLVGWSVGLPKRAPINANLLKLLFPVALCHGIGHVTSNVSFAAVAVSFAHTIKALEPFFSAAATQFILGQQVPLSLWMSLAPVVIGVSMASLTELSFNWTGFINAMISNISFTYRSIYSKKAMTDMDSTNVYAYISIIALIVCIPPAIIFEGPQLMSHGFSDAIAKVGLTKFVSDLVLVGLFYHLYNQIATNTLERVAPLTHAVGNVLKRVFVIGFSIVVFGNKISTQTGIGTSIAIAGVALYSYIKAKIEEEKRKKSA

SEQ ID NO: 47285 - protein, 629 aa, Sorghum bicolor
  Clone ID: SORBI-28MAY03-C49598_1.pep
MALLTAPAVAALLLVFWSAAYGGDAQGVPPYKDPKNDVEVRVKDLLARMTLAEKIGQMTQIERLVASPQVLKDYYIGSLLSGGGSVPRKQATAAEWMAMISDFQKACLSTRLGIPMIYGIDAVHGHNNVYGATIFPHNVGLGATRDPNLVKRIGAATALEVRATGIQYAFAPCIAVCRDPRWGRCYESYSEDHRIVQSMTELIPGLQGDVPQNFTSGMPFAAGKNKVAACAKHFVGDGGTQNGINENNTIIDRDGLMSIHMPAYLDALRKGVSTVMISYSSWNGLKMHANHDLITRFLKGRLNFQGFTISDWEGIDRITSPPGANYSYSVQASILAGIDMIMVPNNYQDFITILTGHVNSGLIPMSRIDDAVTRILRVKFTMGLFENPMPDPSLADQLGKQEHRDLAREAVRKSLVLLKNGKPGDAPLLPLPKKAAKILVAGSHADNLGYQCGGWTIEWQGDTGRITVGTTILDAVKAAVDPSTTVVFAENPDADFVKNGGFSYAIVAVGEHPYTETKGDSLNLTIPDPGPSTVQTVCGAVRCATVLISGRPVVIQPFLGAMDALVAAWLPGTEGQGITDVLFGDYGFTGKLPRTWFKSVDQLPMNYGDKKYDPLFPLGFGLTTQGKGY

SEQ ID NO: 47286 - protein, 82 aa, Sorghum bicolor
  Clone ID: SORBI-28MAY03-C6243_1.pep
MSCCSGNCGCGSGCQCGSGCGGCKMSPDMETTATVGMKPMVLAAPTTKASAGGFEAAVEGGGCDCNTCKCGSSCGCSCCSCN

SEQ ID NO: 47287 - protein, 71 aa, Sorghum bicolor
  Clone ID: LIB5047-007-R1-XP1-A12.pep
MSCCSGNCGCGSGCQCGSGCGGCKMSPDMETTATVGMKPMVLAAPTTKASAGGFEAAVEGGGCDCDTCSCN

SEQ ID NO: 47288 - protein, 340 aa, Sorghum bicolor
  unsure (1)..(340): unsure at all Xaa locations
  Clone ID: SORBI-28MAY03-C10595_1.pep
HEAPSPDRTRHSPAAAPAPAGRRGRKPRRNEAPADADAARPPSPPRRGEPKPVANGGDAVAVAVAEAGPASWDEVVRVVPCMDAVVKVFCVHTEPNFSLPWQRKRQYSSSSSGFIISGRRVLTNAHSVEHHTQVKLKKRGSDTKYLATVLAIGTECDIALLTVNDDEFWEGVSPVEFGTLPALQDAVTVVGYPIGGDTISVTSGVVSRIEILSYVHGSTELLGLXDAAINSGNSGGPAFNGRRKSAGLLEHKTSNRTKQTSKAAQNQAAAKCGTPNPSSSSSHSASRRCRHHARQPVAAAAAAASPLSPPSPRTRPPPSTRRRSRTATRCSSTSPARSSR

SEQ ID NO: 47289 - protein, 62 aa, Sorghum bicolor
  Clone ID: LIB3478-016-P1-K1-C10.pep
TPACPLTHRTPQKIFSSHYKIHWAFSCSRTGYYAALINSTNNMAQSVDPPDGPRLHHAPSSH

SEQ ID NO: 47290 - protein, 223 aa, Sorghum bicolor
  Clone ID: SORBI-28MAY03-C524_7.pep
ISVRGHNVFWDDQSHQMPWVSKLSVDKLRAAVAKHLKSVVSRYAGKVIHWDVVNENLHFSFFEEKLGKDASGEIFKEVAKLDPKPILFMNEFNTIEQPCDKAPLPTKYLAKLRQIQSYPGNEDLKYGIGLESHFAKPNIPYMRGSLDTLAAAKVPIWLTEVDVTKGPKQVEFLLLLAFAATAEARVVRELIGENACQQTCNQVHFKKMCQSLTKLPKVTTPGE

SEQ ID NO: 47291 - protein, 461 aa, Sorghum bicolor
  unsure (1)..(461): unsure at all Xaa locations
  Clone ID: SORBI-28MAY03-C524_6.pep
AHREEVVAKERKKKVKITVESGGKPLPDAELSVVWVAKGFPLGNAMTKEILDMPEYEEWFTKRFKWATMENAMKWYSTEYNEGEEGFVVADKMLALAEKHNISVRGHNVFWDDQSHQMPWVSKLSVDKLRAAVAKHLKSVVSRYAGKVIHWDVVNENLHFSFFEEKLGKDASGEIFKEVAKLDPKPILFMNEFNTIEQPCDKAPLPTKYLAKLRKTIVCCICTAQRRXKSDVAGTVFSDAPCSTNDTHFSPTASNVPSYGSSATLLWTSTIRSHASAGNEDLKYGIGLESHFAKPNIPYMRGSLDTLAAAKVPIWLTEVDVTKGPKQVEFLEEVMRGGFGRPGVEGIVMWAASLPPLGFLCSGFFSSRDTPPPQSTPGGRIDGGGSGGCGEGEDADADQQRPREVRGGGVGGEGVADHREHDRGQLRRQRHPAAQRQRQDPRQGHRVLQEARLGARRHRCW

SEQ ID NO: 47292 - protein, 198 aa, Sorghum bicolor
  Clone ID: SORBI-28MAY03-C524_5.pep
MAAEGEKKMITLKSSDGEEFEVEEAVAMESQTIRHMIEDDCADNGIPLPNVNSKILSKVIEYCNKHVHAAAAAAAASKAGSDDVGAAAANSTAASGEDLKNWDADFVKVDQATLFDLILAANYLNIKGLLDLTCQTVADMIKGKTPEEIRKTFNIKNDFTPEEEEEIRRERRPGRDQPVHSLGLRFCFLLGRPLHSSK

SEQ ID NO: 47293 - protein, 169 aa, Sorghum bicolor
  Clone ID: SORBI-28MAY03-C524_4.pep
MASEGDNKKMITLRSSDNEEFEVEEAVAMESQTIRHMIEDDCADNGIPLPNVNSKILSKVIEYCNKHVHAAAKPAEGADANAAAAAGGGEDLKNWDAEFVKVDQATLFDLILAANYLNIKGLLDLTCQTVADMIKGKTPEEIRKTFNIKNDFTQEEEDEIRRENQWAFE

SEQ ID NO: 47294 - protein, 176 aa, Sorghum bicolor
  Clone ID: SORBI-28MAY03-C524_3.pep
MAAEGEKKMITLKSSDGEEFEVEEAVAMESQTIRHMIEDDCADNGIPLPNVNSKILSKVIEYCNKHVHAAAAAAAASKAGSDDVGAAAANSTAASGEDLKNWDADFVKVDQATLFDLILAANYLNIKGLLDLTCQTVADMIKGKTPEEIRKTFNIKNDFTPEEEEEIRRENQWAFE

SEQ ID NO: 47295 - protein, 234 aa, Sorghum bicolor
  unsure (1)..(234): unsure at all Xaa locations
  Clone ID: SORBI-28MAY03-C524_2.pep
MEVVAAAAAAAKQKTKKHEKHIHLFYCSECEELALKVAASSDAIELQSINWRSFDDGFPNLFINKAHDIRGQHVAFLASFSSPAVIFEQISVIFALPKLFIPSFTLVLPFFPTGSFERVEEEGDVATAFTLARILSMIPKSRGGPTSAVIYDIHALQERFYFGDDVLPCFETGIPLLLQRLRQLPDAKNITIAFPDDGAWKRFHKLLQHFPMIVCNKFVKXDKXIVRIKEGIPE

SEQ ID NO: 47296 - protein, 744 aa, Sorghum bicolor
  unsure (1)..(744): unsure at all Xaa locations
  Clone ID: SORBI-28MAY03-C524_1.pep
SISKSIPVTFAAWFGSSCSTSGYRFSPSIVLCCSGLAFARAEVRVPIWAAGDTAASLTGKPPISYAWIIPPATPQFTRVEVMPAATDGDGKPAYVVMLPLLEGQFRAALQGNDRDELEICVESGDKAVQTEQGARKVYLHAGDSPFDAVTAAVKAVEKHLQTFHHRERKRMPSFLDWFGWCTWDAFYTDVTAGGVKHGLQSLSKGGAPPRFLIIDDGWQQIASDNKKPDDPNVAVQEGAQFASRLTGIKENTKFQTKPDGDGDGDGGLKRLVSETKGVHGVKQVYVWHAMAGYWGGVAPSSGTAMERYEPALAYPVQSPGVTANQPDIVMDSLSVLGLGLVHPRRARDFYGELHAYLASCGVDGVKVDVQNIIETLGAGHGGRVALTRAYHRALEASVACSFPDNGCISCMCHNTDMLYSARQTAVVRASDDFYPREPVSHTVHVACVAXNTNCLGWLMDLKWGMFDCLLPTAEYHGAGRAIGGAAIYAIDRPGNDNFVLKRNNVLPFRSACSVQRAGGVTRDCPDSAPRGDGPTXLNISNFPDCGSAVDVFECQTAWCSRATKWESVHGASPTTLTAATRAGEVTAITRAAVAGGNDSANDSNGEGNGEAVVXRNSARELVRLPRGAALPVTLAPLQYEVFHVCPLRAAAPGVAFAPVGLLDMFNAGGAVEECRAVDGGGKAVVALRVRGCGRFGAYCSREPARCLLDSAEVEFGYDADTGLVSVDLPVPEKEMYRWTLEIVV

SEQ ID NO: 47297 - protein, 69 aa, Sorghum bicolor
  Clone ID: LIB3480-004-P1-K1-D2.pep
KNLPQGDLVDRLLDEWRKVPEKPMTDSNGVFEAELFHGEYQVTVKHASLKEPIVQTVDLDTKSEAAIKA

SEQ ID NO: 47298 - protein, 128 aa, Sorghum bicolor
  Clone ID: LIB3480-059-Q6-K1-A10.pep
LTEVDVVKGPNQVKNLEQVLREGYGHPGVNGIVMWAAWHAKGCYVMCLTDNSFKNLPVGDVVDKLIAEWKTHRASATTDHDGAVELDLPLGEYKFTVRHPSLKAAAVQTVTVDDTSSSASEFTINVKS

SEQ ID NO: 47299 - protein, 171 aa, Sorghum bicolor
  Clone ID: LIB3480-053-P1-K1-G1.pep
QSRAVKRNESGRHHGELEEAVAMESQTIRHMIEDDCADNGIPLPNVNSKILSKVIEYCNKHVHAAAAAAAASKAGSDDVGAAAANSTAASGEDLKNWDADFVKVDQATLFDLILAANYLNIKGLLDLTCQTVADMIKGKTPEEIRKTFNIKNDFTPEEEEEIRRENQWAFE

SEQ ID NO: 47300 - protein, 210 aa, Sorghum bicolor
  Clone ID: SORBI-28MAY03-C97_2.pep
MEEEALERVEKLAEVNPMLGISYPELTEMQARAIFEAAIAMSNQGVEVFPERMVPLVGTPQELGHQVNVIKQTAEKVFANAGKTIGYKIGTMIEIPRAALVADQIAEQAEFFSFGTNDLTQMTFGYSRDDVGKFIPIYLAQGILQHDPFEVLDQRGVGELVKFATERGRQTRPNLKVGICGEHGGEPSSVAFFAKVGLDYVSCSPFRLVK

SEQ ID NO: 47301 - protein, 948 aa, Sorghum bicolor
  Clone ID: SORBI-28MAY03-C97_1.pep
MAASVSGATICLQKPGSKSRRARDATSSFARRSVAAPRSPHAAKASVIRSDAGAGRGQHCAPLRAVVDAAPIATKKRVFYFGKGKSEGDKSMKELLGGKGANLAEMSSIGLSVPPGFTVSTEACKQYQDAGCILPAGLWAEILDGLQFVEEYMGATLGDPQRPLLLSVRSGAAVSMPGMMDTVLNLGLNDEVAAGLAAKSGERFAYDSFRRFLDMFGNVVMDIPRSLFEEKLEHMKESKGVKNDTDLTAADLKELVGQYKEVYLTAKGEPFPSDPKKQLELAVRAVFNSWESPRAKKYRSINQITGLVGTAVNVQSMVFGNMGNTSGTGVLFTRNPNTGEKKLYGEFLINAQGEDVVAGIRTPEDLDAMKDVMPQAYEELVENCNILESHYKEMQDIEFTVQENRLWMLQCRTGKRTGAGAVKIAVDMVSEGLVERRQAIKMVEPGHLDQLLHPQFENPALYKDKVIATGLPASPGAAVGQIVFTAEDAEAWHAQGKAAILVRAETSPEDVGGMHAAAGILTERGGMTSHAAVVARGWGKCCVSGCSAIRVNDAEKTVAIGDHVLSEGEWLSLNGSTGEVILGKQPLSPPALSGDLGTFMSWVDDVRKLKVLANADTPEDALAARNNGAQGIGLCRTEHMFFASDERIKAVRQMIMAPTVELRQQALDRLLPYQRSDFEGIFRAMDGLSVTIRLLDPPLHEFLPEGNVEEIVRELCAETGANEEEALERVEKLAEVNPMLGFRGCRLGISYPELTEMQARAIFEAAIAMSNQGVEVFPEIMVPLVGTPQELGHQVNVIKQTAEKVFANAGKTIGYKIGTMIEIPRAALVADQIAEQAEFFSFGTNDLTQMTFGYSRDDVGKFIPIYLAQGILQHDPFEVLDQRGVGELVKFATERGRQTRPNLKVGICGEHGGEPSSVAFFAKVGLDYVSCSPFRVPIARLAAAQVLV

SEQ ID NO: 47302 - protein, 89 aa, Sorghum bicolor
  Clone ID: LIB3481-025-P1-K1-A10.pep
VRPRVRPRVRGRVGEKVFANAGKTIGYKIGTMIEIPRAALVADQIAEQAEFFSFGTNDLTQITFGYNKDDVGKIIPIYLAQGILQHDPF

SEQ ID NO: 47303 - protein, 73 aa, Sorghum bicolor
  unsure (1)..(73): unsure at all Xaa locations
  Clone ID: LIB3478-037-P1-K1-D1.pep
MDRYGLLFSGWTFYETSIYRCRTEHMFFASDERINAVXQMIIAPTVELRQYALDRIXPYQTSDSDGIIPAMHG

SEQ ID NO: 47304 - protein, 68 aa, Sorghum bicolor
  Clone ID: SORBI-28MAY03-C401_4.pep
VLSSVRGRVGSGTIDNVKAKIQDKEGIPPDQQRLIFAGKQLEDGRTLADYNIQKESTLHLVLRLRGGQ

SEQ ID NO: 47305 - protein, 305 aa, Sorghum bicolor
  Clone ID: SORBI-28MAY03-C401_3.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 47306 - protein, 229 aa, Sorghum bicolor
  Clone ID: SORBI-28MAY03-C401_2.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 47307 - protein, 615 aa, Sorghum bicolor
  unsure (1)..(615): unsure at all Xaa locations
  Clone ID: SORBI-28MAY03-C401_1.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKQSTRHLVLRRTGAMQIFVKTLTGKSITLEEASMXRPKIQETKGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHPALRLRGGAEAVFAKALSSPSLFRPFGYSDGIATCKVRVQAEGGFPQPGRRLSCDGKQHESGAPLADYFISNESSLHLVLRRWAGVLLCVKILTGKSITLELVSFVTIDNVXANIQDTEGIPPDNQQLIFADKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTXHLVLRLXGGMQIFVKTLTGK

SEQ ID NO: 47308 - protein, 98 aa, Sorghum bicolor
  unsure (1)..(98): unsure at all Xaa locations
  Clone ID: LIB3478-058-Q6-K1-F7.pep
MXIFVKTLTGKTITLEVESSDTIDNVKAKIQDKEGIPPDQQRLIFAGKQLEDGRTLADYNIQKESTLHLVLRLXGGMQIFVKTLTGKTITLEVESSDT

SEQ ID NO: 47309 - protein, 75 aa, Sorghum bicolor
  Clone ID: SORBI-28MAY03-C4043_2.pep
TLVMTNGHAFGASAFHVLRLSTGIRRLMLLLSPTRAEVNLFFVCLRLSPDTEKGSGLFPKRHFYLLIYISKAKLS

SEQ ID NO: 47310 - protein, 356 aa, Sorghum bicolor
  Clone ID: SORBI-28MAY03-C4043_1.pep
MASLTDLVNLSLSDTTEKIIAEYIWIGGSGMDLRSKARTLSGPVTDPSKLPKWNYDGSSTGQAPGEDSEVILYPQAIFKDPFRRGNNILVMCDCYTPAGEPIPTNKRHNAAKIFSNPEVAAEEPWYGIEQEYTLLQKDTNWPLGWPLGGFPGPQGPYYCGIGADKSFGRDIVDAHYKACIYAGINISGINGEVMPGQWEFQVGPSVGISSGDQVWVARYILERITEIAGVVLTFDPKPIPGDWNGAGAHTNYSTKSMRNEGGYEVIKAAIEKLKLRHKEHIAAYGEGNERRLTGRHETADINTFSWGVANRGASVRVGRETEQNGKGYFEDRRPASNMDPYVVTSMIADTTILWKP

SEQ ID NO: 47311 - protein, 100 aa, Sorghum bicolor
  unsure (1)..(100): unsure at all Xaa locations
  Clone ID: LIB3476-022-P1-K1-F1.pep
MAAEAKTEPAAPAAAAGLGLASGEQPPQQQQQPKKKTVCVVAVDDSDHSYYALEWTVRHVTGAGGMAGGAADLVIVHAKPSSSSVVSFXXPGAVEAIRYV

SEQ ID NO: 47312 - protein, 52 aa, Sorghum bicolor
  Clone ID: LIB3481-033-P1-K1-E9.pep
KIWRTKKTYFAKCQNVSSWYSFKLRPCLVHPENQNVFKISSHIESFGTYMKH

SEQ ID NO: 47313 - protein, 65 aa, Sorghum bicolor
  unsure (1)..(65): unsure at all Xaa locations
  Clone ID: LIB3480-030-P1-K1-A5.pep
GLINKLDSKQSRWSSGXQWWLTWPVSGFRSSQICRKSISTVHIEDFSSSVVIPSDSPALKGPCPS

SEQ ID NO: 47314 - protein, 70 aa, Sorghum bicolor
  Clone ID: LIB5052-006-A1-XP1-G5.pep
GAFFFFFFESDHLYNAMHEDAASTERYHKCGTAIIGGLHKKKKKVGGDHPSGRTAWNGSGKRKYSPNLIS

SEQ ID NO: 47315 - protein, 157 aa, Sorghum bicolor
  unsure (1)..(157): unsure at all Xaa locations
  Clone ID: SORBI-28MAY03-C683_3.pep
PTRPGRAALDARFKVSGIPHLVILDAKTGEVYTEDGVEFVSEYGVEAYPFTPDRINELKEQEKAEKENQTIQSVLGTSTRDYLISNKGDKVPISELEGKYVGLCFVVDGYGPVIEFTDSLAKIYEKLKEVGEKFEVVAVSLDXRESAFIESFAKMPW

SEQ ID NO: 47316 - protein, 264 aa, Sorghum bicolor
  unsure (1)..(264): unsure at all Xaa locations
  Clone ID: SORBI-28MAY03-C683_2.pep
YFELRSLPTLVLIGPDGKTLNSNVADIIDEHGFEAWEGFPFSAEKLEILAEKAKAKAASQTLESLLISGDLDFVIGKGGAKVPVSELVGKTVLLYFSAKWCGPCRAFLPTLVKEYNKIKEKNSDFEIVFISSDRDQSSFDDFFSQMPWLALPLEDERKVSLKKTFKIRGIPSLVAIGPTGQTVSRDAKAQLMIHGADAFPFTEERLEELQKKLDEMAKGWPQKLKHELHDEHELVLLAPGTYGCDGCEEMGSTWSYXCDECDFD

SEQ ID NO: 47317 - protein, 651 aa, Sorghum bicolor
  unsure (1)..(651): unsure at all Xaa locations
  Clone ID: SORBI-28MAY03-C683_1.pep
MEWTQCTASRARASRASRRRLLRLALGSINAVQRCLGCAKRFLATEQGISSSRMSYSRFLEYLDKDRVKKVDLFENGTIAIVEAISPELGNRVQRVRVQLPGLSQELLQKLREKNIDFAAHSNQEDSGSLLFNLIGNLAFPLILIGGLFLLSSQSLNSLSRLLRSMRNSKKWGRNLKXVAVSLDSEESAFNESFAKMPWLAIPQGDQKCEKLVRYFELRSLPTLVLIGPDGKTLNSNVADIIDEHGFEAWEXSHSVLRSWKFLLVGASRVRHLFKWSKENAPCIVSVDEIDAVGRQRGTGIGGGNDEREQTLNQLLTEMDGFEGNTGIIVIAATNRADILDSALLRPGRFDRQVSVDVPDVRGRTEILKVHGSNKKFDSDVSLDVIAMSPTGQTVSRDAKAQLMIHGADAFPFTEERLEELQKKLDEMAKGWPQKLKHELHDEHELVLLRRGTYGXTGVKRWAAHGPTGAMSVTLICTPSARWRRKRRVKRRKASPLRKPLLGMCARKACAGRSRFVLLSSLCVSGAIXNGASDANKMVVTFGMSQIGPWSLMEGGAQSGDVIMRMMARNSMSEKLAEDIDSAVKQLSDEAYEIALRHIRNNREAIDKIVELLIEKETLTGDEFRAILSEFVEIPVENRVPPATPAAALPA

SEQ ID NO: 47318 - protein, 135 aa, Sorghum bicolor
  unsure (1)..(135): unsure at all Xaa locations
  Clone ID: SORBI-28MAY03-C105_2.pep
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTXAMY

SEQ ID NO: 47319 - protein, 383 aa, Sorghum bicolor
  unsure (1)..(383): unsure at all Xaa locations
  Clone ID: SORBI-28MAY03-C105_1.pep
MIPGLMTPGDAIKPPVCYNGGWMVKAGCAGDYARRVVFPSLVGGLRHTGVMXWGLGQKGAYVGDEPQSKRPIFTLKIPIECGLISNXADMETIRHRTFYNEIRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTTAEREIVRDIKEKLAYVALDYEQELETANTSSSVEKSYELPDGQVITIGAERFRCPEVLFQPSFIGMESPGIHETTYNSIMKCDVDIRKDLYGNIVLSGGSTMFPGIGDRILDSMTALEQSSISIKEEAQSERKNIHRIGGYILASLSTCQQLWISIRQFHESDATIVHLNCL

SEQ ID NO: 47320 - protein, 141 aa, Sorghum bicolor
  Clone ID: SORBI-28MAY03-C193_2.pep
MASVTARAPVAALRPSAASSLNKSSSSSAFLGHSSRLGRTASPTTRRSLKAEAKGEWLPGLPSPAYLDGSVFNPLNFAPTLEAKEKELANGRLAMLAFLGFLIQHNVTGKGPFDNLLQHLSDPWHNSIIPDLLSMIYIQVM

SEQ ID NO: 47321 - protein, 253 aa, Sorghum bicolor
  Clone ID: SORBI-28MAY03-C193_1.pep
MASVTARAPVAALRPSAASLNKSLSSSSSSAFLGHSSRLGRTASPTTRRSLKAEAKGEWLPGLPSPAYLDGSLPGDNGFDPLGLAEDPENLRWFVQAELVNGRWAMLGVAGMLIPEVLTKAGLINAPQWYDAGKSEYFASSSTLFVIEFILFHYVEIRRWQDIKNPGSVNQDPIFKSYSLPPHECGYPGSVFNPLNFAPTLEAKEKELANGRLAMLAFLGFLIQHNVTGKGPFDNLLQHLSDPWHNTIIQTLS

SEQ ID NO: 47322 - protein, 371 aa, Sorghum bicolor
  Clone ID: SORBI-28MAY03-C737_1.pep
MAHRVLLLLSLAAAVAVAAAVDTEDPLIRQVVPGGDDNELELNAESHFLSFVQRFGKSYKDAEEHAYRLSIFKANLRRARRHQLLDPSAEHGVTKFSDLTPAEFRRTYLGLRKSRRALLRELGKSANEAPVLPTDGLPDDFDWRDHGAVTPVKNQGSCGSCWSFSTSGALEGAHYLATGKLEVLSEQQMVDCDHVCDTSEPDSCDSGCNGGLMTNAFSYLQKAGGLESEKDYPYTGSDDKCKFDKSKIVASVQNFSVVSVDEGQIAANLIKHGPLAIGINAAYMQTYIGGVSCPYICGRTLDHGVLLVGYGAAGFAPIRLKDKPYWIIKNSWGENWGENGYYKICRGSNVRNKCGVDSMVSTVSAVRTSKE

SEQ ID NO: 47323 - protein, 156 aa, Sorghum bicolor
  Clone ID: SORBI-28MAY03-C450_1.pep
MSRRGTAEKRTAKSDPIFRNRLVNMVVNRIMKDGKKSLAYQILYRAVKKIQQKTETNPLLVLRQAIRRVTPNIGVKTRRNKKGSTRKVPIEIGSKQGRALAIRWLLEASQKRPGRNMAFKLSSELVDAAKGSGGAIRKKEATHRMAEANRALAHFR

SEQ ID NO: 47324 - protein, 58 aa, Sorghum bicolor
  Clone ID: LIB3478-005-P1-K1-D3.pep
ALRTGKPFWVVSEDMERDVFMSADEAKAYGLVDIVGDEMIDEHCDTDPVWFPEMFKDW

SEQ ID NO: 47325 - protein, 149 aa, Sorghum bicolor
  Clone ID: SORBI-28MAY03-C98_10.pep
RPAGALGPGGHRRLHRAQVAGLRRGDQRAVPHIQTADTQQRHGRLNTHAHPRCQKLIVVQDGAPLRPAAAGPRSRELARTPTLSEADRWRRRPSSRGLQARGDRELDRLMLRSPTGTAPLVDEQQLGSDPKARCPQASVVRVQAFPLLP

SEQ ID NO: 47326 - protein, 286 aa, Sorghum bicolor
  unsure (1)..(286): unsure at all Xaa locations
  Clone ID: SORBI-28MAY03-C98_6.pep
KEYDELMEEFMAAIKQIYGEKVLIQFEDFANHNAFDLLEKYRKSHLVFNDDIQGTASVVLAGLLAALKMVGGTLAEQTYLFLGAGEAGTGIAELIALEISKQTKAPIEECRKKVWLVDSKGLIVDSRKNSLQSFKKPWAHEHEPLTTLYDAVQSIKPTVLIGTSGVGRTFTKEVVEAMASFNERPIIFSLSNPTSHSECTAEEAYNWTQGRAIFASGSPFDPVEYDGKILXPGQANNAYIFPGFGLGLGISGAIRGHEXDMLLCRWEALAGQATQENFDQGSIFPP

SEQ ID NO: 47327 - protein, 90 aa, Sorghum bicolor
  Clone ID: SORBI-28MAY03-C98_4.pep
RYEKQTIFCPKKKKKKKKKKKKKKKKKKKKKKKKAKRKKTRKRPAWRRRRRGAPATTRTTSTASRRRPTTRPSVRAPEHSHRVPHGYYCN

SEQ ID NO: 47328 - protein, 337 aa, Sorghum bicolor
  unsure (1)..(337): unsure at all Xaa locations
  Clone ID: SORBI-28MAY03-C98_3.pep
MADYYHGGRASMYDDCYDAGRHGGGSMKAYSRTDEYYDNVQDDRLNTHAHPRCQKLIDGGSGSPLRPAAAGPPAGLRPSPPAETAEVQQRHDLATARTLSEAQHRSMAAQALLSRPAVQSAVSRSSARKAPFVVRASSSPPAKQGADRQLWFASKQSLSYLDGTLPGDYGFDPLGLSDPEGTGGFIEPKWLAYGEVINGRFAMLGAAGAIAPEVFGKLGIIPPETALPWFKTGVIPPAGTYNYWADSYTLFVFNMALMGFAEHRRLQDWYNPGSMGKQYFLGLEKFLAGSGDPSYPGGPLFNPLGFGKTEKEMNELKLKEXPRNGRLAMLAILGYFH

SEQ ID NO: 47329 - protein, 268 aa, Sorghum bicolor
  Clone ID: SORBI-28MAY03-C98_2.pep
MAAQALLSGRQLLGRPAVQSAVSRSSARKAPFVVRASSSPPAKQGADRQLWFASKQSLSYLDGTLPGDYGFDPLGLSDPEGTGGFIEPKWLAYGEVINGRFAMLGAAGAIAPEVFGKLGIIPPETALPWFKTGVIPPAGTYNYWADSYTLFVFNMALMGFAEHRRLQDWYNPGSMGKQYFLGLEKFLAGSGDPSYPGGPLFNPLGFGKTEKEMNELKLKEIKNGRLAMLAILGYFIQGLVTGVGPFQNLLDHLSDPVNNNVLTSLKFH

SEQ ID NO: 47330 - protein, 370 aa, Sorghum bicolor
  unsure (1)..(370): unsure at all Xaa locations
  Clone ID: SORBI-28MAY03-C98_1.pep
MADYYHGGRASMYDDCYDAGRPRGGSPPPTPNSDESPRISEPNPFCDPMGEASPSIAKDVTELIGNTPLVYLNKVTDGCVGRVAAKLESMEPCSSVKDRIGYSMITDAEEKGLIIPGVSVLIEPTSGNTGIGLAFMAAAKGYKLILTMPASMSMERRIILKAFGAELVLTDPLLGMKGAVKKAXEIHSKTPKSYILNQFNKPEDQKSPYATTGPYFRPAVRWDVSCSSARKADLVDRASSSPPAKQGDYRQLWLSSKQTLSYLDGTLPGESGFDSMGLSDPVGTGVVIEPHWLTLHVLSNGAIETARLXSTRLWMGIRLLASSGGVRRASRPEXAVKLLVVVFPSFGERYPSSVLFQSIKKEAESMVVEP

SEQ ID NO: 47331 - protein, 74 aa, Sorghum bicolor
  Clone ID: LIB5049-003-R1-XP1-A9.pep
LQHCGIICVDRFYYCKIDPSSTIGNYGRQECTCSSLENIIGKICYRSGSNLRPGNGEKQNSPLHPSKLFPGPAG

SEQ ID NO: 47332 - protein, 124 aa, Sorghum bicolor
  unsure (1)..(124): unsure at all Xaa locations
  Clone ID: LIB3478-038-P1-K1-B11.pep
GLPEVWVHLWTTTGSVCQLGLSDPEGTGGFIEPKWLAYGEVINGRFAQLGAAGAIAPEVFGKLGIIPPETALPWFKTGVIPPAGTYNYWADSYTLFVFNMALMGFAEHXRLQDWYNPGSMGKQY

SEQ ID NO: 47333 - protein, 103 aa, Sorghum bicolor
  Clone ID: LIB3481-011-Q6-K1-D7.pep
MADYYHGGRASMYDDCYDAGRHGGGSMKAYSRTDEYYDNVQDDRIRMRPVYADDDCTGYNGGGYGAGRQTAVYTTDEYSRGGGYGGEQEHFKREEREHKPRSA

SEQ ID NO: 47334 - protein, 82 aa, Sorghum bicolor
  Clone ID: LIB3481-024-P1-K1-H5.pep
MKAYSRTDEYYDNVQDDRIRMRPVYADDDCTGYNGGGYGAGRQTAVYTTDEYSRGGGYGGEQEHFKREEREHKHKERLGEVG

SEQ ID NO: 47335 - protein, 915 aa, Sorghum bicolor
  Clone ID: SORBI-28MAY03-C70_1.pep
RCPPRRASPTGSAPAPPARSTAGSPGQIRGPRDQSRSRPEGCRRATGEGCCRGTRSACRGPPRRARRTTAGPPRWPASAASCRRGRTSTTRAAAHSWGAPRRRWWRTRRRRRVPLSCVASALVMAVVVNENEEDDEPGPEQPPQQQKKKRLWGLIVCHHESPRYVPFPLRYACEFLAQVFAVHVNKEFELEKQIREKSILRMQTMLSDMLFKEASPLSIVSGSPNIMDLVKCDGAALLYGDKVWRLQTAPTESQIRDIAFWLSEVHGDSTGLSTDSLQDAGYPGAASLGDMICGMAVAKITSKDILFWFRSHTAAEIKWGGAKHDPSDKDDNRRMHPRLSFKAFLEVVKMKSLPWSDYEMDAIHSLQLILRGTLNDALKPVQASGLDNQIGDLKLDGLAELQAVTSEMVRLMETATVPILAVDGNGLVNGWNQKVAELSGLRVDEAIGRHILTLVEDSSVSIVQRMLYLALQGKEEKEVRFELKTHGSKRDDGPVILVVNACASRDLHDHVVGVCFVAQDMTVHKLVMDKFTRVEGDYKAIIHNPNPLIPPIFGADQFGWCSEWNVAMTKLTGWHRDEVIDKMLLGEVFDSSNASCLLKSKDDFVRLCIIINSALAGEEAENAPFGLFDRNGKYIECLLSVNRKVNADGVVTGVFCFIHVPSDDLQHALHVQQASEQTAQRRLKAFSYMRHAINKPLSGMLYSRETLKSTGLNEEQMRQVHVADSCHRQLNKILADLDQDNITDKSSCLDLDMAEFVLEDVVVSAVSQVLIGCQGKGIRVACNLPERFMKQKVYGDGIRLQQILSDFLFVSVKFSPVGGSVDISSKLTKNSIGENLHLIDFELRIKHQGAGVPAEILSQMYEEDNKEPSEEGLSLLVSRNLLRLMNGNIRHIREAGMSTFILTAELAAAPSAVGQ

SEQ ID NO: 47336 - protein, 160 aa, Sorghum bicolor
  Clone ID: LIB3481-035-P1-K1-G2.pep
YRPPFFFFFAHIIIIIKPLIQGRGDILWNEYPIFTLVYNIVQVHHASHHEHSIIIDSLLRSPPPQKNEVSLYLALQGKEEKEVRFELKTHGSKRDDGPVILVVNACASRDLHDHVVGVCFVAQDMTVHKLVMDKFTRVEGDYKAIIHNPNPLIPPIFGAD

SEQ ID NO: 47337 - protein, 74 aa, Sorghum bicolor
  Clone ID: 9302145.pep
TTHHLIISGVDRYSSMVDAPAEGSSRSVLAVRRTGRPGPRCNYELFNCNNLNIRYWSWNYRGCWHQTCPPMDPR

SEQ ID NO: 47338 - protein, 75 aa, Sorghum bicolor
  unsure (1)..(75): unsure at all Xaa locations
  Clone ID: 7553021.pep
HEGQVSSAIAPCLSYARGXVRSLNSAARTTADRRAACNCLKNAARGISGLNAGNAASIPSKCGVSVPYTITKPKR

SEQ ID NO: 47339 - protein, 95 aa, Sorghum bicolor
  Clone ID: LIB3480-034-P1-K1-B5.pep
MGVNMMSWSMVVLVVALAFLVGGAWCGPPKVAPGKNITATYQPLKNSWGAVWRKDSDKPIKFPVTVQITTEGGTKTAYEDVIPEGWKADTTYTAK

SEQ ID NO: 47340 - protein, 93 aa, Sorghum bicolor
  Clone ID: LIB5052-011-A1-XP1-G2.pep
RPGRDQLALAHLHSKASTQASSLLDPSLDQNSDTKNIDDMARLAVAIAACNCLKNAARGISGLNAGNAASIPSKCGVSVPYTISTSTDCSRVS

SEQ ID NO: 47341 - protein, 101 aa, Sorghum bicolor
  Clone ID: LIB3476-031-P1-K1-H2.pep
MSAYCGKYKDELIKNAAYIGTPGKGILAADESTGTIGKRLSSINVENVEENRRALRELLFCCPGALQYISGVILFEETLYQKTKDGKPFVDVLPGIKVDKG

SEQ ID NO: 47342 - protein, 103 aa, Sorghum bicolor
  Clone ID: LIB5047-003-R1-XP1-B10.pep
NVGMIKLRLHGRSIDNCCLSRSPFITYKSVSNLSLDTYYVSTLFISSPFSLFNIITERMESLALAIYGEDEGSLCLATYGEDEGGRRHRCSSNIDIMQGSMHA

SEQ ID NO: 47343 - protein, 62 aa, Sorghum bicolor; identical to SEQ ID NO: 39835
  Clone ID: LIB5047-012-R1-XP1-E11.pep

SEQ ID NO: 47344 - protein, 216 aa, Sorghum bicolor
  unsure (1)..(216): unsure at all Xaa locations
  Clone ID: SORBI-28MAY03-C100_8.pep
ATWYGKPTGAGPDDNGGACGYKDVNKGPFNSMGACGNLPIFKDGLGCGSCFEIKCDKPAECSGEAVVVHITDMNYEQIAAYHFDLAGTAFGAMAKKGEEEKLRKAGXIDMQFRRVXCKYGEKVTFHVEKGSNPNYLALLVKYVDGDGDVVGVDIKEKGGDAYQPLKHSWGAVWRKDSDKPIKFPVTVQITTEGGTKTAYEDVIPEGWKADTTYTAK

SEQ ID NO: 47345 - protein, 180 aa, Sorghum bicolor
  Clone ID: SORBI-28MAY03-C100_9.pep
MARLAVDDRRGGGGGCGGDSLDHNGLVNMYGKCGRVAAARKVFDRMKSRDLISWNSMIGSYGTHGLCDEALAMFEDLTRATVEPDGVTFVAVLSACSHTGRVAEGRCLFNQMVREHKISPTMEHYTCMVDLLGRAGLLKDVFDLIETMPMRPDLCVWGALLNSCRIHGDAAVAEAAIAKV

SEQ ID NO: 47346 - protein, 123 aa, Sorghum bicolor
  Clone ID: SORBI-28MAY03-C100_10.pep
QLALAHLHSKASTQASSLLDPSLDQNSDTKNIDDMARLAVAIAVVAAAATRAPRRRGGQVHGALLRRACSQPRRLVPGVVVVAAATHPPAAALPTNRPAAVAGRDIAPSVYGERSGRPASRHS

SEQ ID NO: 47347 - protein, 106 aa, Sorghum bicolor
  Clone ID: SORBI-28MAY03-C100_11.pep
NDRYWRLSLPEGATADHPVSNPFGPGAPALDAVEFAPTMVVVGGRDILHDRAVDYADRLKAAGKPVEVRDFDGQQHGFFTIDPWSDASAELMRVIKRFVDSDGRFD

SEQ ID NO: 47348 - protein, 106 aa, Sorghum bicolor
  unsure (1)..(106): unsure at all Xaa locations
  Clone ID: SORBI-28MAY03-C100_12.pep
RAVWHRNPASGSSRIASSAYQKWPTWSSRFXARLTGAAVPSYLFXSLRIGRGRCAPDASNHWLYPIELVMGSSYPEGNFGGNQLLDGSISLSPLYPSQTNDLHVSI

SEQ ID NO: 47349 - protein, 84 aa, Sorghum bicolor
  Clone ID: SORBI-28MAY03-C100_13.pep
TQQAKVHLSHTHVHTHVRTYAKMQAYHSVHDDTYVRTYGEIFIQYYDVAVVDKLDPWSMLRPAPIDDDGDRHSKPSHVVDVLGV

SEQ ID NO: 47350 - protein, 124 aa, Sorghum bicolor
  Clone ID: SORBI-28MAY03-C100_14.pep
DALISSCACRRRPTGFTSAECRVELARTEHGEHLLLRGRAVAARPRRRRRPAEVGQARHHRRGRGGRRLRRQHGARRRRCRVLLPEWWGFFFVVVSFGGGRRLLLNRPASTARRLARTRVILLR

SEQ ID NO: 47351 - protein, 86 aa, Sorghum bicolor
  Clone ID: SORBI-28MAY03-C100_15.pep
RPGLPFEPSPASTCSHCIPKLAYILAHSQALRSLSTADKRTACNCLKSAAGRVSGLNAGNAASIPSKCGVNIPYTISASIDCSRVN

SEQ ID NO: 47352 - protein, 194 aa, Sorghum bicolor
  Clone ID: SORBI-28MAY03-C100_16.pep
YKQVSDTPRTSTTWLGLLWRSPSPEDAATPSSRFVNKLRGGLPPEVSLDDLADEFFRARAESEGDDDEEETAAPVRGRSRFPAPAERGGGGRRSSTARYARETESSRQRGRSVSRPPDERRGVGANAVNAGSAAAGRRQRYASVDRRASMDRQRWCDSDNDMEISHRYGSSGIHTKSSSGNSLQSSFHKPSRAN

SEQ ID NO: 47353 - protein, 183 aa, Sorghum bicolor
  Clone ID: SORBI-28MAY03-C100_17.pep
MARLAVAIAVVAAAAVVPMRETPRQRLWNSNLDLVVPRFHTPSVYFYRRGDGAAAPAEGFFDGERMRRALAEALVPFYPMAGRLARDEDGRVEIDCNGEGVLFVEADAPDVSVDDYGDFAPTMDLKRLIPTVDYTDDISALPLLVLQVTHFKCGGISLGVGMQHHVADGMSGLHFINSWSDLC

SEQ ID NO: 47354 - protein, 198 aa, Sorghum bicolor
  Clone ID: SORBI-28MAY03-C100_18.pep
MVITVRRSTMVRPARETPRQRLWNSNLDLVVPRFHTPSVYFYRRGDGAAAPAEGFFDGERMRRALAEALVPFYPMAGRLARDEDGRVEIDCNGEGVLFVEADAPDVSVDDYGDFAPTMDLKRLIPTVDYTDDISAFPLLVLQVTHFKCGGISLGVGMQHHVADGMSGLHFINSWSDLCRGAQISVMPFIDRTLIRARD

SEQ ID NO: 47355 - protein, 79 aa, Sorghum bicolor
  unsure (1)..(79): unsure at all Xaa locations
  Clone ID: SORBI-28MAY03-C100_19.pep
LLVKYVDGDGDVVGVDIKEKGGDAYQPLKHXWGAIWRKDSDKPIKFPVTVQITTEGGTKTAYEDVIPEGWKADTTYTAK

SEQ ID NO: 47356 - protein, 266 aa, Sorghum bicolor
  Clone ID: SORBI-28MAY03-C100_20.pep
MGVNMMSWSMQVAVVVALAFLVGGAWCGPPKVAPGKNITATYGSDWLEAKATWYGKPTGAGPDDNGGACGYKDVNKAPFNSMGACGNLPIFKDGLGCGSCFEIKCNKPAECSGEAVVVHITDMNYEQIAAYHFDLAGTAFGAMAKKGEEEKLRKAGIIDMQFRRVKCKYGEKVTFHVEKGSNPNYLALLVKYVDGDGDVVGVDIKEKGGDAYQSLKHSWGAVWRKDSDKPIKFPVTVQITTEGGTKTAYEDVIPEGWKADTTYTAK

SEQ ID NO: 47357 - protein, 124 aa, Sorghum bicolor
  Clone ID: SORBI-28MAY03-C100_21.pep
RPGRGSQSHSHTQQATLGQATKAASISNGPRLRVPGRAPPGRRRGGATHDGRRRGAPRRRGGQVHGVLLRRARSQPRRLVPGVVGRTLQQQLFRLTDRSPSPAERYLALRLRRSIRPASSWQLA

SEQ ID NO: 47358 - protein, 137 aa, Sorghum bicolor
  Clone ID: SORBI-28MAY03-C100_22.pep
QRRNNGPRLRVPGRAPPGRRRGGAAHDGRRRGAPRRRGGQVHGVLLRRARSQPRRLVPGVVVVVVGRTLQQQLFRLTEDGSPSPTEISMHLRQSSSWQLASYLSGRSSKTISLILILSNNNVRAWVRAANTHMNVLS

SEQ ID NO: 47359 - protein, 66 aa, Sorghum bicolor
  Clone ID: SORBI-28MAY03-C100_23.pep
CMHSKINPTSKSTCSHTHMYTRTYVHTLRCKRITAYTTTRTYIRRDFYSVVRRSSSRQLIISSYQA

SEQ ID NO: 47360 - protein, 176 aa, Sorghum bicolor
  Clone ID: SORBI-28MAY03-C100_24.pep
WPAPACSWSCSSWPPSRWRHSRRSSTRRAPTSWRAGPWSPPPTRLLPAPTPRPRSRRRRRRTHPPAAALPTNRPVAVAGRDISPSVYGDRSGRPVLGNWPDLYIRYGKTIFPFDYLFWNNNNVLHVCACMRGARGKRTHECACLIVFFLFLSSVPLSPFVYVSVTYTSPNIVRVYM

SEQ ID NO: 47361 - protein, 266 aa, Sorghum bicolor
  Clone ID: SORBI-28MAY03-C100_25.pep
MGVNMMSWSMQVALVVALAFLVGGAWCGPPKVAPGKNITATYGSDWLEAKATWYGKPTGAGPDDNGGACGYKDVNKAPFNSMGACGNLPIFKDGLGCGSCFEIKCDKPAECSGEAVVVHITDMNYEQIAAYHFDLAGTAFGAMAKKGEEEKLRKAGIIDMKFRRVKCKYGEKVTFHVEKGSNPNYLALLVKYVDGDGDVVGVDIKEKGGDAYQPLKHSWGAIWRKDSDKPIKFPVTVQITTEGGTKTAYEDVIPEGWKADTTYTAK

SEQ ID NO: 47362 - protein, 136 aa, Sorghum bicolor
  Clone ID: SORBI-28MAY03-C100_26.pep
NYKRFFLCLHNETTTSKSISKLRAERVRNRYEPNGVASRRLLLRGVGPALLAEADDGGDEAPVVLHPLVGAAAGLLLLVLLRHLGRLPADLPGTGQRSVHLTHGCETAAAAATEASAGRLGDAAAAVRGKSPARPA

SEQ ID NO: 47363 - protein, 358 aa, Sorghum bicolor
  Clone ID: SORBI-28MAY03-C100_27.pep
MSAYCGKYKDELIKNAAYIGTPGKGILAADESTGTIGKRLSSINVENIEENRRALRELLFCAPGALQYLSGVILFEETLYQKTKDGKPFVDVLNEGGVLPGIKVDKGTIEVAGTNKETTTQGHDDLGKRCAKYYEAGARFAKWRAVLNIGPNEPSQLAIDLNAQGLARYAIICQENGLVPIVEPEILVDGPHDIERCAYVTEMVLAACYKALNEHHVLLEGTLLKPNMVTPGSDSKKVAPEVIAEYTVRALQRTVPAAVPAIVFLSGGQSEEEATLNLNAMNKLNTKKPWSLSFSFGRALQASTLKAWAGKEENVEKARAAFLTRCKANSEATLGTYKGDAAAGEGVSESLHVKDYKY

SEQ ID NO: 47364 - protein, 123 aa, Sorghum bicolor
  Clone ID: SORBI-28MAY03-C100_28.pep
MARSMQFAVAMIAVVVAAVLLAAATTTSEAAVTCGQVNSAISPCLAYARGTGTAPSAACCSGVRSLNSAASSTADKRTACNCLKSAAGRVSGLNAGNAASIPSKCGVNIPYTISASIDCSRVN

SEQ ID NO: 47365 - protein, 119 aa, Sorghum bicolor
  Clone ID: SORBI-28MAY03-C100_29.pep
MARLAVAIAVVAAAAVVVLAATTSEAAISCGQVSSAIAPCLSYARGQGSAPSAGCCSGVRSLNSAARTTADRRAACNCLKNAARGISGLNAGNAASIPSKCGVSVPYTISTSTDCSRVS

SEQ ID NO: 47366 - protein, 355 aa, Sorghum bicolor
  Clone ID: SORBI-28MAY03-C100_30.pep
MSAYCGKYKDELIKNAAYIGTPGKGILAADESTGTIGKRLSSINVENVEENRRALRELLFCCPGALQYISGVILFEETLYQKTKDGKPFVDVLKEGGVLPGIKVDKGTIEVAGTDKETTTQGHDDLGKRCAKYYEAGARFAKWRAVLKIGPNEPSQLAIDLNAQGLARYAIICQENGLVPIVEPEILVDGPHDIDRCAYVTEVVLAACYKALNEHHVLLEGTLLKPNMVTPGSDSKKVTPELIAEYTVRTLQRTVPAAVPAVVFLSGGQSEEEATLNLNAMNKLNTKKPWSLSFSFGRALQASTLKAWAGKVENIEKARAAFLARCKANSEATLGTYKGDAAADTESLHVKDYKY

SEQ ID NO: 47367 - protein, 266 aa, Sorghum bicolor
  Clone ID: SORBI-28MAY03-C100_31.pep
MGVNMMSWSMKVALVVALVFLVGGAWCGPPKVAPGKNITATYGSDWLEAKATWYGKPTGAGPDDNGGACGYKDVNKAPFNSMGACGNLPIFKNGLGCGSCFEIKCDKPAECSGEAVVVHITDMNYEQIAAYHFDLAGTAFGAMAKKGEEEKLRKAGIIDMQFRRVKCKYGEKVTFHVEKGSNPNYLALLVKYVDGDGDVVGVDIKEKGGEAYQPLKHSWGAIWRKDSDKPIKFPVTIQITTEGGTKTAYEDVIPEGWKADTTYTAK

SEQ ID NO: 47368 - protein, 140 aa, Sorghum bicolor
  unsure (1)..(140): unsure at all Xaa locations
  Clone ID: LIB3481-013-P1-K1-E12.pep
MAPTVMASSATAVAPFQGLKSTATLPVARRSTTSLXPLTEEQLLKQVDYLLRNNWVPCLEFSKEGFVYRENSTSPCYYDGRYWTMWKLPMFGCTDASQVYKELQEAIASYPDAYXRILGFDNIXQDQCVSFIAYKPAGSE

SEQ ID NO: 47369 - protein, 138 aa, Sorghum bicolor
  Clone ID: LIB3478-047-P1-K1-F9.pep
MNIGSRPAKRKPGGGIPWIFSWTQTRFHLPVWLGVGAAFKWAIDKDIKNFQKLKEMYNEWPFFRVTLDLLEMVFAKGDPGIAGLYDELLVAEELKPFGKQLRDKYVETQQLLLQIAGHKDILEGDPYLKQGLRLRNPY

SEQ ID NO: 47370 - protein, 99 aa, Sorghum bicolor
  Clone ID: 9305464.pep
QLLKQVDYLLRNNWVPCLEFSKEGFVYRENSTSPCYYDGRYWTMWKLPMFGCTDASQVYKELQEAIASYPDAYVRILGFDNIKQTQCVSFIAYKPAGSE

SEQ ID NO: 47371 - protein, 130 aa, Sorghum bicolor
  Clone ID: LIB3478-053-Q6-K1-B10.pep
GTPASRWPEAKFINSAYTVSIPLMQRGSVTVAPYKLVLRTVIVTATTLVALMIPFFNAVLGLLGAFSFWPLTVYFPISMHIAQGKITKGTKWYLLQALSMICLMISVAVGIGSVTDIVSSLKVSSNPFKL

SEQ ID NO: 47372 - protein, 286 aa, Sorghum bicolor
  Clone ID: SORBI-28MAY03-C85_5.pep
SFIGLGLSVGQWVSHGGGLGGRIAGATAASSTKKLWNVLLALGNIAFAYTFAEVLIEIQDTLKSPPPENKTMKKAAMYGIGATTIFYISVGCAGYAAFGSNAPGNILTAGGLGPFWLVDIANMCLILHLIGAYQVYAQPIFASVERWAASRWPEAKFINSAYTVSIPLMQRGSVTVAPYKLVLRTVIVTATTLVALMIPFFNAVLGLLGAFSFWPLTVYFPISMHIAQGKITKGTKWYLLQALSMICLMISVAVGIGSVTDIVSSLKVSSNLSNCKLKVIVVVYNM

SEQ ID NO: 47373 - protein, 69 aa, Sorghum bicolor
  Clone ID: SORBI-28MAY03-C85_6.pep
MAPTVMASSATAVAPFQGLKSTATLPVARRSTTSLAKVSNGGRIRCMQVWPAYGNKKFETLSYLPPLTE

SEQ ID NO: 47374 - protein, 185 aa, Sorghum bicolor
  Clone ID: SORBI-28MAY03-C85_7.pep
KTSVKNTVTQVAKKVLTMNPSGDLSSARFSEKELITAIDREGVFTYAEDPASASLPLMTKLRAVLVDHALSSGDAEREPSVFSKITKFEEELRAVLPREVEAARVAVAEGTAPVANRIADSRSFPLYRFVREELGCVFLTGEKLKSPGEECTKVFNGINQGKLVDPMLECLKEWDGKPLPINVVN

SEQ ID NO: 47375 - protein, 236 aa, Sorghum bicolor
  Clone ID: SORBI-28MAY03-C85_8.pep
ARGEQHNQDVNSLGLVSARKTAEAVDILKLMSSTYMVALCQAVDLRHLEENLKSAVKNCVMAAARKVLTTSLDGDLHSARFSEKALLTAIDREAVYGYYDDPCSANSPLMKKIRAVLVDHALASGEAEKDASASVFSKINRFEEALREALPREMEAARVAFETGTAPIGNRIKDSRSYPLYRFIRQDLGAVYLTGEKLKSPGEECNKVFLALSEGKLIDPMLECLKEWDGKPLPIC

SEQ ID NO: 47376 - protein, 48 aa, Sorghum bicolor
  Clone ID: SORBI-28MAY03-C85_9.pep
ELCYKSLCECGDKAIASYPDAYVRILGFDNIKQTQCVSFIAYKPAGSE

SEQ ID NO: 47377 - protein, 668 aa, Sorghum bicolor
  Clone ID: SORBI-28MAY03-C85_10.pep
QFRDPVVKIEGSTLRVGQVAAVAAAKDASGVAVELDEEARPRVKASSEWILDCIAHGGDIYGVTTGFGGTSHRRTKDGPALQVELLRHLNAGIFGNGSDGHTLPSEVSRAAMLVRINTLLQGYSGIRFEILEAITKLLNTGVSPCLPLRGTITASGDLVPLSYIAGLITGRPNAQAVTVDGRKVDAAEAFKVAGIEHGFFELQPKEGLAMVNGTAVGSGLASTVLFEANVLAIMAEVISAVFCEVMTGKPEFTDHLTHKLKHHPGQIEAAAIMEHILEGSSYMKLAKKLGELDPLMKPKQDRYALRTSPQWLGPQIEVIRFATKSIEREINSVNDNPLIDVSRGKALHGGNFQGTPIGVSMDNTRLALAAIGKLMFAQFSELVNDYYNNGLPSNLSGGRNPSLDYGFKGAEIAMASYCSELQFLGNPVTNHVQSAEQHNQDVNSLGLISSRKTAEAIDILKLMTSTFLIALCQAIDLRHIEENVKAAVKNCVTQVAKKSLSLNARGGLHNARFCEKDLQTAIDREAVFAYADDPCSPNYPLMQKLRAVLIEHALANGDAERVVETSIFAKVAEFEQQVRAALPKEVEAARAAVESGNPLVPNRIKECRSYPLYRFVREEVGTQYLTGEKTRSPGEELNKVLVAINQRKHVDPLLECLKEWNGEPLPLC

SEQ ID NO: 47378 - protein, 169 aa, Sorghum bicolor
  Clone ID: SORBI-28MAY03-C85_11.pep
MAPTVMASSATAVAPFQGLKSTATLPVARRSTTSLAKVSNGGRIRCMQVWPAYGNKKFETLSYLPPLTEEQLLKQVDYLLRNNWVPCLEFSKEGFVYRENSTSPCYYDGRYWTMWKLPMFGCTDASQVYKELQEAIASYPDAYVRILGFDNIKQTQCVSFIAYKPAGSE

SEQ ID NO: 47379 - protein, 705 aa, Sorghum bicolor
  unsure (1)..(705): unsure at all Xaa locations
  Clone ID: SORBI-28MAY03-C85_12.pep
MAGNGAIVESDPLNWGAAAAELSGSHLDEVKRMVAQARQPVVKIEGSTLRVGQVAAVASAKDASGVAVELDEEARPRVKASSEWILDCIAHGGDIYGVTTGFGGTSHRRTKDGPALQVELLRHLNAGIFGTGSDGHTLPSEVVRAAMLVRINTLLQGYSGIRFEILEAITKLLNTGVSPCLPLRGTITASGDLVPLSYIAGLITGRPNAQATTVDGRKVDAAEAFKIAGIEGGFFKLNPKEGLAIVNGTSVGSALAATVMYDANVLAVLSEVLSAIFCEVMNGKPEYTDHLTHKLKHHPGSIEAAAIMEHILDGSAFMKHAKKVNELDPLLKPKQDRYALRTSPQWLGPQIEVLRAATKSIEREVNSVNDNPVIDVHRGKALHGGNFQGTPIGVSMDNARLAIANIGKLMFAQFSELVNEFYNNGLTSNLAGSRNPSLDYGFKGTEIAMASYCSELQYLGNPITNHVQSAEQHNQDVNSLGLVSARKTAEAIDILKLMSSTYIVALCQAIDLRHLEENIKTSVKNTVTQVAKKVLTMNPSGDLSSARFSEKELITAIDREGVFTYAEDPASASLPLMTKLRAVLVDHALSSGXRGAGALRVLQDHQVRGGAPRGAATGGGGRPRXVAEGTAXPVANRIADSRSFPLYRFVREELGCVFLTGEKLKSPGEECTKVFNGINQGKLVDPMLECLKEWDGKPLPINVVN

SEQ ID NO: 47380 - protein, 169 aa, Sorghum bicolor
  Clone ID: SORBI-28MAY03-C85_13.pep
MAPTVMASSATAVAPFQGLKSTATLPVARRSTTSFAKVSNGGRIRCMQVWPAYGNKKFETLSYLPPLTEEQLLKQVDYLLRNNWVPCLEFSKEGFVYRENSTSPCYYDGRYWTMWKLPMFGCTDASQVYKELQEAIASYPDAYVRILGFDNIKQTQCVSFIAYKPAGSE

SEQ ID NO: 47381 - protein, 961 aa, Sorghum bicolor
  Clone ID: SORBI-28MAY03-C85_14.pep
MASERHHSIDAQLRALAPGKVSEELIQYDALLVDRFLDILQDLHGPSLREFVQECYEVSADYEGKKDTSKLGELGAKLTGLAPADAILVASSILHMLNLANLAEEVELAHRRRNSKLKHGDFSDEGSATTESDIEETLKRLVSLGKTPAEVFEALKNQSVDLVFTAHPTQSARRSLLQKNARIRNCLTQLSAKDVTVEDKKELDEALHREIQAAFRTDEIRRAQPTPQDEMRYGMSYIHETVWNGVPKFLRRVDTALKNIGINERLPYDVPLIKFCSWMGGDRDGNPRVTPEVTRDVCLLSRMMAANLYINQVEDLMFELSMWRCNDELRARAEEVQSTPASKKVTKYYIEFWKQIPPNEPYRVILGAVRDKLYNTRERARHLLATGFSEISEDAVFTKIEEFLEPLELCYKSLCECGDKAIADGSLLDLLRQVFAFGLSLVKLDIRQESERHTDVIDAITTHLGIGSYRSWPEDKRMEWLVSELKGKRPLLPPDLPMTEEIADVIGAMRVLAELPIDSFGPYIISMCTAPSDVLAVELLQRECGIRQTLPVVPLFERLADLQAAPASVEKLFSTDWYINHINGKQQVMVGYSDSGKDAGRLSAAWQLYVAQEEMAKVAKKYGVKLTLFHGRGGTVGRGGGPTHLAILSQPPDTINGSIRVTVQGEVIEFMFGEENLCFQSLQRFTAATLEHGMHPPVSPKPEWRKLMEEMAVVATEEYRSVVVKEPRFVEYFRSATPETEYGKMNIGSRPAKRKPGGGITTLRAIPWIFSWTQTRFHLPVWLGVGAAFKWAIDKDIKNFQKLKEMYNEWPFFRVTLDLLEMVFAKGDPGIAGLYDELLVAEELKPFGKQLRDKYVETQQLLLQIAGHKDILEGDPYLKQGLRLRNPYITTLNVFQAYTLKRIRDPSFKVTPQPPLSKEFADENKPAGLVKLNPASEYPPGLEDTLILTMKGIAAGMQNTG

SEQ ID NO: 47382 - protein, 97 aa, Sorghum bicolor
  Clone ID: SORBI-28MAY03-C880_10.pep
QSPPPSPNNGVGRERRGDVVREQRRSPSEGPLKGIMGYVEEDLVSTDFVGDSRSSIFDAKAGIALNDNFIKLVLDRDNEWGYSNRVVDLIRHMFKTQ

SEQ ID NO: 47383 - protein, 148 aa, Sorghum bicolor
  Clone ID: SORBI-28MAY03-C880_9.pep
MAKIKIGINGFGRIGRLVARVALQSDDVELVAVNDPFITTDYMTYMFKYDTVHGQWKHHEVKVKDSKTLLFGEKEVAVFGSRNPEEIPWGSVGADYVVESTGVFTDQEKAAAHLKGGAKKGVISAPSKDAPMFVVGVNEKEYKSDINI

SEQ ID NO: 47384 - protein, 173 aa, Sorghum bicolor
  unsure (1)..(173): unsure at all Xaa locations
  Clone ID: SORBI-28MAY03-C880_7.pep
MGKIKIGINGFGRIGRLVARVALQSEDVELVAVNDPFITTDYMTYMFKYDTVHGHWKHSDITLKDSKTLLFGQKPVTVFGIRNPEEIPWGEAGADYVVESTGVFTDKDKAAAHLKGGAKKVVISAPSKDAPMFVVGVNEKEXIADIHIVSNASCTXITDNFGILGGLMTTCHA

SEQ ID NO: 47385 - protein, 170 aa, Sorghum bicolor
  Clone ID: SORBI-28MAY03-C880_6.pep
SAAPLAENLNGKHEPKSPKADPRSPKAATHGTWATSVKNPIGASSTGAAKAVGKVLPDLNGKLTGMSFRVPTVDVSVVDLTVRIEKGASYGDIKKAIKAASEGPLKGIMGYVEEDLVSTDFVGDSRSSIFDAKAGIALNDNFIKLVSWYDNEWGYSNRVVDLIRHMFKTQ

SEQ ID NO: 47386 - protein, 73 aa, Sorghum bicolor
  Clone ID: SORBI-28MAY03-C880_4.pep
QNMSHSMLNQPLRYNTPNIIVSDNPIDRKILFSEALSPGKKTTPYSLVSPDLQFVHLVGAAHVADQVNHAGAP

SEQ ID NO: 47387 - protein, 67 aa, Sorghum bicolor
  Clone ID: SORBI-28MAY03-C880_3.pep
ARSASNWRSKFRHLNAIFKSEHLTTHKSIRCYSRLYALSEYLRLKSDRASKSLMPTRPGRGSTRNAD

SEQ ID NO: 47388 - protein, 165 aa, Sorghum bicolor
  Clone ID: SORBI-28MAY03-C880_2.pep
AGRAGRAVHAITATQKTVDGPSAKDWRGGRAASFNIIPSSTGAAKAVGKVLPDLNGKLTGMSFRVPTVDVSVVDLTVRIEKGASYEDIKKAIKAASEGPLKGIMGYVEEDLVSTDFVGDSRSSIFDAKAGIALNDNFIKLVSWYDNEWGYSNRVVDLIRHMFKTQ

SEQ ID NO: 47389 - protein, 224 aa, Sorghum bicolor
  unsure (1)..(224): unsure at all Xaa locations
  Clone ID: SORBI-28MAY03-C880_1.pep
LAGTWQRHYLEVWCPKKRVISALIKDGPMLVHVVNEYKYTSEINIVSNASCTTXCLAPLDKGIHDNFGIIDGFMTAVHAITATQXSVDGPSAEYLTVSRAATFKVIPRMIGAFNVMRMGSSWLDSTVHLSVVSRSFSVVLSWSYEPPKRDMKAACESPVKGLVCYLVANLGYNGLCGDSSGGIRHPRGGPDPHHDFNDLVSRYDNLXDYGNGVVELVRHKLPPR

SEQ ID NO: 47390 - protein, 137 aa, Sorghum bicolor
  Clone ID: LIB3478-039-P1-K1-B11.pep
MFRPSMERASRGTIHIYSQHRQAAGWTATKAIGMLWKAEKSLLGLEHVADQVDNTVAVAPLVVVPRDKLDEVVVALFFLPYHPNHLHYITFPAIPPNLYPIETTGYNPTMLLFRHIYMLFTWAGGRPAGAKYKSSDV

SEQ ID NO: 47391 - protein, 94 aa, Sorghum bicolor
  Clone ID: LIB3476-057-P1-K1-B4.pep
NFRKVQVQLSIGMTNTAMLVDAHTVATTPTSLQAYWVSRLSSNSVPLLLDCKTARTTTIIIEQEYRSSAPREVVATRGRGNATWPPAFRSCRTH

SEQ ID NO: 47392 - protein, 71 aa, Sorghum bicolor
  Clone ID: LIB5049-012-R1-XP1-H12.pep
MGKIKIGINGFGRIGRLVARVALQSEDVELVAVNDPFITTDYMTYMFKYDTVHGHWKHTDITLKDSDTLLF

SEQ ID NO: 47393 - protein, 451 aa, Sorghum bicolor
  Clone ID: SORBI-28MAY03-C739_1.pep
MRECISIHIGQAGIQVGNACWELYCLEHGIQADGQMPGDKTVGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVFNAVGGGTGSGLGSLLLERLSVDYGKKSKLGFTVYPSPQVSTSVVEPYNSVLSTHSLLEHTDVAVLLDNEAIYDICRRSLDIERPTYTNLNRLVSQVISSLTASLRFDGALNVDVNEFQTNLVPYPRIHFMLSSYAPVISAEKAYHEQLSVAEITNSAFEPSSMMAKCDPRHGKYMACCLMYRGDVVPKDVNAAVATIKTKRTIQFVDWCPTGFKCGINYQPPSVVPGGDLAKVQRAVCMISNSTSVVEVFSRIDHKFDLMYAKRAFVHWYVGEGMEEGEFSEAREDLAALEKDYEEVGAEYDEGEDGDEGDEY

SEQ ID NO: 47394 - protein, 117 aa, Sorghum bicolor
  Clone ID: LIB3476-057-P1-K1-C8.pep
MPGDKTVGGGDDAFNTFFSETGAGKHVPRAVFVDLEPTVTTVLGLEEGKDCIIVGTLYKHMKLKPSILDEYAKERSAIPLVKPHNFMHPDDHLILEDESGRVTLAGAIPPAAFVTWG

SEQ ID NO: 47395 - protein, 82 aa, Sorghum bicolor
  Clone ID: LIB3476-009-P1-K1-H7.pep
MRECISIHIGQAGIQVGNACWELYCLEHGIQADGQMPGDIERPTYTNLNRLVSQVISSLTASLRFDGALNVDVNEFQTNLVP

SEQ ID NO: 47396 - protein, 289 aa, Sorghum bicolor
  Clone ID: SORBI-28MAY03-C73_1.pep
MEGKEEDVRLGANKFSERQPIGTAAQGAGDDKDYKEPPPAPLFEPGELKSWSFYRAGIAEFVATFLFLYITILTVMGVSKSNSKCATVGIQGIAWSFGGMIFALVYCTAGISGGHINPAVTFGLFLARKLSLTRAIFYIIMQCLGAICGAGVVKGFQQGLYMGNGGGANVVAPGYTKGDGLGAEIVGTFILVYTVFSATDAKRNARDSHVPILAPLPIGFAVFLVHLATIPITGTGINPARSLGAAIIYNRDHAWSDHWIFWVGPFIGAALAAIYHQVIIRAIPFKSRS

SEQ ID NO: 47397 - protein, 121 aa, Sorghum bicolor
  Clone ID: SORBI-28MAY03-C96_2.pep
MLTRSFAAKDEVFCLFEGVLDNLGRLSQQHGLSTKGANEVLLVIEAYKTLRDRAPYPASFMLAQLTGSYAFVLFDKSTNSLLVASDPEGKVPLFWGITADGCVAFSDDIDMLKGSCGKSLA

SEQ ID NO: 47398 - protein, 238 aa, Sorghum bicolor
  Clone ID: SORBI-28MAY03-C96_1.pep
MLAVFSGGVVEVPAELVAAGSRTPSPKTRASELVGRFLGASEPAVSVQLGDLGHLAYSHTNQALLRPRSFAAKDEVFCLFEGVLDNLGRLSQQHGLSTKGANEVLLVIEAYKTLRDRAPYPASFMLAQLTGSYAFVLFDKSTNSLLVASDPEGKVPLFWGITADGCVAFSDDIDMLKGSCGKSLAPFPQGCFYSNALGGLKCYENPKHKVTAVPADEEEICGATFKVEGSTVLTALHF

SEQ ID NO: 47399 - protein, 85 aa, Sorghum bicolor
  unsure (1)..(85): unsure at all Xaa locations
  Clone ID: LIB3481-016-P1-K1-H9.pep
VRPLXLGITADGCVAFSDDIDMLKGSCGKSLAPFPHGCFYSNALGGLKCYENPKHKVTAVPADEEEICGATFKVEGSTVLTALHF

SEQ ID NO: 47400 - protein, 34 aa, Sorghum bicolor
  Clone ID: 2909877.pep
MVRTSVLAVGCCVCSCILVVRHMEQPESLAETRC

SEQ ID NO: 47401 - protein, 211 aa, Sorghum bicolor
  unsure (1)..(211): unsure at all Xaa locations
  Clone ID: SORBI-28MAY03-C3435_5.pep
MFGRAPKKSDGTRYYEILGVSKDASQDDLKKAYRKAAIKNHPDKGGDPEKFKELAQAYEVLSDPEKREIYDQYGEDALKEGMXSGGGMHDPFDIFQSFFGGGSPFGGGGSSRGRRQRRGEDVVHPLKVSLEDLYNGTSKKLSLSRNVLCSKCNGKGSKSGASSRCAGCQGSGFKVQIRQLGPGMIQQMQHPCNECKGSGETINDKDRCPQC

SEQ ID NO: 47402 - protein, 136 aa, Sorghum bicolor
  Clone ID: SORBI-28MAY03-C3435_4.pep
PTRPGFQFVLTHLDNRQLLIKSNPGEVVKPDSFKAINDEGMPMYQRPFMKGKLYIHFSVDFPDSLSLEQCKALEAVLPPKPVSQYTDMELDECEETMPYDVNIEEEMRRRQQQHQEAYDEDEDMPGGAQRVQCAQQ

SEQ ID NO: 47403 - protein, 419 aa, Sorghum bicolor
  Clone ID: SORBI-28MAY03-C3435_3.pep
MFGRAPKKSDNTKYYEILGVPKSASQDDLKKAYRKAAIKNHPDKGGDPEKFKELAQAYEVLSDPEKREIYDQYGEDALKEGMGGGGAHVDPFDIFSSFFGPSFGGGGGSSRGRRQRRGEDVVHPLKVSLEDLYNGTSKKLSLSRNVICSKCKGKGSKSGASMRCPGCQGSGMKVTIRQLGPSMIQQMQQPCNECKGTGESINEKDRCPGCKGEKVVQEKKVLEVHVEKGMQHNQKITFPGEADEAPDTVTGDIVFVLQQKDHSKFKRKGEDLFYEHTLSLTEALCGFQFVLTHLDNRQLLIKSNPGEVVKPDQFKAINDEGMPIYQRPFMKGKLYIHFTVEFPDSLAPEQCKALEAVLPPRSSSKLTDMEIDECEETTMHDVNNIEEEMRRKQAHAAQEAYEEDDEMPGGAQRVQCAQQ

SEQ ID NO: 47404 - protein, 181 aa, Sorghum bicolor
  Clone ID: SORBI-28MAY03-C3435_1.pep
MGLAFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSSNIASKA

SEQ ID NO: 47405 - protein, 181 aa, Sorghum bicolor
  Clone ID: LIB5052-001-A1-XP1-E12.pep
MGLSFGKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGEGLYEGLDWLSNNIANKS

SEQ ID NO: 47406 - protein, 131 aa, Sorghum bicolor
  Clone ID: SORBI-28MAY03-C4949_4.pep
MREILHIQGGQCGNQIGAKFWEVICDEHGIDHTGKYAGDSDLQLERINVYYNEASGGRYVPRAVLMDLEPGTMDSVRSGPFGQIFRPDNFVFGQSGAGNNWAKGHYTEGAELIDSVLDVVRKEARTGLLTG

SEQ ID NO: 47407 - protein, 223 aa, Sorghum bicolor
  Clone ID: SORBI-28MAY03-C4949_3.pep
MREILHIQGGQCGNQIGAKFWEVVCAEHGIDATGRYGGDSDLQLERVNVYYNEASCGRFVPRAVLMDLEPGTMDSVRSGPYGHIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSFR

SEQ ID NO: 47408 - protein, 446 aa, Sorghum bicolor
  unsure (1)..(446): unsure at all Xaa locations
  Clone ID: SORBI-28MAY03-C4949_2.pep
MREILHIQGGQCGNQIGSKFWEVVCDEHGIDPTGRYVGTSDLQLERVNVYYNEASCGRFVPRAVLMDLEPGTMDSVRTGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLATPTFGDLNHLISATMSGVTCCLRFPGQLNSDLRKLAVNLIPFPRLHFFMVGFAPLTSRGSQQYRALTVPELTQQMWDAKNMMCAADPRHGRYLTASAMFRGKMSTKEVDEQMLNVQNKNSSYFVEWIPDNVKSSVCDIPPRGLSMAXTFIGNSTSIQEMFRRVSEQFTAMFRRKAFSHASDTSEGMDEMEFTEAESNMNDLVAEYQQYQDATAEEYDEEEQDGEEEHA

SEQ ID NO: 47409 - protein, 275 aa, Sorghum bicolor
  unsure (1)..(275): unsure at all Xaa locations
  Clone ID: SORBI-28MAY03-C4949_1.pep
AHFTEGAELIDTVLDVVRKEAENCDCLQGFQVCHSLGGGTGSGMGTLLISKIREEXPDPMMCAFSVFPXPKVSDTVVEPYNATLSVHQLVENADECMVLDNAALYDICFRTLKLATPTQQVFSAKYMLYAINRGHGRYRIAAEMFRGKMSTKEVDEQMINVQNKNSSYFVEWIPNNVKSSVCDIPPRGLSMASTFIGNSTSIQEMFRRVSEQFTAMFRRKAFLHWYTGEGMDEMEFTEAESNMNDLVSEYQQYQDATADDEGEYEDEEDVQGDEI

SEQ ID NO: 47410 - protein, 104 aa, Sorghum bicolor
  Clone ID: LIB5047-002-R1-XP1-A10.pep
PAGPTRCTCCSDRTIDRCTAGRHWHTTCSYVVDRLCPWCDVTGAYCLRVSSVGPPAVFSAPVMHEFPAVFFVTCIRYNVRALVSAYAWFCTSPCSQKKKKKRPL

SEQ ID NO: 47411 - protein, 80 aa, Sorghum bicolor
  Clone ID: LIB5051-003-A1-XP1-F5.pep
GVLDSGQPHICTPLWTWFFLSSLCFAYGLLIIVFAHVNAGYVVALLWGSMLYATTCPLSPPQRLVHLHCLICHGLYVRSI

SEQ ID NO: 47412 - protein, 42 aa, Sorghum bicolor
  Clone ID: SORBI-28MAY03-C482_6.pep
QNQGTKRARSTDTTSLVKIIHQLHVSSSKLKQKCLLQDYREQ

SEQ ID NO: 47413 - protein, 224 aa, Sorghum bicolor
  Clone ID: SORBI-28MAY03-C482_3.pep
MAAPRLALVVATTVAVLAALLLASSEPASAAVSCSDVTSSVAPCLGYAMGTTASPSPACCTGVRSLNSRASSTASRRRRRRCRCVRVRRPQPQQATEMAGGFVKTQKTNAYFKRFQVKFKRRRAGKTDYRARIRLINQDKNKYNTPKYRFVVRFTNKDITAQIVSASIAGDMVLAAAYSHELPRYGLEVGLTNYAAAYCTGLLLARRVLKIRDLHQEYEGNGRS

SEQ ID NO: 47414 - protein, 126 aa, Sorghum bicolor
  Clone ID: SORBI-28MAY03-C482_2.pep
MAAPRLALVVATTVAVLAALLLASSEPASAAVSCSDVTSSVAPCLGYAMGTTASPSPACCTGVRSLNSRASSTADRQATCACLKSMTSRLGGGGGVSMGNAASIPSKCGVSVGVPISPNVDCSKIN

SEQ ID NO: 47415 - protein, 302 aa, Sorghum bicolor
  Clone ID: SORBI-28MAY03-C482_1.pep
MGGFVKTQKTNAYFKRFQVKFKRRRAGKTDYRARIRLINQDKNKYNTPKYRFVVRFTNKDITAQIISASIAGDMVLASAYSHELPRYGLEVGLTNYAAAYCTGLLLARRVLKIRGLDQEYEGNVEATGEDFSVEPADERRPFRALLDVGLIRTTTGNRVFGALKGALDGGLDIPHSEKRFAGFKKDDKQLDADIHRKYIYGGHVADYMKNLAEEEPEKYQSHFSDYIKKGIEAEDMEGLYKKVHAAIRADPSVAKSTKQPPKEHKRYNPKKLTYEQRKASLVQRLNQLNSSGGADDDDEDDE

SEQ ID NO: 47416 - protein, 128 aa, Sorghum bicolor
  Clone ID: LIB5049-007-R1-XP1-A5.pep
MAAPRLALVVATTVAVLAALLLASSEPASAAVSCSDVTSSVAPCLGYAMGTTASPSPACCTGVRSLNSRASSTADRQATCACLKSMTSRLGGGGGVSMGNAASIPSKCGVSVGVPISPNVDCSKYDAS

SEQ ID NO: 47417 - protein, 126 aa, Sorghum bicolor
  Clone ID: LIB5049-005-R1-XP1-H6.pep
MAAPRLALVVATTVAVLAALLLASSEPASAAVSCSDVTSSVAPCLGYAMGTTASPSPACCTGVRSLNSRASSTADRQATCACLKSMTSRLGGGGGVSMGNAASIPSKCGVSVGVPIIPNVDCSKIN

SEQ ID NO: 47418 - protein, 483 aa, Sorghum bicolor
  Clone ID: SORBI-28MAY03-C1621_1.pep
MSCREGLMSPQTETKASVGFKAGVKDYKLTYYTPEYETKDTDILAAFRVTPQLGVPPEEAGAAVAAESSTGTWTTVWTDGLTSLDRYKGRCYHIEPVPGDPDQYICYVAYPLDLFEEGSVTNMFTSIVGNVFGFKALRALRLEDLRIPPAYVKTFQGPPHGIQVERDKLNKYGRPLLGCTIKPKLGLSAKNYGRACYECLRGGLDFTKDDENVNSQPFMRWRDRFVFCAEAIYKAQAETGEIKGHYLNATAGTCEEMIKRAVFAKELGVPIVMHDYLTGGFTANTTLSHYCRDNGLLLHIHRAMHAVIDRQKNHGMHFRVLAKALRMSGGDHIHSGTVVGKLEGEREITLGFVDLLRDDFIEKDRSRGIFFTQDWVSMPGVIPVASGGIHVWHMPALTEIFGDDSVLQFGGGTLGHPWGNAPGAAANRVALEACVQARNEGRDLAREGNEIIKAACKWSAELAAACEIWKEIKFDTFKAMDTL

SEQ ID NO: 47419 - protein, 608 aa, Sorghum bicolor
  Clone ID: 1255713.pep
MSTLATSQLVATHAGLGVPDASMFRRGGVQGLRAAARASAAAGDALSMRTSACPAPRQQPAARRGGRGGRFPSLVVCATAGMNVVFVGAEMAPWSKTGGLGDVLGGLPPAMAANGHRVMVVSPRYDQYKDAWDTSVVSEIKMGDGYETVRFFHCYKRGVDRVFIDHPLFLERVWGKTEEKIYGPDAGTDYKDNQLRFSLLCQAALEAPRILSLNNNPYFSGPYGEDVVFVCNDWHTGPLSCYLKSNYQSNGIYKDAKTAFCIHNISYQGRFAFSDFPELNLPERFKSSFDFIDGYEKPVEGRKINWMKAGILEADRVLTVSPYYAEELISGIARGCELDNIMRLTGITGIVNGMDVSEWDPSKDKYIAVKYDVSTAVEAKALNKEALQAEVGLPVDRKIPLVAFIGRLEEQKGPDVMAAAIPLLMEEDIQIVLLGTGKKKFERMLMSAEEKYPDKVRAVVKFNAALAHHIMAGADLLAVTSRFEPCGLIQLQGMRYGTPCACASTGGLVDTIIEGKTGFHMGRLSVDCNVVEPADVKKVATTLKRAIKVVGTPAYEEMVKNCMIQDLSWKGPAKNWENVLLSLGVAGGEPGIEGEEIAPLAKENVAAP

SEQ ID NO: 47420 - protein, 81 aa, Sorghum bicolor
  Clone ID: 2909875.pep
MTAKFGLGLGQFGSVSRSSGNYAQSDSYMTSSTSPLSTGLGYNKYLMEQYADGLLFYRLMLVASFAQTLGVTCDLFVFHDL

SEQ ID NO: 47421 - protein, 165 aa, Sorghum bicolor
  Clone ID: 871529.pep
SIYLSILLNPGFVPPGCVSQGGQRRPQWRHRWHRRRRRYRRRRECLASGGGGGGLGGGGIGGGGGGMAVGVAAASAGWRRHRWRPGRRRPDPDQLPLHSRQLEDRQVQELPQLVPDHSPLPLLRLGRPGGHRGPATTGTSLYTAPPAPPANEAATRAAPVVVYAL

SEQ ID NO: 47422 - protein, 141 aa, Sorghum bicolor
  unsure (1)..(141): unsure at all Xaa locations
  Clone ID: LIB3481-049-Q6-K1-B2.pep
PGVLPVELLAARARAFATTLPGVPLLRRLADLHAAPASGEILFCTDWCIHHFYGAHAVMXVGYSDSGKDARRLSWAWLLLVARVEMAMVAPKYGVKLALFHGRGGPVGRGGGPSHLAFLSQPPASVCGFFRVSVLGVVLLF

SEQ ID NO: 47423 - protein, 62 aa, Sorghum bicolor
  unsure (1)..(62): unsure at all Xaa locations
  Clone ID: LIB3481-049-Q6-K1-B7.pep
LQKRRTHDQALASGQATAEEGDNLLSPRGGRCGGAAGARRRQLSWGAQDXRVEASAHCRDAP

SEQ ID NO: 47424 - protein, 185 aa, Sorghum bicolor
  Clone ID: LIB3481-049-Q6-K1-C10.pep
RPFSAGNDAAIWYCVIVAGRPGAELSKKRQILRKAQDKLLGDVDGSAGEVDNSVETSSAATAFKDDRLTFVWLDGEVQKQICAFYLATDYTGACGPRDFGDDNDKPEIFIVRFQRNATYEALKAEKKNNLVDVLQGQHTDASQLVARYKGLDEIEEINRWISQIIKDGDTREIPYFTSKVPDLVP

SEQ ID NO: 47425 - protein, 157 aa, Sorghum bicolor
  unsure (1)..(157): unsure at all Xaa locations
  Clone ID: LIB3481-049-Q6-K1-C3.pep
HGYWPVITILKHLNTDPRXQAGPYLEASGRWCQXRNRHGDCFSALLTAQPKFLSARKAKLWSRPFWLSVSVTXFLIDCPRTAFCDGIGFGTKQFDMLVIIVTIRTTALIFXAVLGVDNPHFTTVLGGMCWIQPAXLSSSECGYIPLVKTSKRIPLIA

SEQ ID NO: 47426 - protein, 78 aa, Sorghum bicolor
  Clone ID: LIB3481-049-Q6-K1-C5.pep
WAAGSSAESVGFEEAVALFEEEEATAEEAREAFAVFDRNGDGFIDAVELLSALTSLGLQAGVPDADCQCMLDAVDRDW

SEQ ID NO: 47427 - protein, 179 aa, Sorghum bicolor
  Clone ID: LIB3481-049-Q6-K1-D8.pep
VRWIRHSIVRAMTLSSFTRFPFAMESERQEIGKAREELAFELGRPATDEEVRRKVGISPQRYRDVLRMTRPTYSLHARNRVTQEELINEVTDDDAIGVDAGGRHNTLLRLAIDDLLDSLKPKESLVIRQRFGLDGRGKRTLSEIAGNLSISREMVRKYELKALMKLKHPTRVEYLRRYM

SEQ ID NO: 47428 - protein, 39 aa, Sorghum bicolor
  unsure (1)..(39): unsure at all Xaa locations
  Clone ID: LIB3481-049-Q6-K1-E7.pep
LCVGVPSCPRFGCGRVVFXFVCARCVFKNXDRRAWVXPG

SEQ ID NO: 47429 - protein, 88 aa, Sorghum bicolor
  Clone ID: LIB3481-049-Q6-K1-F6.pep
IDSLFLCRLILLNIAVFRVILFSLPTSIYMALNLNYLYYSKHIVRLSFRTYFSAQHLMLLYRYYKLHGSFLHLCPRPSKAAMHLLLTL

SEQ ID NO: 47430 - protein, 86 aa, Sorghum bicolor
  Clone ID: LIB3481-049-Q6-K1-F9.pep
SPVIYTSILATLSRKAIVSGTVRHISIFVNHDAVVTIIFLKSVYQKRKFSVLQNSSLLLWPSQVQNKIYDGQIFHAKEPKKHNIGS

SEQ ID NO: 47431 - protein, 77 aa, Sorghum bicolor
  Clone ID: LIB3481-049-Q6-K1-G3.pep
FVGVFLAPVARVAARPFRVPVPPLRCGGGFAVARRRLRVVPLLSRWGGLSAPWSFWWVLRPPPLAGLLCRCGCAAPV

SEQ ID NO: 47432 - protein, 79 aa, Sorghum bicolor
  unsure (1)..(79): unsure at all Xaa locations
  Clone ID: LIB3481-049-Q6-K1-G4.pep
GGDMHPSLGLXRMQHALHAPTRPFQSRRSIHSCGXLMYLLNIRRPPIFFLARSXGFRPGACAMGCLVGAAAGCVGGGAW

SEQ ID NO: 47433 - protein, 56 aa, Sorghum bicolor
  Clone ID: LIB3481-049-Q6-K1-H11.pep
IYFIGRPNSTSRLGKPLAWGGGKPLHHIPFSPGGVLPNRPVPFSLTNPCPSSLANG

SEQ ID NO: 47434 - protein, 79 aa, Sorghum bicolor
  unsure (1)..(79): unsure at all Xaa locations
  Clone ID: LIB3481-050-Q6-K1-A4.pep
AVGQGILIXRGAGDRVGGGSSSSSREAMSANCVDILIAIILPPLGVLPQVCCVARLCLCLLLGVRGSLSPLVFLPSVLW

SEQ ID NO: 47435 - protein, 63 aa, Sorghum bicolor
  Clone ID: LIB3481-050-Q6-K1-B4.pep
SNSTESAAAWTSDGAGSAFRGHERAICLTWSLARTPGLGENTRRCAWPCYQTWRAVNALPQTA

SEQ ID NO: 47436 - protein, 132 aa, Sorghum bicolor
  Clone ID: LIB3481-050-Q6-K1-C1.pep
CTVVVSLQGATPYSVRARCWADAGDRAGPARRTPSTSLALTSSARRTRLSESTIDITPISKPGTGRAYGRMRLDRPCKLILLRADASSCPADSLLGDLGRGFHCAGRVPVPLCCWLLRGGLRLRDASAFRAA

SEQ ID NO: 47437 - protein, 99 aa, Sorghum bicolor
  unsure (1)..(99): unsure at all Xaa locations
  Clone ID: LIB3481-050-Q6-K1-C2.pep
ESSISLLAYXHRRATRVAREMTDSHDLATMMLLGSAARTHLPGPTPLALAMPSSRRGYRQTLVGGVGRAVEXRRGGRTWLHHAGEDKGASTKRSVGRTR

SEQ ID NO: 47438 - protein, 213 aa, Sorghum bicolor
  unsure (1)..(213): unsure at all Xaa locations
  Clone ID: LIB3481-050-Q6-K1-E1.pep
RVRPTNDALSQEXLNLRSQVESLTRXSLNSLXTWSWERTTKQLKEAISIAGEETAKCKAAKEVIKSLTAQLKGMAERLPGGAANNTKLPPLPGISIPSDISSMATESALSPSSSGEQIINGHTGLLASNGPSSVRNKTSHPEVGKNGSRPPDAESCHDAEWVEQDEPGVYITLTALPGGARDLKRVRFRRERFSETQAEQGWQENRARVYQQY

SEQ ID NO: 47439 - protein, 140 aa, Sorghum bicolor
  unsure (1)..(140): unsure at all Xaa locations
  Clone ID: LIB3481-050-Q6-K1-E9.pep
RXETACAGRMPTPAGAYGGPGGFAPITMEAATFSSRSPRRGGDEEEDLNELFRALSLRQAAASVAATTTVPVRSRSVAVGRIDEDAPCEFFGADDDVVVRVGGGPAVRRARSIAVGSARLTARAGYYGAVYKPGAGVVRG

SEQ ID NO: 47440 - protein, 207 aa, Sorghum bicolor
  Clone ID: LIB3481-050-Q6-K1-F1.pep
ASAGFVSVSGIERSACNKMLRFTIWTVFFANVLTGTVGSVLSQLEIFLNPKELPSKLAVVVPAQASFFIAYVVTSWTSITSELTQIAALFRHLWGKCAKCCKRDDSKAPSMPYYSEIPRILLFGLLGLAYFIVAPLILPFVLVYFCLGYFIFRNQLINVYVPKYDTGGKFWPVVHNTTIFSLVVLHIIAIGVFGLKKLPLASSLLLP

SEQ ID NO: 47441 - protein, 105 aa, Sorghum bicolor
  Clone ID: LIB3481-050-Q6-K1-F4.pep
EGQEQKPAMSLSRTVLSMMKILGGKMCGVLGPRYSKKQNARMLATAPRFRVLAGPIANHTQQEGRREGAERERLQGRQQAQLRGATSMHPQKVPACTECVNGCNG

SEQ ID NO: 47442 - protein, 53 aa, Sorghum bicolor
  Clone ID: LIB3481-050-Q6-K1-F5.pep
LVSLQKYQLSGAGWRQSAARIKPPLMSSWLMAEQLLYTTRRPGRRRSPALAGR

SEQ ID NO: 47443 - protein, 184 aa, Sorghum bicolor
  unsure (1)..(184): unsure at all Xaa locations
  Clone ID: LIB3481-050-Q6-K1-F7.pep
LRFAFVEFADDAGAXAXLTLGGTMLGXSPVRVLPSFSXFLPVNPXVVGGXEXXKDXVSRTVCCXHXXKKVTEDDXKGFFQXSCGKVSRLWLLGDYVHSTCXAFVAFAEAVCAFLALNFCGVVLGLLPLRVSPSETPVRPRSPRVLSFCARFVPSSPLRLPPMAYLPRLRFLSICERPYNPCFVV

SEQ ID NO: 47444 - protein, 119 aa, Sorghum bicolor
  Clone ID: LIB3481-051-Q6-K1-A12.pep
FGLTIAKKKKKKKKKKKKDYRSKKNKKKRGGGGGGLYLFYTLTSISMARGLTSTTTGTSQNPCRYPTSFALHAPSSLFCALVAIDEQTRTPSPSPNSMLNLECGNGHPPLLHSHLSACW

SEQ ID NO: 47445 - protein, 113 aa, Sorghum bicolor
  unsure (1)..(113): unsure at all Xaa locations
  Clone ID: LIB3481-051-Q6-K1-E1.pep
DLAFRKYKRHHTYFETQLKNCLWEDVSERYLEADTSEGFKALMSCSFPPXMIFGMALNVPVXYLNICADGFIGGICIFKMRKLYKPHNLDPKIYXLHRTARDKMIILLQLHGH

SEQ ID NO: 47446 - protein, 75 aa, Sorghum bicolor
  unsure (1)..(75): unsure at all Xaa locations
  Clone ID: LIB3481-051-Q6-K1-G6.pep
MSANGFNLGFTIKKYKKLHPPGNKLGPLKTAKPFFFFFFFFFFFFFFFFFFFFFFFFFFFFFFFFFYPRXPRNAW

SEQ ID NO: 47447 - protein, 89 aa, Sorghum bicolor
  unsure (1)..(89): unsure at all Xaa locations
  Clone ID: LIB3481-051-Q6-K1-G7.pep
INKFVSRLVVIAKKTSAAKSFVRGKNGDVVGXXRIHAFCGWSKLTIRTSFSWGLLLTGRGGKLCAQIENPSPWLCSLKNKWPTLWRSSL

SEQ ID NO: 47448 - protein, 171 aa, Sorghum bicolor
  unsure (1)..(171): unsure at all Xaa locations
  Clone ID: LIB3481-051-Q6-K1-H1.pep
NGPRXGAPGEEQDRETRRGGQQSQRKQKKGPAAGPWQMKRAHRVESDKRAGPKGLPNAGPQGPFRQRNIWEGPPGWPPSAVGQLGHRGINARPQRRVTPGVGPVPPPRNCGQGTPLKSHYRRVYAVCKHGYVKLGPPIFVLPFFFFFFFFFFFFFFFFFPSFFFFYGRGAD

SEQ ID NO: 47449 - protein, 177 aa, Sorghum bicolor
  Clone ID: LIB3481-051-Q6-K1-H5.pep
RSLKLCTYPLGLIKERLTIQRGVYDNFLDAFVKIVRDEGPTELYRGLTPSLIGVVPYAATNYLAYDTLKKVYKKVFKTNEIGNIPTLLIGSTAGAISSTATFPLEVARKHMQVGAVGGKKVYKNMLHALLSILEDEGVGGLYRGLGPSCMKLMPAAGISFMCYEACKKILIEEEENE

SEQ ID NO: 47450 - protein, 46 aa, Sorghum bicolor
  unsure (1)..(46): unsure at all Xaa locations
  Clone ID: LIB3481-052-Q6-K1-A1.pep
FXFHSNPPQHMXINVNPXTSKQGLKCXPNTVALRSVLGAQLSXCTT

SEQ ID NO: 47451 - protein, 78 aa, Sorghum bicolor
  unsure (1)..(78): unsure at all Xaa locations
  Clone ID: LIB3481-052-Q6-K1-A10.pep
ASALLKIKSFVEDGASVAEARPVAVTDLSGVGLSDLQEGLLSSESKASSVKELREDXLRGWGGGGHSLXLYXSSIAIT

SEQ ID NO: 47452 - protein, 62 aa, Sorghum bicolor
  unsure (1)..(62): unsure at all Xaa locations
  Clone ID: LIB3481-052-Q6-K1-A5.pep
YICXRVHAPTQNTSTCXKIPSMXTCMAXQTCWLLXXQHXVDKQKATAXTKSLPATTQSMART

SEQ ID NO: 47453 - protein, 65 aa, Sorghum bicolor
  unsure (1)..(65): unsure at all Xaa locations
  Clone ID: LIB3481-052-Q6-K1-B12.pep
SSSPPPPPNFSCTICLMYEAPGKFLLSFASDRSSGNQYATYSLQDSYDFACXGTXNIPLXLDHCQ

SEQ ID NO: 47454 - protein, 82 aa, Sorghum bicolor
  Clone ID: LIB3481-052-Q6-K1-B3.pep
SRERNGIPQTRRWKKDSQGNETKKHEKKQHDIRKQGTAKKVTLKLFALFFFFFFFFFFFFFFFFFFFFFFFFFFPTRNLRYT

SEQ ID NO: 47455 - protein, 96 aa, Sorghum bicolor
  Clone ID: LIB3481-052-Q6-K1-E6.pep
ALEPGQPVFWKGPLGVFEFDKFAVGTGGGAKKLAELRARGVPPIIGGGDSVAPVKKVGGAGVLSPIFRGGGPPLELLEGKNLSGVVALEEPLPLVV

SEQ ID NO: 47456 - protein, 209 aa, Sorghum bicolor
  Clone ID: LIB3481-052-Q6-K1-F8.pep
RPPRVRLLPLSRPRAHAGLLTCSSTPVVLGLHSHSAAAPSRRAWPLLARRNRNGRTDEETAAEPKIITVGRAGKSRRRRNRKQQTPPKEEGDDEEDDDERDATIPEVVTNRMMRRVGASVGLPLALGVGFFPVFYYLKAVAKVDVPTWIPFGVSFVFFGAALAGVSYGIVSASWDPAREGSLLGWNEARRNWPVFWDSLRRSPSPPRRG

SEQ ID NO: 47457 - protein, 134 aa, Sorghum bicolor
  Clone ID: LIB3481-052-Q6-K1-F9.pep
PDRPSRSTQRSPYLRSYGVTTCSGFLFLCSFIITYNFRGMQDAMTKQGLSMGFFGGIALLGWFYQLLFMPETKGKTLEEIDLIFERPTRSIVAENLKNIKETTSDLCHFRFKKVFVDDNKAKAAVALTEERFGH

SEQ ID NO: 47458 - protein, 48 aa, Sorghum bicolor
  Clone ID: LIB3478-058-Q6-K1-B11.pep
CCTGIDKDRVLQFAGAVRSWEPPEVCKGKGILYIDEVIKTKPGKKQKK

SEQ ID NO: 47459 - protein, 77 aa, Sorghum bicolor
  Clone ID: LIB3478-058-Q6-K1-B8.pep
AFPGQQSITAAASQPGYASQPATSAAVSYLTQRTPSYTYGAPPPHTGYDTQPAVYGQDTYGQPYPQGQKPTAFRPYG

SEQ ID NO: 47460 - protein, 57 aa, Sorghum bicolor
  Clone ID: LIB3478-058-Q6-K1-C3.pep
VVSFADMLIDFVPTVEWISMVEAPGFLNASWGTVSNVGMILCLLGWAAYFIKKLENH

SEQ ID NO: 47461 - protein, 84 aa, Sorghum bicolor
  Clone ID: LIB3478-058-Q6-K1-D9.pep
ASNQTHSFFPLPIQVAYTGAPSTTAAAYIDYLPTDEFLSSSRYSHIYSKKLHHWPYCYFFNHYNHTILNCLTSQCSHIRSDYRL

SEQ ID NO: 47462 - protein, 140 aa, Sorghum bicolor
  Clone ID: LIB3478-058-Q6-K1-G9.pep
GATDAKTELDSFVDFAPHYFRHLTEGWASRSPTCLAKIVGLYQVSIKNSKGGREVKMDLMVMENIFFQRSISRVYDLKGSGRSRYNSDASGHNKVLLDSNLIEALHTKPMFLGSKAKQKLERAVWNDTSFLAVLDVMDYF

SEQ ID NO: 47463 - protein, 66 aa, Sorghum bicolor
  unsure (1)..(66): unsure at all Xaa locations
  Clone ID: LIB3478-058-Q6-K1-H4.pep
ERAVQGPLLQLASVQQXXLMVNLSMVHSRRXXXQQSRHLSTCFXXEHATTYSTASSVQCSLIDTMC

SEQ ID NO: 47464 - protein, 54 aa, Sorghum bicolor
  Clone ID: LIB3478-058-Q6-K1-H9.pep
MADCTMSIFFTSIAGTPMEAGFYCEGRITKRKTEDKHKVARDGSPCYGPDRIKY

SEQ ID NO: 47465 - protein, 81 aa, Sorghum bicolor
  Clone ID: LIB3478-059-Q6-K1-A6.pep
NRRVPPSSNLFIKKMQPLTKKFKSQKKVKNVHKSSKISRWFLPIVFFKEKIFYYYFKKILLLFFNNLSKLQCHIFFTFIIA

SEQ ID NO: 47466 - protein, 61 aa, Sorghum bicolor
  Clone ID: LIB3478-059-Q6-K1-A9.pep
SHRHGGAFTRPNADTSSVEYNQSSTGRLVAKIKRRVSTPSDKLMPAEMPNMAATTHPTINE

SEQ ID NO: 47467 - protein, 89 aa, Sorghum bicolor
  Clone ID: LIB3478-059-Q6-K1-B2.pep
SGRPKTFHIGRGGTVHTTHATPADTDLHYLQRRDHAQLKADSRHALRRCNLADEPHTPRLHSISPEHVCPAPTHVHPHPGTGTLLSAAP

SEQ ID NO: 47468 - protein, 164 aa, Sorghum bicolor
  Clone ID: LIB3478-059-Q6-K1-B6.pep
MHCPTLFLLYKEMGERGVKPDEYTYVLLIESCFKVDRVEDAVSYFNKMLDAGLRPNANAFNKVIGGLVKVDRLSEAQGFFDMMPEKEVKPNIASYELLLKAYVAAARLDDAIKIAKGILLDESVVFSDEMKTLLEEALEKEGRDGEMTKLYEDVEREKAEAAAR

SEQ ID NO: 47469 - protein, 85 aa, Sorghum bicolor
  Clone ID: LIB3478-059-Q6-K1-B8.pep
PTRPTEPRPWPVRFTLYYRFNTKLKERVASLLPSAHLYRLNKHCLALSSPRLAPKTQGCSILWGWAQLFGTCFPKVGPCRSDGCG

SEQ ID NO: 47470 - protein, 128 aa, Sorghum bicolor
  unsure (1)..(128): unsure at all Xaa locations
  Clone ID: LIB3478-059-Q6-K1-B9.pep
IRIGPFLPPTTTHHTPRLVLGKTRRWSEMLSLFGSLILTHADIKLSPCSCHXAEGNLHQCGFHQSLSSFHIVQASTTGXPGLVTGRFTGRPAESSLLNPWCPYNRLEFSLNWLPGALRATQPXTSPGI

SEQ ID NO: 47471 - protein, 159 aa, Sorghum bicolor
  unsure (1)..(159): unsure at all Xaa locations
  Clone ID: LIB3478-059-Q6-K1-C5.pep
HSPGASGGVIECTGQGFSWLALGCCTCLAQDXSFTGLRVLTAFDHAGCDSVFPSRRSASSSSSRQIGCDCGCTSGLDPRSSKPVSANGNTCSPFCAAVQGFFGNVMGKSSVSAGLLQFLKCSKPSGLDPIIVHLMLSIPNTALPGALELLTGYGVGNDG

SEQ ID NO: 47472 - protein, 70 aa, Sorghum bicolor
  unsure (1)..(70): unsure at all Xaa locations
  Clone ID: LIB3478-059-Q6-K1-D1.pep
NVRVTTMHAELEFDMQPNTTRKQFFDHVVKTICLRXVWYLSLQSFHYERLTTWVQLDKKVSPQDVTKENP

SEQ ID NO: 47473 - protein, 96 aa, Sorghum bicolor
  unsure (1)..(96): unsure at all Xaa locations
  Clone ID: LIB3478-059-Q6-K1-E11.pep
QEHIMKKRTPKFCXIVPRKFHERRIFTTDRIPQQLSSMGVDPNAAMNRARTVCSAMAPSTMSISSTEMAGTPIKVGFFGDGRITMRKTAVKSNVAA

SEQ ID NO: 47474 - protein, 81 aa, Sorghum bicolor
  unsure (1)..(81): unsure at all Xaa locations
  Clone ID: LIB3478-059-Q6-K1-F9.pep
MTSKEDVPGGARHLVLTASAQSSIEPLRTSTACVAYPXXHKQNRRARTFTRLXGKTKGVFINPALVEPFGLTLIEAAAYGL

SEQ ID NO: 47475 - protein, 132 aa, Sorghum bicolor
  unsure (1)..(132): unsure at all Xaa locations
  Clone ID: LIB3480-043-P1-K1-E7.pep
RLTKCYLNTRYRYSSTYAVASMCRKQDGAQRSLHNNMSTSKSLISLAQTQCIFEPSLTYIVKPHVLMMQHAQREIVARSLSCCSSKRTCLLQTISLRSTTXDAWSCSLTWFILEDIVLESHAWQRDTLEITC

SEQ ID NO: 47476 - protein, 105 aa, Sorghum bicolor
  Clone ID: LIB3480-043-P1-K1-E8.pep
SLVPERTLPSRKLSVKLNKGGRVEMEGRQDCRRGALALEAEIFEVAPSVHVVEMRKTGGDSLEFREFYREELKPSLGDIVWSWQGGDSPPPAPVLVPRHATNQRS

SEQ ID NO: 47477 - protein, 72 aa, Sorghum bicolor
  Clone ID: LIB3480-043-P1-K1-G10.pep
HYNTSMQNYNGRGMIDERQSSSHWLYNVALLENTTVTELNQDEGYSALPSSANTDDDATDRAYQHTLSLNGD

SEQ ID NO: 47478 - protein, 89 aa, Sorghum bicolor
  Clone ID: LIB3480-043-P1-K1-H6.pep
ATLGSYKKRAGGYSPPMHIKNVDQILRPVQGLPPAAFITAVLRGVYRHHPDATSHRADYKDCGSAPPSSRYHLIDVSIVCIKDSSVYYL

SEQ ID NO: 47479 - protein, 141 aa, Sorghum bicolor
  Clone ID: LIB3480-045-P1-K1-A11.pep
MFPQYVVPTMRTPLFILNAAYDSWQVKNVLAPSPADPKKTWAQCKLDIKSCSPSQLTTLQNFRTDFLAALPKTPSVGMFIDSCNAHCQSGSQDTWLADGSPTVNKTQIGKAVGDWYFDREVSRQIDCPYPCNPTCKNREDD

SEQ ID NO: 47480 - protein, 169 aa, Sorghum bicolor
  unsure (1)..(169): unsure at all Xaa locations
  Clone ID: LIB3480-045-P1-K1-B7.pep
GPYFQVFFFFFFFFFFFFFIKTIFDPYQQFIGTRLLNRQFENIQRTLSLFKAINPNLRTXIRQRVGKXCDSLDFNKLGGLKQNVYASFKVVRHRTNHLIATQTETXKKKVKLSYEAYKNLKKGLCLRKDPAFGLKKKTGPGGRDRPRAXTGRHPPXMYSFRVVPSQTNL

SEQ ID NO: 47481 - protein, 109 aa, Sorghum bicolor
  Clone ID: LIB3480-045-P1-K1-H12.pep
AYGHLQAELEAERGAAEGAASEAMYMILRLQRNKSEAMMDARQYRRYAEERFEHDAAEVDALHDTLDCRDHAVHALACRLRACHARLLHHGLPGCANNDDGRHYYHCDC

SEQ ID NO: 47482 - protein, 121 aa, Sorghum bicolor
  Clone ID: LIB3480-048-P1-K1-G3.pep
VICCCAVFFPIIWSIRNLRKASKTDGKAARNLQKLTLFKQFYLVVVCYLYFTRIAASAVAAVLSYKYQWAVNVSIETASLAFYVFVFYNFQPVEKNPYLYVGDDEEEAAGGQLEMESTFEI

SEQ ID NO: 47483 - protein, 192 aa, Sorghum bicolor
  Clone ID: LIB3480-049-P1-K1-C11.pep
GRFLWRPLRPSPQTLPHSQASRHATPPNIAPSGRAGHRHRSFELPHLGCRIYSSSLLPRFTSDPDLHRLPLIYAPVPFSFPILHLFACSFPGGGGRIHGRWILGRWRKTCCPGTRWRSTNNQRPLPWLPTPSTLASLWHVHPIHVHETDHMNVNSDRCVANGTRAESRRQSWRCTQRWLNWRMQAELGAPNS

SEQ ID NO: 47484 - protein, 174 aa, Sorghum bicolor
  unsure (1)..(174): unsure at all Xaa locations
  Clone ID: LIB3480-051-P1-K1-A7.pep
MANHLRPLALLLAVLACALLCRRADATAFEVGGDDGWVVPPASDGGRYNQWASKNRFLVGDIVHFKYKEDSVMVVTEADYDSCSASHPIFFSNNGDTEVALDHPGTIYFISGETGHCERGQRMVVKVVGPDAPPPAPXSPPAPTGAAAPVTTSGALAGAIAAVAMALPVIVIGV

SEQ ID NO: 47485 - protein, 103 aa, Sorghum bicolor
  Clone ID: LIB3480-052-P1-K1-H10.pep
LTAYTFWAAKQGYDFEFLGPFLVAAVLILMLFGLVRILFPLGKTGTMVYGCIAALVFSGFIIYDTDNLIKRYSYDEYVSAAIELYLDIINLFQAILAILEGVD

SEQ ID NO: 47486 - protein, 55 aa, Sorghum bicolor
  Clone ID: LIB3480-053-P1-K1-E8.pep
EGLNRNKAAPLRSDAPTARPLYPLLFCFFFCVFFFLFFYIVRFFFFFGRAVDRNR

SEQ ID NO: 47487 - protein, 57 aa, Sorghum bicolor
  Clone ID: LIB3480-053-P1-K1-E9.pep
RLKPPCCQTKSLSCTSSSCQQHGLVTRRALPIEPNSSAASIMYDASRAAAPHSPRLL

SEQ ID NO: 47488 - protein, 64 aa, Sorghum bicolor
  Clone ID: LIB3480-053-P1-K1-H1.pep
AVHSSSKRVGGKGLPRSSSCSAWGSKNGPFRFRVAPSYPPPAICCHRTRSGRWFEKARAEAVNT

SEQ ID NO: 47489 - protein, 96 aa, Sorghum bicolor
  Clone ID: LIB3480-056-P1-K1-A10.pep
TADQQAYIYIFIYIYIYIYIYIYIYIYIYIFIYIYIYIYIYIYIYIFIYIYIYIYIYIYIFIFLYIFIILILFLFILLFLFLFLFSFYPQPSTTLA

SEQ ID NO: 47490 - protein, 87 aa, Sorghum bicolor
  unsure (1)..(87): unsure at all Xaa locations
  Clone ID: LIB3480-056-P1-K1-A3.pep
VSSWPLEPSPCFSRDGFMISSGLPEXVFFVSAVCLVLLCQGVLGIIELIMLVWVPXGXVGPISPLPVLVSIHTPXVEVELRPPVLAP

SEQ ID NO: 47491 - protein, 154 aa, Sorghum bicolor
  Clone ID: LIB3480-056-P1-K1-A4.pep
PDIPGLDPSQSDFLFFFIFFFFFFFFFFFGLSFLKSSIAFCSRACAVFVVPWCASCFHCPGSFSVASGFSLARPFSSSLLVFPRPPPAVSPWRPAPFALPLCCPKGLAFGSLPTVALFVRRLRRPLFGCPFHWPGPYYPLLALFSVLFSPARSV

SEQ ID NO: 47492 - protein, 69 aa, Sorghum bicolor
  Clone ID: LIB3480-056-P1-K1-A7.pep
PRVRTSTGEKLPFGVEANYILETGVGSVSLSFVPLLAQRDMLRSCLHSLRKSRYVYLFICFSNAKLKYI

SEQ ID NO: 47493 - protein, 51 aa, Sorghum bicolor
  Clone ID: LIB3480-056-P1-K1-B3.pep
IAWRGQPTNVARKERKLTKRAVASSLVRVTVTLCVTPSPPVINASKQGAFQ

SEQ ID NO: 47494 - protein, 110 aa, Sorghum bicolor
  unsure (1)..(110): unsure at all Xaa locations
  Clone ID: LIB3480-056-P1-K1-F8.pep
SRGSIFFTQEXGDGPTTVTGRVSGLXPSLHGFHVHALGVTSYGCMSTGPLYFPASXELGPPLVVFRLAGVLGFVTAGAVGVANFRVTDSQFPLSGPNSFFGRAVVVHAVP

SEQ ID NO: 47495 - protein, 45 aa, Sorghum bicolor
  Clone ID: LIB3480-056-P1-K1-G4.pep
NKNQSEKTKNSTRKNPYRHLPFLSYQPSAEEVELRQHATGTRTRP

SEQ ID NO: 47496 - protein, 126 aa, Sorghum bicolor
  unsure (1)..(126): unsure at all Xaa locations
  Clone ID: LIB3480-056-P1-K1-H6.pep
VSPICLVVFQVGFVVRGLPCALFFLVVSFVLWLRLFVLCPQSXCSVFPFLVLSALFFLRSSCVPVLPSACACVVSSASAASCFVRSLPARLCYLVRLLGLLLRPVRLESVMRVGEPAVAFCRLVGS

SEQ ID NO: 47497 - protein, 50 aa, Sorghum bicolor
  Clone ID: LIB3480-057-P1-K1-H6.pep
VCEPMFSMTRLMKGRSSCDPRELSAGPGYSWAPDINVDLRRVVDRIPAGT

SEQ ID NO: 47498 - protein, 151 aa, Sorghum bicolor
  unsure (1)..(151): unsure at all Xaa locations
  Clone ID: LIB3480-058-Q6-K1-A4.pep
GRPSXRANXNXXPKXTKDTETQEQERKDTXTTRGQEQGGGHERKGADQXHKEPGEPRHRGDEGAXQPRPPGTNPQATDKKTGREKGXKNPRERQGRATGXPKPGQQRRNTRGPRKKRQTHRGTQNEPPKKNKQSGAKGPRKEAKRRQTTGT

SEQ ID NO: 47499 - protein, 63 aa, Sorghum bicolor
  Clone ID: LIB3480-058-Q6-K1-C2.pep
MLLFKRASLTSGFSLDDPNALGSRIRRMLNLGLSVFEDQAPEAHSAMPPFEEDARLTKLDAVA

SEQ ID NO: 47500 - protein, 88 aa, Sorghum bicolor
  unsure (1)..(88): unsure at all Xaa locations
  Clone ID: LIB3480-058-Q6-K1-H2.pep
FRLAPLVSSALXAGVVPAWPAGXCLRPVGVAGPGRXRRGXXLLRRAALRXGPPGXVXAXXPPPPLGLFLPGWLVXLLSPSLLVFFVVL

SEQ ID NO: 47501 - protein, 42 aa, Sorghum bicolor
  unsure (1)..(42): unsure at all Xaa locations
  Clone ID: LIB3480-059-Q6-K1-D3.pep
LXSVXXLXXFXXXCXGVXXVAVXFFPAXLLXXXAFCALXAAV

SEQ ID NO: 47502 - protein, 65 aa, Sorghum bicolor
  Clone ID: LIB3480-059-Q6-K1-G10.pep
PGSDGGDLLYAWADTKPNVLVTLTNVRIGHRKRVENGENGGTWAGRQPLRVPPRRSEAGQHLYRK

SEQ ID NO: 47503 - protein, 92 aa, Sorghum bicolor
  Clone ID: LIB3478-053-Q6-K1-D7.pep
GLKNANPALTTHIRWDVRHGRQCPCSWRLRKDTRACSSADPKDPDQHHAGPLTTVGTKKRLDQKYKAAKQGTTDPCRTAQLGLHKGDEEIAH

SEQ ID NO: 47504 - protein, 63 aa, Sorghum bicolor
  Clone ID: LIB3478-053-Q6-K1-D8.pep
RPEISLSLLDFCYCLYPTERDYLSAIFHRIYGKNMVHSPFIRKAIKCQQIISAISYKETYLKD

SEQ ID NO: 47505 - protein, 75 aa, Sorghum bicolor
  unsure (1)..(75): unsure at all Xaa locations
  Clone ID: LIB3478-053-Q6-K1-D9.pep
DASSTLYCAFIVHRPFITKAINNIFYRLIFETDNHNGLPDLLQNFRKIIHVFVFPLTEQHTSXQMLPLIPLHKPL

SEQ ID NO: 47506 - protein, 71 aa, Sorghum bicolor
  Clone ID: LIB3478-053-Q6-K1-E8.pep
SFLTQLLTQNAHSQKIPLHSLSIHKNLEHTYSIVSHTAYVIRVSDFPNKLLLIHISTNLFLHLPFDPKLAT

SEQ ID NO: 47507 - protein, 117 aa, Sorghum bicolor
  unsure (1)..(117): unsure at all Xaa locations
  Clone ID: LIB3478-053-Q6-K1-G11.pep
PPLPGAAPFSLPPRKPPPVLHTPCSAHSAWPPPPPSSSPXPPRHSRAPPPRSHPRPLPSRSRCPPRPTTPSQTPPRPSPTPSRSSSSRPPASFASAARTRRARAWPRPDAERATPAS

SEQ ID NO: 47508 - protein, 172 aa, Sorghum bicolor
  unsure (1)..(172): unsure at all Xaa locations
  Clone ID: LIB3480-060-Q6-K1-A4.pep
SRALKMARSSPKPEKTVARLTYLATLAGMLGELGEGGTLEQVASWLRPVECVLCSPAXCASRSPSCRXPCWCRPSPRVPRPLRGXPCSXRCCPRPCLGPARLLXCXRXAGVGVVLXSCGARPRPAVPLVRXCPXWRLPMPSPXLGAXXVARRFPAAPVARSGPVATXAPAVC

SEQ ID NO: 47509 - protein, 70 aa, Sorghum bicolor
  unsure (1)..(70): unsure at all Xaa locations
  Clone ID: LIB3480-060-Q6-K1-A9.pep
EASGTSNDETXRTGGXTTGTREGAKGEXREEGGEEXXPQXGAKXXQXAGXRKDREXGPXKPDPXXEEAKQ

SEQ ID NO: 47510 - protein, 91 aa, Sorghum bicolor
  Clone ID: LIB3480-060-Q6-K1-C5.pep
SAVQGNPPTCRSIQISYSFISACNTRWLNITSVPHVPFGRLTRTWSTSLREHPGFSAIQGFIWVTLNETLSLEFTTLLVSSRSDGPFQKLT

SEQ ID NO: 47511 - protein, 161 aa, Sorghum bicolor
  unsure (1)..(161): unsure at all Xaa locations
  Clone ID: LIB3480-060-Q6-K1-H2.pep
MTTLNSTPRADGFHMPAEWAPQTQAWMIWPERPDNWRLGGRPAQAAHAAVARAIARFEPVTVAVSAAQYENARARLDVPNIRLVEMSSDDAWVRDSGPTFVINDQGEVRGVNWGFNAWGGFDGGLYAPWNRDAQVAGKILXIERCPRXQXVGFVLXGGSIH

SEQ ID NO: 47512 - protein, 74 aa, Sorghum bicolor
  Clone ID: LIB3480-061-Q6-K1-B3.pep
ILGQVRCQEQPSKLGAYPRLDLRSGRFEHTRAHARMILSSSPSPGPAPPCPRARNSRQSGCPTARTAAADQVGR

SEQ ID NO: 47513 - protein, 38 aa, Sorghum bicolor
  Clone ID: LIB3480-061-Q6-K1-G10.pep
CIGQTARFADINVPLYAASECIPLIINSAQVRSTTIYP

SEQ ID NO: 47514 - protein, 79 aa, Sorghum bicolor
  Clone ID: LIB3481-041-Q6-K1-B6.pep
GFGPLNRRPFFFFFFFFFFFFFFFFFFFFFFFFFFFFFFFFFFFFFFFFFVHHSHQLTFFHICKVYYTSTGHTSHNLPD

SEQ ID NO: 47515 - protein, 114 aa, Sorghum bicolor
  Clone ID: LIB3481-041-Q6-K1-C11.pep
IRAAYRDMYPYVCIVLTNGVSRSVELHIWKETWQEPRAKKLKNGRSALCEYAPDLSALFNGTPEAHCPVSMPLRLFRLFCAENKWQARKEKKKKKKKKKKKKKKKKKKKKKTHG

SEQ ID NO: 47516 - protein, 102 aa, Sorghum bicolor
  unsure (1)..(102): unsure at all Xaa locations
  Clone ID: LIB3481-041-Q6-K1-F9.pep
DGTLKQGDNGEGDTEEEEEPVVVXVSKMWENIKSADYDSSTEKDNDGQSQVDLESNKGDAGIHGNGLHSAKESRGKTSPTKQYQQHKKKPLLKRFIGLLQQE

SEQ ID NO: 47517 - protein, 75 aa, Sorghum bicolor
  Clone ID: LIB3481-041-Q6-K1-G5.pep
RFDVMRNLKNFAKFLGTKQGPVIPVGLSPARKKKVIPVSELCLFQLRHCSVHEKNLALATVTFSFVFDKFYLIMD

SEQ ID NO: 47518 - protein, 142 aa, Sorghum bicolor
  unsure (1)..(142): unsure at all Xaa locations
  Clone ID: LIB3481-041-Q6-K1-G8.pep
PFPEQGYILLTTYLRTXYKIGNFVRQTSGRGXVLWGSPYKDTSGGRVFSIKXTTGAICGEINKQVNGHIIRMGVHVAVLARAAMPFCIIVTPGERXSNDELNLASKGLGEIISAKNQDYGSKPTFVVQGATLHTVTTIPHDD

SEQ ID NO: 47519 - protein, 119 aa, Sorghum bicolor
  Clone ID: LIB3481-041-Q6-K1-H11.pep
MCQGELSFYVAGTSIVPAAQSPRGLRLQLQLQCSASAVGLASGGDTVGDELEFLNRCKDAGVVHILGNTIVRARRDSGVVKKLAVDYMYAFMRRVCRENSIIFNVPHESLLNVGQIYYI

SEQ ID NO: 47520 - protein, 107 aa, Sorghum bicolor
  Clone ID: LIB3481-042-Q6-K1-A8.pep
GKSDRKTEKRKPERGARKEAHRGEKTKKTPKKWREKKGKQPKKQGKRPIEKGGRAWANSTNPPRLKGKQRGLKKMAKRRESLSKKRLKRAPGEKSRGPQKKNFTPPN

SEQ ID NO: 47521 - protein, 93 aa, Sorghum bicolor
  Clone ID: LIB3481-042-Q6-K1-B4.pep
LILRSCLFDKANFMCSSDASQSLTEHFNDEYHHHMLQAEIFHIASSCLPFPEPNSLETLQKKRNHIPLLSRQTEPSYEERISKVKTKVADNLK

SEQ ID NO: 47522 - protein, 131 aa, Sorghum bicolor
  Clone ID: LIB3481-042-Q6-K1-C10.pep
GAQALAVPHLEKNLWGGGGVSPACFTCRVGLNRLGSCGRACGFLAIFDCGLRHSCVFIWVRALCGGVFTRVALCPFFARLLPGYFALPPRCGLLTLAGLFFPALSPRFPARFRFRVFFFLSPRFLPGGAGF

SEQ ID NO: 47523 - protein, 185 aa, Sorghum bicolor
  Clone ID: LIB3481-042-Q6-K1-D12.pep
MSSVVKLGTWGGDGGSACDLTVAPQRLESITVRGGEVIDWISFSYRDRSGELHTAGPWGGNGKGEGTETITLEPSEYVTGVAWSVGPFTFKNVECCITSIKVVSNLRSYGPFGHGVDSTHHSLPVLDGSVVGMFARAGDFLDAIGFYILPAALPAAVKPTDPNNQEEKEKDSSQEGNQEEKGEQS

SEQ ID NO: 47524 - protein, 46 aa, Sorghum bicolor
  Clone ID: LIB3481-042-Q6-K1-E11.pep
MSELYLNPDGNFELAASDSRCYIRSSVGQFISPVHVSVTAVASLQH

SEQ ID NO: 47525 - protein, 56 aa, Sorghum bicolor
  Clone ID: LIB3481-042-Q6-K1-F5.pep
RNLIVKSSSTMSNMISNFGSTFTALLDPVMFQSGGIHSCHLFISLKSYLFIIIMNE

SEQ ID NO: 47526 - protein, 73 aa, Sorghum bicolor
  unsure (1)..(73): unsure at all Xaa locations
  Clone ID: LIB3481-042-Q6-K1-G6.pep
RFXKKKKKKKKRGGEGDKKKKQTNIHNAYKIHTLLYRRNLTFSFTGPPNLQRPGTWVNPSALPQLKPLLRRGG

SEQ ID NO: 47527 - protein, 72 aa, Sorghum bicolor
  Clone ID: LIB3481-043-Q6-K1-C6.pep
SAPLSAPCVGVTPSVAVGFASSLGPFPWGFLGFFPAGSACFPRQVLNGGFLLGFLFWAKRPLFPKKLFRGGV

SEQ ID NO: 47528 - protein, 120 aa, Sorghum bicolor
  unsure (1)..(120): unsure at all Xaa locations
  Clone ID: LIB3481-043-Q6-K1-D5.pep
FTSLAVFLGGRGWKTPGVPRLSRVAXAHPFFPGGRTAXAARPVRPSHQWGRLSGRWAPPCCGLLTPGGGVFPPTVTGALAGALPPVPSVFFPSFVAPFACFPLHVLIGGLPCGSRFTALR

SEQ ID NO: 47529 - protein, 122 aa, Sorghum bicolor
  unsure (1)..(122): unsure at all Xaa locations
  Clone ID: LIB3481-043-Q6-K1-E4.pep
FSVQNPGVSLLFLLGALFFFAWRCFSHGGRGKPPGQPILILFGKWPFPWVGVFTPGPVLFSLPCGXALALALAPPLFAAFHPFVGWFFLFPCPFLLRGLSFRFFCIFFLLFSPLSLVFPDGF

SEQ ID NO: 47530 - protein, 56 aa, Sorghum bicolor
  unsure (1)..(56): unsure at all Xaa locations
  Clone ID: LIB3481-043-Q6-K1-F9.pep
VRLITFIELIKNPXYSFWTRSFXHCAPEIEKLFESVARSCGGKGADDGMGLADGGH

SEQ ID NO: 47531 - protein, 195 aa, Sorghum bicolor
  unsure (1)..(195): unsure at all Xaa locations
  Clone ID: LIB3481-043-Q6-K1-G5.pep
MLESPESXKMHSICLRFTTIFWNLIIAPWKFLFAFVPPYKIAHGWIAFICSLIFISGIAYGVTKLTDQISCVTGVSPYVIAFTALAAGTSWPDLVASKIAAERQVTADSAIANITCSNSVNIYVGIGVPWLIDTVYNFFVYQEPLYIDNAAGLSFSLLVFFATSFVCITXLVLRRIILGAELGGPRLWAWVTSVY

SEQ ID NO: 47532 - protein, 97 aa, Sorghum bicolor
  unsure (1)..(97): unsure at all Xaa locations
  Clone ID: LIB3481-044-Q6-K1-A10.pep
RPPRVRPASAYAXGGSRTLGAPPRSPPPLLHLFHGVPPTRTPLALSSFLSFLSLSFHHRWGGGAPPSLLCRLQHRIRNDDVKLFRHLPSPVLRSNSS

SEQ ID NO: 47533 - protein, 66 aa, Sorghum bicolor
  Clone ID: LIB3481-044-Q6-K1-A8.pep
GQFIKFFFFRPGEFNFGVPYKKTPPLPRFFFFFFFFFLFFFFFFFFFFFFFFFFFFFFFLYIIHIS

SEQ ID NO: 47534 - protein, 185 aa, Sorghum bicolor
  unsure (1)..(185): unsure at all Xaa locations
  Clone ID: LIB3481-044-Q6-K1-A9.pep
RPPSVXFFTGEGGGITDLKFTGDGQYLLTRDYMNLKLWDLRVETSPVATYKVHEFLRPKLSGVGTDDYIFDRFSCCASKDGAYFATGSYSNTFKVFSRAAAQTSGTTLEASTNPYRIQLQAPTKLPALLSNFPLGVNRKGHDGPRSDGKEEVSCNMASKVKHLAWHPAEKXIVCAANNNLYMYHT

SEQ ID NO: 47535 - protein, 168 aa, Sorghum bicolor
  unsure (1)..(168): unsure at all Xaa locations
  Clone ID: LIB3481-044-Q6-K1-C5.pep
EDALGMASTGXCKSGEVMYDQRLFNQDKGMDSGFATDDQYNIYSKGLFTAQSTMSTLYRPKKDGDSDVYGDADEQLEKVMKTERFKPDKGFTGASERTGKRDRPVEFDKQEENDPFGLDQFLTEVKKGKKAVEKIGGGGTMKASGGSSMRDDYDGGSGRSRINFERGR

SEQ ID NO: 47536 - protein, 121 aa, Sorghum bicolor
  Clone ID: LIB3481-044-Q6-K1-E6.pep
NISNRLNCRGHATKTGLHRYKTIGIPASTSCSMSVKTRSMIIIVVLHLIIQLSHHLKSNLATFGSLLSMGLLTNEPFVKLTSPLLIEEPLMQLISLPFVGVFGAGSEQRPEEWVCVSKTGR

SEQ ID NO: 47537 - protein, 58 aa, Sorghum bicolor
  Clone ID: LIB3481-044-Q6-K1-E7.pep
LTLTHNHVRVLSYCLFSFFRKERTYKYLKHLALTEACSSKPSLFPLVSQKACDSMSTQ

SEQ ID NO: 47538 - protein, 134 aa, Sorghum bicolor
  unsure (1)..(134): unsure at all Xaa locations
  Clone ID: LIB3481-044-Q6-K1-F8.pep
VRXKTXYSLDPLVRQVGAPIPLKRPALSAEPSVQVRKLKPNDLFLIFASDGLWEHLSDDDAVQIVFKNPRTGIANRLVKAALKEATRKREVRYRDLRTIDRGVRRHFHDDISVVVVYLDRHRERRHTRVIDSSS

SEQ ID NO: 47539 - protein, 86 aa, Sorghum bicolor
  Clone ID: LIB3481-044-Q6-K1-H12.pep
MPFSSPKYVELLDMGVRIGAGFPSHCPQTGGLFYHPPPGGPGSHAVAASGGDGPKGDPPASAAIIIKNHQGQRLDPPSKIILYPVV

SEQ ID NO: 47540 - protein, 69 aa, Sorghum bicolor
  Clone ID: LIB3481-044-Q6-K1-H5.pep
MASSSVAADMELDRPNLEDYLQSVSLPQEAPHYLHLRDLLDISPVLTQAAGAIVDEKGFGELHIRKHFQ

SEQ ID NO: 47541 - protein, 71 aa, Sorghum bicolor
  Clone ID: LIB3478-054-Q6-K1-E3.pep
LLVISWATLPRCYATPWTAVACDRGFCVSAAFRQPRVGLVARVPGLRKATYVRCFPQGALCTVVGAVFRRL

SEQ ID NO: 47542 - protein, 175 aa, Sorghum bicolor
  unsure (1)..(175): unsure at all Xaa locations
  Clone ID: LIB3478-055-Q6-K1-G7.pep
FPGATPTRARVKTQTFXXKGXXLXXARCRERKXMKPTXXGXXKCHALSXILAHKLVAKNTASYCVGHIAGQRKRFGGPXEDGXTTFIGQVVPLXXMFDGYPSKXLTXTRXCSNXXAXRDPLCXGXXXXNHXXHXXSXCGKPRVXXVXETQAXXQSPKXXVTXXQTGXEEXXAVLL

SEQ ID NO: 47543 - protein, 94 aa, Sorghum bicolor
  unsure (1)..(94): unsure at all Xaa locations
  Clone ID: LIB3478-055-Q6-K1-H12.pep
PPGHHRKDEEQLEQPVAGGGYGYGEAAEYTETTETEVVATGGEDESDTCKKEEKEHKHRQHLGEAGAIAGGAXALYEKHEAKKDPEHAHRPKTE

SEQ ID NO: 47544 - protein, 63 aa, Sorghum bicolor
  Clone ID: LIB3478-055-Q6-K1-H5.pep
PRVRSRATRRQYYYVHHHDGITTTRPAMPSGGYYGLRVDRTFRTRNLMSGYRSLAPTARSRTS

SEQ ID NO: 47545 - protein, 171 aa, Sorghum bicolor
  Clone ID: LIB3478-056-Q6-K1-A6.pep
GDESKLISDRMKYLLYEVPVRVAGGLLFELLGQSIGDPNREEEDIPIVLRSWQAQNFLVTTMHVKGPSSNINVLGVTEVQELLLAGGSQTPRSVHEVIAHLVSRLSRWDDRLFRKYVFGEADEIELKFVNRRNREDLNLISIILNQEIRRLATQVIRVKWSLHAREEILLE

SEQ ID NO: 47546 - protein, 56 aa, Sorghum bicolor
  Clone ID: LIB3478-056-Q6-K1-G6.pep
PGTSNDLLTPMICKKSKLSTFNFGLQKNYHKHIGGLNFFFNIWITTTRPAAKLKSK

SEQ ID NO: 47547 - protein, 58 aa, Sorghum bicolor
  Clone ID: LIB3476-001-Q6-K1-A3.pep
LQVDNFRRQYLNLEGVKNNQMVLIVEVQIIMPSDAFHFWFLLNTSTKNQREGHNFLCS

SEQ ID NO: 47548 - protein, 93 aa, Sorghum bicolor
  unsure (1)..(93): unsure at all Xaa locations
  Clone ID: LIB3476-001-Q6-K1-F12.pep
RPNSRSTSVRSPPLPGWGWRVPGLAAPGRRVAWAPARPDSPAXLVLRGDTDSARASLQRLRGPGGGRDXELKDIFRAEEDARRNNQGTYERMV

SEQ ID NO: 47549 - protein, 62 aa, Sorghum bicolor
  Clone ID: LIB3476-001-Q6-K1-G1.pep
MLAVFNGGVVEVPAELVAVGSRTPSPKTRAYELVGRFLGASEPAVFVQIGDLGHLAYYHNNQ

SEQ ID NO: 47550 - protein, 71 aa, Sorghum bicolor
  unsure (1)..(71): unsure at all Xaa locations
  Clone ID: LIB3476-001-Q6-K2-C2.pep
LPTVRIPVATRPRYPLASGTEXVRERKRRRPPRPFIYWRRRRPMMARTLLPLWGGPSRRYLDCTFTGLLTG

SEQ ID NO: 47551 - protein, 62 aa, Sorghum bicolor
  unsure (1)..(62): unsure at all Xaa locations
  Clone ID: LIB3476-001-Q6-K2-G2.pep
SKGLISDVIGPQPXCKIVSIRSQPYQKSQAVMGCTLCSRVHLISQAITFTAIMTISRGPEWD

SEQ ID NO: 47552 - protein, 100 aa, Sorghum bicolor
  unsure (1)..(100): unsure at all Xaa locations
  Clone ID: LIB3476-001-Q6-K2-H8.pep
VXXGVXXEVVHPPGVLRRAPAAAPAXAPAAPAAEVRPPPLRELHLGDISRRSRRRSRRRPRGGRGHLPRRACGWIPTVKGGGGGGKVGKRSIRILQLYGR

SEQ ID NO: 47553 - protein, 43 aa, Sorghum bicolor
  Clone ID: LIB3476-002-Q6-K1-B5.pep
RQAADGVMGILRSWQLLSCQIQLHAPPHRMSLNRSAYAGRPGI

SEQ ID NO: 47554 - protein, 34 aa, Sorghum bicolor
  Clone ID: LIB3476-002-Q6-K1-G2.pep
WGCSPWASHQAGLLCLCEELDISSSLLILAEYRR

SEQ ID NO: 47555 - protein, 63 aa, Sorghum bicolor
  Clone ID: LIB3476-002-Q6-K1-H2.pep
AAPAAPTPTPTLPRAGAGAALDCSRSRPGNRSYTPSGGMAEELVLDTENRDWRLIALSVIMDL

SEQ ID NO: 47556 - protein, 56 aa, Sorghum bicolor
  Clone ID: LIB3476-003-Q6-K2-E8.pep
VRIPGRPASATFPSLAVSSLPIHHQPKSPSSSSPPSMKAAIKAPVEAPGGGGRRRR

SEQ ID NO: 47557 - protein, 86 aa, Sorghum bicolor
  Clone ID: LIB3476-004-Q6-K2-E6.pep
MAAPRLALVVATTVAVLAALLLAVLEPASAAVSCSYFTSWGARVPHYSMDTTASPSPVCYTGVRSLNSRASSIVERHFTCACLKSI

SEQ ID NO: 47558 - protein, 64 aa, Sorghum bicolor
  Clone ID: LIB3476-005-Q6-K1-C4.pep
MKKLFFVSFVLLLAVPAVNGENGASIGVTIGTAMSSVPAPTQITTLLRSQNIRQVRLYNADPAM

SEQ ID NO: 47559 - protein, 77 aa, Sorghum bicolor
  Clone ID: LIB3476-005-Q6-K1-F2.pep
PRVRDCGSTRRGGGLHKYAIIPKRTALLPIYLHGRRTVDMITGLYQDLPELGGDFSQRGVGEHHLLPHHQGLHWATW

SEQ ID NO: 47560 - protein, 63 aa, Sorghum bicolor
  Clone ID: LIB3476-005-Q6-K1-F3.pep
GSSNISVIIISQQCSSVLGISSYDPYAPSKPQKANYVRVSIHPRHVLSVDVMPASLTSSEGWV

SEQ ID NO: 47561 - protein, 103 aa, Sorghum bicolor
  unsure (1)..(103): unsure at all Xaa locations
  Clone ID: LIB3476-006-Q6-K1-B12.pep
PLKSNAVDSALEGTKGNVSVVPTNNQTGSLALAGQKDVGSPRNNNTVVASPSVKNQEQTGSQVAPSGSTGTANNPKGDAAXGSAGSSENHSTQANSSKSGNNS

SEQ ID NO: 47562 - protein, 38 aa, Sorghum bicolor
  Clone ID: LIB3476-006-Q6-K1-B6.pep
CRISEYPKKVNWAHTAGSPFLIYIFFRLSLLVQSIHQH

SEQ ID NO: 47563 - protein, 63 aa, Sorghum bicolor
  Clone ID: LIB3476-006-Q6-K1-C6.pep
ASAGLMWGRFFFKIHTGATLSRQIMMELFFSATTRGRPFPADQQELEVALSEPATLHGATPAD

SEQ ID NO: 47564 - protein, 88 aa, Sorghum bicolor
  Clone ID: LIB3476-006-Q6-K1-F10.pep
MEGDKMPRVRLGKQGLEVSKLGFGCMGLTGVYNAPVPEEAGIAIIKHAFEAGVTFFDTADAYGPHTNEVLLGKALKHLPREKVQVATK

SEQ ID NO: 47565 - protein, 46 aa, Sorghum bicolor
  Clone ID: LIB3476-006-Q6-K1-F7.pep
VYVMSLDAVQGVLFGFWLGLSILFFFRWPCADPHKMCLVVVLSYAP

SEQ ID NO: 47566 - protein, 35 aa, Sorghum bicolor
  Clone ID: LIB3476-006-Q6-K1-H10.pep
LLCLFREVFGNRGLAYIVIIMLKVYAGLCYKMCLY

SEQ ID NO: 47567 - protein, 66 aa, Sorghum bicolor
  Clone ID: LIB3476-007-P1-K1-A2.pep
YVHRNHPNLIQSQKTYKTIIVAGSTAKRLLRGFLHGLTHDLDAGRCHHTDTPQPVPVPYVAADDPE

SEQ ID NO: 47568 - protein, 50 aa, Sorghum bicolor
  unsure (1)..(50): unsure at all Xaa locations
  Clone ID: LIB3476-007-P1-K1-A3.pep
PRVRAHLPYPPPAXAVEGEDHLSVRRDGRRGPTRPRDAPPGGAPATGAGR

SEQ ID NO: 47569 - protein, 82 aa, Sorghum bicolor
  Clone ID: LIB3476-007-P1-K1-B5.pep
RSTTRPVATFAVVGFAAGLAGTAISNGLIAMRKRVDPAFETPNKAPPTLLNAATWALHMGVSSNLRYQTLNGVEYLLGKVAP

SEQ ID NO: 47570 - protein, 75 aa, Sorghum bicolor
  Clone ID: LIB3476-007-P1-K1-C4.pep
ELMQHNKVIDVVAEICVHLLVVVGITCQKKTRIRGLASSAAMTKVNTPETITVLQKIIHKRNKYSHVKPRHVCII

SEQ ID NO: 47571 - protein, 44 aa, Sorghum bicolor
  Clone ID: LIB3476-007-P1-K1-D5.pep
SRRSMPHPTRSLRSYRSTESDGSRGQSSIGRLAAAPDAWATRSR

SEQ ID NO: 47572 - protein, 57 aa, Sorghum bicolor
  Clone ID: LIB3476-008-P1-K1-B7.pep
MGARIFGLETPLMVALQHLLDVHDGDACAAGGDKAGAGAGGGDTRTYVRDARAMADT

SEQ ID NO: 47573 - protein, 54 aa, Sorghum bicolor
  Clone ID: LIB3476-008-P1-K1-C3.pep
GLGLVTFSATMLTEWVAFILAGDDLRARSHGLLPNLLLLRSSAVGDLILWRTAV

SEQ ID NO: 47574 - protein, 97 aa, Sorghum bicolor
  Clone ID: LIB3476-008-P1-K1-D3.pep
TLKKIWTLICSWIGCAGDIVKYLFRQYGQGKSPSPGLLESTIFTGWVPTLLRAGRGMTLWNKAGAVPAKKLELFSYENNSYARIVREAFCELELPYV

SEQ ID NO: 47575 - protein, 74 aa, Sorghum bicolor
  unsure (1)..(74): unsure at all Xaa locations
  Clone ID: LIB3476-008-P1-K1-D4.pep
SGEGGFGSXVYKGCLADGREVAVNKLKDAGGQGDLEYHAEADIISRVHHRHLVSLVGCRYSHDQRLLGYDIVPN

SEQ ID NO: 47576 - protein, 120 aa, Sorghum bicolor
  unsure (1)..(120): unsure at all Xaa locations
  Clone ID: LIB3476-008-P1-K1-F4.pep
RVRIIFVDEVDSFLGKPERPGEHEAMSEFKNEFXINWDGLHTKEQEHVTVLGATNRPFDLGEAVIRRFPCRLMVSIPDALSIEKILKVILSKEMLAPDVDLIXVASMAGGYIWTDLKNLS

SEQ ID NO: 47577 - protein, 70 aa, Sorghum bicolor
  unsure (1)..(70): unsure at all Xaa locations
  Clone ID: LIB3476-008-P1-K1-F6.pep
VXGALGRLLVPRRRVRGAFGWLGFWARRRARWWRLSGGRVALALACQSSLPVSALHEDGPRKPTQVETPS

SEQ ID NO: 47578 - protein, 65 aa, Sorghum bicolor
  Clone ID: LIB3476-008-P1-K1-H12.pep
SYTSQLLHPAAEHPTRVPDGRQTHLRKPGDQTREQQYRERESTVARETETVHYSALRGSLAHTYM

SEQ ID NO: 47579 - protein, 123 aa, Sorghum bicolor
  unsure (1)..(123): unsure at all Xaa locations
  Clone ID: LIB3476-008-P1-K1-H2.pep
EYYCHVSQIALQDSKGNEDVRVFVKADGRVFLIGTLSVDKYPQYTTSLVFXKEFELLHTSKTSTISALGYKFRHCNRKYDSETSTEEGDESNEEVPQAIPLYPNADDDKSIESKCGVENPAAT

SEQ ID NO: 47580 - protein, 131 aa, Sorghum bicolor
  unsure (1)..(131): unsure at all Xaa locations
  Clone ID: LIB3476-008-P1-K1-H3.pep
MESASVALASPASDDRRFWDRLRTRVDTILEDRRDLPAAAAPTRVVESERXKRLREDSLMLVRGLDSVVASLAQLSDTLTXAQKGVSALATCSSQARGCEGGACPEEVEEEEPKAKRMCGGSTEDSPRNSN

SEQ ID NO: 47581 - protein, 60 aa, Sorghum bicolor
  Clone ID: LIB3476-008-P1-K1-H9.pep
KRGSVRGDKPSYQDVKLPSPPAGLVRSLPALPPTTNLGGRIWGLSLILAQAAEWEGPERY

SEQ ID NO: 47582 - protein, 82 aa, Sorghum bicolor
  Clone ID: LIB3476-009-P1-K1-B6.pep
FLYCVDWLTCALRSLVHQVLDGTVLPDPLQLLRPLCTSIRPATLLQAQIQHHGGQAHLSAATPRSEARACTCPTPTTTAPTT

SEQ ID NO: 47583 - protein, 74 aa, Sorghum bicolor
  unsure (1)..(74): unsure at all Xaa locations
  Clone ID: LIB3476-009-P1-K1-E12.pep
AFLGLFPYLSSPEGSACRRLLVDGVAGYDGGVGQLPHAASSLLXLLYIRTTGTAPPESSCVYDELLVPSINYCV

SEQ ID NO: 47584 - protein, 126 aa, Sorghum bicolor
  unsure (1)..(126): unsure at all Xaa locations
  Clone ID: LIB3476-009-P1-K1-G6.pep
MRHEASNLQYSDERSNMSNNVLXIARLGVRSPNGIPGFPYHCSGCGESQRFQKVLQGQEVPRPFRGGCLADGHIRTAGMYQPKWPAPQGCDFPQPAKPVLVLQAYLPSSVLMFTQTGSKITSLEYE

SEQ ID NO: 47585 - protein, 79 aa, Sorghum bicolor
  unsure (1)..(79): unsure at all Xaa locations
  Clone ID: LIB3476-010-P1-K1-F4.pep
CVLSSVPSWXCPVGFVFGCLRXSFVSSRLCSAWFFGSLLSFAFPSCLLPLVLVLCFLPFVLVRLPPRPRWLASLCLLVS

SEQ ID NO: 47586 - protein, 42 aa, Sorghum bicolor
  Clone ID: LIB3476-011-P1-K1-A6.pep
VRKKKKKKKKIAINKQYYLLKTFIKKCPALLKGEAPLECVGP

SEQ ID NO: 47587 - protein, 185 aa, Sorghum bicolor
  Clone ID: LIB3476-011-P1-K1-B10.pep
STVIPGLAVLCDADVALVVFSATGKLSQFASTSMNHIIDKYSTHSKNLGKSHQQSPIDLNVEQSKYTGLNEQLAEATHGLRQMRGENLEGLSVEELHQMERKLEAGLHRVLSTKDQLFTQQISELQQKGTQLEDENRRLKEQMPQVLTPGTMVVAASAENILTEDGQSSESVMTALHSGSSLDND

SEQ ID NO: 47588 - protein, 37 aa, Sorghum bicolor
  Clone ID: LIB3476-012-P1-K1-A6.pep
TRALGVSSSHAALQARSECERHAMTACCTVKSERVTV

SEQ ID NO: 47589 - protein, 81 aa, Sorghum bicolor
  Clone ID: LIB3476-012-P1-K1-E3.pep
LARNTRHSRAMARAPVSLGTCRSRSVGLSRVAAWVAHLLKRSYRWQRHNSGVWPAAGRSRSAGTTAAGSLEHVPCGRMFAP

SEQ ID NO: 47590 - protein, 68 aa, Sorghum bicolor
  Clone ID: LIB3476-012-P1-K1-G7.pep
VCSACGTSNLHLAPYSIILYGYGLLVIESELLPNSAHSDGKFHAAEFINLVIYCFSSNILTLNYDYYK

SEQ ID NO: 47591 - protein, 87 aa, Sorghum bicolor
  Clone ID: LIB3476-012-P1-K1-H6.pep
FSQEDPHVPLQARCGGAPCNYAGYVNGTIATSLSSGLQPMCPGPHQFPPLTAVPTVANHGSYSPSPAPGPGDAGGAIPGGSGVSPSN

SEQ ID NO: 47592 - protein, 51 aa, Sorghum bicolor
  Clone ID: LIB3476-013-P1-K1-C11.pep
MAILYALVARGTVVLAEHSAAATNAVAIARQVLERLPDGGADSFVFYTHDR

SEQ ID NO: 47593 - protein, 56 aa, Sorghum bicolor
  Clone ID: LIB3476-013-P1-K1-C4.pep
LSDQNHIERVIQGHEQLLMRLVAVNILCSDPEKCSDPEKLLDECADPNIVFCIYES

SEQ ID NO: 47594 - protein, 94 aa, Sorghum bicolor
  unsure (1)..(94): unsure at all Xaa locations
  Clone ID: LIB3476-013-P1-K1-D2.pep
FSDPKKALRILYRQFDHAXHSTSIHQFLHITISFTTLHCCYHKHRSCAETVQKYVLTSYISHLEAIDQKFKIQDGASANQLMTAIAVAVSKLAQ

SEQ ID NO: 47595 - protein, 139 aa, Sorghum bicolor
  Clone ID: LIB3476-013-P1-K1-E11.pep
SGSRSPTSVYMQNDMKALTNTAILLSTDLNKRKGCPYLDSNENIGSPSDCTIIENPKMAHQASMKKRKHSKEVECSVVQTDTQHIQTHNKSSQVHVLQEDDEFWAFEVMKVMPMSNEEMTELLLLCDYVMAIQDEAILK

SEQ ID NO: 47596 - protein, 136 aa, Sorghum bicolor
  unsure (1)..(136): unsure at all Xaa locations
  Clone ID: LIB3476-013-P1-K1-H8.pep
PEXIGTARITIEKLRQREHFMVAEIELLKAENSNYKTIILNLEADVKNLTRQQNLQLRINHHVKTKEENILLKRQNEELSAKLKQLGGILTRTKEELARYKVSDGKDPHEQIEEEELLRKKLDESEQDRSQLVENL

SEQ ID NO: 47597 - protein, 131 aa, Sorghum bicolor
  Clone ID: LIB3476-014-P1-K1-A8.pep
CDPRMRAVLGRVRLLLLLANSTVFKATPLPPRSSGFASPTPAPPSATWGMAPASSNSPPPPPPPPSSSLVTTAAAALALLDSSNQGRICRGRKRRTGRLEVGYRGREKEAAHRAQTASDQARQPAGSPQAT

SEQ ID NO: 47598 - protein, 57 aa, Sorghum bicolor
  Clone ID: LIB3476-014-P1-K1-F11.pep
DEFTQKYSSIAPSFASTFSGSGSGLIYSSIIHISPSITPYTLYILNLCLTEHEPDDL

SEQ ID NO: 47599 - protein, 57 aa, Sorghum bicolor
  Clone ID: LIB3476-014-P1-K1-H2.pep
VRKKKKKKKKKKKKKKKKKKKKKIKKKAGLSRGSELTYTCLLTSNLLYNVKLKAPPF

SEQ ID NO: 47600 - protein, 57 aa, Sorghum bicolor
  Clone ID: LIB3476-015-P1-K1-A2.pep
FQKNITMCMLANTVSCCCLYHVQTRPHHPWHDDITYLHQCKPEWSSLLMAKSTWRAW

SEQ ID NO: 47601 - protein, 57 aa, Sorghum bicolor
  Clone ID: LIB3476-015-P1-K1-B2.pep
SVLAGGLVEHHTLIHYLYAHRASYIGSAVVSMYVVDAPRSTLDTIFPRTQCVRLGLP

SEQ ID NO: 47602 - protein, 82 aa, Sorghum bicolor
  Clone ID: LIB3476-015-P1-K1-G12.pep
SQGWRTSMGISGTRAASPSVWWWCGCAWWTSYRTVSTSKVIAGGIGKKTVRDMWMSSVAIRFAGGLGLRGLIGLVRARSVRG

SEQ ID NO: 47603 - protein, 86 aa, Sorghum bicolor
  Clone ID: LIB3476-015-P1-K1-G3.pep
GCRKREGSLLTFSPACTFHYCILLLMVVQMSAILRVCSFLGLKPFVSPEWPETVPDLESFDILYLVGNIPDRSRLGMVNRTGPKME

SEQ ID NO: 47604 - protein, 87 aa, Sorghum bicolor
  unsure (1)..(87): unsure at all Xaa locations
  Clone ID: LIB3476-015-P1-K1-G6.pep
LAPSSPRSTVPSCMGSGGEGSDGGAASFREAHDFSNVASFSELPFLRSAPARESSNNSGIRIFGNDVPHSPPERKAKEATXTTPATT

SEQ ID NO: 47605 - protein, 73 aa, Sorghum bicolor
  Clone ID: LIB3476-017-P1-K1-E8.pep
QPEQCFSLTTNQHQHWQWPFFQPAEQGLHLAIRFYRGLEQHSGPTEDFKLQCFQPTQNQNAKSCLQFGLSTLS

SEQ ID NO: 47606 - protein, 87 aa, Sorghum bicolor
  Clone ID: LIB3476-018-P1-K1-E3.pep
PLKIAGSVAWGCNAIVRLGEAQDTTLTVVPRLDYEKELAALSDPVTSESFSEIEEITRTVVPGIHSEKALLAYLTTSLQIVVVMLMP

SEQ ID NO: 47607 - protein, 115 aa, Sorghum bicolor
  unsure (1)..(115): unsure at all Xaa locations
  Clone ID: LIB3476-019-P1-K1-G10.pep
RTRGGGTSVGGQDSCVTGAAPGRGARSKRSRATAAAAAAWHSLVPRPPSQSSPSSSCSSSDFPSSNKPGGARGGNCSRGKKSPASPGGCPAGVEVDLEGGIRQCTHCAXEKTPDW

SEQ ID NO: 47608 - protein, 40 aa, Sorghum bicolor
  Clone ID: LIB3476-020-P1-K1-E4.pep
GLWLSPGVLITQSMFVHNGFICISNEYAWGSSIKRTRGDR

SEQ ID NO: 47609 - protein, 87 aa, Sorghum bicolor
  unsure (1)..(87): unsure at all Xaa locations
  Clone ID: LIB3476-022-P1-K1-B2.pep
EXXFAAPLMASGTRCVPXRGGGAGHAPGHGAPRRRRHHAARLDGASWIDCAGLLTLELRGAAHGIAPIFVRDGNASICSRVGNGTVT

SEQ ID NO: 47610 - protein, 72 aa, Sorghum bicolor
  unsure (1)..(72): unsure at all Xaa locations
  Clone ID: LIB3476-022-P1-K1-D4.pep
LEFRGGTTMAALLARYTFVSEDTFPYHSIXXTVVSSMHGHLRTYMNAVIPKLFKEDEEKEQLAKDVSKDWNA

SEQ ID NO: 47611 - protein, 99 aa, Sorghum bicolor
  Clone ID: LIB3476-022-P1-K1-F4.pep
IPGRPRVREAHLASTRYLAADKLTLADANNPSYLFYLTKTPRVGLVTNRPNVKACGRGFASPPRFKRTVAAFQFQRRPSSVGVDLPLVRRRQRPLPSGL

SEQ ID NO: 47612 - protein, 45 aa, Sorghum bicolor
  Clone ID: LIB3476-025-P1-K1-A10.pep
RRARASQLDAGALGHRLRGGSRGVVWCGSRREVELGVDEPRAARW

SEQ ID NO: 47613 - protein, 46 aa, Sorghum bicolor
  Clone ID: LIB3476-025-P1-K1-A2.pep
KSLTLHVYMNFLGCTLPHTVTRLDKLKLVDLTCVPDFLGPFKHINS

SEQ ID NO: 47614 - protein, 36 aa, Sorghum bicolor
  Clone ID: LIB3476-025-P1-K1-C2.pep
SVRNPVATRPQRESCTVNTYARSCRWRSHVDSHGMA

SEQ ID NO: 47615 - protein, 73 aa, Sorghum bicolor
  Clone ID: LIB3476-025-P1-K1-G5.pep
QAPLTAQAKSYSRRSLRRSAHKTPVCNPTARLLRNMTASVAGRGPSARAASTARGGTVLDSDHFTRLVAPAYV

SEQ ID NO: 47616 - protein, 37 aa, Sorghum bicolor
  Clone ID: LIB3476-027-P1-K1-A9.pep
DRRTAAYKATEIFVIGVCLLCYYMSAHMAEWLTLSCY

SEQ ID NO: 47617 - protein, 158 aa, Sorghum bicolor
  Clone ID: LIB3476-027-P1-K1-D3.pep
LDHKQEEQLFEDISNVLLELSQLHDSQGHAQNEVNEVKQSCLHSSNDVDFARKYNELATKLQGMCKSIRVALTNHVHREELELWPLFDKHFSVEEQDKLVGRIIGSTGAEVLQSMLPWVTSALTQEEQNKMLDTWKQATKNTMFGEWLNEWWKGAGTT

SEQ ID NO: 47618 - protein, 70 aa, Sorghum bicolor
  unsure (1)..(70): unsure at all Xaa locations
  Clone ID: LIB3476-027-P1-K1-D5.pep
MSTPSGNGNGGGAYYYLYDLYGPNAKPDVIFKEAALNTTLNLXDIXGLVTWVIGDGMLPSWVFVKVLCPF

SEQ ID NO: 47619 - protein, 90 aa, Sorghum bicolor
  Clone ID: LIB3476-028-P1-K1-B1.pep
HPTYESADSLASASSSLLLSIKIFHRKKAKALHHIFGGRAEAYYMIDCAHVHLCTLITSYLNIASRVSVFQSHGMKLVVVSDEDLAHNDH

SEQ ID NO: 47620 - protein, 71 aa, Sorghum bicolor
  unsure (1)..(71): unsure at all Xaa locations
  Clone ID: LIB3476-031-P1-K1-A7.pep
TRHAVYGSSDKVVQHNSMSXVSSPGRVRLNHAMNLSTGYSILELNRPLVGFSSIFLFTLMTRQKGGRQGSL

SEQ ID NO: 47621 - protein, 59 aa, Sorghum bicolor
  unsure (1)..(59): unsure at all Xaa locations
  Clone ID: LIB3476-031-P1-K1-B6.pep
ADIXNHWXAMLQQVKKSGARVNFKREHDKKGCCLGLTSLIALPADKIPAESLDRIFKAT

SEQ ID NO: 47622 - protein, 104 aa, Sorghum bicolor
  Clone ID: LIB3476-031-P1-K1-H11.pep
IGYACRPLFIPPSLVFCICCPYLLECDSILLILGLAKCCLISLVSYASKLPRKPWNTSSLSVSSCKLDVSVIILVLTTGLNLLSLWNISNHKFGVLSTWKLSYY

SEQ ID NO: 47623 - protein, 33 aa, Sorghum bicolor
  Clone ID: LIB3476-031-P1-K1-H4.pep
IGRWVSIPRIVEVLQLLHDVGLNLMTLVQVASR

SEQ ID NO: 47624 - protein, 41 aa, Sorghum bicolor
  unsure (1)..(41): unsure at all Xaa locations
  Clone ID: LIB3476-031-P1-K1-H6.pep
NSPLKVIDAGLSDFVXPDGRLNDIVGSAYYVAPEVLHRSYG

SEQ ID NO: 47625 - protein, 131 aa, Sorghum bicolor
  unsure (1)..(131): unsure at all Xaa locations
  Clone ID: LIB3476-032-P1-K1-B12.pep
TQRGRGGLFSVLQDVQHAAVTVLDRCNITIKGRPSKLMVPPKFMNNYFRFACISXDALYIHNFTXKNPEWFYIQFINMVLFARXESYNIISYTFHCFPFFVKLYIDLFKFYIFHVFECILFTLYHVLHVTV

SEQ ID NO: 47626 - protein, 59 aa, Sorghum bicolor
  Clone ID: LIB3476-032-P1-K1-F4.pep
LTHACEPTEFPACDSYPLASSSSPMGSPDRNLKEGRFIQVKGAMYHIDTVCLSPVGPHP

SEQ ID NO: 47627 - protein, 71 aa, Sorghum bicolor
  Clone ID: LIB3476-032-P1-K1-H2.pep
SSRLVSSPPFSSLTRPIPYKGKSVIISPLASPFLIISYTIDSSFLTSPSNSIFPYPPLYAQTFVQPLSLFL

SEQ ID NO: 47628 - protein, 132 aa, Sorghum bicolor
  Clone ID: LIB3476-033-P1-K1-B10.pep
RVHQKREEALAPAFSTAQLKRYISFAKSLKPQLSSEAKKVLVESYVTLRRGDSTPGTRVAYRMTVRQLEALIRLSEAIARSHLERVVLPAHVRLAVKLLKTSIISVESSEVDLSDFQDAEDGTNVPSENDAG

SEQ ID NO: 47629 - protein, 37 aa, Sorghum bicolor
  Clone ID: LIB3476-033-P1-K1-G5.pep
YLCYFDTKNQYTYHGLYYFLTKKPLAPPNLINLHHIP

SEQ ID NO: 47630 - protein, 74 aa, Sorghum bicolor
  unsure (1)..(74): unsure at all Xaa locations
  Clone ID: LIB3476-033-P1-K1-G7.pep
LQRRERRWGGSXLSGKTVTPSPFTKKAPTAALKIREKDGNCALHAVCELESMKNGNAHTNKSRVQRYIPQHQES

SEQ ID NO: 47631 - protein, 56 aa, Sorghum bicolor
  unsure (1)..(56): unsure at all Xaa locations
  Clone ID: LIB3476-034-P1-K1-A2.pep
QQESKPFPLXGPRSPSHTTGPRRNQHEQLPPGSIRARPERRNAPRRDPRPWXSDAA

SEQ ID NO: 47632 - protein, 66 aa, Sorghum bicolor
  Clone ID: LIB3476-034-P1-K1-A3.pep
PPTRPRKILERSGLGEDTYLPPAVLRVPPNPCMDEARKEARAVMFGAIDQLLEKTGVRPKDIGVLG

SEQ ID NO: 47633 - protein, 106 aa, Sorghum bicolor
  Clone ID: LIB3476-034-P1-K1-A5.pep
VAPLHGKVALVLVEAPDLPEELLRVLPGLRLGFPFMGRPSRRGHSRVSVALRPGPLLDPSQGYDSASTSAEGTEIRLHSPACDGRDHRGCGANSRHEFYADAGPTR

SEQ ID NO: 47634 - protein, 88 aa, Sorghum bicolor
  unsure (1)..(88): unsure at all Xaa locations
  Clone ID: LIB3476-034-P1-K1-B4.pep
MVHQGYELREAWWFDSHNXTRPSTWLNNTLSELDDKTKQMLKLIDQNADFFDQSAEMYYKKRPALVDMLGDLYRTHRYLAEHYDLLKH

SEQ ID NO: 47635 - protein, 108 aa, Sorghum bicolor
  unsure (1)..(108): unsure at all Xaa locations
  Clone ID: LIB3476-034-P1-K1-B6.pep
VDPRPLNFIXPDIFSSHQEFESWFDFSGKGNGEKDEETDENKRLHVVSKLHAXLRPFLLRRMKEDVEQLLPRKKEIIIYANMTEHQKQIQHHLVEKTFDNYLNEESDI

SEQ ID NO: 47636 - protein, 132 aa, Sorghum bicolor
  unsure (1)..(132): unsure at all Xaa locations
  Clone ID: LIB3476-034-P1-K1-C3.pep
VKPLTKELVDYLEVSDQDFKEDLTAKICSIVEKFSMDKLWYLDQMFRVLSLAGNYIKDDVWHALIVLMSNASELXGYSVRSLYKALQASGEQESLVRVAVWCIGEYGEMLVNNLSMLDMEEPITVTESDAVD

SEQ ID NO: 47637 - protein, 88 aa, Sorghum bicolor
  Clone ID: LIB3476-034-P1-K1-C4.pep
MAMLLRRVWGSVLARAAAPGADPPPGSPRARRAQAQRVEQYQYHGSLSLGALDAVPTDVLAQILRLLGPVDAARFNAVWRAWRGLAFD

SEQ ID NO: 47638 - protein, 149 aa, Sorghum bicolor
  unsure (1)..(149): unsure at all Xaa locations
  Clone ID: LIB3476-034-P1-K1-D2.pep
RSTHVRRRFMGHHIGLATENYLDARGTYSRLDGGNFQFGTDKGSSDSDSHVSRTYLSDYPYQSFGLSVSSDPLQLGEKLSPYGGATKTIPNIHQKEHHSFHASYSSHSLTGSRNPCFATSERSFGSPSLLATSHLGIQXHHLLTSDIEN

SEQ ID NO: 47639 - protein, 116 aa, Sorghum bicolor
  unsure (1)..(116): unsure at all Xaa locations
  Clone ID: LIB3476-034-P1-K1-E5.pep
RAPHPPGVSDHDVIKQEDDCNACRICRMLRTETLFHCSKCGCCSAIGLQNSYAXFEALMLYDCSIXFYLIQEYNDCFFFFGYTXNVNXIKNEEHCSLMPPCSKSGCDMSKVWERLD

SEQ ID NO: 47640 - protein, 87 aa, Sorghum bicolor
  unsure (1)..(87): unsure at all Xaa locations
  Clone ID: LIB3476-034-P1-K1-F5.pep
PRHASIGQRAESXGFRALVLTVDRPVLGRREADIRNKMISPRFVNLEGLMSLDKDIHSAEGGSKLERFSRKTLDPSLSWKDVEWLKF

SEQ ID NO: 47641 - protein, 71 aa, Sorghum bicolor
  Clone ID: LIB3476-034-P1-K1-G1.pep
SVPVTTLSFAFVCYSLTAIATWKTKANTGVSMSIKKMHCSSHSFHYLAHVLKTTSSRRVPSRALSVHNAEL

SEQ ID NO: 47642 - protein, 95 aa, Sorghum bicolor
  unsure (1)..(95): unsure at all Xaa locations
  Clone ID: LIB3476-034-P1-K1-G12.pep
TFFKRKIIFYMTYMCEKIGYWRCITIFMDIKANPQXVGVPYFQILXNWCLHENKNGDYFSALLKDEPQLLNDWKDALLSPLFCLSXNETMFLNDC

SEQ ID NO: 47643 - protein, 35 aa, Sorghum bicolor
  Clone ID: LIB3476-034-P1-K1-G4.pep
IALESSCRPVTIVLPTATSSIWIPQPAHVEAHDLE

SEQ ID NO: 47644 - protein, 143 aa, Sorghum bicolor
  unsure (1)..(143): unsure at all Xaa locations
  Clone ID: LIB3476-034-P1-K1-G5.pep
STRVREDRLQHANGAVVLATIKVFLHLTMSMTDVHQQVYERIRAPLLTLVGAGSPEQSYFXLCHLHLRGSRAPRXFSSAYKSFYCQLRDPSYVKKLKLEMLTVIANEGTTYEMVTELCEYAGNVDVPIAGESIRPVGKIALQQ

SEQ ID NO: 47645 - protein, 206 aa, Sorghum bicolor
  Clone ID: LIB3476-034-P1-K1-H3.pep
RSTHVRRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGILPDQQRLIYAGKQLEDGRTLADYNISEESTLYLVLRLRGGLQIFGKTLTGMTY

SEQ ID NO: 47646 - protein, 148 aa, Sorghum bicolor
  Clone ID: LIB3476-034-P1-K1-H5.pep
NVQTYLQSASVRIEEMRVKRRDTEQWMAHRLLPENLKDRIMHHEQYRWQETRGVDEEGLLKNLPKDLRREIKRHLCLSLLMKVPMFENMDEQLLDAMCDRLKPMLYTDGSCIIREGDPVNEMLFIMRGTLKSTTTHGGQTGFFNSNVL

SEQ ID NO: 47647 - protein, 102 aa, Sorghum bicolor
  unsure (1)..(102): unsure at all Xaa locations
  Clone ID: LIB3476-035-P1-K1-G3.pep
MPPHNIETGHQDVVHDVAMDYYGKRIATASSDNTIKIVGVSGTSHQQLATLSGHQGPVWQVVWAHPKFGSMLASCGYDGCXIIWKEGGRPDEWXQAHTSPST

SEQ ID NO: 47648 - protein, 96 aa, Sorghum bicolor
  Clone ID: LIB3476-035-P1-K1-H6.pep
SVTTTSTHYKVSFFFRSPQGTAAALPLVAEAAVVWLNNLSAVLKEERLTDGHGAAREGDLEARQQRVLHIRRPRRGACGRTYGVGGRSTAGSPRRV

SEQ ID NO: 47649 - protein, 98 aa, Sorghum bicolor
  Clone ID: LIB3476-036-P1-K1-B3.pep
GRPRVRSNHTIYNAALGKKKIHIVEYGIQYGFQWPCCLRWIADREGGPPEVRITGIDLPQPGFRPTQRIEETGRRLSKYAQQFGVPFKYQAIAASKME

SEQ ID NO: 47650 - protein, 60 aa, Sorghum bicolor
  unsure (1)..(60): unsure at all Xaa locations
  Clone ID: LIB3476-036-P1-K1-B7.pep
PGCQALASRSAAREGRSVRRTALEQSTTAATRRKTARKVXVVVNAIVLVCVLGSRVCANA

SEQ ID NO: 47651 - protein, 101 aa, Sorghum bicolor
  unsure (1)..(101): unsure at all Xaa locations
  Clone ID: LIB3476-038-P1-K1-A10.pep
MTAKDANPSGPSSEVTAAGGGGCGFGEEQEALVLNAWNAMKGESASFALKFFLRIFEIAPGAKQMFXFLRDDAGGDAPLENHPKLKAHAVTVFIMACEFAT

SEQ ID NO: 47652 - protein, 106 aa, Sorghum bicolor
  unsure (1)..(106): unsure at all Xaa locations
  Clone ID: LIB3476-038-P1-K1-A8.pep
TTRPIGLETARVLALRGVHVVMAVRNVSXPGVEAREAIVAKIPRARIDVLELDLSSIAFVRRFASHFDSLNLPLNILINNAGVMTRNCTRSCDGLELHFVTNHIVV

SEQ ID NO: 47653 - protein, 121 aa, Sorghum bicolor
  Clone ID: LIB3476-038-P1-K1-C3.pep
PGRPRVRCGGHRCRRRCSLPCRRRGPPEAASPLAAAVVAAMPMARAPSMSRSGATSTLARRRNRRLGADALTTTTSSAYTSSILCRRTTSGGGTGRTRCNGRRRCCALCWRWWCWRSPCQS

SEQ ID NO: 47654 - protein, 93 aa, Sorghum bicolor
  Clone ID: LIB3476-038-P1-K1-E12.pep
VLSSVLELSYQLVQYTGCTCPVISFVRNFHESLQIPLHIKTFLSPQVHPLGFTFTSLMACICQTVAVPICPFDKIDIMSISFEPQPMSFIFLS

SEQ ID NO: 47655 - protein, 150 aa, Sorghum bicolor
  unsure (1)..(150): unsure at all Xaa locations
  Clone ID: LIB3476-039-P1-K1-C1.pep
AREKAQAHIKELEEEVKLLKNLSHPNIVRYLGTVREEDTLNILLEFVPGGSIQSLLGKLGSFPEPVIKKYTKQILQGLEYLHSNAIIHRDIKGANILVDNKGSIKLADFGASKQVAKVATVTAAKTMKGTPFWMAPXVIGGSGHSFSAIY

SEQ ID NO: 47656 - protein, 137 aa, Sorghum bicolor
  unsure (1)..(137): unsure at all Xaa locations
  Clone ID: LIB3476-039-P1-K1-C6.pep
RVRHASAHASGPGKLKFVFEGKEEQVELEVFKCTGAGGVALSMYNTDESIHACAEAPMATAYEKKWPLYLSTKNTILKKYDGXFKDILQEVDEAGWKTKFEAAGIWYEHRLIDDMGAYALKSEGGSVWACKNYDGDV

SEQ ID NO: 47657 - protein, 48 aa, Sorghum bicolor
  Clone ID: LIB3476-039-P1-K1-H6.pep
AVWLCQCGGKIWCVRVPVGLTTGNEERDTARPPTFAFRRWRDQELGSA

SEQ ID NO: 47658 - protein, 63 aa, Sorghum bicolor
  unsure (1)..(63): unsure at all Xaa locations
  Clone ID: LIB3476-039-P1-K1-H9.pep
THASDDMTXPHXNALSDPSDAXVLLVXEAHARGGEESHHFHHPGSYLIRTLHNNHXLLEKRGA

SEQ ID NO: 47659 - protein, 43 aa, Sorghum bicolor
  Clone ID: LIB3476-040-P1-K1-A7.pep
IQSGYRWRNSWPRCQDIMSRALRMLRHIPWKVQCAMVPGTDAC

SEQ ID NO: 47660 - protein, 52 aa, Sorghum bicolor
  unsure (1)..(52): unsure at all Xaa locations
  Clone ID: LIB3476-040-P1-K1-D9.pep
TLFPPXSQSLMPLHTPTQHSSLWPVWPSFLAYSPPTIIFNISRNVNGSILSV

SEQ ID NO: 47661 - protein, 68 aa, Sorghum bicolor
  Clone ID: LIB3476-041-P1-K1-A8.pep
RLPFTGLVGLIDITQDALTRRSRTTMRGCHRLFLVRVQAEPLRCVGVVLQARQRTHARLILTYCPPRA

SEQ ID NO: 47662 - protein, 70 aa, Sorghum bicolor
  Clone ID: LIB3476-042-P1-K1-C10.pep
IKHTPISRDNLIQINIFGDSCPNKTLHRHLYYIIQHKNPDMIFEYQDKKLYNSKIVQALQNLASAYEVLD

SEQ ID NO: 47663 - protein, 44 aa, Sorghum bicolor
  unsure (1)..(44): unsure at all Xaa locations
  Clone ID: LIB3476-043-P1-K1-C3.pep
GAMVARGDLGAELPIEEVPLLXEEIMRMCXSMGKAVIVATNMLE

SEQ ID NO: 47664 - protein, 51 aa, Sorghum bicolor
  Clone ID: LIB3476-043-P1-K1-C8.pep
RHQDVRRRGKPEPGCSGGGVAAAVVVEGSGGRAKVRRRRRRARVVDRKSTV

SEQ ID NO: 47665 - protein, 56 aa, Sorghum bicolor
  Clone ID: LIB3476-043-P1-K1-G8.pep
GLLPFSCGVWRSPAGPAESAPVVHCYAVPEDTQSAFFTLGKRNSNLFFSPLLVFFL

SEQ ID NO: 47666 - protein, 55 aa, Sorghum bicolor
  Clone ID: LIB3476-044-P1-K1-E6.pep
AHTLLSSSGVVASGRTEHGLSRAEHPHTARIDTRTRTPTQMTLLKTQEGLCLRIT

SEQ ID NO: 47667 - protein, 58 aa, Sorghum bicolor
  unsure (1)..(58): unsure at all Xaa locations
  Clone ID: LIB3476-044-P1-K1-H6.pep
RVRNTVYYSSRFPISALPDGEHEHLHRRHDCSERGTLCDCEIEYANLSSSXXVLARDD

SEQ ID NO: 47668 - protein, 88 aa, Sorghum bicolor
  unsure (1)..(88): unsure at all Xaa locations
  Clone ID: LIB3476-045-P1-K1-A5.pep
YSRLFRAQSHRQELIYDLYQTCYDPGMNTVTCDMITXLLISLMKATAHNPFRIIFYMYCVSVRQFYQILLYELDAIHYVCSFPLTNLP

SEQ ID NO: 47669 - protein, 62 aa, Sorghum bicolor
  Clone ID: LIB3476-045-P1-K1-A7.pep
KIEKRMERRECQDIICKCKSFMCKRGVERELRNLVYGKEWKKTRMWGVNECKEMDRRRTLKD

SEQ ID NO: 47670 - protein, 62 aa, Sorghum bicolor
  Clone ID: LIB3476-045-P1-K1-C4.pep
IYEYIILATHQKQKLVQHDSRIDLPALQRYKAVICWSERAMDIYWDGQTSPLMSVELLRLTG

SEQ ID NO: 47671 - protein, 137 aa, Sorghum bicolor
  unsure (1)..(137): unsure at all Xaa locations
  Clone ID: LIB3476-045-P1-K1-D11.pep
VLRYLTFTLKCVLLRHRLCYESCRRSWRXIVRRSSYFQPLSWNLRMKXALGAAKGLAYLHSDEAKVIYRDFKTSNVLLDANFNAKLSDFGLAKDGPTGDKSHVSTRVMGTHGYAAPEYLATSHLTTKXSDVYSFWSS

SEQ ID NO: 47672 - protein, 71 aa, Sorghum bicolor
  Clone ID: LIB3476-046-P1-K1-C10.pep
HTQQPLAPTLGMSVSHVPISSTHSFASGARARAMHTPEDRARWLQVGSRRVSGAPYHPGAGPARRQRGFLT

SEQ ID NO: 47673 - protein, 34 aa, Sorghum bicolor
  Clone ID: LIB3476-046-P1-K1-D3.pep
ITHFGSTLNNDTSRRVAALTGHCANTYTRSYTCQ

SEQ ID NO: 47674 - protein, 64 aa, Sorghum bicolor
  unsure (1)..(64): unsure at all Xaa locations
  Clone ID: LIB3476-046-P1-K1-E7.pep
YPXIKCAQSFPGQPLRVQVVPVLTTPQLIQELEERLLRVFTGQVRLAHQVLQKVVTRYLRRAIS

SEQ ID NO: 47675 - protein, 46 aa, Sorghum bicolor
  unsure (1)..(46): unsure at all Xaa locations
  Clone ID: LIB3476-046-P1-K1-G4.pep
ASSVRXNREXSWPRQRSRQQQARPRRGTKQDRALEPETDGGDGIDG

SEQ ID NO: 47676 - protein, 39 aa, Sorghum bicolor
  Clone ID: LIB3476-047-P1-K1-A1.pep
LKRIRRILRRISICIKELQIRHFKTKRHIGTYVIPVFLN

SEQ ID NO: 47677 - protein, 79 aa, Sorghum bicolor
  unsure (1)..(79): unsure at all Xaa locations
  Clone ID: LIB3476-047-P1-K1-A7.pep
TTHAFVHACGWTHPTHLPPTPITPSRRPASFLSTXRAVAPRPLARPCHHLRRQRPRVGCPISACATAGRPLQRPTGTGQ

SEQ ID NO: 47678 - protein, 62 aa, Sorghum bicolor
  Clone ID: LIB3476-047-P1-K1-F4.pep
RPPTRPKKKKKKKKKKKNKKKSNIKKIKNGQGVWKIHAYLHVLTKIIFFLLFKPKFNCLADS

SEQ ID NO: 47679 - protein, 70 aa, Sorghum bicolor
  Clone ID: LIB3476-047-P1-K1-H11.pep
HAYRRGLRSTWPWRPPPSPRAPPPSTSPCDLAPSPPASYPSVPRPETRCATCGSPPQVTATGERPRAHGR

SEQ ID NO: 47680 - protein, 107 aa, Sorghum bicolor
  Clone ID: LIB3476-048-P1-K1-B4.pep
PGRPRVRPRVRPRVRTDICDFLENPQINREMMELIETLQRKAVEEGKVASDDAEECGDGDSEENDGALVKGEEDDSGLNEEEQDSADADANADGSVKNVVKSRRRKR

SEQ ID NO: 47681 - protein, 57 aa, Sorghum bicolor
  Clone ID: LIB3476-048-P1-K1-B9.pep
TAVVCTLPRGRKYPGHHHTPMWVNTVICNPPCGRSGSQPSIDPTPFTDGPTTGGVRQ

SEQ ID NO: 47682 - protein, 92 aa, Sorghum bicolor
  unsure (1)..(92): unsure at all Xaa locations
  Clone ID: LIB3476-048-P1-K1-D6.pep
RLPLPRSPQPRRSVLLPSPVQEPCLLPVMGMEHFMSSAXPSAGFALYGNEATEEMKRLQGLRAETLMETYQSTRKQRCSDQVSNTMQKQQAV

SEQ ID NO: 47683 - protein, 66 aa, Sorghum bicolor
  Clone ID: LIB3476-048-P1-K1-G7.pep
LSKGHYKHLKLIFTAPLFVTCRASRAPHSCCCLQDAPCFHRRPPCSANINQSLLITLLMSHVIENI

SEQ ID NO: 47684 - protein, 44 aa, Sorghum bicolor
  unsure (1)..(44): unsure at all Xaa locations
  Clone ID: LIB3476-049-P1-K1-A3.pep
DRIGHDLHPADLHRVVLSTAVVDXGATERRERAGTRDARGETRG

SEQ ID NO: 47685 - protein, 37 aa, Sorghum bicolor
  Clone ID: LIB3476-049-P1-K1-B7.pep
CLCQPYGGCGAYGCKVWLVGSEGYDSFMDVYGRMRCA

SEQ ID NO: 47686 - protein, 41 aa, Sorghum bicolor
  unsure (1)..(41): unsure at all Xaa locations
  Clone ID: LIB3476-049-P1-K1-C9.pep
CVATKKYVIDIMDLQAXGLGCDFSWWPPMSPLLDRTRGDRE

SEQ ID NO: 47687 - protein, 59 aa, Sorghum bicolor
  unsure (1)..(59): unsure at all Xaa locations
  Clone ID: LIB3476-049-P1-K1-D11.pep
PSESRSTHRRQEHQPFRISTPDPKFFSSPLMPISLIRGPNIPHLLXHSLSHSPTNLIAR

SEQ ID NO: 47688 - protein, 67 aa, Sorghum bicolor
  unsure (1)..(67): unsure at all Xaa locations
  Clone ID: LIB3476-049-P1-K1-D8.pep
QTTYDNKCTYRRSSNRHISRVAXRCHTLHCGHITPQSAVRHMTTEYVKTSCTCIHRFSIISGVRPLY

SEQ ID NO: 47689 - protein, 66 aa, Sorghum bicolor
  Clone ID: LIB3476-049-P1-K1-E4.pep
VNLNVEARAQRGLVGKAHHCGRRALARVALYLNGQQRRARCGEEGQSTTKNIRPARPPNAWSTGNR

SEQ ID NO: 47690 - protein, 100 aa, Sorghum bicolor
  unsure (1)..(100): unsure at all Xaa locations
  Clone ID: LIB3476-049-P1-K1-G7.pep
ASGHFEPAAARSKISSRRRSQSRTPRLQWRLPPAPARSWTSPCSKLRRCILKALLQQRRRRRLVLAGGGXDLVRADRPKIAGCPVRXNTXCPREVEARVR

SEQ ID NO: 47691 - protein, 39 aa, Sorghum bicolor
  Clone ID: LIB3476-050-P1-K1-A9.pep
HGDLDARGGHYADAPQPVPVPRVDAGDHEHRVPGHLREH

SEQ ID NO: 47692 - protein, 50 aa, Sorghum bicolor
  Clone ID: LIB3476-050-P1-K1-C1.pep
GGSRVQPVRGPGADRGPAQWTHQKRGAGLTTAGVGVSPREGGTLDNTAAR

SEQ ID NO: 47693 - protein, 64 aa, Sorghum bicolor
  Clone ID: LIB3476-050-P1-K1-G2.pep
LRCCIRGHYRKSTETNADYNHLLTSSHLAVIPMMRHLIEKVERASKGSCKARGKQRRSIQTCYL

SEQ ID NO: 47694 - protein, 35 aa, Sorghum bicolor
  Clone ID: LIB3476-050-P1-K1-H11.pep
TRHNGLKRSRSKEVLVDTQADRYNRQTVTHQSIVA

SEQ ID NO: 47695 - protein, 50 aa, Sorghum bicolor
  Clone ID: LIB3476-051-P1-K1-G2.pep
IKRHCPALLKYIKPTNYPHRGTQRAAIEVTLQNRLQIISIGHDNLSHLLC

SEQ ID NO: 47696 - protein, 78 aa, Sorghum bicolor
  unsure (1)..(78): unsure at all Xaa locations
  Clone ID: LIB3476-052-P1-K1-A7.pep
LPLVAGWGGFEPREHGRRDDDGRDSGKGVRVLVTPTSDLVKILACMQACLTPNYASASPLSSIVRALFLGGKAPCVQX

SEQ ID NO: 47697 - protein, 88 aa, Sorghum bicolor
  Clone ID: LIB3476-052-P1-K1-A8.pep
PREGTVQNTFIRKPRLTSSSTGLTKSRGSDITQSRQGERDTTLFFIFIASMTDKEAMVYPFLVKALQNSRHLLTILRMEPIEEIRCST

SEQ ID NO: 47698 - protein, 182 aa, Sorghum bicolor
  Clone ID: LIB3476-052-P1-K1-H5.pep
RPTRTRTFTPGQSGSGTSQSSEGGSDKPAGWRNQSWFYIVVRISLFLWVALLNLITISSTWARVIDVMDSESGSRLFGFIGAGATLGQLFGSLFAASMAWLGPFLLLFSSLLMELAALSSKGICIDDGNYASTELCQTGAGQSPNTVADDEMSSLVTLPRSTTQSQKSKSEFFIMFESFWLI

SEQ ID NO: 47699 - protein, 110 aa, Sorghum bicolor
  unsure (1)..(110): unsure at all Xaa locations
  Clone ID: LIB3476-053-P1-K1-F4.pep
QKSNXMCLNLHESIRFSGSTGSKVTTRISTRNCIRTCADWGFRSDNQNCYYTYNKTQNIRRQDKICFSVAMCSSRSKAFKLKGPEFVIKSLGTSNNMGPSAVVRNGQQRN

SEQ ID NO: 47700 - protein, 52 aa, Sorghum bicolor
  Clone ID: LIB3476-055-P1-K1-G6.pep
PVDHAFATRAMAEADGIIMPRGNLRIDLPPDKDYVQGRFALNKCNMAAKPID

SEQ ID NO: 47701 - protein, 76 aa, Sorghum bicolor
  unsure (1)..(76): unsure at all Xaa locations
  Clone ID: LIB3476-056-P1-K1-C1.pep
VLCTFXXTSPPSRIVCSASQGRDRALSTFSFMFSYSVMVSEAVISDLFNFSLAAASLISNVSIIFLWDEHVPRDRR

SEQ ID NO: 47702 - protein, 88 aa, Sorghum bicolor
  Clone ID: LIB3476-056-P1-K1-E6.pep
QHHEDEDDTPPSDDNNQGGALKLILGREPERDKLRVNLSCRLVCPSQRHLDPSKKNIRSHVYHRGSNCSARPLLTTKGDIHINRLCDE

SEQ ID NO: 47703 - protein, 34 aa, Sorghum bicolor
  Clone ID: LIB3476-057-P1-K1-C5.pep
CIGTRAVATHISCSCCAVTRNWTGTLGSGLALTP

SEQ ID NO: 47704 - protein, 73 aa, Sorghum bicolor
  Clone ID: LIB3476-057-P1-K1-G5.pep
SCSLLIASVIAYRQRYGVTRPSKAKSGEKLYNDSQQMYDTQTRPLSRILKRLAQVVSHERIHMSTYSVEHSAS

SEQ ID NO: 47705 - protein, 55 aa, Sorghum bicolor
  Clone ID: LIB3476-059-P1-K1-F7.pep
LLFFLLFFFSQMVKLTITQLVRFSLFSINALLTPLQKKREETEATSKQWVSRDSS

SEQ ID NO: 47706 - protein, 45 aa, Sorghum bicolor
  unsure (1)..(45): unsure at all Xaa locations
  Clone ID: LIB3476-059-P1-K1-G12.pep
PTRTQTRXVSHAHLRFLLNSVRAQICCAGANCTFVSLLQILRDYT

SEQ ID NO: 47707 - protein, 78 aa, Sorghum bicolor
  Clone ID: LIB3476-059-P1-K1-H5.pep
LTASIHACGLTETHAKSASITSAVVMRDSDGKCRWLGYANRDKAHDAAHADQELNGMIFNDKELHGARAQKKSERETE

SEQ ID NO: 47708 - protein, 88 aa, Sorghum bicolor
  Clone ID: LIB3476-060-P1-K1-C5.pep
GGILIAFDFFSFQKKKGGGFFGVTKFISPGMGKLFFFLGYSKLNSVPVFLTGVFWKNFGFSKLYAFGQYSFFTWGDKKKRCPSFFFFK

SEQ ID NO: 47709 - protein, 98 aa, Sorghum bicolor
  unsure (1)..(98): unsure at all Xaa locations
  Clone ID: LIB3476-060-P1-K1-C8.pep
DVRSRVRATLLVHKDIXTRVEGLDYLLVDLEKDGXTIYGAXVAHDKXIVLKVDSLIHEYSSMACTLKFGADVQANITHINPYRRAHTDCIITTDERVA

SEQ ID NO: 47710 - protein, 75 aa, Sorghum bicolor
  Clone ID: LIB3476-060-P1-K1-D2.pep
FCLKEEKEFQADLQLRSQRLIAPKGKITIQTFQVGRLITLTRAHLSVMSLHITPVNCSLRRRFECKAGPALFWNG

SEQ ID NO: 47711 - protein, 68 aa, Sorghum bicolor
  unsure (1)..(68): unsure at all Xaa locations
  Clone ID: LIB3476-060-P1-K1-F4.pep
VFLQRTVQKSQELAETLATDNSALTDKFNQQAHIISQLTSDMERLXEEIQAQLLALESVRTEYAKCTN

SEQ ID NO: 47712 - protein, 165 aa, Sorghum bicolor
  unsure (1)..(165): unsure at all Xaa locations
  Clone ID: LIB3476-061-P1-K1-E10.pep
IPATTYAYAYAYVTAGAPDPAAAHFFSTEKSPKSAKPKEGMSAVFQEISTKPVPAGLRKVTDDMKTKNRADRSGVVSSSVAAPAAAXEKTSRAXSFSFKSGTPKLELQMGRKWVVENQVGKKXXAXDDCDSRQSVYVYGCKDSVLQVNGKGNNITVDKCTKFGIV

SEQ ID NO: 47713 - protein, 53 aa, Sorghum bicolor
  Clone ID: LIB3478-001-P1-K1-B12.pep
NVTHCLSAGHVCIYSGSRYPHVPGTIVTTSASAVGASMAALNTHPSPYISSEV

SEQ ID NO: 47714 - protein, 45 aa, Sorghum bicolor
  Clone ID: LIB3478-002-P1-K1-E2.pep
PRVVLLVGICVGSLTASTEMKTAECNATEGAYTGSCQRCPNQGAL

SEQ ID NO: 47715 - protein, 59 aa, Sorghum bicolor
  Clone ID: LIB3478-002-P1-K1-G6.pep
LLLFEIASPVKSSENEYLSLPLLYGAKINNLILSGEWWRLLTPMCLVLLLPLLLDKVSQ

SEQ ID NO: 47716 - protein, 100 aa, Sorghum bicolor
  Clone ID: LIB3478-002-P1-K1-H4.pep
LDVLTQELEGAKRQIEALKTEKSQIEAEANNQRNLSVKLESDLKSLSEAYNSIEQANYRLDAEVKTLRQGGSVPYPDVEAIKAQAKEEAEKDSEGELIDL

SEQ ID NO: 47717 - protein, 64 aa, Sorghum bicolor
  unsure (1)..(64): unsure at all Xaa locations
  Clone ID: LIB3478-003-P1-K1-C3.pep
DWPFGSPATYREFPRLRGHRGLSADPETFAKNREPGGIHSRWAMLGALGCVFPELLGRXNGVKF

SEQ ID NO: 47718 - protein, 42 aa, Sorghum bicolor
  Clone ID: LIB3478-003-P1-K1-F1.pep
GRRCGKDNVIGDQGRRAIHKGTGGAGGLQARCGSNQRMWGTV

SEQ ID NO: 47719 - protein, 74 aa, Sorghum bicolor
  unsure (1)..(74): unsure at all Xaa locations
  Clone ID: LIB3478-003-P1-K1-F2.pep
DHASAVTDPTTSRSFGGAQAVAASSLLVQILIHFGASRPFGASSLEQSYLLYNTTTXWGWRTTSSKYSARLIAR

SEQ ID NO: 47720 - protein, 62 aa, Sorghum bicolor
  Clone ID: LIB3478-003-P1-K1-G1.pep
VQIRSRFYTLMHIFSFCKTFLVSPNSLFRASSNCMEIVLQSCKLFPSLRRCHAVFVRRIFIE

SEQ ID NO: 47721 - protein, 66 aa, Sorghum bicolor
  Clone ID: LIB3478-003-P1-K1-G12.pep
TTNPDDMNYTMLITLAFTMFYTGDMPFMHTDTYLVILGTKLDFGSLTDLEYVYLGTVASLITSRYC

SEQ ID NO: 47722 - protein, 54 aa, Sorghum bicolor
  Clone ID: LIB3478-003-P1-K1-H2.pep
RVPVESVSAGDICAVCGMDDIMIVETIADKVTGTPFATIKVEEPTVRMSFCINT

SEQ ID NO: 47723 - protein, 108 aa, Sorghum bicolor
  Clone ID: LIB3478-004-P1-K1-G12.pep
ESFKVTRLRSLVPRASRSLRVSPRSRHREPLCASVAHGPPGSSVACATGPRTSKELPPQCSDKIWLAKVAKSPLLTRSVTACGCQRNWWAMARAPGPDTDAWATGNAV

SEQ ID NO: 47724 - protein, 86 aa, Sorghum bicolor
  Clone ID: LIB3478-004-P1-K1-G9.pep
CCLVNRVPACRAPLLPHAPVRVIAAGRSAVRRRLYATPGELTGLLGSHGILFVLWPSLRSLSRCGVLSFCQLLCFALLWLLLSARF

SEQ ID NO: 47725 - protein, 49 aa, Sorghum bicolor
  Clone ID: LIB3478-005-P1-K1-C1.pep
LGSKDSSHKLQVNCVISFYFCLYLILYACDQRFDVMGYLENFCELNKTL

SEQ ID NO: 47726 - protein, 82 aa, Sorghum bicolor
  Clone ID: LIB3478-005-P1-K1-H5.pep
VARVGGCFSPSTSPRLGRVLGFGRESGARREYRASRARWPPTTDLSSSQLAVCSGIPPETGGPRSVRNLSLSSHADAIENMN

SEQ ID NO: 47727 - protein, 47 aa, Sorghum bicolor
  Clone ID: LIB3478-006-P1-K1-F7.pep
SNHCYQLLFNNMGLAVSRCKDAWMTMTVHLCTIEQVVASSPCRYISR

SEQ ID NO: 47728 - protein, 92 aa, Sorghum bicolor
  Clone ID: LIB3478-009-P1-K1-A3.pep
SGPAEGAEDSRRPRAEDFSSACSSCSTEYTPDDGLGMDCYWIYLLVSWTKISYDSNALGSTAEVLFSDRPLWETVALDNCLMTTYPNHAPFM

SEQ ID NO: 47729 - protein, 58 aa, Sorghum bicolor
  Clone ID: LIB3478-010-P1-K1-D4.pep
LAYQVSCLLSFAGYSLVTAYFILRFYTRLMRFQISPPVQHIHTDPTKQPWAGEQRGGA

SEQ ID NO: 47730 - protein, 48 aa, Sorghum bicolor
  Clone ID: LIB3478-010-P1-K1-G2.pep
MCTASHAYHVCSLPTMLGMFVLSRTNGWSAAVIEERGGVRRTRGRPGI

SEQ ID NO: 47731 - protein, 84 aa, Sorghum bicolor
  unsure (1)..(84): unsure at all Xaa locations
  Clone ID: LIB3478-011-P1-K1-C6.pep
VRHLRSSCRCRNLQLYIDSSNVDDLPGRFITAPAADPNAGEVYYRLMRGHVEQSRXTLDPLLGKLSCPLLLLWGALDPWVGPGQ

SEQ ID NO: 47732 - protein, 97 aa, Sorghum bicolor
  Clone ID: LIB3478-012-P1-K1-F12.pep
ESGISGCLGNPHVRLKKLQPDRRRQRHRLLDLVGVVVQVAVAQHFQHLVLVLPWTGQTSNSCQQRIMVAELELETSYFGDDGEVRRAGPAMERCRQR

SEQ ID NO: 47733 - protein, 63 aa, Sorghum bicolor
  Clone ID: LIB3478-015-P1-K1-B8.pep
KKKKTKYTQHNACEGPDRRREPCARAGEGEVRRADGSFPCRPQFDRRRHGVHGLRRCVPTLFD

SEQ ID NO: 47734 - protein, 73 aa, Sorghum bicolor
  Clone ID: LIB3478-015-P1-K1-E10.pep
ILGPRPALAIWWRWVYWCNPVFWTIYGVTASQFGDLSANVTGTGRSTGTVVVKEFLDQTLCMKHDFLGYVVLA

SEQ ID NO: 47735 - protein, 36 aa, Sorghum bicolor
  Clone ID: LIB3478-015-P1-K1-H10.pep
DPGRPRVRGRVGGGVQLQDVKPNPSLGSSIAVIGED

SEQ ID NO: 47736 - protein, 121 aa, Sorghum bicolor
  unsure (1)..(121): unsure at all Xaa locations
  Clone ID: LIB3478-016-P1-K1-B8.pep
VRGTHSSNDIQSKSLGASTWSGTGIXIRVALGRSRDLSKFTDYGALKAXLDTRCELNGQLISANRRWQIGYTDTEADMTLASDDPRQEFCSIRRKIYIDTSVEGQKMNSRSSAPRKEEPLT

SEQ ID NO: 47737 - protein, 100 aa, Sorghum bicolor
  Clone ID: LIB3478-017-P1-K1-B9.pep
TSQKTRSGTFPPRTALKTDRPPPIAKGRTVLSFTTGPQTPAKEEARRPRDGRPCALDGGATRADGEIMEAAIAACFFAGVGALLIDRPDAWAHAGSTGNR

SEQ ID NO: 47738 - protein, 70 aa, Sorghum bicolor
  unsure (1)..(70): unsure at all Xaa locations
  Clone ID: LIB3478-017-P1-K1-D6.pep
GRVGFEGKKLVSATKEGLKLDESEDEKKKKEELKEKFEGLCKVIXDVLCDKVENVXVSDRVMDSPAASDW

SEQ ID NO: 47739 - protein, 94 aa, Sorghum bicolor
  unsure (1)..(94): unsure at all Xaa locations
  Clone ID: LIB3478-017-P1-K1-E5.pep
SQTHYHLMKHYLTYPLLASMIILRTDRVFCNRDHICNLLMNIMFIHVDMLVHIWSMLISGQDVLSIFCXXTRTWTVSLLLCYIFKHYIYVTCSY

SEQ ID NO: 47740 - protein, 80 aa, Sorghum bicolor
  Clone ID: LIB3478-017-P1-K1-G7.pep
GDEVEEEENEAAASVQAKIKSIHDVLDDPRFLKGEPEDVQLSKEQEEQKKDTVQSVRDALISKKVESREQHHDPLSDDYP

SEQ ID NO: 47741 - protein, 78 aa, Sorghum bicolor
  Clone ID: LIB3478-017-P1-K1-H1.pep
SPRVAQAQARTASATHQDHGGGTPACDSSGGRPSARALSSNGEWSPRRAGCRCGVCVPHTSPSRIMTVLGEQGQQGAE

SEQ ID NO: 47742 - protein, 46 aa, Sorghum bicolor
  Clone ID: LIB3478-017-P1-K1-H5.pep
PTRAVCLFIPWLFLEKPKMDDSISWNFPPFTLFLNCLSTFILNMSV

SEQ ID NO: 47743 - protein, 88 aa, Sorghum bicolor
  Clone ID: LIB3478-018-P1-K1-A7.pep
VLLREPPPPRHLTTSSPEITRGARTRPQSSTPPARPPWGTPPAAWDTSSTLPAPPRTSIRTTAPAVPTFYAPSHHEGRGSFYACSADP

SEQ ID NO: 47744 - protein, 112 aa, Sorghum bicolor
  unsure (1)..(112): unsure at all Xaa locations
  Clone ID: LIB3478-018-P1-K1-G2.pep
THCIKLTWNPSCQHLIIRLGIHLQHLSNNPTFIDERSAKPPIWRXSEMISDERYYEPVQWRMFAHVCTVPVKYDPLWAMRRLASGGYIVSGAQLHVKAHDSTNXLHLRPLYT

SEQ ID NO: 47745 - protein, 68 aa, Sorghum bicolor
  Clone ID: LIB3478-018-P1-K1-H12.pep
HTNDRREHRRTVAEVRAKVALEHEQKELERYLELERIQKQREEALRRKKMEEEEERANKLRLLGKNRG

SEQ ID NO: 47746 - protein, 47 aa, Sorghum bicolor
  unsure (1)..(47): unsure at all Xaa locations
  Clone ID: LIB3478-019-P1-K1-A9.pep
SSCTLYGVVTYXCSLCIMEXGTPSLPASACIMSIPVQFSSFIKRMDV

SEQ ID NO: 47747 - protein, 106 aa, Sorghum bicolor
  unsure (1)..(106): unsure at all Xaa locations
  Clone ID: LIB3478-019-P1-K1-B6.pep
MALVSAFSYSTTDVAALPRNGQQRASYTSLLGGKTLLRQANYAFRPSFAVRTMADPDRHDQLPERTAAFVVKYCLPGDFSFDPXGPRSDPHSMSWTMQELVDHRRS

SEQ ID NO: 47748 - protein, 63 aa, Sorghum bicolor
  Clone ID: LIB3478-019-P1-K1-C6.pep
YPTRSKREDLEKYANESEKKISNSYIFAFFTSLCKYYRLGGNPLQGRSASTIVECFGVEVGRG

SEQ ID NO: 47749 - protein, 62 aa, Sorghum bicolor
  unsure (1)..(62): unsure at all Xaa locations
  Clone ID: LIB3478-019-P1-K1-E5.pep
MRVSFMPCGLTWTRNTAIQIGRASRIGTYEFPQFLMASVPXQAVYMIQLEPAISAFRPSPLT

SEQ ID NO: 47750 - protein, 111 aa, Sorghum bicolor
  Clone ID: LIB3478-019-P1-K1-F5.pep
SACFIFFSLQWAAGFWTFWYPGGSRSGRAFLLPWHVFFGIFIYVLAIATSVTGLLEKSIFMQSAKMIERFSTEAMFMNSLGMLLVLLSGLVILAIVSPGPSKIDTYRGSSE

SEQ ID NO: 47751 - protein, 120 aa, Sorghum bicolor
  Clone ID: LIB3478-019-P1-K1-G1.pep
MVIMAGMLPGVESARRRRVRQSSESGAARRPSLCLYAGGLGSSSSAAAAAASGACGDTTAAMACAWMTTLGSDARDSKERLDHKLRGHRQPVVLKRHQTTSTRPPPAKPQDDATRGAGGS

SEQ ID NO: 47752 - protein, 78 aa, Sorghum bicolor
  unsure (1)..(78): unsure at all Xaa locations
  Clone ID: LIB3478-020-P1-K1-H1.pep
PTRAGGFSSPSSSVRFAFDRFFWGSGSXVSGRDGGVCTSVPLLPQRTLLGHRRQRPSLRLQHLRLGPRVQYHPASGDA

SEQ ID NO: 47753 - protein, 46 aa, Sorghum bicolor
  Clone ID: LIB3478-021-P1-K1-A9.pep
RVHLPGRGRGGGCAHTVVSQEETVDHYRRHEQNSIMLYQLERSLCI

SEQ ID NO: 47754 - protein, 53 aa, Sorghum bicolor
  Clone ID: LIB3478-021-P1-K1-C4.pep
ITLSTTSLFVSTEIFSYKNLRATIRMHNLCQYLSSMIWNCDLIARSFQIIAAT

SEQ ID NO: 47755 - protein, 41 aa, Sorghum bicolor
  Clone ID: LIB3478-021-P1-K1-E10.pep
PGQCTARVLQCHQGVAVGIRSFIGASKYLATLTIPTRPRTR

SEQ ID NO: 47756 - protein, 56 aa, Sorghum bicolor
  Clone ID: LIB3478-021-P1-K1-E4.pep
QLPVPVPVGKEDAVDDLAVPRYDALQPVERCGISRNKQRGRGAREAAWRGMWLQAY

SEQ ID NO: 47757 - protein, 84 aa, Sorghum bicolor
  Clone ID: LIB3478-021-P1-K1-G6.pep
PVDHASGAVRYRTTRCARSQGAELATADAVWTKTLQLYESCSKIPATRTSTALSLWHVASLGVLILGTCELAVDARTEKLLPMT

SEQ ID NO: 47758 - protein, 99 aa, Sorghum bicolor
  Clone ID: LIB3478-022-P1-K1-C11.pep
PSRFPVATRRAYQQLLHHIDLLGGLQARNNKELLSLRANSQLSRMSLEGCGHLAWTRGRTRQIFGTGRRSPCCQSTRRRSTSSEPGTGSLPSRWRHLSA

SEQ ID NO: 47759 - protein, 91 aa, Sorghum bicolor
  unsure (1)..(91): unsure at all Xaa locations
  Clone ID: LIB3478-022-P1-K1-E12.pep
PGGRCYSRGGYVSRWSALWWGSADSAPAPSWAGNSLVYRRGSLVGDPASGWAHXCGCXIVNXRHGWDNPRVCRSGADYPASTVAGPMLAAH

SEQ ID NO: 47760 - protein, 57 aa, Sorghum bicolor
  Clone ID: LIB3478-022-P1-K1-F3.pep
PVDHASVLSSDLGCLLVENKEPCATAIINVQGTAGRMGQSKLTVANVQPHSIYMVPP

SEQ ID NO: 47761 - protein, 49 aa, Sorghum bicolor
  Clone ID: LIB3478-022-P1-K1-G12.pep
LIHIETCVSHLFDVKRLVRHSIQSDLQRTRCHMTSVQVITSERGDTLPG

SEQ ID NO: 47762 - protein, 41 aa, Sorghum bicolor
  Clone ID: LIB3478-023-P1-K1-B10.pep
AVRSEFRSPTRPGGSGVISFAPRTLYLTSKRVGAAGPQPPT

SEQ ID NO: 47763 - protein, 59 aa, Sorghum bicolor
  Clone ID: LIB3478-023-P1-K1-H12.pep
QPKFFFKKQSNTIISSCIERRFLVVSENRSKLGSSSQEIVPVPGIQEQFHPCLTKTSSK

SEQ ID NO: 47764 - protein, 74 aa, Sorghum bicolor
  Clone ID: LIB3478-024-P1-K1-F3.pep
RFRSTTRVFYYYYPKRLGQVLFVDAPFVFQPMWQVLKPLLKSYASLVRFCDANTVRKEYFNEETVPADFCNLIP

SEQ ID NO: 47765 - protein, 46 aa, Sorghum bicolor
  Clone ID: LIB3478-024-P1-K1-G2.pep
RHVPYVCACILDGSVSIHILPFMSTCKRVAIDMSHHLYQLNNTEPN

SEQ ID NO: 47766 - protein, 101 aa, Sorghum bicolor
  unsure (1)..(101): unsure at all Xaa locations
  Clone ID: LIB3478-024-P1-K1-H2.pep
IRSGIRHLKAVQGTRYGRTTLAAPAGDXRFKASATEAAFANGPSLRGLTLTLEKPGAFLVDLKPHNQDVRFQFMNSALVLDKRVSLTYTHSTSFAPGPAPP

SEQ ID NO: 47767 - protein, 49 aa, Sorghum bicolor
  Clone ID: LIB3478-024-P1-K1-H5.pep
QDVILYLHLLMQIKICPARTLLWLLERQNRVRSCICAYIMKNYRTGSVG

SEQ ID NO: 47768 - protein, 104 aa, Sorghum bicolor
  unsure (1)..(104): unsure at all Xaa locations
  Clone ID: LIB3478-026-P1-K1-B4.pep
YYPLYNITTLSSITKLFPSYSRAQYYYAGRDKVNYISTIKXLFLIHVSSYLSFLIHAXTLTNLSFINMLLKLLYHLLIPFNYLLLTLFISTIYQYLSTKYTSIL

SEQ ID NO: 47769 - protein, 67 aa, Sorghum bicolor
  unsure (1)..(67): unsure at all Xaa locations
  Clone ID: LIB3478-026-P1-K1-C8.pep
LWPGSPSIARMSSSXPSTTPSSPRFSLQTSARVTXXSLHLTTFKSPSKTPXPFSSFISRGPSIPSFF

SEQ ID NO: 47770 - protein, 48 aa, Sorghum bicolor
  unsure (1)..(48): unsure at all Xaa locations
  Clone ID: LIB3478-026-P1-K1-H6.pep
EDSIPPTQQQGTTTTRQCLRRRTAFGSGDEGHAQGPLLGRQGYXXHHS

SEQ ID NO: 47771 - protein, 90 aa, Sorghum bicolor
  Clone ID: LIB3478-026-P1-K1-H7.pep
HISQYCSNASTHAPSMYTTVSMNWTSSCPPCMNVSSCPLWDCDLQHLQLAVARPHAVRNAAHHDATAWCSGMYQVQLAALCLCHLARLMV

SEQ ID NO: 47772 - protein, 70 aa, Sorghum bicolor
  unsure (1)..(70): unsure at all Xaa locations
  Clone ID: LIB3478-027-P1-K1-B9.pep
SAQTEHAGRRAFLLQSPANKPVVLPTLDPFSPATLTAAAVTWTPAMLLSVYMCFLAAAAAGFXYTWAHAG

SEQ ID NO: 47773 - protein, 54 aa, Sorghum bicolor
  unsure (1)..(54): unsure at all Xaa locations
  Clone ID: LIB3478-027-P1-K1-C4.pep
RHALPLTDEDDDXGSDVSLLLLRADGSLHPFYIMAWAISSLQRRIQRQEAAALV

SEQ ID NO: 47774 - protein, 63 aa, Sorghum bicolor
  Clone ID: LIB3478-027-P1-K1-C5.pep
SLPNGAHTRFAQRWPMATTPERLNHGHALQEEVTKESEGRVEAQEAAISVWPQVRCCLACCVV

SEQ ID NO: 47775 - protein, 32 aa, Sorghum bicolor
  Clone ID: LIB3478-027-P1-K1-D1.pep
ADSGRHASLRIDCVFSESEKRPQFTGDSDVNM

SEQ ID NO: 47776 - protein, 42 aa, Sorghum bicolor
  Clone ID: LIB3478-027-P1-K1-E11.pep
ASDTIYYRSLATAVGETQKEIESAHMNSTTAGQEDEILTLVP

SEQ ID NO: 47777 - protein, 38 aa, Sorghum bicolor
  Clone ID: LIB3478-027-P1-K1-E8.pep
LPLHYYIKIQGNLVGKIFSLKHHSSMGMQSADAWSTGI

SEQ ID NO: 47778 - protein, 61 aa, Sorghum bicolor
  Clone ID: LIB3478-027-P1-K1-G6.pep
GNCTSGNSSTEPYIVYHNMAGCHANSGSIYKENISRETRCLYSNYTLSQDATDHFEVFQQI

SEQ ID NO: 47779 - protein, 56 aa, Sorghum bicolor
  unsure (1)..(56): unsure at all Xaa locations
  Clone ID: LIB3478-027-P1-K1-H1.pep
PRSSPPRRTTAARLLQEIGTSQSWQLRRQLVSVIQGSXRARHCHVTLLINVASSTV

SEQ ID NO: 47780 - protein, 49 aa, Sorghum bicolor
  Clone ID: LIB3478-028-P1-K1-A5.pep
CTLCYKRAVVKKHSNRSYDNRKIVFIREKTLSFIYFNIIRAYLFELHMT

SEQ ID NO: 47781 - protein, 51 aa, Sorghum bicolor
  Clone ID: LIB3478-028-P1-K1-A9.pep
HPIPTTPLFPLINLMLVGDLVIADNVTTSHIKKNASNNYLQITTRPPNGLI

SEQ ID NO: 47782 - protein, 50 aa, Sorghum bicolor
  unsure (1)..(50): unsure at all Xaa locations
  Clone ID: LIB3478-028-P1-K1-D9.pep
KGSEYEKLVVSGITQVYQSSLSWHGCKSCCEVQVXNLXILIRLYDVHYYN

SEQ ID NO: 47783 - protein, 83 aa, Sorghum bicolor
  Clone ID: LIB3478-028-P1-K1-E7.pep
PPRDPKNKGVMAPGLEPASNHGIPLHACPTKMSRLCTNPLSRSMKQSASFNSVQLALSFLHMHQSWLRQAMLYILYARVVTGI

SEQ ID NO: 47784 - protein, 53 aa, Sorghum bicolor
  Clone ID: LIB3478-028-P1-K1-G8.pep
IFSSCSHHSVLCPGIADALKDSSMPVRLAAKRCALHVFQLTKGQIMLHQHKST

SEQ ID NO: 47785 - protein, 65 aa, Sorghum bicolor
  Clone ID: LIB3478-028-P1-K1-H12.pep
KSQTAPARDETCEQGYCATLGPAQLEGSSVRRTHSRALHASDMGAHVVTTASYRAESMLYRATRS

SEQ ID NO: 47786 - protein, 150 aa, Sorghum bicolor
  Clone ID: LIB3478-028-P1-K1-H5.pep
DTRAMWRAISGMFRNRIIFYDAEVHDVPQALLKSLGVKNLPAVIGRTVNGEELLLKDGISVKDLRSGIKELKTLLESFEKKNKKLSSSQANSKPSSQWEEKKVPLLTASNFEEKWGDKTSECIIGGVGSNKAKEQLETVLAEIFKKTLIR

SEQ ID NO: 47787 - protein, 69 aa, Sorghum bicolor
  Clone ID: LIB3478-029-P1-K1-A10.pep
HAVPLHASSLACSSLSLACLDRNALGMASECGYRHVSPPSLSQRPPASSTHLHTPLFFRPLSGLLVRAR

SEQ ID NO: 47788 - protein, 96 aa, Sorghum bicolor
  unsure (1)..(96): unsure at all Xaa locations
  Clone ID: LIB3478-029-P1-K1-B1.pep
ERSWKTYRRLYLRGVLTPSTRKARSRQGGSPDQQRYLAASSRGRXTLXYNIQKESTLHLVLRLRGGMQIFVKTXTGKTITXEVESSDTIDNVIGPR

SEQ ID NO: 47789 - protein, 39 aa, Sorghum bicolor
  Clone ID: LIB3478-029-P1-K1-B6.pep
NNSPPPHFFRFACRRRTSSSPASYRPLPYLTRAVTILSN

SEQ ID NO: 47790 - protein, 89 aa, Sorghum bicolor
  unsure (1)..(89): unsure at all Xaa locations
  Clone ID: LIB3478-030-P1-K1-A1.pep
PSEFRSTTRPLIGLLRGIEKXGCXRRSRMTTYEYWRLRQGVLRALSDHSKANRLPTYGHEKLIAIRGAKYAXEDQGIAPTVEVTRRLSC

SEQ ID NO: 47791 - protein, 50 aa, Sorghum bicolor
  Clone ID: LIB3478-030-P1-K1-D5.pep
WLEARKSTRRIDEKVVYVCKECLGAAGLLSPHGSPICTDRGTPPSGRQGC

SEQ ID NO: 47792 - protein, 69 aa, Sorghum bicolor
  Clone ID: LIB3478-030-P1-K1-E6.pep
PGPPTLTRWRLYTAEGSMYDTATPGGRGADEATPHDSLYTAAPIGRPVPHTAAQGGSGRGTALHYDRLR

SEQ ID NO: 47793 - protein, 35 aa, Sorghum bicolor
  unsure (1)..(35): unsure at all Xaa locations
  Clone ID: LIB3478-030-P1-K1-H10.pep
VLCQFAPAPLIXTRAYLSPQEGFKRGITRVDKFSK

SEQ ID NO: 47794 - protein, 158 aa, Sorghum bicolor
  unsure (1)..(158): unsure at all Xaa locations
  Clone ID: LIB3478-032-P1-K1-D5.pep
SWPSPSPSPSPSPSPAARSSSSSSPRTSASSPEGVAADLLSVLGGPRAAARVPAAEASRLRACLRFLAPANPTTAPKVSSWSRGGPRKFLLERCDAGTAEADEMVMWPPAPVLELARLAVDFGGDPGAIHRALDPTMLPVPDVEGAQKNXCELTRTPF

SEQ ID NO: 47795 - protein, 67 aa, Sorghum bicolor
  Clone ID: LIB3478-032-P1-K1-F5.pep
LAPFIPVHHQCILLTLVGSFLQMRHEFLHVSDNCFAHCVIVRVTSVNGVDPVISLVLLVACYPTISL

SEQ ID NO: 47796 - protein, 72 aa, Sorghum bicolor
  Clone ID: LIB3478-032-P1-K1-F6.pep
TPHNPLVQPAIKILVKARVQQVSSVLTAEAAVDVLSAQLLHLLQAQKYYVLINCQQLMQEAFPFARITDPQN

SEQ ID NO: 47797 - protein, 59 aa, Sorghum bicolor
  Clone ID: LIB3478-032-P1-K1-H8.pep
TSTPPFAPSSTSWAMAPPARRALRPRHAAVRGLPKGAPVRRLCPAGAGRERRRYVKKEP

SEQ ID NO: 47798 - protein, 95 aa, Sorghum bicolor
  Clone ID: LIB3478-033-P1-K1-A1.pep
DDNLQFYTLASPRTTSCRMRRRCCRDGAQSARSMRQRRQTGRRACTAVGRTCARPESSLMAGCGPGHGGTQVSSIREVRRINGKNKIKCNNDEHG

SEQ ID NO: 47799 - protein, 56 aa, Sorghum bicolor
  Clone ID: LIB3478-033-P1-K1-A8.pep
HASVIIIHGFTLCMLRKRDNAVSDTALRIVASMKRDWMQTGRKPRDWWAHIHVTLM

SEQ ID NO: 47800 - protein, 104 aa, Sorghum bicolor
  unsure (1)..(104): unsure at all Xaa locations
  Clone ID: LIB3478-033-P1-K1-C5.pep
MAASLQAXSTLMQPGKIGVPAHSASLPSRPSSHLARAFGVYAGAARITCSFQSDIRNFSSKCVNAAKLAGFVLATFDLLVSGASAKGTPRRLTYNHIQILTYME

SEQ ID NO: 47801 - protein, 113 aa, Sorghum bicolor
  unsure (1)..(113): unsure at all Xaa locations
  Clone ID: LIB3478-033-P1-K1-C8.pep
TKTCPPPTIHNLISAAWTFWGGSFILVGLLRLTTRSIPGPIIAWPSLHPTGTINCTVVPDASPIVXSRHLRPPLLLPTALIPCSQSPNKHNLPTVCTTSKSVAKAKSFLHKYP

SEQ ID NO: 47802 - protein, 42 aa, Sorghum bicolor
  Clone ID: LIB3478-033-P1-K1-G9.pep
LSCYSRSRSNRHLDCVTVENHDQYDRYINSDIQSKHNVWQYD

SEQ ID NO: 47803 - protein, 36 aa, Sorghum bicolor
  Clone ID: LIB3478-034-P1-K1-A8.pep
RRSHRCASEFADENKSAGLVKLNPASEYPPALEDTL

SEQ ID NO: 47804 - protein, 113 aa, Sorghum bicolor
  Clone ID: LIB3478-034-P1-K1-B12.pep
TFAIVIGVLELVLFALLIGNMQSYLQTTMVRLEEWRTKRTDMERWMHHRQMPQPLKQCVRRYHQYQWVATRGVDEEALLQDLPMDIRRDIKRHLCLDLVRRVPLFDEMDERML

SEQ ID NO: 47805 - protein, 70 aa, Sorghum bicolor
  Clone ID: LIB3478-034-P1-K1-B4.pep
YDPRRAAARQGVPPLLSVVDRTRGGQSPRVRAVCPRVIPLALYVVCGWFCRSVCCSLSLGKGATVVTGIG

SEQ ID NO: 47806 - protein, 75 aa, Sorghum bicolor
  Clone ID: LIB3478-034-P1-K1-C10.pep
APTMSVHHNAIEQTKDQGTTPKSHALSPQDFIFPHKHTMTTAGVKSLHSWLCPAHLRFEATPRESLLRDAGRGAE

SEQ ID NO: 47807 - protein, 54 aa, Sorghum bicolor
  Clone ID: LIB3478-034-P1-K1-C6.pep
RSRSPRGAIKGLHLWYFQEYIYSTYAYIVYGRRLTFCVDRRKNSTGLILLYSDG

SEQ ID NO: 47808 - protein, 54 aa, Sorghum bicolor
  unsure (1)..(54): unsure at all Xaa locations
  Clone ID: LIB3478-034-P1-K1-D1.pep
PTFNYTTSVKTLLTTXHQPHNSSHVCLYSTHNTLLFPLHLLPKNTKYQNTHKLP

SEQ ID NO: 47809 - protein, 75 aa, Sorghum bicolor
  unsure (1)..(75): unsure at all Xaa locations
  Clone ID: LIB3478-034-P1-K1-D2.pep
HTXLYIFILKIYSLTXITLIIIFSLSIISYTTYQQITSNLFPLLFFFLYIYIYHIFTHKTHLXNIFSLKNSYYIQ

SEQ ID NO: 47810 - protein, 64 aa, Sorghum bicolor
  unsure (1)..(64): unsure at all Xaa locations
  Clone ID: LIB3478-034-P1-K1-E4.pep
TSGWYVGLPXQPCSGKVLQMSCATIVESVCPRIVLLLPRLSSAQQLCTAACRSPANRRVAPGSD

SEQ ID NO: 47811 - protein, 55 aa, Sorghum bicolor
  unsure (1)..(55): unsure at all Xaa locations
  Clone ID: LIB3478-034-P1-K1-G2.pep
SEATSPTNSSQXARYELRCLCHAVPFSRICSSFTIHAKFPIPSADITGVIKKELT

SEQ ID NO: 47812 - protein, 77 aa, Sorghum bicolor
  Clone ID: LIB3478-034-P1-K1-H11.pep
GAPATGRWTCRRRQRRQRPCQMRWRRRSSGAVKDFRRHHGAAPDDSLFCSRLLVLVYTRIHSCHCNYYLWTVSDERF

SEQ ID NO: 47813 - protein, 55 aa, Sorghum bicolor
  Clone ID: LIB3478-034-P1-K1-H3.pep
TFGRRALLTPAPCCHAAIVIASVIDRKGSMQLLFFSVWYTDWAESSPHAWSTGIG

SEQ ID NO: 47814 - protein, 92 aa, Sorghum bicolor
  unsure (1)..(92): unsure at all Xaa locations
  Clone ID: LIB3478-035-P1-K1-E12.pep
MASMAYAMAGALKGLYLAPTTTSFLRGDRESLYVGGSSGAMGVSVPARWLTIXMXHKKGAGSTKNGRDSNGQNFXVKIYGDQVXKPWASIIR

SEQ ID NO: 47815 - protein, 125 aa, Sorghum bicolor
  unsure (1)..(125): unsure at all Xaa locations
  Clone ID: LIB3478-037-P1-K1-G11.pep
RPRVAENLLLDESGALMVADFWLGAVAGTADGGGSLLRRTMCGTPAYVAPEILSRKGYEPAKVDIWSCGVVLFVLSAGYLPFNDASLVNMYRKIYAGRFRCPVWFLTALXILLMCVLDPDPSARI

SEQ ID NO: 47816 - protein, 88 aa, Sorghum bicolor
  Clone ID: LIB3478-038-P1-K1-A2.pep
PWIGRNPRGPQPGGPPAPDRPGRGGPREEAGPPPRGGWRRQPIFGGDRQPEYGPSAPWGPTPCSPAPSSPPGPPPRTCRPSRRWRLRW

SEQ ID NO: 47817 - protein, 45 aa, Sorghum bicolor
  Clone ID: LIB3478-038-P1-K1-A9.pep
ISVMRVAACATRAAAHSSESPNVAGGGRAEGYECHYDVYRTRGER

SEQ ID NO: 47818 - protein, 53 aa, Sorghum bicolor
  Clone ID: LIB3478-038-P1-K1-B2.pep
LDDSENDDGNVQQEQGLSTYEKERLEMPAKIEQMEKACLEPSTWTMQGEGSGF

SEQ ID NO: 47819 - protein, 87 aa, Sorghum bicolor
  Clone ID: LIB3478-038-P1-K1-D3.pep
AGSVLKRTIAVVLIPSDVLIPHADEMRAAEHVAPIVVLALDVRVADRPRVAGHPRVDDPGRAEHAEGVRHRVVQSQRVHHPYHRHPR

SEQ ID NO: 47820 - protein, 70 aa, Sorghum bicolor
  unsure (1)..(70): unsure at all Xaa locations
  Clone ID: LIB3478-039-P1-K1-H6.pep
SSYKYLSSIMCCKKYPDLXEKSAAAHATVVLGVALELTLAAENXAVEESCAVTFHGCSFRDSCKCNPCNC

SEQ ID NO: 47821 - protein, 35 aa, Sorghum bicolor
  Clone ID: LIB3478-040-P1-K1-A4.pep
SLDNRSIISVLPHCGTDGQRRLGHQNRVDMFKDTM

SEQ ID NO: 47822 - protein, 83 aa, Sorghum bicolor
  Clone ID: LIB3478-040-P1-K1-C5.pep
PAGFGRHASGPTERLVANLHTLTSPHQRRQLRPDRVSRVAQNKPATGSDPQRSRGLEPYLHEDRAHQTPLAASLTHLQSTARQ

SEQ ID NO: 47823 - protein, 66 aa, Sorghum bicolor
  Clone ID: LIB3478-041-P1-K1-C6.pep
LGLRLAPCSCTDRLGLGPTRVLGWGHRRAGPRRQETRRAERKMEAGGSGTEGPGSAVDEDETRATG

SEQ ID NO: 47824 - protein, 43 aa, Sorghum bicolor
  unsure (1)..(43): unsure at all Xaa locations
  Clone ID: LIB3478-041-P1-K1-D3.pep
AHGRRAXGSGQDRGRLAMRLVRAVSAQLALMADRPSDGWSLYE

SEQ ID NO: 47825 - protein, 52 aa, Sorghum bicolor
  Clone ID: LIB3478-041-P1-K1-G1.pep
VPTAFSNQLQSAITCANPDSTQSRTGQQLTGDRTPRYYCVDEPTRCLLLTTS

SEQ ID NO: 47826 - protein, 36 aa, Sorghum bicolor
  Clone ID: LIB3478-041-P1-K1-H4.pep
LYDKPLEPPEVNLRLDTARQYSSSLLGAVHDEGESR

SEQ ID NO: 47827 - protein, 152 aa, Sorghum bicolor
  unsure (1)..(152): unsure at all Xaa locations
  Clone ID: LIB3478-043-P1-K1-A7.pep
GPSYIGSPGDAADGKXRAGGVEVDAADGVGRTGKGGGRHGGRQPELPFAARRRQLGVLVVVGLMISFTATGRKRSSNGGGYLLVVVVVQSLGFLFRQAVLLCGGAAGPGRRGRRSGVAHGLARAHHSRVAGIAEAAGAALVPDAWIECGRFR

SEQ ID NO: 47828 - protein, 75 aa, Sorghum bicolor
  unsure (1)..(75): unsure at all Xaa locations
  Clone ID: LIB3478-043-P1-K1-G6.pep
RPKERKLXTNXTLSKELKTHSHMAGRSIFPGGLRRPTLRTLSYNLTDIQSSARTLITCATVKQHGEPEKHWPCPK

SEQ ID NO: 47829 - protein, 95 aa, Sorghum bicolor
  unsure (1)..(95): unsure at all Xaa locations
  Clone ID: LIB3478-043-P1-K1-H10.pep
PGGGQHNSPSMPXQTIMSGMNYPNGRHHMGNHGVPPRMEQPAGXSGWHVPGDNMANGQAAYDQYQPERSGPSWHXRDNPGGQRYNPYARENRQGF

SEQ ID NO: 47830 - protein, 62 aa, Sorghum bicolor
  Clone ID: LIB3478-044-P1-K1-D9.pep
FWFILLILFLWVGCIPVYISTKNINSILLLFTNHYLSIFNIQQNFSFSKELNALYIHHHLSS

SEQ ID NO: 47831 - protein, 79 aa, Sorghum bicolor
  Clone ID: LIB3478-044-P1-K1-F4.pep
HASGWIDYLPLRHHSPHRSLLSPPPGSYATKHGVRDRPRPGRGPAPVGGVVAQQSAAPRLLALALATVHPPLAAAGALR

SEQ ID NO: 47832 - protein, 53 aa, Sorghum bicolor
  Clone ID: LIB3478-044-P1-K1-H9.pep
MSMRACPRAGAHARRWSADAQRVRDPLAVLKGPADSCHGGVVGGVDACRRFAV

SEQ ID NO: 47833 - protein, 60 aa, Sorghum bicolor
  Clone ID: LIB3478-046-P1-K1-C2.pep
GSTIKDLVLIHRNTELQRVRRFVSLTSNTPSQWHQTNPSLLLDNDDIFRHHADLEQGVGF

SEQ ID NO: 47834 - protein, 118 aa, Sorghum bicolor
  Clone ID: LIB3478-046-P1-K1-D5.pep
TNTLPVVRVIQYSSAYELSIMYTVNDNTYIRDYSLGEGRITMRKTAAKPKVAASGSPWYGPDRVKYLGPFSGEPTSYLTGEFPGDYCWDTAGLSADPETFAKNREQQVIHSTWAMLGT

SEQ ID NO: 47835 - protein, 64 aa, Sorghum bicolor
  Clone ID: LIB3478-046-P1-K1-D9.pep
RALCHSRVCSCIHRVLRLYGNALNTILGGEEHYISCSHLLLRLDTPKLYSLRPLSAAMIYFKCL

SEQ ID NO: 47836 - protein, 96 aa, Sorghum bicolor
  Clone ID: LIB3478-046-P1-K1-G11.pep
DPDRPRVRPHAPARPPASKTLHPVNPSRRRRPRCRKWGVSCGSPWPDPRLGSSLVADHTVGYRRQRWTSAHRSVMSRTLLRLLSLRSHSRCHLCYT

SEQ ID NO: 47837 - protein, 44 aa, Sorghum bicolor
  Clone ID: LIB3478-047-P1-K1-B1.pep
IGVFVKACMEQTDILKNTIHEEEKNGSGKTWLGTRDESSRLDLI

SEQ ID NO: 47838 - protein, 55 aa, Sorghum bicolor
  unsure (1)..(55): unsure at all Xaa locations
  Clone ID: LIB3478-048-P1-K1-B11.pep
TIQHGGNYAINNSHKRRWLSQKRYITLHTMFNIVDIGTQHSXFLTLSSEIVNIIG

SEQ ID NO: 47839 - protein, 51 aa, Sorghum bicolor
  unsure (1)..(51): unsure at all Xaa locations
  Clone ID: LIB3478-048-P1-K1-B9.pep
QDDTGAYVRIMVVDIGHPPATDVGGRAPGHDGQGRLSAMRAVATRGDXDSD

SEQ ID NO: 47840 - protein, 64 aa, Sorghum bicolor
  Clone ID: LIB3478-048-P1-K1-G7.pep
PVDHASELSRFCLNLYAQILYAALARVSRGLLASSLAGQEATDCPTKWGCGGGHDRILAHRRVL

SEQ ID NO: 47841 - protein, 39 aa, Sorghum bicolor
  unsure (1)..(39): unsure at all Xaa locations
  Clone ID: LIB3478-050-P1-K1-A1.pep
FSEVILKASRKNIFNVWRQTVWEYWLFFLQDNQLIISSX

SEQ ID NO: 47842 - protein, 66 aa, Sorghum bicolor
  Clone ID: LIB3478-050-P1-K1-E9.pep
PSRFPVDHACDTRSDQKQWKDPFQTEIRATEILIPLMRIMWGFYKDCLYISMSLNSECTYIPVRLV

SEQ ID NO: 47843 - protein, 48 aa, Sorghum bicolor
  Clone ID: LIB3478-050-P1-K1-F3.pep
VDSSPRVGRGCRACMRTRGVTWPIDWRGGGGIYAGTLCDTPDLRSYSE

SEQ ID NO: 47844 - protein, 42 aa, Sorghum bicolor
  Clone ID: LIB3478-050-P1-K1-F7.pep
LQQSHVAHITHSKESIHSVPPLCNQHCLFKNDRSCFARSVRS

SEQ ID NO: 47845 - protein, 27 aa, Sorghum bicolor
  Clone ID: LIB3478-051-P1-K1-C8.pep
GRGIGACNLPPSSSIKVGSPRSRVQFQ

SEQ ID NO: 47846 - protein, 55 aa, Sorghum bicolor
  Clone ID: LIB3478-051-P1-K1-E8.pep
SPLGATCDFSVSLAPGCLRRDRGLNRVSRWGAQQATLRRPSPTYPCDSAVDCGVE

SEQ ID NO: 47847 - protein, 73 aa, Sorghum bicolor
  Clone ID: LIB3478-051-P1-K1-H3.pep
GFPGEDRVDGERGMVIVQSDGDGCLSDSDSDGSDWSIGWLEPLAPELQSDADSEGSFAVLVPCYRHSRLPAAV

SEQ ID NO: 47848 - protein, 43 aa, Sorghum bicolor
  Clone ID: LIB3478-052-P1-K1-A2.pep
LHLHRQHYTDLQSSLYQYPPPQRRFPSYKPKFALIQPELLLIS

SEQ ID NO: 47849 - protein, 99 aa, Sorghum bicolor
  Clone ID: LIB3478-052-P1-K1-B1.pep
TLDACDLLVKSQHSVEDDEEADHGAHRHHRALDNRPHDHEPTNYSPLPNNHQTFSSILFFRSLRPSLPLLHRSLAVAAQRLPATASKHKQQEGERARGS

SEQ ID NO: 47850 - protein, 66 aa, Sorghum bicolor
  Clone ID: LIB3478-052-P1-K1-B4.pep
SARRTTFSLETVMSHKMLHLVAVSSPQFIHLGSESEDYAGPRKDPREVWGFAAKPELLARLLSAAS

SEQ ID NO: 47851 - protein, 90 aa, Sorghum bicolor
  unsure (1)..(90): unsure at all Xaa locations
  Clone ID: LIB3478-052-P1-K1-C12.pep
ITSSSRFLAKVSGSADSPAVSSRSXGNSRQDLGSRDDQVQTGRRTGSDPWLLAQSGVSPPKPGWFRSRRGGRPWAAATITLLEVAVATDR

SEQ ID NO: 47852 - protein, 49 aa, Sorghum bicolor
  Clone ID: LIB3478-052-P1-K1-G4.pep
LIFSVIITSMLFPLQPLGIQLEGLLNWVRAQAHHMLELDQLNMQLTCHL

SEQ ID NO: 47853 - protein, 65 aa, Sorghum bicolor
  Clone ID: LIB3478-052-P1-K1-G6.pep
TNFRHPIVCSRTKKSRTAKLGGMLFFLANCFLLHSKGCPYPWLPELHIVSFDLLPDGQKLGLRNP

SEQ ID NO: 47854 - protein, 105 aa, Sorghum bicolor
  unsure (1)..(105): unsure at all Xaa locations
  Clone ID: LIB3478-052-P1-K1-H4.pep
RGLGGCXRDAKRSRCGTPSPISCISPSTAHHSDFFMPTXAAGPRPGGGGLDQPVPPVTKPXRRCAHRRCVYKQRNIVSPLPXGLQARLWRPTAPWHASSQARPHA

SEQ ID NO: 47855 - protein, 104 aa, Sorghum bicolor
  Clone ID: LIB3480-002-P1-K1-G6.pep
LRPPHRRLRRSSEVLVADLEPVPATGLDDDGFSRIWYFYHAKKYKNTRGDTSGHRQRAVTGGGGTAWHSEIGRKDVHGSGGGTFCTLSYGRKMEPSARSIDRMG

SEQ ID NO: 47856 - protein, 162 aa, Sorghum bicolor
  Clone ID: LIB3480-002-P1-K1-H4.pep
AKLGDQNKFYYDEKLKRWVEEGAAVPAEEPPLPPPPTKPSFQNGMPDHKLNGPMSVNHAPNGVTEWKSSNSSEQGGLGMPPIPPSQNQFSARGRMGVRSRYVDTFNKSGASGAVPSYNKPAAPSVTPPAGAKFFMPTAAPAAADQMVPHQAAEIHSETIHHD

SEQ ID NO: 47857 - protein, 71 aa, Sorghum bicolor
  Clone ID: LIB3480-003-P1-K1-B4.pep
AGQTMNNIPTKCQNNSNCRWIKAWSDALLLFYGSLLGGWSSRRRVLLGLLLRAPLGGRRRRSGGGPGGRVG

SEQ ID NO: 47858 - protein, 149 aa, Sorghum bicolor
  unsure (1)..(149): unsure at all Xaa locations
  Clone ID: LIB3480-004-P1-K1-E8.pep
SGARCRAAAPATLPDDDDILSEILLRLPPRPSSLPRASLVCKRWRRLVTDPHFRRRYRSRHPNPPLLGFFDESAHFSFFRSAMDPPDLIPPKRFCPPIADETGGCDPSHWRNFGCRHGHVFLYNRKQKEIXVAIPPELDKEERMIWRGA

SEQ ID NO: 47859 - protein, 118 aa, Sorghum bicolor
  Clone ID: LIB3480-004-P1-K1-F9.pep
ASLGPSGSLPGRPYFRPLSVEHDGVQDALSVLITPNTLDDIMTKIITTLWFIWRARNELCFRQNKWSVMQVHYAVQVHIQANVQALMKNAGSTAGNGGKINASLEAPKGHASQSLEES

SEQ ID NO: 47860 - protein, 43 aa, Sorghum bicolor
  Clone ID: LIB3480-005-P1-K1-B7.pep
HPLNLMLRDGAHPPFHLGCACDGKGDRPVPLCCHPSKGEWAVT

SEQ ID NO: 47861 - protein, 116 aa, Sorghum bicolor
  Clone ID: LIB3480-005-P1-K1-B8.pep
RVQSTRPLAQLPIMNYYRSPDMGDAVDFTVHVATPVEKLSLMKERLMHYLDNKKEHWYPGSMVVLRDVDDTNKLKASIWCRHTINFHDMGLRFERKKLLLQEMIKILGDLENEYRM

SEQ ID NO: 47862 - protein, 42 aa, Sorghum bicolor
  Clone ID: LIB3480-007-P1-K1-B2.pep
RIVYTPAGHCLHMCTSGSAGLQREHCNACVCADTCESRYRSA

SEQ ID NO: 47863 - protein, 58 aa, Sorghum bicolor
  Clone ID: LIB3480-009-P1-K1-A9.pep
SPQGGPPLLAARGEQPTVATKQGKKAKEAAASTLLTIAVVMLVVTPPPAVNDALQRGS

SEQ ID NO: 47864 - protein, 48 aa, Sorghum bicolor
  Clone ID: LIB3480-010-P1-K1-B5.pep
KARKSSSIIKKIAIDVAYTFLRKNCRGPAVALNIPHISLIEVGMIYYV

SEQ ID NO: 47865 - protein, 124 aa, Sorghum bicolor
  Clone ID: LIB3480-011-P1-K1-H6.pep
LRYRAVIGGSHASFELLGSSFFPKSNRPHLLKYGFNKGKAVLVMPPSYSSEIQESEMGSWHIPMEEKSGDERGRIWLCIGRGGSCKEHGEVPTTNGVVHEIPPTEASKVVQQRLAENKNETISG

SEQ ID NO: 47866 - protein, 67 aa, Sorghum bicolor
  Clone ID: LIB3480-012-P1-K1-A1.pep
EAIYLATARMMGPSRCPHRPPTGRRPASSLSSSHPPAPSHTTAPSRRRFPPAHGLSRPASGAAHGAA

SEQ ID NO: 47867 - protein, 35 aa, Sorghum bicolor
  Clone ID: LIB3480-012-P1-K1-A12.pep
CMCSSSRQTSCVADQVLHRVPALRNLACIILPRTS

SEQ ID NO: 47868 - protein, 94 aa, Sorghum bicolor
  Clone ID: LIB3480-012-P1-K1-A7.pep
FCIPGTDINTFFDRYQQAIGTSLWNELYENMQRTLSHLKDINRNLRTVIMQRMGEDLDTLEFDELRGLEQNGDAALKEVRHKKFHLIATQTETY

SEQ ID NO: 47869 - protein, 49 aa, Sorghum bicolor
  Clone ID: LIB3480-012-P1-K1-C2.pep
RGMKGQAHQDPSRSVPRAYITGIRLIHAPLVLTDRPELFLFFLFFFYIG

SEQ ID NO: 47870 - protein, 39 aa, Sorghum bicolor
  Clone ID: LIB3480-012-P1-K1-F3.pep
TLLHQALNANTHLKPHLATASILKTLHEWLGSPDRLIHR

SEQ ID NO: 47871 - protein, 61 aa, Sorghum bicolor
  Clone ID: LIB3480-013-P1-K1-C10.pep
NCRLGHQKKKKKKKKKKGGGKLKGGEIYQKCPLDFKVARLHTLTCGSLYGVGGSGAFNFPA

SEQ ID NO: 47872 - protein, 108 aa, Sorghum bicolor
  Clone ID: LIB3480-013-P1-K1-E9.pep
KKNKTKNKINKEDKNKNKIHNRDVETHTRRAWSLLISHYHFLFFRVQLTSVSHMMILLKPHCDPILFSYLTVLLVHLPLCLRSFIAFGSITCLPHGLLTIMCHTNALF

SEQ ID NO: 47873 - protein, 106 aa, Sorghum bicolor
  Clone ID: LIB3480-013-P1-K1-H12.pep
YNDLPIDGILAQSNRFTEGCLLVASGLLILLHAEGAGTALRRVFCASCRYQVRLLLHAASSGDGHGCCWYKSSSHGHEGDDDGELCDDAVTTLGHYYCFRSVDHLE

SEQ ID NO: 47874 - protein, 85 aa, Sorghum bicolor
  unsure (1)..(85): unsure at all Xaa locations
  Clone ID: LIB3480-014-P1-K1-D12.pep
SXIPXDPASAKKKKKKKYKKKKIRDAYIKKKNLNNKGGGIIYNYLNKKRLAGSPLSGFLAFPCLFPTFPFLFGSINSPSVPRFKP

SEQ ID NO: 47875 - protein, 40 aa, Sorghum bicolor
  Clone ID: LIB3480-016-P1-K1-E3.pep
STVPAEEGPPDGITRGGPRAVMRLASCFLFECVPSYGSRS

SEQ ID NO: 47876 - protein, 134 aa, Sorghum bicolor
  Clone ID: LIB3480-017-P1-K1-A12.pep
IVWRHLLPEQQKGTKRKKGYNTVNGQKRGSKPTAACMQGQSSRTRAPKFKPLAGGQQHSNWGTPVDTQLNGKTLHSPNESWRNNKQVRTDRAIQKKAQPERLTEHALNRNSKRDAPCGYAQSARYAWQTPSVSS

SEQ ID NO: 47877 - protein, 89 aa, Sorghum bicolor
  Clone ID: LIB3480-017-P1-K1-D5.pep
CLEDPQKHGPKHFGLPFFLGLFFFNPPQVSQKKPKGFWWGVTRPFANLHPLGWGVPRLFLTLGGALKKGGGFFKNPGNLTGGPVGPFFI

SEQ ID NO: 47878 - protein, 70 aa, Sorghum bicolor
  Clone ID: LIB3480-017-P1-K1-G11.pep
KEGQKNEHRGEKKGGEARETKGRTPQKLINGPPLVCNFSLFFFFFFFFFFFFFFFFFFFFFIFFYFGRGV

SEQ ID NO: 47879 - protein, 42 aa, Sorghum bicolor
  Clone ID: LIB3480-017-P1-K1-H6.pep
NLITPPHTSCMATPKFTLISFIQQQEQQATIRSDHHQYQSTR

SEQ ID NO: 47880 - protein, 130 aa, Sorghum bicolor
  unsure (1)..(130): unsure at all Xaa locations
  Clone ID: LIB3480-018-P1-K1-B1.pep
DHAARAWRTISRELGPPGYGPGENQRSITSWNTRCESGVFTSPVTTSREDGPPGYGPGENQENDSTSCELRMFDPPTTISREVAPPGYELIGKNKGNDTSWTTNYQQGVFTSPXTISREACPPGFGSGGE

SEQ ID NO: 47881 - protein, 50 aa, Sorghum bicolor
  Clone ID: LIB3480-018-P1-K1-F8.pep
GRTPDGITRVGTQGRHAGLRRLVFFFSPFAVPASSNGVLRSIRLTDLTQN

SEQ ID NO: 47882 - protein, 37 aa, Sorghum bicolor
  unsure (1)..(37): unsure at all Xaa locations
  Clone ID: LIB3480-019-P1-K1-B12.pep
RPXSRSTQRPGQXWVDCCTLFSHIYYSLRKLTPKLCC

SEQ ID NO: 47883 - protein, 63 aa, Sorghum bicolor
  unsure (1)..(63): unsure at all Xaa locations
  Clone ID: LIB3480-019-P1-K1-E5.pep
MAVWGFGLRAPQDRFALLHTSILLAANDLLACCGIXCGDGCDGGYTTMAWRYFAQYGVGTDQC

SEQ ID NO: 47884 - protein, 107 aa, Sorghum bicolor
  unsure (1)..(107): unsure at all Xaa locations
  Clone ID: LIB3480-021-P1-K1-A9.pep
TNASDFSRISSPGDGSNPSDAKRTRRAFNKPPAHSSCCSKKSAAAEGGGDARGHRHHQENHREGAAADEENRMPSGQYYGGTDXEEESEEEEQHFKRQSSSSYRRER

SEQ ID NO: 47885 - protein, 81 aa, Sorghum bicolor
  unsure (1)..(81): unsure at all Xaa locations
  Clone ID: LIB3480-021-P1-K1-B6.pep
ISTXSAAKIEELIQEDHNVKRKREKFKLQSSLLSKVTRLLSIHDSRSASATLSTDSAGSESSPRKGGYSGDEWKSAFEAGS

SEQ ID NO: 47886 - protein, 52 aa, Sorghum bicolor
  Clone ID: LIB3480-021-P1-K1-C12.pep
LPPCLAPCARVRESALCSWASWAPGSAELHRRTQVYDAATPSVMVERGGDDR

SEQ ID NO: 47887 - protein, 36 aa, Sorghum bicolor
  Clone ID: LIB3480-021-P1-K1-E5.pep
MRYAIKWHASEGMLDASRVSVCDLERVDAWSIGKAV

SEQ ID NO: 47888 - protein, 85 aa, Sorghum bicolor
  Clone ID: LIB3480-021-P1-K1-E6.pep
PGHKEQSHGDGFSIRAQSFHDMSARRRPHENEFLMVRMDQPQNAWIQTDPTTSPYLARTKLIAHEDHMAITTNLETNMDNNSRYY

SEQ ID NO: 47889 - protein, 33 aa, Sorghum bicolor
  Clone ID: LIB3480-021-P1-K1-G7.pep
MNGKERCAFSSMKFAVRLVVSPPERARTSRSFR

SEQ ID NO: 47890 - protein, 63 aa, Sorghum bicolor
  Clone ID: LIB3480-022-P1-K1-B6.pep
CHLCSISCQKYHYSSVHQILSTYPKHSVMHSQSALNLLCASSYAIICAAYNVSRTAVQFALSI

SEQ ID NO: 47891 - protein, 56 aa, Sorghum bicolor
  Clone ID: LIB3480-022-P1-K1-C8.pep
SVFPVDGACAQAPPGLHLGRRHHGAHPGLLGPICKPRGRGTRWARVVKPNQYRYSL

SEQ ID NO: 47892 - protein, 60 aa, Sorghum bicolor
  unsure (1)..(60): unsure at all Xaa locations
  Clone ID: LIB3480-022-P1-K1-F11.pep
IFLFIFYFLINFYFFILYILLLTFPGFIFYTLLFYFFFFINFFFFIYIIXSNLRTRWSRS

SEQ ID NO: 47893 - protein, 59 aa, Sorghum bicolor
  Clone ID: LIB3480-023-P1-K1-G5.pep
PDYPSTTRPWAKVGLLVELVSTSNSTIEGFPIKSISYGSFTKLVRLWCCHSIHRNPLGG

SEQ ID NO: 47894 - protein, 67 aa, Sorghum bicolor
  Clone ID: LIB3480-023-P1-K1-G6.pep
PRRGEPSNALVCGQSSVRETVPGTVIEHPIFLSVTPLIGETQAVGIFHDQCYFSPELVQMFLFCHSY

SEQ ID NO: 47895 - protein, 97 aa, Sorghum bicolor
  Clone ID: LIB3480-023-P1-K1-H6.pep
LTRSVSGRVTPRSPARTSLSLSSPSSEWYPGHSPVTSTPTKFPAAASPWITILLTIFSPTSRPWSYLTTPREASQACFRNCSRTTTNYFIHLMSLIY

SEQ ID NO: 47896 - protein, 65 aa, Sorghum bicolor
  unsure (1)..(65): unsure at all Xaa locations
  Clone ID: LIB3480-024-P1-K1-A4.pep
HVVCDYFDERKQQMEGITVLIKNVXHKLYESXSANDQSGKDWTLILKHIDMFSYTALNKAQSDNM

SEQ ID NO: 47897 - protein, 37 aa, Sorghum bicolor
  Clone ID: LIB3480-024-P1-K1-G8.pep
RTARETNACRIRPGPPRYASGAFLSCTLKASVGLCYT

SEQ ID NO: 47898 - protein, 57 aa, Sorghum bicolor
  Clone ID: LIB3480-024-P1-K1-H6.pep
VRGYGRGEFSYRSDYGGRGGGRGGSSRGDVSYQRVDHSGTASGRGARAPSAATAVAK

SEQ ID NO: 47899 - protein, 59 aa, Sorghum bicolor
  unsure (1)..(59): unsure at all Xaa locations
  Clone ID: LIB3480-026-P1-K1-A12.pep
XDSRLDGWISCRSPRGGRTGSHLTSRRPTAGCIALIFGNIIGGASAQVGLGGGYTTGRR

SEQ ID NO: 47900 - protein, 72 aa, Sorghum bicolor
  Clone ID: LIB3480-026-P1-K1-B12.pep
KKQDEPGRGISSLKRSSSYDEDRVYRAAHSKSDTESSCESGSFRCLPQTIRIISCKQSRNGTILSPVSDVRN

SEQ ID NO: 47901 - protein, 87 aa, Sorghum bicolor
  Clone ID: LIB3480-026-P1-K1-C4.pep
HCWVFCAIVSHPADNLVSFLNNAKGATVGDAVKKIGLVGLFTRGLPLRIVMIGTLTGAQWGIYDAFKVMVGLPTTGGAAPTPAATKA

SEQ ID NO: 47902 - protein, 81 aa, Sorghum bicolor
  Clone ID: LIB3480-026-P1-K1-E11.pep
AYRPKEPINFGNRESKEKTRRGSLMTSLGPPPGYAVRGPSFRCTLKASVGPLYSHSRDFSLVSRFVGVPHVVIHKVSSHEV

SEQ ID NO: 47903 - protein, 90 aa, Sorghum bicolor
  unsure (1)..(90): unsure at all Xaa locations
  Clone ID: LIB3480-026-P1-K1-E3.pep
QIAAHPIKLTHISRAKIHPIPKSHKRSMEYVLPVXPSPLQPLASHPIVATVMTNCSELITVIEATYAEALGQFXCRAYAEALAQFQCRAA

SEQ ID NO: 47904 - protein, 57 aa, Sorghum bicolor
  Clone ID: LIB3480-026-P1-K1-E6.pep
PATFLTYLILRRGILTRCRSISNLLLYPILIHTYTPCQDTTINKDQNSRREATATLR

SEQ ID NO: 47905 - protein, 55 aa, Sorghum bicolor
  Clone ID: LIB3480-026-P1-K1-F11.pep
MKAITRVRLENRTYYGQRATRKESLTTDVQCGEKMSGGMNKVDHGWAGAVWLGSE

SEQ ID NO: 47906 - protein, 56 aa, Sorghum bicolor
  Clone ID: LIB3480-026-P1-K1-G6.pep
QSCMVNGTRDAPCHEALSAWGVLATRTVHFAVAYALVLALFAFSLSLRATAVRFTR

SEQ ID NO: 47907 - protein, 46 aa, Sorghum bicolor
  unsure (1)..(46): unsure at all Xaa locations
  Clone ID: LIB3480-026-P1-K1-H3.pep
PLIWRYGDRCSXVAGCYYSCLAXLVVXLLXLXVDFATILPSASKRS

SEQ ID NO: 47908 - protein, 39 aa, Sorghum bicolor
  unsure (1)..(39): unsure at all Xaa locations
  Clone ID: LIB3480-028-P1-K1-E4.pep
EFRSTHAPIIEVHRIAXPAEENVIDPSIIRDKADTGEKS

SEQ ID NO: 47909 - protein, 88 aa, Sorghum bicolor
  unsure (1)..(88): unsure at all Xaa locations
  Clone ID: LIB3480-029-P1-K1-A7.pep
TYTYASRYETSWWKLPSALWPATLEWSVYSLWKSFLGVLGGGAXGEAKASSEVKVELAILKMEVALEKMHRETEKMKYYAYKMRSEAY

SEQ ID NO: 47910 - protein, 46 aa, Sorghum bicolor
  Clone ID: LIB3480-029-P1-K1-G4.pep
TYAPRVRIEKLAASEKMAATLRLRILAAAATRRRHGTAVVDIAPRP

SEQ ID NO: 47911 - protein, 109 aa, Sorghum bicolor
  Clone ID: LIB3480-030-P1-K1-A6.pep
RPLGVAGDIISKAFHCKHGKAYLFHKVVNVTSGVKEDRMMITGMHTVSDIFCVGCGSIVGWKYEAAHEKSQRYKEGKFILERYKVSGPDGSQYWIAPDVNLGGSDADDV

SEQ ID NO: 47912 - protein, 47 aa, Sorghum bicolor
  Clone ID: LIB3480-030-P1-K1-H3.pep
ITRNARQRETRRVPHDALGTTALAVRGLPRACEARRLCIPTQRDSQA

SEQ ID NO: 47913 - protein, 84 aa, Sorghum bicolor
  unsure (1)..(84): unsure at all Xaa locations
  Clone ID: LIB3480-031-P1-K1-B12.pep
EVELSALGMAIGTVVTVAEILKNNGLATEKKILTXTIGTKDESKGRLVRKAKIEILLCKSENFNSIMSSKKSDRPKSAEEEIKV

SEQ ID NO: 47914 - protein, 48 aa, Sorghum bicolor
  Clone ID: LIB3480-031-P1-K1-E6.pep
TTTSRVRVRPCGFTTLPFFSGAYTSAAASGETTGCRCKVLPHGGHILT

SEQ ID NO: 47915 - protein, 67 aa, Sorghum bicolor
  Clone ID: LIB3480-031-P1-K1-H2.pep
GGGKVLVVQNIPRHFPTHPLFLKGVPKQLSYTMHALNATVQKGSLPFTRASGWVTLLRHNKKGFKWN

SEQ ID NO: 47916 - protein, 43 aa, Sorghum bicolor
  Clone ID: LIB3480-032-P1-K1-A7.pep
SVALVHTTSGKVAPVVPLLPPIRARGDELVRLRRAEGRRRPDA

SEQ ID NO: 47917 - protein, 67 aa, Sorghum bicolor
  Clone ID: LIB3480-032-P1-K1-D9.pep
RSRAVTPHPRAKPRPGASIAISWHCGRRRSASRYTHCEGMVSISGRRFSVKCNAPVIDLGAYKSRRE

SEQ ID NO: 47918 - protein, 47 aa, Sorghum bicolor
  Clone ID: LIB3480-033-P1-K1-A11.pep
SGSRGQSSGGRNASRLSGAGATYQLGRTSRLAKSLRSPFLVCRAPDA

SEQ ID NO: 47919 - protein, 71 aa, Sorghum bicolor
  Clone ID: LIB3480-033-P1-K1-C5.pep
LATRCAKGSMLSNWASHRGVDSGIVCNYMLHYISHTGCGTGLGLCQFIEHVSEQVAVQFGVLLDVLLEGLV

SEQ ID NO: 47920 - protein, 50 aa, Sorghum bicolor
  Clone ID: LIB3480-033-P1-K1-G1.pep
GRECLALYHCYTRQPIPTSKALPDTRDNLVHINTPSGHTTDHQDSNGYGN

SEQ ID NO: 47921 - protein, 49 aa, Sorghum bicolor
  Clone ID: LIB3480-033-P1-K1-G5.pep
TFGSVLRQDLNSERTQRETNASLIRPGPPRYAQGSFLSCTLKRRRPLYT

SEQ ID NO: 47922 - protein, 51 aa, Sorghum bicolor
  Clone ID: LIB3480-034-P1-K1-D3.pep
PITIFNTQFLKILNVKPKMVDHFFNQTANLLSFKYNPYIPKKGFLIFKYSL

SEQ ID NO: 47923 - protein, 86 aa, Sorghum bicolor
  unsure (1)..(86): unsure at all Xaa locations
  Clone ID: LIB3480-034-P1-K1-H12.pep
MIPFYLGKLFRQTRASEDISSKIGIGKEKALSISQAVQKYGNLIGFVEXISIGVRNPTAFLAGAXGISADXFFEGVCFGCLFTLPY

SEQ ID NO: 47924 - protein, 94 aa, Sorghum bicolor
  Clone ID: LIB3480-036-P1-K1-A1.pep
RDGNLDCVRQLLSWGADRLQRDSVGRIPYEVAVKRGHVACAALLNPSSAEPLVWPSALKFISELEPNAKSLLEATLMEANRERERRILKGLRCT

SEQ ID NO: 47925 - protein, 76 aa, Sorghum bicolor
  unsure (1)..(76): unsure at all Xaa locations
  Clone ID: LIB3480-036-P1-K1-B3.pep
NFIDLNDDVPNDDNSEESVXSRECEVEPSRNNHPKRTFVIDLXAXACEEDAAWDXDQESVQPKLDAYXEADNRSDT

SEQ ID NO: 47926 - protein, 62 aa, Sorghum bicolor
  Clone ID: LIB3480-036-P1-K1-D11.pep
GLAAPPGLNLADCGVGAAGLEQLIQQLAENDPNRYGTPPAAKSAVASLPDVAGSADMMHADG

SEQ ID NO: 47927 - protein, 79 aa, Sorghum bicolor
  unsure (1)..(79): unsure at all Xaa locations
  Clone ID: LIB3480-036-P1-K1-D5.pep
AYKTVDEVPLDAEXVDRTGYSSLDPDANGLPRTHGLSSSLHGFNDGSXPYSTQKHITVKRSNHSLEQPIFNPNLSGNAQ

SEQ ID NO: 47928 - protein, 51 aa, Sorghum bicolor
  unsure (1)..(51): unsure at all Xaa locations
  Clone ID: LIB3480-036-P1-K1-E1.pep
NYPLHPLFGHVYTIHSHTLQNNLLFLPTYIHFIYFLYKXAILIHCPHLHNF

SEQ ID NO: 47929 - protein, 55 aa, Sorghum bicolor
  Clone ID: LIB3480-036-P1-K1-H5.pep
PPSLMSRYARRPSRLLRPAAPSPAHRPARRRSREGPSPARAPRRRSPAQPPWGTP

SEQ ID NO: 47930 - protein, 63 aa, Sorghum bicolor
  unsure (1)..(63): unsure at all Xaa locations
  Clone ID: LIB3480-038-P1-K1-H8.pep
SDPVAXXQADREQPCRAETLSIRWHCQDHGVWLWLHSLRCATELLLQACYCCIMIVLLAHDRR

SEQ ID NO: 47931 - protein, 79 aa, Sorghum bicolor
  Clone ID: LIB3480-039-P1-K1-B1.pep
CYKSSGLLGDMGSIATMQRSVVGLKNSLYVGVRGSVILSLKEYVYVIPLCTSIVGDIVSEVKVDATGRVLSRSSLPRML

SEQ ID NO: 47932 - protein, 87 aa, Sorghum bicolor
  Clone ID: LIB3480-039-P1-K1-E2.pep
PRVRTCLRSFYRASLSAVSIPQKRFRLYILSGTRWTTLSRALVLILTALEFQSRLQTHNCNSMAGRSIHLAGQMDTLHYTTCQVAVF

SEQ ID NO: 47933 - protein, 76 aa, Sorghum bicolor
  Clone ID: LIB3480-039-P1-K1-F5.pep
NDPSMKIPTYMSGHSVYTQHYRVTNCKCRISLATTNTWLLLFMIYSLEIDVVVPYTSVTTSPSYCKLSTRSRCIYL

SEQ ID NO: 47934 - protein, 77 aa, Sorghum bicolor
  unsure (1)..(77): unsure at all Xaa locations
  Clone ID: LIB3480-040-P1-K1-A4.pep
HASASGRWDRXADPDSDITXEEDKWMKFTSHVMAXSLMMANIAPEVFRQANHHGHIKGFTFLGGVKVENCSSNRGGW

SEQ ID NO: 47935 - protein, 66 aa, Sorghum bicolor
  unsure (1)..(66): unsure at all Xaa locations
  Clone ID: LIB3480-040-P1-K1-E12.pep
ILFMFVLSSNTNSNFIYFXGGAPFLSFNFFIPFFEKNFFFFMGPKIKIPAPGLKNFGLEKPWFSQH

SEQ ID NO: 47936 - protein, 56 aa, Sorghum bicolor
  Clone ID: LIB3480-040-P1-K1-G1.pep
EIISQFPSVLCGHVIHRNSAVPSNGSLSSKSCPPPHTPPLVISYTIFVDQSVCSRP

SEQ ID NO: 47937 - protein, 46 aa, Sorghum bicolor
  Clone ID: LIB3480-040-P1-K1-G5.pep
DSGHHAPRGGGCMGLFRCREAKLTNGGLLRYVVYIAARECNEASGI

SEQ ID NO: 47938 - protein, 45 aa, Sorghum bicolor
  unsure (1)..(45): unsure at all Xaa locations
  Clone ID: LIB3481-001-Q6-K1-A11.pep
ASXXETLAAVYCSSSMVLVTHCSTTKDFDSTVDVHGFLLLYHPDA

SEQ ID NO: 47939 - protein, 70 aa, Sorghum bicolor
  unsure (1)..(70): unsure at all Xaa locations
  Clone ID: LIB3481-001-Q6-K1-A12.pep
SSPRFSDRTGSSLERNENDLVIRPPRLSVSAGGXGADRSPKHVELVSNGHNSGQNDQVRHLLSLLEKEYC

SEQ ID NO: 47940 - protein, 58 aa, Sorghum bicolor
  Clone ID: LIB3481-001-Q6-K1-A2.pep
NQTLFHFPDQDRMLGPLPELVKKGDRVRYGTTSYQDFLKQYFTAKLDGRKLIESFKLE

SEQ ID NO: 47941 - protein, 119 aa, Sorghum bicolor
  Clone ID: LIB3481-001-Q6-K1-B11.pep
ASVAETHSLGGEGGNKSISKSHTLDLGITLVSIWLKIISMDIMSVDADHIWLERWRLVPPNWREESGSTYYVDCEYSRPEPERPYPSNMRKIPIPFRAAEKKRSSTSEAALLMHAHLGR

SEQ ID NO: 47942 - protein, 78 aa, Sorghum bicolor
  Clone ID: LIB3481-001-Q6-K1-B2.pep
SAHASAHASGLGEGEYEPRVVHQFLDLAYRYVGDVLGDAQVYADHAGKAQIDADDVSLAIQAKVNFSFLQPPAREGSL

SEQ ID NO: 47943 - protein, 107 aa, Sorghum bicolor
  unsure (1)..(107): unsure at all Xaa locations
  Clone ID: LIB3481-001-Q6-K1-C10.pep
SFPVAQRPPSVRSPHQPVLGILPHVDNFAHIGGFATGFLLGFVLLIQPQFGWLEQPYGSKTKSKYRGGXIILLLAALVLLAAGLAVVYGMVFFGRISNPISVGCCFL

SEQ ID NO: 47944 - protein, 40 aa, Sorghum bicolor
  Clone ID: LIB3481-001-Q6-K1-C12.pep
PYHPPHLKNYLMRILHLCSKVFQTTYTYAVCGLFFLHGES

SEQ ID NO: 47945 - protein, 77 aa, Sorghum bicolor
  Clone ID: LIB3481-001-Q6-K1-C8.pep
RVRLDLEGTRRFFDAFFDLEPHYWHGFLSSRLFLPELLMFGLALFGNASNTSRLEIMAKGTVPLGKMIGNLIQDRDG

SEQ ID NO: 47946 - protein, 109 aa, Sorghum bicolor
  Clone ID: LIB3481-001-Q6-K1-D10.pep
ASGASGSSRFCERACVLCSVLVQAPQGKRSSGENVVMVDPLEAKRLAAKQMQEIRAKEKLRRGGQAEAINGALAMIGLTAGLVVEAQTGKGILGQLAGYLTAISSLFGQ

SEQ ID NO: 47947 - protein, 93 aa, Sorghum bicolor
  unsure (1)..(93): unsure at all Xaa locations
  Clone ID: LIB3481-001-Q6-K1-E3.pep
VRFVVGLVPWLKSLIIGDGAPFKVIQDSLQLMGNGAIPCITLILGGNLTQGLRKSGLKRRVIVTILCIRFVLLPLIGIAVXHAAYGLGLLSRD

SEQ ID NO: 47948 - protein, 79 aa, Sorghum bicolor
  Clone ID: LIB3481-001-Q6-K1-F9.pep
VRGAPPSQAKQQELNTVGRKQRFRNKLKEADRKFTGSAQENKVESLRELMGARASGTSMPKSSPRDWLDPHCHESEFDR

SEQ ID NO: 47949 - protein, 70 aa, Sorghum bicolor
  Clone ID: LIB3481-001-Q6-K1-G4.pep
ALSQGIALCTIGLFPLCRTTWVKRGEVGGPGQSVMMHLLRHHKLHEFWIIQRECYICTLELEEDQLPYDG

SEQ ID NO: 47950 - protein, 118 aa, Sorghum bicolor
  unsure (1)..(118): unsure at all Xaa locations
  Clone ID: LIB3481-001-Q6-K1-G6.pep
LRERALDMASLSVAAVAATTARPSSSGGRGRRRLRVASMATQKGQKPTTAKTVSGTTRRSQGTTTTTVFPVGEPGPRAAGTTTTKKAAPAVKLLTNVEKLRLLTKAERAGLLXXAERA

SEQ ID NO: 47951 - protein, 55 aa, Sorghum bicolor
  Clone ID: LIB3481-002-Q6-K1-A11.pep
PGPTGRRRTRAPARWRRHRGHGLLLPGQCASRELCSRVVTWVSGPRTRGRPGIGR

SEQ ID NO: 47952 - protein, 121 aa, Sorghum bicolor
  Clone ID: LIB3481-002-Q6-K1-B1.pep
PSGCRREGQKEAGGGAELGIPLGGWPSYNPHNFSQLVPADPSAQPSNVTPATYVATHRTDPPPNQVITTEARNILLRHFYQKSEEKLRPKRAAPDNLAPENNNKQPRGPVGDVGGQSSARG

SEQ ID NO: 47953 - protein, 74 aa, Sorghum bicolor
  unsure (1)..(74): unsure at all Xaa locations
  Clone ID: LIB3481-002-Q6-K1-B11.pep
SGISEFCLHGLSSPPLGCCQYFFMYAPFATVFKSCAIYNCSYVPSHNQYGYPMFAPNHLIFGCSGXVVDRDPDG

SEQ ID NO: 47954 - protein, 102 aa, Sorghum bicolor
  Clone ID: LIB3481-002-Q6-K1-B3.pep
RPGGVSALMAETTASIGCYVASGYRRLAGVQLSINHVGPARLGDVVQARATPIQLGRKIQVWEVQIWQIDPSTSERKDLVSTARVTLLANLSTPDKMKSEEG

SEQ ID NO: 47955 - protein, 97 aa, Sorghum bicolor
  Clone ID: LIB3481-002-Q6-K1-B7.pep
AAAMASMDFVVQVLVRVVMRRSIRRLQEVVDMAVEIGTAVFVAVRVSGLVFRRRLPTSTPSSSSSPAVSGGTATTTTTYYYSPGASALIGMSRIDRH

SEQ ID NO: 47956 - protein, 157 aa, Sorghum bicolor
  unsure (1)..(157): unsure at all Xaa locations
  Clone ID: LIB3481-002-Q6-K1-B8.pep
VRIFVHNIYNLLAHVPSMDFQKESTFDMWSTVGLSSKGEKDSSKDTSTHIKKKLQLKFTKAWLSFLKLPLPLDVYKEVLASIHQNVIPSMSNPSILCDFLTRSYDIGGVISVMALSGLFILMTXHXLEFPKFYEKLYALLTPAXXMGKHPAXVLQLF

SEQ ID NO: 47957 - protein, 73 aa, Sorghum bicolor
  Clone ID: LIB3481-002-Q6-K1-B9.pep
VRTVPTASPPRAVGVGVALSFPSIAPRPSGAVEREGSSTGVVDIAQALLPLSYFVFFLLWGGGQMKQLLFFFG

SEQ ID NO: 47958 - protein, 64 aa, Sorghum bicolor
  Clone ID: LIB3481-002-Q6-K1-C1.pep
NIHRLIYIHRIIYCFCLSSDNSPAPREKNKELIITDMASTSIGPKITSAKNCDDYMPFDSSNRT

SEQ ID NO: 47959 - protein, 115 aa, Sorghum bicolor
  unsure (1)..(115): unsure at all Xaa locations
  Clone ID: LIB3481-002-Q6-K1-C10.pep
VRACGAGSSAADPAANYLLAHTTDRDVYSVVQGSAFVIPKGSIVNYGVAEIGRDAKLWADGEVFXPERFLEGGEGFSIXGIPGVGGGGGXVPEMMKMIPFGAVGRACPGEVFLIK

SEQ ID NO: 47960 - protein, 138 aa, Sorghum bicolor
  Clone ID: LIB3481-002-Q6-K1-C12.pep
WRILTEQVQIVRDNSTDVMLYRIALAVIQVMLDFQAAERQRLEEPASDVGVESLCALINNNLRCYELSSELSSSTLEALPQNYAEQVNFEDTCKGFLEVAKEAVLQTVSVIFEDPGVQDLLVKLYQKDWLEGMVTEYL

SEQ ID NO: 47961 - protein, 55 aa, Sorghum bicolor
  unsure (1)..(55): unsure at all Xaa locations
  Clone ID: LIB3481-002-Q6-K1-C3.pep
ILQSVPNHCGIYVKQSTTQKIHGTNACSYSFLVLSIGNVVQEDYNNWNYWKGPXP

SEQ ID NO: 47962 - protein, 72 aa, Sorghum bicolor
  Clone ID: LIB3481-002-Q6-K1-D3.pep
GNCCTTTPVLDESIAISKAMQLLEAQEYIMFSRIVFDTAPTGHTLRLLSLPDLLDASIGKILKLRSQIAFAT

SEQ ID NO: 47963 - protein, 55 aa, Sorghum bicolor
  unsure (1)..(55): unsure at all Xaa locations
  Clone ID: LIB3481-002-Q6-K1-D6.pep
LNGLXFGDLVITPTTAIPECFTSSLCRLISSLVARPQCYSHLSAISAITLKQCSR

SEQ ID NO: 47964 - protein, 86 aa, Sorghum bicolor
  unsure (1)..(86): unsure at all Xaa locations
  Clone ID: LIB3481-002-Q6-K1-D7.pep
RPASGQHIRKGVXSFFAIDESRFTQTDEVSCTPYFHSSHSWGFFRNRTRLLCRKCSGHIGNAYEDEDPTLCEGSDDLDMSSKSSST

SEQ ID NO: 47965 - protein, 43 aa, Sorghum bicolor
  Clone ID: LIB3481-002-Q6-K1-D8.pep
RRYRFVNTVKEGDEETHAQVSQMYMVAPLDLHFSILYDVLKKH

SEQ ID NO: 47966 - protein, 116 aa, Sorghum bicolor
  unsure (1)..(116): unsure at all Xaa locations
  Clone ID: LIB3481-002-Q6-K1-E1.pep
MVAWWRRKVLPRARRAWAAVAARLRARKPGFHLDTMRSGSGGILKLHEDVQTCGYKDVQVMFDMLTSELEAAAQAQKAPPSPPRKQALPXAWPGRSTIAVAILANSVITETPCPFF

SEQ ID NO: 47967 - protein, 102 aa, Sorghum bicolor
  Clone ID: LIB3481-002-Q6-K1-E4.pep
AVSFSSIIGRVDADILRPKLKKLNSFQDAAKHIKVLLRWPHRKSKRSGSGQKDLDDDASSVDSAKTWSHEETPTPLRQRYSRISSLFNKRTYAGKTLPREAM

SEQ ID NO: 47968 - protein, 53 aa, Sorghum bicolor
  Clone ID: LIB3481-002-Q6-K1-E8.pep
DHGRPATDPSRPRACEPASVSQYASSGVDHQVPRTRSGLAPEPSDAGRPGSGR

SEQ ID NO: 47969 - protein, 84 aa, Sorghum bicolor
  Clone ID: LIB3481-002-Q6-K1-F12.pep
STPRPPTRPPTRPQDTVQTTESGYGRTDPTKQQQEQLPHQKNLLIHSALAQPSALHALLGPCIGRGRANLMADRSRCTTTKLQF

SEQ ID NO: 47970 - protein, 127 aa, Sorghum bicolor
  unsure (1)..(127): unsure at all Xaa locations
  Clone ID: LIB3481-002-Q6-K1-F9.pep
RPGESHAHFIAKSLFEEYLMVEELFSDGIQSDVIETLRHQHSKDLQKVVDIVLSHQGVRNKAKLVTALMEKLVYPNPVAYRDLLVRFSSLNHKRYYKLALKARELLEQTKLXEXRASLARSLSXLGM

SEQ ID NO: 47971 - protein, 53 aa, Sorghum bicolor
  Clone ID: LIB3481-002-Q6-K1-H8.pep
DDAHNLTASLYGNMTPILHLSPLISTNKVHMAVLIVIPYITPPLAVVSKKQRT

SEQ ID NO: 47972 - protein, 58 aa, Sorghum bicolor
  Clone ID: LIB3481-003-Q6-K1-A10.pep
RGGGGVNPYPPFLYTLFYFFFFSFFFIFYFFFSFFFFFFFFFFFFLFFLSFFFFFFFF

SEQ ID NO: 47973 - protein, 53 aa, Sorghum bicolor
  unsure (1)..(53): unsure at all Xaa locations
  Clone ID: LIB3481-003-Q6-K1-A9.pep
SEEAYLRRMXTCVAADGIVINMVVGGEVATLKALEENSGLLIAEMPIHVSEIL

SEQ ID NO: 47974 - protein, 151 aa, Sorghum bicolor
  Clone ID: LIB3481-003-Q6-K1-B2.pep
ASADSVGVDLAEPAESEQEEEEAFATEEDEGAEDDAVEASAAVEDEEVGEYVEPPEEAKVYVGNLPYDVDSERLAQLFEQAGVVEVAEVIYNRETDRSRGFGFVTMSTVEEADKAVEMLHRYDVNGRLLTVNKAAPRGSRVDRPPRHLGLL

SEQ ID NO: 47975 - protein, 70 aa, Sorghum bicolor
  unsure (1)..(70): unsure at all Xaa locations
  Clone ID: LIB3481-003-Q6-K1-C6.pep
IEVLPNKLGHFGXKPRTSRIGKLLALGSENHDGEKWAKHRRILNPASHYYKTKSGPPALSTLRIATIIGF

SEQ ID NO: 47976 - protein, 122 aa, Sorghum bicolor
  unsure (1)..(122): unsure at all Xaa locations
  Clone ID: LIB3481-003-Q6-K1-D2.pep
MSLCCIYLKFCPQKKKKKKKKKKKKKKKKKKKKKKKKKKKKKKKKKKKKKKRGGPIKKKKGXKRGNGRENFLKRGTKNKFVGHLLKTGELEKPWGNQNKYHGAKSPFSQMGKNQKGPPLSPF

SEQ ID NO: 47977 - protein, 52 aa, Sorghum bicolor
  Clone ID: LIB3481-003-Q6-K1-D7.pep
GKKWTLSFSLVWNTLVWLMVVNFIIQIVTSTAQGYLRTQQEPEISKKLETEL

SEQ ID NO: 47978 - protein, 54 aa, Sorghum bicolor
  Clone ID: LIB3481-003-Q6-K1-E1.pep
LYKDGKYEEALENVTVSLGSNTWSHEASLPAQCCLNYSKLGHEEAGLYELKETL

SEQ ID NO: 47979 - protein, 56 aa, Sorghum bicolor
  Clone ID: LIB3481-003-Q6-K1-E8.pep
ILGKCQICPYRNYSLFYHLRMSQPSRFFFPIYCIKLQCICAMVNPVLGLEVVLICY

SEQ ID NO: 47980 - protein, 38 aa, Sorghum bicolor
  Clone ID: LIB3481-003-Q6-K1-F12.pep
RLSFITHIWSSKLPHTQISYHVLAISYARQWVGIISGR

SEQ ID NO: 47981 - protein, 73 aa, Sorghum bicolor
  Clone ID: LIB3481-003-Q6-K1-F3.pep
GYCCTHHHLHWMNQLQFLKLFNYWEAQEYILFSRIVLDTASTVLILNEITIGIISCQSSLTASVTIRDLSHFY

SEQ ID NO: 47982 - protein, 39 aa, Sorghum bicolor
  Clone ID: LIB3481-003-Q6-K1-F7.pep
VRASTSEKGVWVMSLQYDESLLYTRLSEVRLHHRTFHIK

SEQ ID NO: 47983 - protein, 60 aa, Sorghum bicolor
  Clone ID: LIB3481-004-Q6-K1-A10.pep
HKSIIPIRKHSRMFVECFPHYLALSLMSPEESGKLSKSDRFDLRIMMHLCLEKKKKNQPP

SEQ ID NO: 47984 - protein, 56 aa, Sorghum bicolor
  Clone ID: LIB3481-004-Q6-K1-A11.pep
QSLFLCNQLVCSPYEFLVLQSSIPSPRMYESWSVSISQSSNKYFVQVHYMSMEKNQ

SEQ ID NO: 47985 - protein, 140 aa, Sorghum bicolor
  Clone ID: LIB3481-004-Q6-K1-A12.pep
HGKLFIFHDEHTYTAHLVLVGYKRVKDSLPTILPAPTLTVPPVPWLRRLLASFSSSSLPPSHSWLHPRRRRQQQRCSPPPALPTKSGYLPIPPANASLFFAFYEATDPVTPPASTPLLLWLQGGPGCSGLVGNFFELGPD

SEQ ID NO: 47986 - protein, 97 aa, Sorghum bicolor
  Clone ID: LIB3481-004-Q6-K1-A2.pep
RRPDRGDWSGLQHRGLVERYIRLHPADADAGPRRPPLERDLGFPPRLEVASHWSAVQAASGRGAFRLVEANPGLHSTGPGTPEKSGGGGRGVAPKPR

SEQ ID NO: 47987 - protein, 127 aa, Sorghum bicolor
  Clone ID: LIB3481-004-Q6-K1-B2.pep
SGGRLAKFAIHGCDLVTSVGIRRLATALRPTIKEVSILHCRLLDTATCLTALSPIRDRIESLEVSCVWKEVEQPESVANGTTGCDHEDDDLGEVTYESASKKCRYMELDDLVSWEMLRSLFLWVPWE

SEQ ID NO: 47988 - protein, 113 aa, Sorghum bicolor
  unsure (1)..(113): unsure at all Xaa locations
  Clone ID: LIB3481-004-Q6-K1-D9.pep
AVXVVLPVSPAAPPRRLPLXRLPPARRTRRRRHADARQLQLLRGVARQRPQGRQLGPPAAGGALAPGAHGCRCCCAPYAVALAHTHTRTHASTTRSGPLADAGRPGVRTVTAG

SEQ ID NO: 47989 - protein, 56 aa, Sorghum bicolor
  Clone ID: LIB3481-004-Q6-K1-E4.pep
VCFCAVASCVDVPLLPLESFWSPGSMAGVKPGGEGGFRDGERPAGRGATGMRTVRG

SEQ ID NO: 47990 - protein, 126 aa, Sorghum bicolor
  Clone ID: LIB3481-004-Q6-K1-H3.pep
VRCKRHPEHRMSKGVCPYCLRDRLAHLSASSSATTTTRASSTATTSLCSSGGSSPPPHHAAFSADVSSVHVVGAGSSFADVSAFSQPLMPTSANKKKPPPPPTTTTTGRQDDEAAAQPARGKGERK

SEQ ID NO: 47991 - protein, 76 aa, Sorghum bicolor
  unsure (1)..(76): unsure at all Xaa locations
  Clone ID: LIB3481-005-Q6-K1-A1.pep
EGAQAQAAPLLRSASSTTAPLNCTRSTRRRMTRYARAPSQDRGGDRGGGGRGIRRFELPRAPREEDXPQGGRGGLW

SEQ ID NO: 47992 - protein, 51 aa, Sorghum bicolor
  Clone ID: LIB3481-005-Q6-K1-C3.pep
LAGPHPHNSSSLLFYYARHLLSFLPYTNSVNSTPVCLLNTINFKNTVHLKP

SEQ ID NO: 47993 - protein, 75 aa, Sorghum bicolor
  unsure (1)..(75): unsure at all Xaa locations
  Clone ID: LIB3481-005-Q6-K1-D5.pep
DGRITMRMIAAKRKPASSGSHXCGADRVLYLSPFFGEPPCYXLTGELREYYGCDTDGLTEDRETFYYNLELDVIH

SEQ ID NO: 47994 - protein, 83 aa, Sorghum bicolor
  unsure (1)..(83): unsure at all Xaa locations
  Clone ID: LIB3481-005-Q6-K1-F1.pep
RVRESSGAAAAGEPSTTSSFARASTMMSSRAASASASAAAVAVGEHRRQHATVGYGGLPRPIRPVLGAAGPRPGTPRPGXPAP

SEQ ID NO: 47995 - protein, 40 aa, Sorghum bicolor
  Clone ID: LIB3481-005-Q6-K1-F5.pep
PLILSQVIFFLFIAILNPRLGVKVQASILSPGSTGRVVDP

SEQ ID NO: 47996 - protein, 137 aa, Sorghum bicolor
  Clone ID: LIB3481-005-Q6-K1-H1.pep
MASFRRRNGYSGYLKSMAAASSSSSSGGFDGLMNTVIKKKLGIIPKDLNWGDQSDDVFVALEGDFMKPRIEEVDRLLKLGVNVTIYNGQLDLICATKGTMDWVHKLKWDGLNSFLSAPRTPIYCDNEGQSGTRTQAF

SEQ ID NO: 47997 - protein, 73 aa, Sorghum bicolor
  unsure (1)..(73): unsure at all Xaa locations
  Clone ID: LIB3481-005-Q6-K1-H2.pep
CRQSTSSISLAEVFLTHDPFESSLQXKTGQLPKLATQNAPXTRSNLKVDICXEHGGETLSVAFFNKVELDYVS

SEQ ID NO: 47998 - protein, 52 aa, Sorghum bicolor
  Clone ID: LIB3481-005-Q6-K1-H5.pep
NVKAPRVGRRGGWRATRWVLALREKCVMGGCMGWEGTNQEADAWRQDADGPQ

SEQ ID NO: 47999 - protein, 47 aa, Sorghum bicolor
  Clone ID: LIB3481-006-Q6-K1-A1.pep
HHKACIALPQTCFDGLGWSHFARRYYGNGFWFLFVWILRCFTWPGFL

SEQ ID NO: 48000 - protein, 50 aa, Sorghum bicolor
  Clone ID: LIB3481-006-Q6-K1-A2.pep
NFHIPIPNCLSIIDLSVQVVMIVKWAISSSQDWLYLTSYWERNLGRRLSK

SEQ ID NO: 48001 - protein, 62 aa, Sorghum bicolor
  Clone ID: LIB3481-006-Q6-K1-A3.pep
RPHRRRGAPQEWAAARVVDVLPRRQDAAEAGHRGGPIDCRAAFLEVYMFTSGCFQLFFFFLV

SEQ ID NO: 48002 - protein, 51 aa, Sorghum bicolor
  Clone ID: LIB3481-006-Q6-K1-A4.pep
GYGDTIIAFLVIHQGKMICCLSMVERCAFLQTTSRFHHDGCIVRGWLGSSR

SEQ ID NO: 48003 - protein, 28 aa, Sorghum bicolor
  Clone ID: LIB3481-006-Q6-K1-B6.pep
ALAPATKAAARSTKRVEEAAIDDAGLAS

SEQ ID NO: 48004 - protein, 62 aa, Sorghum bicolor
  Clone ID: LIB3481-006-Q6-K1-E1.pep
LSGLYAPSHRRLTIASPAKWSRSVGLSGQAVCLTRPAGGIWVPSKAIKKGKGWAFASRGSVK

SEQ ID NO: 48005 - protein, 90 aa, Sorghum bicolor
  Clone ID: LIB3481-006-Q6-K1-E6.pep
RANPPVRGLFLRFIPGGEFLIVCIPRHLYYWVSQCYTHTTRRKRSGGRYKRGLISLLIVMMWSNPFVRKRGGSKKACSSVLFASKDGRFL

SEQ ID NO: 48006 - protein, 58 aa, Sorghum bicolor
  unsure (1)..(58): unsure at all Xaa locations
  Clone ID: LIB3481-006-Q6-K1-E7.pep
VRLVVLHAYTSNEGRTTTSTRPARLSSSPCSCATPSRCACSYRGLRVRRRCYSCTXLF

SEQ ID NO: 48007 - protein, 95 aa, Sorghum bicolor
  unsure (1)..(95): unsure at all Xaa locations
  Clone ID: LIB3481-006-Q6-K1-E8.pep
PPSFSKIPCGGGWSKYFMGASGRRRVFILLARAEKHIRXWGTIAGGVICAQEAGGHTCHWRGEPWDFAADQTGRIIIYPWGGVLATNCALDDQLV

SEQ ID NO: 48008 - protein, 48 aa, Sorghum bicolor
  Clone ID: LIB3481-006-Q6-K1-F5.pep
RNSPPHQSQNYTASSHLSLLPCFHITVQDLCLCISDTKGLGIYGSTSP

SEQ ID NO: 48009 - protein, 67 aa, Sorghum bicolor
  unsure (1)..(67): unsure at all Xaa locations
  Clone ID: LIB3481-006-Q6-K1-G4.pep
GFQXVISXGLXXSASCPAASSPVREDFLSPRLALSPASQLCCPPLHSQPMVCHELVQPDAGRPGFGR

SEQ ID NO: 48010 - protein, 51 aa, Sorghum bicolor
  unsure (1)..(51): unsure at all Xaa locations
  Clone ID: LIB3481-006-Q6-K1-G6.pep
WLEDIIYNFGCLAAGQASKDTCLLFSSQAVVAGDRWRQVRGGDKVHAXTSE

SEQ ID NO: 48011 - protein, 66 aa, Sorghum bicolor
  Clone ID: LIB3481-006-Q6-K1-H1.pep
PSARLRDLTKEVAAAVVREAVAEDLAEGYRDMDAHELARLSEEETIEYVKTNMWSPVYPTIIYKKD

SEQ ID NO: 48012 - protein, 97 aa, Sorghum bicolor
  unsure (1)..(97): unsure at all Xaa locations
  Clone ID: LIB3481-006-Q6-K1-H2.pep
CVTVRIPGRPAXLAAIDKFDAMLSRSNTYAPEALYRWGTALQQRSYLRPRNSRDKVRLLEQAKSLFEDVLYVEADNKMVREALSSCISELNYHGRWL

SEQ ID NO: 48013 - protein, 132 aa, Sorghum bicolor
  unsure (1)..(132): unsure at all Xaa locations
  Clone ID: LIB3481-006-Q6-K1-H5.pep
PGRPRVREVPPQDFSKRVLEGFQVTPIWHQGFIRDDGRSKYVPNVQTARWEYSTRPVYGWGDVKSKQLSTAGWLAAFPFFEPHWQICMAGGLSTGWIEWDGERFEFENAPSYSXKNWGGGFPRKGYXVLLLK

SEQ ID NO: 48014 - protein, 82 aa, Sorghum bicolor
  unsure (1)..(82): unsure at all Xaa locations
  Clone ID: LIB3481-006-Q6-K1-H6.pep
WLMRALVFPRPDRRRSLCTALAVRRVVLRGREEGTYLPGLGDGGPRRGPGRYTTISSPIGKRVGKVLLLRSKXSLHSLYTLD

SEQ ID NO: 48015 - protein, 51 aa, Sorghum bicolor
  Clone ID: LIB3481-007-Q6-K1-A4.pep
NVHYSRQTHRLKIALKIKWSAKLMTMALAQLETRWGMGARYCRHACFLSGV

SEQ ID NO: 48016 - protein, 65 aa, Sorghum bicolor
  Clone ID: LIB3481-007-Q6-K1-A7.pep
WSTRRGTTRERPYAWTLCAHLGLPCCYDGLLWWINLRIKLTFEKSLTVGMDSGIVQWELCSIEMR

SEQ ID NO: 48017 - protein, 62 aa, Sorghum bicolor
  unsure (1)..(62): unsure at all Xaa locations
  Clone ID: LIB3481-007-Q6-K1-A9.pep
PPLKKKTTMSYYVPNFCGLXCHLIENIFFHCAVHIAANVTDIGVDFVVPTPPARLHAHHHRT

SEQ ID NO: 48018 - protein, 60 aa, Sorghum bicolor
  Clone ID: LIB3481-007-Q6-K1-B3.pep
ASSCYTLCTRAPFSAFSSHASPRMPWHVRVSHLGPPQTTPSYLKKIKKKKKKKKKKKKRT

SEQ ID NO: 48019 - protein, 97 aa, Sorghum bicolor
  unsure (1)..(97): unsure at all Xaa locations
  Clone ID: LIB3481-007-Q6-K1-C5.pep
VRAMVGFMYALSLSRRNGDGGLLXQAVNGSGLTCFAATGRXLSVATIVPLLKGDSAEDRSDASMSADTKLWNGRFVMLGLVMLIFTEYLTDALNINT

SEQ ID NO: 48020 - protein, 85 aa, Sorghum bicolor
  Clone ID: LIB3481-007-Q6-K1-C7.pep
RCGPETRHRIIASKLCMQALYATLIPTDDIDGWNTRGGSTTEGPCAWPLCAHLGRTCCNDGLLGWINSRIRITVEKSLAVGRDFG

SEQ ID NO: 48021 - protein, 169 aa, Sorghum bicolor
  Clone ID: LIB3481-007-Q6-K1-D3.pep
MRPQRSLKEKKRDCAAAALQRRQQMLLTRLPSSSTAQQRHACAGKSHLRGAAAACWRKREKLPGLRAVKPPRAAPGKGGIVPASDDDDGVSLGTVKLPGNIDIARFESLLFQWGNSLCQGANLPLPVPLKVDKVEGGIRLGFIAVDNGATQTLVYIDCLVSPAPDGSGL

SEQ ID NO: 48022 - protein, 135 aa, Sorghum bicolor
  unsure (1)..(135): unsure at all Xaa locations
  Clone ID: LIB3481-007-Q6-K1-E5.pep
VRGTRRFRSSEAWTSQPPDQHPKVRTRQEHATDPHNLAYSLMKDIIATRXRCHLXELVRNTNPTYRAPLLDXILAYSKLICRGTSEXFMSLEANSGTCWCMVHSLGDNIPFSANARSCYSASTXHIWEKWSTAGT

SEQ ID NO: 48023 - protein, 114 aa, Sorghum bicolor
  Clone ID: LIB3481-007-Q6-K1-E7.pep
RPPTRPGFRKQDFRVQVDGAGRLTVRGQRSDAATNPRHSRFSKVFQLPSTSNLDDIAGRFDAGVLTLTVPKRLPASQQQVRQDQDQAAAKQQEKAKAPPKDDTVAKDEADAHRQ

SEQ ID NO: 48024 - protein, 169 aa, Sorghum bicolor
  unsure (1)..(169): unsure at all Xaa locations
  Clone ID: LIB3481-007-Q6-K1-G9.pep
VRPCMHICIDSYDDCSYXSDIRSEMLXAGRRFYEKECLTALPIANIDQTLVQTVVERVRSTMPHSDPRPXHASSDALSVALMMALMEALIEKVHSYCQIIYESLIESVDXSNHSMHARVRAFMVDNWSTTGXLGSKVXSPHWDHILTHLATETADETAPINQHLIHDFM

SEQ ID NO: 48025 - protein, 92 aa, Sorghum bicolor
  unsure (1)..(92): unsure at all Xaa locations
  Clone ID: LIB3481-007-Q6-K1-H1.pep
LTIRQGLGVGGXGPPTGFDVRHSEXGMFYNGWILGVEGMKVGXQKLIIVPPELAYGKKGVQEIPPNATIELDVELLSIKQSPFGTPVKIIEG

SEQ ID NO: 48026 - protein, 67 aa, Sorghum bicolor
  Clone ID: LIB3481-007-Q6-K1-H2.pep
SSASGGYCINKPWHKGFVCNNKHCMELSAECVLGYFQYWAQHQSRSCTLNKDSGWLLVPTRNNVKLM

SEQ ID NO: 48027 - protein, 145 aa, Sorghum bicolor
  unsure (1)..(145): unsure at all Xaa locations
  Clone ID: LIB3481-008-Q6-K1-A1.pep
SDPRARSASPGSGGHXRSSRQQPLRSDLLPPPTCXCRARSWSSSXSNVNFGRGDDADEKLEDLLKQHGXVEFSLCGPAFTTDEADDDAVCLSFAVWMAKATRDIKATDIAVLWVNRLSXWTTFFIILTALLYAQIDALXAKMRDI

SEQ ID NO: 48028 - protein, 85 aa, Sorghum bicolor
  Clone ID: LIB3481-008-Q6-K1-B3.pep
RPKNFKKKKKGRDDLKRYQTNKHSSMRHNRVLSILSFLAFAGRRSYGEVLVWAPLFPIHCPLFNTPLFGTPVGFPKLTALGLVFF

SEQ ID NO: 48029 - protein, 109 aa, Sorghum bicolor
  unsure (1)..(109): unsure at all Xaa locations
  Clone ID: LIB3481-008-Q6-K1-C7.pep
LRTVRFPVAHASDVPSSHNWTSDVNRTEYQLIDISEDGFVSLLTXDGNXKDDLXLPTDETLVAQIKEGFGVGRILCDCQSVWGRSXICALKDLAPVTSLPWKTELPDLK

SEQ ID NO: 48030 - protein, 48 aa, Sorghum bicolor
  Clone ID: LIB3481-008-Q6-K1-C8.pep
YHTTTATRYSRECLDELVKDSNLYDFFFYLFNGLVVVHAVTKEKKSAG

SEQ ID NO: 48031 - protein, 83 aa, Sorghum bicolor
  unsure (1)..(83): unsure at all Xaa locations
  Clone ID: LIB3481-008-Q6-K1-D5.pep
FPSGPFXVDIAFXXSLGGLVDTTASIPKMRVERASGPLISRSDGDACRRKLVGLLQARKSTVCISCSTDAGGRGATGMRTVPR

SEQ ID NO: 48032 - protein, 58 aa, Sorghum bicolor
  unsure (1)..(58): unsure at all Xaa locations
  Clone ID: LIB3481-008-Q6-K1-D7.pep
TFTSLPCIPFGPVLLVEYAXTVFKSLLTNKHVSTIVLKRNTIVNTNKRYTDKFQETLS

SEQ ID NO: 48033 - protein, 92 aa, Sorghum bicolor
  unsure (1)..(92): unsure at all Xaa locations
  Clone ID: LIB3481-008-Q6-K1-E6.pep
APLCSPSERQLPSGSPPAGRLAVYFHSRLGPEGPRHRXVQVNVPTGCVASPQMGPCKMHKSPIRISAFMLLPRQLTRHSVCVVPAAGRGATG

SEQ ID NO: 48034 - protein, 57 aa, Sorghum bicolor
  unsure (1)..(57): unsure at all Xaa locations
  Clone ID: LIB3481-008-Q6-K1-F6.pep
PPRVRPRVRPTRAQPSSTNDPFGLRRVSYGLVQILVENKKSFDXRRALTLLAGXQPI

SEQ ID NO: 48035 - protein, 113 aa, Sorghum bicolor
  Clone ID: LIB3481-008-Q6-K1-F8.pep
RPVKHGARVVIADIDDAAGEALASALGPQVSFVRCDVSVEEDVARAVEWALSRHGGRLDVYCNNAGVLGRQTRAAKSILSFDAGEFDRVLRVNALGAALGMKHAALAMAPRRA

SEQ ID NO: 48036 - protein, 43 aa, Sorghum bicolor
  Clone ID: LIB3481-008-Q6-K1-G7.pep
KKHVLVQSLHSQLDILRHIFVYVFFFFFFLLFFFILISFSHIY

SEQ ID NO: 48037 - protein, 51 aa, Sorghum bicolor
  Clone ID: LIB3481-009-Q6-K1-A11.pep
AHLGPSLAHDLPFAALIRAVSATSISAMEVGSRLSYASTHERGHILQAERT

SEQ ID NO: 48038 - protein, 75 aa, Sorghum bicolor
  Clone ID: LIB3481-009-Q6-K1-A7.pep
RPHKVGFCRVRVPFSSFRPVNPQDPPLDPFLVHTLTIRFEPKKQRPGDSSEGASDQRNFELKMEFIKALPSGQET

SEQ ID NO: 48039 - protein, 85 aa, Sorghum bicolor
  Clone ID: LIB3481-009-Q6-K1-B11.pep
AVGSELSCGIITRLVALCARASDILVRSPSIGMTIGRKRVTEDIFCLISLLQTLGSLPIGYRLLESIPTATRVGHSQIAIRSTSH

SEQ ID NO: 48040 - protein, 83 aa, Sorghum bicolor
  unsure (1)..(83): unsure at all Xaa locations
  Clone ID: LIB3481-009-Q6-K1-B6.pep
MTDXDQTGXRRKIHCGCTIGRYEPLVTLGSHPPPTSPRPFTSPCQPPGSRGPPPGPTGRSHVTRRLPSRSGGGRPGSTDAGDG

SEQ ID NO: 48041 - protein, 191 aa, Sorghum bicolor
  unsure (1)..(191): unsure at all Xaa locations
  Clone ID: LIB3481-009-Q6-K1-C12.pep
VRGKPVPVTVVGFREXGGNVVTQVKTAVTDGYHAVQVGYHGVREDXLTRPELGHLGEAGAPPLKQLQEFRLTAVDAFEPGQPLDFADLLKEGDIIDVSGDTIGKGFQGGIXRHNFKRGLMTHGSKSHRQLGSIGAGTTPGRVYKGKKMPGRMGGKKTKIRKLKIVKIDNDLRVLMIKGAVPGKPGNLLRIT

SEQ ID NO: 48042 - protein, 182 aa, Sorghum bicolor
  Clone ID: LIB3481-009-Q6-K1-C8.pep
VSFAVWRFFNRLLTKLKDGTVSQAHISVSSKVDELFMMIQYGSRLLHWWSIDEDSKEEQAHLCYANNIGYSTFCSYPPEVVKEMPKEVLVKEVQRLQLALEEQTEMANHSQQQCDSLRNERILCRICFERDICIVMLPCRHHVLCEPCSNKCQSCPICRLTVESRLSVYDTVISANPLWDAV

SEQ ID NO: 48043 - protein, 93 aa, Sorghum bicolor
  Clone ID: LIB3481-009-Q6-K1-D4.pep
TAYKGICTDATIMSLSILSPRTITLQYENWLSSQHLWLVLLSHCYDFAYLAVCNPLVLDWRSLPSVEGIQDCVLVPVFAKNLLGACSTLFART

SEQ ID NO: 48044 - protein, 54 aa, Sorghum bicolor
  Clone ID: LIB3481-009-Q6-K1-D6.pep
RPPSVRRLQNLLFFLVRSSPNPFFVHLVLPLVDSSRWPGLVRSGRTGSRWWSSR

SEQ ID NO: 48045 - protein, 105 aa, Sorghum bicolor
  Clone ID: LIB3481-009-Q6-K1-D9.pep
STCPACGSGVFVVNVGDVLEIFTNGRYRSVEHRAVVNAHTERLSVAAFHSPSIHATIGPLPELLGDQEAPKYKTLDHQSFITLFFSAKLQGKSFLERMKKKKLSD

SEQ ID NO: 48046 - protein, 40 aa, Sorghum bicolor
  unsure (1)..(40): unsure at all Xaa locations
  Clone ID: LIB3481-009-Q6-K1-E1.pep
GHFSFFSXTHPCRLMTINNAQRILKSPPSYNTLIVRVTIH

SEQ ID NO: 48047 - protein, 137 aa, Sorghum bicolor
  Clone ID: LIB3481-009-Q6-K1-E12.pep
MHRKRMLEEFLQRSRCGKVGTIKMIITTNNRRVANIVGTVEPIKLMPLPCPEYWFFFKAHAFAGRDIEENPRLMSTGKAIAKKLNGSFFGAKIIGGVLRDHPDPRLWCKVMSSSIGGMSPLGDGISYISDLADSLLP

SEQ ID NO: 48048 - protein, 30 aa, Sorghum bicolor
  Clone ID: LIB3481-009-Q6-K1-F4.pep
KVACIYSYYFQLSINWIIITRMVILLPLIV

SEQ ID NO: 48049 - protein, 54 aa, Sorghum bicolor
  unsure (1)..(54): unsure at all Xaa locations
  Clone ID: LIB3481-009-Q6-K1-G12.pep
PETAADRALRLKAKLAARGLRTSVHGVLLVELFDHPHLLLLQVRNSXFLLPXGL

SEQ ID NO: 48050 - protein, 67 aa, Sorghum bicolor
  unsure (1)..(67): unsure at all Xaa locations
  Clone ID: LIB3481-009-Q6-K1-G5.pep
SDSMIMIFVRTCESTRLLALMLRNLGLKAMSISGQMSQDKRLGALNRFKAKDCNILICTDVARXXLD

SEQ ID NO: 48051 - protein, 54 aa, Sorghum bicolor
  unsure (1)..(54): unsure at all Xaa locations
  Clone ID: LIB3481-009-Q6-K1-H4.pep
FLWQNKDXKGSRNCIFAYFSEGKCQSTHGLAYLLKPVHMHEASHYVKHICFLKS

SEQ ID NO: 48052 - protein, 103 aa, Sorghum bicolor
  Clone ID: LIB3481-009-Q6-K1-H5.pep
SAHASDLAEKTDMGRLASPSLLKLVYDSARPNGKTSEGRLSTEIWNEIEQLLEKVSVWFADPSKLACFLIMDPRRSISVSSALRYWGCTTQAGGQICGGFGYT

SEQ ID NO: 48053 - protein, 37 aa, Sorghum bicolor
  unsure (1)..(37): unsure at all Xaa locations
  Clone ID: LIB3481-010-Q6-K1-A11.pep
IWXSPDXXLFXTPXSIXSLXTPFLLSGCXGIHSKPGR

SEQ ID NO: 48054 - protein, 85 aa, Sorghum bicolor
  unsure (1)..(85): unsure at all Xaa locations
  Clone ID: LIB3481-010-Q6-K1-A2.pep
VRNLLAVVNTKLLRDYAQIDRRLRQLAFIVKHWAKIRRVNETYQGTLSSYAYVIMCIFXLQVGRILXCVQEMEATYYVGGDENNC

SEQ ID NO: 48055 - protein, 59 aa, Sorghum bicolor
  Clone ID: LIB3481-010-Q6-K1-B12.pep
TRKYEYEVLKILPGYETALEKVCSTNDHICSIWAFAIPVFLRIGEHLIERYFHTFARRT

SEQ ID NO: 48056 - protein, 149 aa, Sorghum bicolor
  unsure (1)..(149): unsure at all Xaa locations
  Clone ID: LIB3481-010-Q6-K1-C11.pep
SAHAYDQKIHRCRXQGDVIALPAGVAHWCYNDGEVPVVAIYVTDINNGANQLDPRQRDFLLAGNKRNPQAYRREVEEWSQNIFSGFSTELLSEAFGISNQVARQLQRQNDQRGEIVRVERGLSLLHPYASWQEQEPGLVPSGEHHQYGG

SEQ ID NO: 48057 - protein, 56 aa, Sorghum bicolor
  unsure (1)..(56): unsure at all Xaa locations
  Clone ID: LIB3481-010-Q6-K1-D4.pep
CEYITSAPVVCMAXEGNGVVASSRKLIGAANPLQADPPTIRGDLPVHTGWNVVHRS

SEQ ID NO: 48058 - protein, 88 aa, Sorghum bicolor
  unsure (1)..(88): unsure at all Xaa locations
  Clone ID: LIB3481-010-Q6-K1-D7.pep
THRNLDLTQHNEQGDRYXRDSAHRVDEALGFMFGXMGVTXVDHPLMTCTDLWTLHDCLLVRYEQCLTCQDSTNGHFYDCCAHMLWVVQ

SEQ ID NO: 48059 - protein, 173 aa, Sorghum bicolor
  unsure (1)..(173): unsure at all Xaa locations
  Clone ID: LIB3481-010-Q6-K1-D8.pep
SAHVSAHASGGSAHLYQAGGRKPWHSINFVCAHDGFTLADLVTYNKKYNSSNGEDNRDGENHNLSWNCGEEGEFAGLSVKRLRKRQMRNFFVSLMVSQGVPMFYMGDEYGHTKGGNINTYCHDHYVNYLRWDKKEESSDLQRFFSLMTKFRXQCESLGLTYFATAXRLHWHGH

SEQ ID NO: 48060 - protein, 107 aa, Sorghum bicolor
  Clone ID: LIB3481-010-Q6-K1-E8.pep
LCHGSMAQLFGPNVNPWHNPRQGGFRECRFDRLQAFEPLRRVRSEAGVTEYFDEKNEQFQCTGTFVIRRVIEPQGLLVPRYSNTPGMVYIIQGRGFMGLTFPGLPAT

SEQ ID NO: 48061 - protein, 124 aa, Sorghum bicolor
  unsure (1)..(124): unsure at all Xaa locations
  Clone ID: LIB3481-010-Q6-K1-F8.pep
KEGKKNMKXCNMKNIESQDDFDKQLLLASDKLTVVHFFSPSCGAGXAXXPMVCQLAGMHPELAFLMVNSNEQKEMCRXLNVHVLPMFRFYRGAEGRICSFSCTISTIYKIKDALKRDGVQLENL

SEQ ID NO: 48062 - protein, 41 aa, Sorghum bicolor
  Clone ID: LIB3481-010-Q6-K1-F9.pep
VRGILTRHDFMPEHILGLHPFLFKSRWKKVRLGKVKVADIF

SEQ ID NO: 48063 - protein, 102 aa, Sorghum bicolor
  Clone ID: LIB3481-010-Q6-K1-G10.pep
MEGYDREFYQFSDQLRLQTASFSGLSLGDSIWSSPSEVWGEPAFDGEYHHFSSPCPWKNAIANINGVAGNLDGPDLIGSGKLESSALVSLADGDTYPGDLAL

SEQ ID NO: 48064 - protein, 73 aa, Sorghum bicolor
  unsure (1)..(73): unsure at all Xaa locations
  Clone ID: LIB3481-010-Q6-K1-G6.pep
PPKGDPPLAXSFKTHRSKGXGCSSXQLNXQGXXXRSLFXXRXLVSLVNIXYFKLVVRRFXTRGRTRGRTRGRP

SEQ ID NO: 48065 - protein, 100 aa, Sorghum bicolor
  unsure (1)..(100): unsure at all Xaa locations
  Clone ID: LIB3481-010-Q6-K1-G9.pep
SRSTRVRDSSVPRSCPISSDRLPVQAERSSTVSGACGERFLLICIARAAHIFGKLGRLAKPCILCLTXLICEYAVCGEMXIXPCXDMHTXDHANYEWTYI

SEQ ID NO: 48066 - protein, 29 aa, Sorghum bicolor
  Clone ID: LIB3481-011-Q6-K1-A2.pep
YVPVTRSSALTACMLQGFSYFQLTSNPFA

SEQ ID NO: 48067 - protein, 189 aa, Sorghum bicolor
  Clone ID: LIB3481-011-Q6-K1-C12.pep
VRGRVGECLSSNIQSETKQNDTLPSACRFKFEDITASSLVLVLKEAVSSQYHTIKGYKLWYWNSREAPYTGEPAVFPKDQRRILISNLQPCTEYSFRIISFTEDGELGHSESKIFTKSVEIIHKNTEHGAEGCSSSAKRVGKRQNVRSLGFQVRQLGNVFRKAQTEENGYPNALCKDEIEDSCDQSDSL

SEQ ID NO: 48068 - protein, 88 aa, Sorghum bicolor
  unsure (1)..(88): unsure at all Xaa locations
  Clone ID: LIB3481-011-Q6-K1-C5.pep
RPQLVIIGACGDDXQGVLFVSNMSFSGVDLTRLRTKKGHTAQCACLVDASGNRTMRPCLSSAGELQANEFKKEDFKGSKCSAVRYARQ

SEQ ID NO: 48069 - protein, 79 aa, Sorghum bicolor
  Clone ID: LIB3481-011-Q6-K1-D1.pep
FLQDSHHKESGQEQDGDVRSSQNGASRSPSEGKLNQAMTIVPMPSSGPVTGPTTNLNIGMDYWANTASSAPAIHGKVTP

SEQ ID NO: 48070 - protein, 108 aa, Sorghum bicolor
  unsure (1)..(108): unsure at all Xaa locations
  Clone ID: LIB3481-011-Q6-K1-D12.pep
KREKKEIKKKERKKERERKREGKKKKRRKKRREKKKREKGKKITRKSRKKERSMKKQREKRRIRKDKTKKKKKKDKVKKKXRKKKIKRKKKEEKYNGQEKKEKRRKTE

SEQ ID NO: 48071 - protein, 161 aa, Sorghum bicolor
  Clone ID: LIB3481-011-Q6-K1-D3.pep
SRSNTECFFSPVSQVTAHEIMLWCIKDAQDLIRKTPPPPLPGSDLTKLLAEYETLSKCAETESIEIFAGTGNFLKLQVKTWQNYGETVKGGGIEAAQDVTCTVRSACVDHVIRHRLLSRFGLKMDNMPEDPIEHDMAAAMMYSADFTKDRRGRYRRELKWI

SEQ ID NO: 48072 - protein, 151 aa, Sorghum bicolor
  unsure (1)..(151): unsure at all Xaa locations
  Clone ID: LIB3481-011-Q6-K1-D5.pep
SGSQLVHSRVDRARAGQAAGSAGIGITVTALPFPCAEAGLPAGCERLDHVPSVDLVPNFFDAXRRPSCIVAGMCNTWAHGVARELGVPCFIFHGFGAFALLCCEYLXTHKPHEGKSLDEAIDXPVLPXAXELKFARRQLPLQFPAFVPQFR

SEQ ID NO: 48073 - protein, 87 aa, Sorghum bicolor
  unsure (1)..(87): unsure at all Xaa locations
  Clone ID: LIB3481-011-Q6-K1-D9.pep
ASGYCGPEVDWLRTGDLLLDGYTMSYFSGRIPIXTLVVDVIAEIALMSSAXEYYRIIKGLDLEDGLHPGGALYPLRLISKHARPCHL

SEQ ID NO: 48074 - protein, 123 aa, Sorghum bicolor
  Clone ID: LIB3481-011-Q6-K1-E6.pep
MYPAAGYAVPQVQPVLPDSDPTNTTIFIGNLDQNVTEDELRQICVQFGELIYVKIPANKACGFVQYASRASAEEAVQRLHGTTIGQQVVRLSWGRSPASKLDQSAVWSQHADSNHWAGAYYGY

SEQ ID NO: 48075 - protein, 50 aa, Sorghum bicolor
  unsure (1)..(50): unsure at all Xaa locations
  Clone ID: LIB3481-011-Q6-K1-F12.pep
MYQKKILDGATFTVPSGKSVAIVGSSGXGKSTILRLLFRFFDSTSGSVRI

SEQ ID NO: 48076 - protein, 145 aa, Sorghum bicolor
  Clone ID: LIB3481-011-Q6-K1-F5.pep
VRQTEVVESLLFEMQDLGIRPSAGSYNCLISAYGRQKKMSGKAEDAFLRMKREGIKPLSSSYNALLFAYAVNGLHEKAHTIYVDMKREGLKPTLETYTALLNTLRRAGDTEKLMETWKTMIDEKVGGTRVIFHVVLDCLAKHGLY

SEQ ID NO: 48077 - protein, 166 aa, Sorghum bicolor
  unsure (1)..(166): unsure at all Xaa locations
  Clone ID: LIB3481-011-Q6-K1-F7.pep
RPDAVCFPLTLFSSLFEPGWSSGSSAVSIKGLLSLLVEGGADNVNQCFLEAARFGSTELVRILLEVAYQNSLAVDTELALVYASHYCKFNTMECLVDEGNVNSFLSPLIKAAERGCLQVVHWFVSRGISEIEMCLALTTAASSGHFMVASYLLAHIPQXILEALST

SEQ ID NO: 48078 - protein, 62 aa, Sorghum bicolor
  Clone ID: LIB3481-011-Q6-K1-F8.pep
VRWVLCRLHYGPKITVPRSLRWASCGAISMSLTSALLVRSFSPECEPQNIIAAYDKPQRKTE

SEQ ID NO: 48079 - protein, 110 aa, Sorghum bicolor
  Clone ID: LIB3481-011-Q6-K1-G10.pep
SALPVSADGRETPQSNKVRSVVGRLAVQAAQRGLRVYLQDEYGTSTDALEYMISRGVKKSARDTQSDAYAAVMILKRYFTSSGQGAKIVLPRQPELQDKLIVQSRQDAEI

SEQ ID NO: 48080 - protein, 85 aa, Sorghum bicolor
  Clone ID: LIB3481-011-Q6-K1-H12.pep
ASPRPSSSSPEITGRSIKCFLVPRPPSEGLLVVSSTLPLQQTTPGSQPQGEASPTATTERQETNVVAIESIIRSCGIPLHVRDLL

SEQ ID NO: 48081 - protein, 137 aa, Sorghum bicolor
  unsure (1)..(137): unsure at all Xaa locations
  Clone ID: LIB3481-011-Q6-K1-H5.pep
GXWHNIYXXXHAYCMAHXXSSQPQQPAGRRCMQAMNSSSDRRSLVVTEVAVVRPAALLGLLLLLQCGGGGGGGAGGEGAQLAAVVAVVGVRWPTAARVVVSVHPPAAVHVLAGVVAVVGVGPAGVEKLGHLGEFAPD

SEQ ID NO: 48082 - protein, 75 aa, Sorghum bicolor
  Clone ID: LIB3481-011-Q6-K1-H6.pep
NRIYEGARGLHPEDSSLHLSCWLAIPRIKNTPMLGSQPGTHARNIAAMRHVLALSIASSTDVAYSRDLYILSKCR

SEQ ID NO: 48083 - protein, 120 aa, Sorghum bicolor
  Clone ID: LIB3481-012-Q6-K1-A8.pep
APRPGIGLSYHVLNRKMECQACTISDSATADTGDSHTCGIGAETHLYGTARAGVASYEEHTEKGGRESTGYRISYEGYSSLDLGTCAVHNEPILDYARICLLIGGLSEACAKRCCGLQYG

SEQ ID NO: 48084 - protein, 56 aa, Sorghum bicolor
  unsure (1)..(56): unsure at all Xaa locations
  Clone ID: LIB3481-012-Q6-K1-B11.pep
HKAPVPITLFRYXRQCSSTNTTHQHXKQILXTRHANTTRSITLVLITIQEEQLHQA

SEQ ID NO: 48085 - protein, 107 aa, Sorghum bicolor
  Clone ID: LIB3481-012-Q6-K1-B4.pep
VRGRCGKKKKKKKKKKKKKKKKKKKKKKKKRADSFKGSKLYMGGPSLKVPVLFGRPSHFYCFFWGPLFSFKSPAFPNLGAGKPLGFRKLLGLPKMPFLLAVVILKGP

SEQ ID NO: 48086 - protein, 87 aa, Sorghum bicolor
  unsure (1)..(87): unsure at all Xaa locations
  Clone ID: LIB3481-012-Q6-K1-B9.pep
MVFSVIQPGRFSNSLVQSDFIAKILGRSEAPLTYRRTKAGYPDKFGVNFAVGGAGVFEVPREAPTLARQIDDXEKMXDDRTGKWQLR

SEQ ID NO: 48087 - protein, 54 aa, Sorghum bicolor
  unsure (1)..(54): unsure at all Xaa locations
  Clone ID: LIB3481-012-Q6-K1-C2.pep
SDKGGPSQENTHTHTQGNSLHSPHHTTTXSTXLSLNPIHFFIIKLPPFIXLNYN

SEQ ID NO: 48088 - protein, 77 aa, Sorghum bicolor
  Clone ID: LIB3481-012-Q6-K1-C5.pep
MNVFIKTFFFTFQKQVVIPLHQLRAANPSVSKVNSAEKYIQVVSVEGHEFWFMGFLMYDKAAASLQEALATARELQP

SEQ ID NO: 48089 - protein, 118 aa, Sorghum bicolor
  Clone ID: LIB3481-012-Q6-K1-C6.pep
IFFANSGESFGSKMGSFFEFPRELFGADQFGIQAGFFFFGTTHLPRLIFASTGDFWGNFFPISLPTGFLQHNPFGVFYPKGGGQLFNFSSKRGPPTWLILKGGFCGKLWGNPYLFLFF

SEQ ID NO: 48090 - protein, 66 aa, Sorghum bicolor
  Clone ID: LIB3481-012-Q6-K1-D6.pep
PSRPHPPSCRTTLLASGSSRHAAESGRPGSAWPPCEAPGGWRVVSRPSAQASISFARVDRIGRTAG

SEQ ID NO: 48091 - protein, 85 aa, Sorghum bicolor
  unsure (1)..(85): unsure at all Xaa locations
  Clone ID: LIB3481-012-Q6-K1-E10.pep
VXRXRRPGRGRGLFRFHVPRRGACPPESQGEPPQLRRYLQAGESRSPFDCRACSLNCQLLCVRFNFLHHACLVSPVTIFNSCVTN

SEQ ID NO: 48092 - protein, 133 aa, Sorghum bicolor
  unsure (1)..(133): unsure at all Xaa locations
  Clone ID: LIB3481-012-Q6-K1-E6.pep
RPLHNFTGLVPRQSRRFTTPRGLRRIQVLTFERDWGYTDLSNAIELVCAPEELGGDNGTFSTYGGADQIQGLASQVMETLDTINVAGRKVTPXNGTLGRTWDNDEKLLVDADWGNYKGWPFNGGRVIKMVERA

SEQ ID NO: 48093 - protein, 118 aa, Sorghum bicolor
  Clone ID: LIB3481-012-Q6-K1-F2.pep
RPRRGSARCRAAAANAEAAASTNQCSLILKGCSSSMEKVYAVNSPHKKRKSQYELSDPKLVPLKCKFRKRLSCHDDESATTESLGYDCIFMNKTSGTDMVSIPEELDSWENTMSLFGG

SEQ ID NO: 48094 - protein, 65 aa, Sorghum bicolor
  unsure (1)..(65): unsure at all Xaa locations
  Clone ID: LIB3481-012-Q6-K1-F7.pep
RPEGLLAFNCIHLCSTVXLEDNSITGTIPAEIGKLSGLKKLDLSSNHLYGEIPSSLFYLESLRYM

SEQ ID NO: 48095 - protein, 153 aa, Sorghum bicolor
  Clone ID: LIB3481-012-Q6-K1-H9.pep
LAIHPVAFRRAWRRTCCRLPTTRRQSAQPPNRRGCTLMSSHTREIHIQRFDLEGACSWMSGICGPHRLATSTPERLRFHHSANVFKSRATTLGVIEYGTDVTIDIEDAEHFSSYSLSLPLVGEQELSKNGERLSFHRDQGVILSPNSIRCWRF

SEQ ID NO: 48096 - protein, 34 aa, Sorghum bicolor
  Clone ID: LIB3481-013-P1-K1-A1.pep
IVDFVCTPGHAPVVGTTGRCQYGAARSARCNHGR

SEQ ID NO: 48097 - protein, 126 aa, Sorghum bicolor
  unsure (1)..(126): unsure at all Xaa locations
  Clone ID: LIB3481-013-P1-K1-A4.pep
SQRNAEGAYTLSTMIVDAHELVLFLANYHRMYRQPYSMHLLLGNCMFGRQMEAQYVIDFLLHTQPPGGVKEPVXVLPIVGPSAVGKTTLVAHVFKDERVRDHFTETVFLSNHDFAYDGLAAFREGL

SEQ ID NO: 48098 - protein, 70 aa, Sorghum bicolor
  Clone ID: LIB3481-013-P1-K1-A7.pep
RDRYAWARTLAATSRCGGPSGHCLGIAIAMGYAVTWVSYARLSQHARQVHGGRQSYAGVTNKSQLDQSEV

SEQ ID NO: 48099 - protein, 104 aa, Sorghum bicolor
  Clone ID: LIB3481-013-P1-K1-A8.pep
KYEKSPHYKTYSMSINIQWPSYGHTMRQHISTINMKNCIILMLHHRKKVHSISSQTSAKFAAESLECWHSRTSKQKKQRRSQMHWSSLSYQMPNIKSITLVTGR

SEQ ID NO: 48100 - protein, 94 aa, Sorghum bicolor
  unsure (1)..(94): unsure at all Xaa locations
  Clone ID: LIB3481-013-P1-K1-B1.pep
MADGDAGTELAETYVLLHMYTPAAFSDEELILVQPTIPLYHIAYAVVLYTMVGLDILRTAQKYCAXTIQLTGGMNTRAFCGDSCARLQSFGLPT

SEQ ID NO: 48101 - protein, 125 aa, Sorghum bicolor
  Clone ID: LIB3481-013-P1-K1-B2.pep
VRLQQDTYLALATAFVILRLLYHLYPKINSFARWAWRRHNLFSNLMGAHEYFLTYLEQARQKFHRLYPSSSKRGNLQEGAMNATAWASKSLASVSIGEPSAIGRTNSTSEARMKCITFCPQGIYV

SEQ ID NO: 48102 - protein, 44 aa, Sorghum bicolor
  Clone ID: LIB3481-013-P1-K1-B9.pep
REPPWNVISFMSYAHKYVPGDRPALLYLHSQSRLSTSACISGRT

SEQ ID NO: 48103 - protein, 107 aa, Sorghum bicolor
  Clone ID: LIB3481-013-P1-K1-C5.pep
LFLPLLAGVAVAILRRLLCFRNTESVEVICLISTVTQDVLYHRLCHTAGRGIGNMCSIRDDCPSAHHINVLFSLATDVVVLVEHSVVCAVLGTSCPSLHILYAPSSG

SEQ ID NO: 48104 - protein, 86 aa, Sorghum bicolor
  Clone ID: LIB3481-013-P1-K1-C7.pep
HIHLLLSAESTTCIRHLQLYLQSIMVHVTCIVTVNSGQQSIYALTWSHSGSHDINAWCARWIILSAALLLVTACVHLAHRSRASCV

SEQ ID NO: 48105 - protein, 65 aa, Sorghum bicolor
  Clone ID: LIB3481-013-P1-K1-C9.pep
ASADTWANSLYFYDTTTRTTYSRHAPTRWPHQYNSLADKYYSYHTLLILILKNKNHRSIKLNDHI

SEQ ID NO: 48106 - protein, 131 aa, Sorghum bicolor
  Clone ID: LIB3481-013-P1-K1-D8.pep
VREGGFGSVHRGVLPDGQAIAVKQHKLASSQGDVEFCSEVEVLSCAQHRNVVMLIGFCVEDRRRLLVYEYICNRSLDSHLYGRNRETLEWTARQKIAVGAARGLRYLHEECRVGCIIHRDMRPNNILVTHD

SEQ ID NO: 48107 - protein, 105 aa, Sorghum bicolor
  Clone ID: LIB3481-013-P1-K1-E11.pep
SLSHGLRILKLTMAAVVEVTFDAQKHVNVSKGSIVGEDGGIGYLVYPMPPAGTFDLSTDKELLKNINQELIGCKGGDNARAGSPKTLRKACEKAVRRAFLAYLGQ

SEQ ID NO: 48108 - protein, 57 aa, Sorghum bicolor
  Clone ID: LIB3481-013-P1-K1-E2.pep
SDLDKVENVSQCPELKHLHSDCSMSTEGQHGTFRRTATRVSLTCRLVLKVHKKLFKI

SEQ ID NO: 48109 - protein, 115 aa, Sorghum bicolor
  Clone ID: LIB3481-013-P1-K1-E3.pep
SAARMSITSLNKSMGVIYTTAAGLIMRALSAMKDATDLEAEMTVVHDESHTMDADSQFLASMWPDYDKVVKFISVSAYGAPMPATDMYSPQVAVVSVPFCEESAITPADETFDGK

SEQ ID NO: 48110 - protein, 49 aa, Sorghum bicolor
  Clone ID: LIB3481-013-P1-K1-E4.pep
GPQELGKLAKIAQPRFDQSHPTNSETLLGKLNGKAATITLNKDSCRKPD

SEQ ID NO: 48111 - protein, 108 aa, Sorghum bicolor
  unsure (1)..(108): unsure at all Xaa locations
  Clone ID: LIB3481-013-P1-K1-E5.pep
VRLAAAIYMEDNVVGITIQLAQKDYTIGCVREDNSCLAYSVNXTNSSVTXILAALTLQDLRIAKGAETVVESIMIFRNPASITGMLVYTLTVIGVILYREYKTRINKP

SEQ ID NO: 48112 - protein, 80 aa, Sorghum bicolor
  Clone ID: LIB3481-013-P1-K1-E6.pep
RAGPPAETLFGLFGLAQFWEGSGGHSHGLLHKNPPKTLPPVVMALAEAFKLVDNAFLPFRICALLAHLYPAENMDLVVLL

SEQ ID NO: 48113 - protein, 113 aa, Sorghum bicolor
  Clone ID: LIB3481-013-P1-K1-E8.pep
VRVRGPAHQGVRVRAPVPPRFDLQSTRSRCDRLVPLVNRFVGGIIDEHRARNDLRSAPPHAVMDFTDVLLSLPADDRLTDSDMIAVLWEMVFRGTDTVAGLIEWVLARLVLHP

SEQ ID NO: 48114 - protein, 43 aa, Sorghum bicolor
  Clone ID: LIB3481-013-P1-K1-F4.pep
LLATKPSINKKKKKTLVYATSRFAASCGLLVPVPNTYYKQTHS

SEQ ID NO: 48115 - protein, 86 aa, Sorghum bicolor
  unsure (1)..(86): unsure at all Xaa locations
  Clone ID: LIB3481-013-P1-K1-G10.pep
RNKPGPSRSSTHLTTDSPPHIHWDNVRHVKHLHAALVQADVRKXPSGQPSTLNAPRPLSSYVALRTSRRCTLTPTLVIVFYVLSRT

SEQ ID NO: 48116 - protein, 70 aa, Sorghum bicolor
  Clone ID: LIB3481-013-P1-K1-G11.pep
VRAGGAMATTLSLSSPLFLGAPARARDAISYGVASASISPTTVNVLSKGYTSRVPVREQQRRMAIVSVLG

SEQ ID NO: 48117 - protein, 69 aa, Sorghum bicolor
  Clone ID: LIB3481-013-P1-K1-G7.pep
PVLRVGALSPADVAEEHGGGGPPAEVESERDADELGTGYLHTKIQLGMLLTACGGVGVPPLDTPPSSVR

SEQ ID NO: 48118 - protein, 50 aa, Sorghum bicolor
  Clone ID: LIB3481-013-P1-K1-H3.pep
KRGGPFWRCPFFFPVAGLERILFVGHNIVFRVQGYKPLGGSKLQVTAHLF

SEQ ID NO: 48119 - protein, 114 aa, Sorghum bicolor
  Clone ID: LIB3481-014-P1-K1-A7.pep
RVRDKIGPTMAVLRLDVQRNIERLHELYLLDPVKYSTLTEVVEKEVKEGTARKVDSCARADLWLARSMDYTIALVVSIEEDSDEHQQQSLAQLDEDPYEACLKPWHGWISSADC

SEQ ID NO: 48120 - protein, 80 aa, Sorghum bicolor
  Clone ID: LIB3481-014-P1-K1-B11.pep
SGGDAEENGEEDEEDPEDQEGGGGDDDDDDDDDNGDDEDDDNGDDEEEDGVDEEEDDDQDEDEEEDDDEDSLQPPKKRKK

SEQ ID NO: 48121 - protein, 142 aa, Sorghum bicolor
  unsure (1)..(142): unsure at all Xaa locations
  Clone ID: LIB3481-014-P1-K1-D2.pep
MSAAPAASPWLRPSPTVRLRETASLACSISSTPTRLCIGRRCSDRTFVGIQTAGSDLRRSTIAHVKSGEADGYPKTEDLVDEDTLLSNLDRAIKEEDYARAAKIRDDLRILHEDAKASLLAXANARFYNAFKNGDIAAMYSI

SEQ ID NO: 48122 - protein, 113 aa, Sorghum bicolor
  Clone ID: LIB3481-014-P1-K1-E1.pep
RPPEVSDSASLLKAEWLEAFEAGSSCIHAGAHSVADKVYVTLQPITQLPDGGVTNLPDGGVINVPDGGDDCFDIGEMLSMMEAHPHNERGAHVRIGQPWRLDGLDSSVLESML

SEQ ID NO: 48123 - protein, 79 aa, Sorghum bicolor
  unsure (1)..(79): unsure at all Xaa locations
  Clone ID: LIB3481-014-P1-K1-E10.pep
MESWATWVGTSVTSAFFASLERCSCINLSTDDYDYDYRDHDEAKDRPLILAXXPRHDDVAKPDPDFFLPGPGRKDQKQE

SEQ ID NO: 48124 - protein, 61 aa, Sorghum bicolor
  Clone ID: LIB3481-014-P1-K1-E6.pep
VIKRGFHKKAEPVCTLVYEPQPLVFFRRLLLCCCFLFLYSAICACFFCLCKFFFFAMQPDA

SEQ ID NO: 48125 - protein, 76 aa, Sorghum bicolor
  Clone ID: LIB3481-014-P1-K1-E9.pep
ASPAELYMLFGSSDRPLCTSAYRIVLVTHYPSMRLGPCAQLLVPLRKSIRPVRRFNGPLVLLFRTGRSAGSIVSGR

SEQ ID NO: 48126 - protein, 98 aa, Sorghum bicolor
  Clone ID: LIB3481-014-P1-K1-F1.pep
MSEADLRVIGLWPSLVVIRVLLPLRRWVLGFELVQEVVVKKSWLLLRSYSEHMKIPVLLHHGKSISLFLIIVQNINEVWSSDTLAFLLSVDSYTRAVL

SEQ ID NO: 48127 - protein, 55 aa, Sorghum bicolor
  Clone ID: LIB3481-014-P1-K1-F7.pep
MPPAPKFGDALLASVDRVNAELITLTYGAIVRNLLTDLEEVEEVNKLDYQMGDNM

SEQ ID NO: 48128 - protein, 93 aa, Sorghum bicolor
  unsure (1)..(93): unsure at all Xaa locations
  Clone ID: LIB3481-014-P1-K1-G11.pep
LDQRVCLGVEYQGYKNVQSRSGIDAKPSQRSGTTADTFIADLXVDLATVQIKTGAPCQSXRLSKYNQLLTIEEELDDALVYHRSKLTAPVEPY

SEQ ID NO: 48129 - protein, 117 aa, Sorghum bicolor
  Clone ID: LIB3481-014-P1-K1-G2.pep
RPTRPEKLSSGKTKPRNFQYETAQSIYIYTLGWLLSEPFLHIQHLYKIYFMPTARKFARTKRKRTISFPNEHIPPCLVKFILFSRLCPSYSLKKKMHDCWKLKRVKGYCSCVKFSQS

SEQ ID NO: 48130 - protein, 113 aa, Sorghum bicolor
  unsure (1)..(113): unsure at all Xaa locations
  Clone ID: LIB3481-014-P1-K1-G3.pep
FCTELLQPFFVTNDEPMETWEFMNCIMEAMGCQRPRINLPAKMLTSAALVSKMIHHRLGFQMLSTPLLHSDTIYFLSCTRTFNTSRARRLLGYHPIVTLEDGIMKTXGSFTEL

SEQ ID NO: 48131 - protein, 91 aa, Sorghum bicolor
  Clone ID: LIB3481-014-P1-K1-G8.pep
RPRTRGISWASNEVPSLEAYLLQSQRNRRTEPALPFTLSRNQPTCFSRLQRIHCEAISPLNTFAVSCNQPTCFRRLQQVQMPTRHAEAPVH

SEQ ID NO: 48132 - protein, 75 aa, Sorghum bicolor
  Clone ID: LIB3481-014-P1-K1-H10.pep
SGESAVDFVARRCRLAFLDTDAAGRALPRIVEILASEHKWDKARRKVELQKGREFLETFKSSKNAQFRDGKHNGP

SEQ ID NO: 48133 - protein, 60 aa, Sorghum bicolor
  Clone ID: LIB3481-015-P1-K1-A3.pep
LNLHVCVVDTSVQFSDTCYPSTFGYSVGPKMSSILDLNHVINFLKFGQVIEDSINVYVSE

SEQ ID NO: 48134 - protein, 43 aa, Sorghum bicolor
  Clone ID: LIB3481-015-P1-K1-A4.pep
MLPPFFVDHHAHDHTHDPGVSSVSIVCEREMDLEKADFWLGTY

SEQ ID NO: 48135 - protein, 110 aa, Sorghum bicolor
  unsure (1)..(110): unsure at all Xaa locations
  Clone ID: LIB3481-015-P1-K1-A5.pep
RPDEAIPNGLVTLTNGITLNDLYARLVRHEEGQRINIHKTDLWWRCDTTSDETQDLLSPLPSSTSVEPVCISXGSNTGSRFQLAGKPTNAARSAWGGTGSLLPPRVSGLG

SEQ ID NO: 48136 - protein, 51 aa, Sorghum bicolor
  Clone ID: LIB3481-015-P1-K1-B4.pep
RPTCEHGILEPRGAYSSTTSCYTATRSLLTRSMLWSHLSTFFGQPPAGQSL

SEQ ID NO: 48137 - protein, 73 aa, Sorghum bicolor
  unsure (1)..(73): unsure at all Xaa locations
  Clone ID: LIB3481-015-P1-K1-C4.pep
TRPVFIMAPLILPFLLVYFCLGYLVYRNQILNVYYPKSEMGGKLWPIMHNTIVFSLVLTXVIALGVFTIKHSP

SEQ ID NO: 48138 - protein, 63 aa, Sorghum bicolor
  Clone ID: LIB3481-015-P1-K1-C7.pep
KKGNRTPCRPLTGAGTDRLGAQEARPPGWPRNETMAVLVIILPSSGVFNIIFIFFTDRPFYFF

SEQ ID NO: 48139 - protein, 88 aa, Sorghum bicolor
  unsure (1)..(88): unsure at all Xaa locations
  Clone ID: LIB3481-015-P1-K1-C9.pep
VRFFFFFFNSLTSQDSTDCTSTPIFXTHSSWNLLSDPALPIIIIAPYTGLSPYRIFFHHRLAQKEFGAHLRPSLFLFGCINSMMDFIY

SEQ ID NO: 48140 - protein, 60 aa, Sorghum bicolor
  Clone ID: LIB3481-015-P1-K1-D10.pep
HSRRLSITQQYVVVVAVHRTIMLASSMSICISACAYASIVRMSFSSSSNRAAPCVCALGA

SEQ ID NO: 48141 - protein, 94 aa, Sorghum bicolor
  unsure (1)..(94): unsure at all Xaa locations
  Clone ID: LIB3481-015-P1-K1-D5.pep
KMLPKAHPXSEFCRSSNDECDDSEDMADEIRPSDPVELCPRFNMPSLSPNRCTLRDSNPKHLQTKQKIKFTHNRLFGTYIEISAYQTIPRRPNM

SEQ ID NO: 48142 - protein, 72 aa, Sorghum bicolor
  Clone ID: LIB3481-015-P1-K1-E4.pep
GRRSTRPTKEGPPPTVSSSIITPPAAAVVTTSISKNDSPPSSDDDYYTRCSSDDDDGVINSPPWEKLVALLH

SEQ ID NO: 48143 - protein, 64 aa, Sorghum bicolor
  Clone ID: LIB3481-015-P1-K1-F1.pep
FHIINSSPTHNHAKIYQSYDQFVIGCDGWLLPKWRWLCSFHLSISHECNCKKCRADRKRQTTNI

SEQ ID NO: 48144 - protein, 81 aa, Sorghum bicolor
  unsure (1)..(81): unsure at all Xaa locations
  Clone ID: LIB3481-015-P1-K1-F11.pep
VREDKVAASAELPKRTPTLNERILSSLSRMAVASHHRPDLXEIGAGAPAAFNVAGGTTYGSRVHYWLHKKTWPNNGARALF

SEQ ID NO: 48145 - protein, 54 aa, Sorghum bicolor
  Clone ID: LIB3481-015-P1-K1-F2.pep
FRTAAPNFNYIFYFFFPLLFYFFFLFLVYFFFFFCFSFFFFFFFFFFFFRTRES

SEQ ID NO: 48146 - protein, 78 aa, Sorghum bicolor
  Clone ID: LIB3481-015-P1-K1-F9.pep
AWRTHTISPPPPHLHLSPAKDRLRRRAPSLREVHPAAEQSLLTDDEDIAIMEDMPMRPPHPVPTMQHRSPSSIARLPP

SEQ ID NO: 48147 - protein, 54 aa, Sorghum bicolor
  Clone ID: LIB3481-015-P1-K1-G5.pep
KRNCVAHRNNPSKPIFLVEQSSMGSKSTQIWSTQFLLSSRNNGSEFQPRNPRVY

SEQ ID NO: 48148 - protein, 97 aa, Sorghum bicolor
  Clone ID: LIB3481-015-P1-K1-G9.pep
FPIPHPPGVRAQHHSPNVLTHTRPLTTLSHHTRISPPGPAIYLAGTSYTYYSLTVRLKSIMLLLLSLRSIDHSAVGKSVDPHDDNDHLNKRFELLPK

SEQ ID NO: 48149 - protein, 102 aa, Sorghum bicolor
  Clone ID: LIB3481-015-P1-K1-H10.pep
VRAPIPKLMSMPMHSMATFRPSILGRSYQQEHDVVWDQAKANTHKTGTIKDLDGTTVYDTVNREHSAYPTRQTSHDVDYPVACLLFIRVTGLVSVILNDNNV

SEQ ID NO: 48150 - protein, 85 aa, Sorghum bicolor
  Clone ID: LIB3481-016-P1-K1-B10.pep
RPPTRPAHQHQFNLHAALDVAQDLAWSTNAMFLRSVDRFSDFVVSVYVTAGHTRFMLLHDSRSDDGIKSFFQEVHELYMKLNIQI

SEQ ID NO: 48151 - protein, 75 aa, Sorghum bicolor
  unsure (1)..(75): unsure at all Xaa locations
  Clone ID: LIB3481-016-P1-K1-B12.pep
CSISCFQWFQKTTESQGSDLCQNLPQSKLGAHYICFLXDDVYPYDEAESCRSVYSEELECVKCREKQRFSFPRQE

SEQ ID NO: 48152 - protein, 49 aa, Sorghum bicolor
  unsure (1)..(49): unsure at all Xaa locations
  Clone ID: LIB3481-016-P1-K1-B3.pep
STHACDRXLLSSGSTPSXQRHRAKNLHRRRARSAPRSPRRWNAWGRLRS

SEQ ID NO: 48153 - protein, 78 aa, Sorghum bicolor
  Clone ID: LIB3481-016-P1-K1-B5.pep
RPSCCGGIRALLSLQDGAPDNFHLLRTASRLAACQDEGKKRTLRAVDDQAHSREGRNGLGPRPYSRRLPTDPSCGHIL

SEQ ID NO: 48154 - protein, 70 aa, Sorghum bicolor
  unsure (1)..(70): unsure at all Xaa locations
  Clone ID: LIB3481-016-P1-K1-B6.pep
CRYSXGICSPSPFKLYIGKYKGSIFPPLNMKQKEQMRDVLFSILIYIIEPDDWSHFKILLPVSIKRFYFL

SEQ ID NO: 48155 - protein, 48 aa, Sorghum bicolor
  unsure (1)..(48): unsure at all Xaa locations
  Clone ID: LIB3481-016-P1-K1-B7.pep
RHQSPWGALTGASLVRRVWPLPACAWLHRRAAWRRGRYGYAXRFHGRT

SEQ ID NO: 48156 - protein, 66 aa, Sorghum bicolor
  Clone ID: LIB3481-016-P1-K1-C11.pep
SFWSLPRASYNLLGAVSSAISVACSSRTCSCPSGIACRSMEVYLLPLHASRANIASFEFFLDYCPW

SEQ ID NO: 48157 - protein, 64 aa, Sorghum bicolor
  Clone ID: LIB3481-016-P1-K1-C7.pep
LFDHGGFSALLDTANTESVHHIRSGQYSGPNDAPALCTFSLDHTSRVFLLGLPFPAKAYCSTTS

SEQ ID NO: 48158 - protein, 42 aa, Sorghum bicolor
  unsure (1)..(42): unsure at all Xaa locations
  Clone ID: LIB3481-016-P1-K1-D10.pep
GRSMFVYVKMDHGSINKSLQQQKNRFKXMVGVVKLKKMFAQV

SEQ ID NO: 48159 - protein, 45 aa, Sorghum bicolor
  Clone ID: LIB3481-016-P1-K1-D3.pep
QSHPEDLYAIVDINCFNGSQIRSLRAGKNHHGTDYTMVLFNTTFR

SEQ ID NO: 48160 - protein, 65 aa, Sorghum bicolor
  Clone ID: LIB3481-016-P1-K1-D4.pep
ISQPCDVSMQAACITPCYSKNQSPAIEISAFDQPTTFTSELVTHRIRVRQRVHAVITHSITSYLG

SEQ ID NO: 48161 - protein, 100 aa, Sorghum bicolor
  unsure (1)..(100): unsure at all Xaa locations
  Clone ID: LIB3481-016-P1-K1-E1.pep
VDPRVRVHARWIGAPPIPVEQLQLQSLIDAIKXMIDPKVKERAVQLAKAIESEDGVDXAVKSFXKHLPQKRDSEATPTAPQSTFMQPLLLPVKRCFGMAS

SEQ ID NO: 48162 - protein, 179 aa, Sorghum bicolor
  unsure (1)..(179): unsure at all Xaa locations
  Clone ID: LIB3481-016-P1-K1-E10.pep
VREHRADHLGFHRAXCVLMGWNYSVAPVHKTAYQALSTIDAEANQGDLILWPPTVIIENTYKSKHDGQKDGMSDKDMESKLREMGFVGVDVQPLPGKDGQRSMQAKFPASLDGLNNASLLVEFFERQGHGRAAWARIRSIVPASDGGNNNPMLVKVDGKGERTWVLYGYLATAWDLDIL

SEQ ID NO: 48163 - protein, 53 aa, Sorghum bicolor
  Clone ID: LIB3481-016-P1-K1-E4.pep
MESGTHTVPAHYALPVRWLRADATDALDSVLDAVDTSVFRGFLATLDDCTGHA

SEQ ID NO: 48164 - protein, 144 aa, Sorghum bicolor
  unsure (1)..(144): unsure at all Xaa locations
  Clone ID: LIB3481-016-P1-K1-E5.pep
MSCELWMPEAYPKAVIHDNVVLTFXHHYRRAHATLEXYNCTDAQXHPLRRSLSGVQELSTQDTRMPLQGIRYGEXKHISRIRRDTMNESMADAAYQAXILDRGRCSEDVQYKATYHYTRIAPEKMTWAIEVADAIQPKLQAHVE

SEQ ID NO: 48165 - protein, 54 aa, Sorghum bicolor
  unsure (1)..(54): unsure at all Xaa locations
  Clone ID: LIB3481-016-P1-K1-E6.pep
SPAGVGVTPRGTVTFASAXAPALFVFFLSFFATFAGFPRKVLNWGLLLGFQLSV

SEQ ID NO: 48166 - protein, 124 aa, Sorghum bicolor
  unsure (1)..(124): unsure at all Xaa locations
  Clone ID: LIB3481-016-P1-K1-E9.pep
TLRDRAPLPASCMLAQLTGSYSYALYAGAPTRLXLSDPEGMVPVYWRITADGVRTLXDDIDMLKGSCGKXIAPLPQGCFYSNGLGGSEXYENPMHMVTAVSADEEERCGATMKAEGSTVLTALH

SEQ ID NO: 48167 - protein, 80 aa, Sorghum bicolor
  Clone ID: LIB3481-016-P1-K1-G12.pep
LVCRVSVVFPPRPRPTGQVRARRARPRQLTPCAVRSRRSAEPCQRDGDRPVAAGRSAQRPRRERAAVEERPGPAAARRVV

SEQ ID NO: 48168 - protein, 99 aa, Sorghum bicolor
  unsure (1)..(99): unsure at all Xaa locations
  Clone ID: LIB3481-016-P1-K1-H3.pep
VALICLFXTGPTKPLPSGILPVDPPAVGYRNLQNCNYIVGNRAIVDSGLSARTRITAGWQTTTNIDKYKQPCCFGLHNSVSGITVHDTWQPRLTDTLHK

SEQ ID NO: 48169 - protein, 81 aa, Sorghum bicolor
  unsure (1)..(81): unsure at all Xaa locations
  Clone ID: LIB3481-016-P1-K1-H4.pep
YIPDVELSRWKPRXAYEMYMKACSQGLQLPAKSYDTVLEACKAYGSIVDLTTLGPRPSKGVEPIRIENNFSSFSQFKDLPS

SEQ ID NO: 48170 - protein, 104 aa, Sorghum bicolor
  unsure (1)..(104): unsure at all Xaa locations
  Clone ID: LIB3481-016-P1-K1-H5.pep
QTGGFWGXYAGXFISTGTQGGGQESTALAAMSTLAHHGIIYVPLGYKTTFHLLGDNSEVRGGSAWGAGTFSNGDGSRQPSQKELELATVQGKAFYEAVAKVNFQ

SEQ ID NO: 48171 - protein, 141 aa, Sorghum bicolor
  Clone ID: LIB3481-017-P1-K1-A2.pep
PGPTHASAHASAHLEDEHPFESKIVSCPVCLARISKNLLDHITLQGGYLFTLQRHHRVRRVTGNGNHNLSYAGRDLQLQETYLKVLLGNSSRSSSTNASSTVTDSLLSSLVLNLSSLEVEDTSKSSASSVVENKWFKRSLP

SEQ ID NO: 48172 - protein, 92 aa, Sorghum bicolor
  Clone ID: LIB3481-017-P1-K1-A3.pep
RPTRPFLVEALIEMFPAVELVELLEAFEKRPPECLRTETLKTRRRDLAAALIPRGFNLDPISKWSKVGLVVYYSTILTGATTEYMAGHYMKQ

SEQ ID NO: 48173 - protein, 166 aa, Sorghum bicolor
  unsure (1)..(166): unsure at all Xaa locations
  Clone ID: LIB3481-017-P1-K1-A4.pep
RPVSTDTQVAIWRDSSRRRLVVAFRGTEQSRWKDLRTDLMLVPAGLNPXRLGGDFKQEVQVHSGFLGAYDSVRNRIMTLIKYAVGFLDEEDAGTIPSWHVYVTGHSLGGALATLLALELSSSQMAKNGVIFVTMYNFGSPRVGNRRFAEVYNAKVKDSLRIXNHRD

SEQ ID NO: 48174 - protein, 129 aa, Sorghum bicolor
  Clone ID: LIB3481-017-P1-K1-B5.pep
VRVAALQELKKSAPAFLETLVHSWVSALFSGDPGCVSINAPSCSMHDMMPYVSSRKLHLLNIICRKVMLSNHAQHGPGAENSNEETTDLWNTLLVRSETELRERLVGFTFAAVLKRTASLFNGTSTETC

SEQ ID NO: 48175 - protein, 55 aa, Sorghum bicolor
  Clone ID: LIB3481-017-P1-K1-B8.pep
NAHFLMLLIEDTWSAFVFIGLAEADGGSGLDVSLMRATSFVADMESLPCEYTTGC

SEQ ID NO: 48176 - protein, 83 aa, Sorghum bicolor
  unsure (1)..(83): unsure at all Xaa locations
  Clone ID: LIB3481-017-P1-K1-B9.pep
ELEGDVQNYRADYKPYINHLIEAMEFANEGALTETLTMTXCVVTRDQAINTMVNALADVLDVITYGLTMRPYMRHMHRYEHVT

SEQ ID NO: 48177 - protein, 97 aa, Sorghum bicolor
  unsure (1)..(97): unsure at all Xaa locations
  Clone ID: LIB3481-017-P1-K1-C4.pep
YYFFNINFFXXRTKPFIHLLLLLIKKVRQTDIKFTDTHAYMVSSQSITRAKKPTTMSILLLVIIIIHMVVLAEHRTLHASSRSRSKVVYELRVQLAS

SEQ ID NO: 48178 - protein, 72 aa, Sorghum bicolor
  unsure (1)..(72): unsure at all Xaa locations
  Clone ID: LIB3481-017-P1-K1-C7.pep
IKYIKKIYNXGGPFLVLNLDSLKPIGFFDFFNPKKFFFFFPLSVKNFLISVFTREFFIFSKGIGHLFFFRIG

SEQ ID NO: 48179 - protein, 78 aa, Sorghum bicolor
  Clone ID: LIB3481-017-P1-K1-D3.pep
HRTRPNKNLVASNTNIASASGATASTTTSYMKGAAFLEEQILLTPPGHRKDFFKVTQIKICGPTFYNHEAGKTRDFPN

SEQ ID NO: 48180 - protein, 94 aa, Sorghum bicolor
  unsure (1)..(94): unsure at all Xaa locations
  Clone ID: LIB3481-017-P1-K1-E1.pep
SGLVPNDLTLIHGLMGDSTFLLVYQYMTLTRYSMNALCTDLFCLLPWNRPXNKFICSCHGFQYNNQGKVVYGPAPLSLALIYAYFDYGKVLFFP

SEQ ID NO: 48181 - protein, 80 aa, Sorghum bicolor
  unsure (1)..(80): unsure at all Xaa locations
  Clone ID: LIB3481-017-P1-K1-E8.pep
PLHKSIKEVRTAALIVDSELKALQTWKCWAPCKNSPLTVLDINDRLMMTERAXTDSDGLSGQSWYKHTDIRTLTAQRLRG

SEQ ID NO: 48182 - protein, 95 aa, Sorghum bicolor
  Clone ID: LIB3481-017-P1-K1-E9.pep
DVPPVGIFMDGQDSSNPERLVGLDSLAGAAADGKGEGTTTEGRQSLRPGRRAPPPADGEIMEAAITACFFAGVGALLIDRRGRVGRPRGSAPVLR

SEQ ID NO: 48183 - protein, 85 aa, Sorghum bicolor
  Clone ID: LIB3481-017-P1-K1-F1.pep
QHVVTLRNPPVCMVRATNTTHQGPDGTPSIMKLFVFMHRGPHRVLHMRSRINSFMSLSNGSLPPHASKFNPCVRTSYTVHGNAHA

SEQ ID NO: 48184 - protein, 114 aa, Sorghum bicolor
  Clone ID: LIB3481-017-P1-K1-F7.pep
VRRRLSSVLPHYPLANELSSCLPPPDPSPRISQYISTRKKGAIKWCNSLLQIVDAALCKFASKTGLHYELHTIYGDSLLTDEDFYDYYHINFMGLPKDDRSSSSGAKPVRALVF

SEQ ID NO: 48185 - protein, 54 aa, Sorghum bicolor
  Clone ID: LIB3481-017-P1-K1-F8.pep
KEKVAVQDSTHNKEHTQKHPQGHLDRLTPHLQASRKETLKTEKHPKPTNQHLAP

SEQ ID NO: 48186 - protein, 65 aa, Sorghum bicolor
  Clone ID: LIB3481-017-P1-K1-G10.pep
VLLPTPVDFKLTVWERCQARIISIFYVHFFEQEIISRTANPLCILACRSEALSCFILRRYCYKIG

SEQ ID NO: 48187 - protein, 109 aa, Sorghum bicolor
  Clone ID: LIB3481-017-P1-K1-G9.pep
GSMAPIPLSPPTNKNGRKAAAFLEFRRGTGTSWSGPTSPGPIYPASPSPHGFGRGEVWDFLINRRKRPPGSNPTPPMGFDSVSEGPVPNQGTGMDGILSFSTTPCGRGD

SEQ ID NO: 48188 - protein, 157 aa, Sorghum bicolor
  Clone ID: LIB3481-017-P1-K1-H1.pep
VRTNMKHTGNSCKETISQIQSNHSSGIRSLCMDTHPEPIVETTDFGLVKSQNHGLNADGLRFYPLFSLSVPAQHGICCRKPGFVETTSYYNSLPFFFNFSLSIRPYMYSLLQLFRCRQHNHQLGQIHAHNATNFRSWVESLTCLRSWFFCFHACMCT

SEQ ID NO: 48189 - protein, 91 aa, Sorghum bicolor
  unsure (1)..(91): unsure at all Xaa locations
  Clone ID: LIB3481-017-P1-K1-H6.pep
VRRGGGGVSSTVLLGLRFAHELVLLTHRRPWTVAGIENRYFDLLLVPIALCLGATLLAAHRPGEPTPRLARAAGLALXGTWMLQMGFSFFT

SEQ ID NO: 48190 - protein, 73 aa, Sorghum bicolor
  Clone ID: LIB3481-017-P1-K1-H8.pep
MKKFSIIKERKMRYTLYKMKKTIDRIEIVGHHHWINLGNGILSRRVIVELAVVLEEEMVQCVVQVSQKSRYIQ

SEQ ID NO: 48191 - protein, 63 aa, Sorghum bicolor
  Clone ID: LIB3481-018-P1-K1-A1.pep
SPLSVPPLSVQLRPQVSRVSAQTDQSFTHVSITSSLMYMLHKMWSRHRRGPTYCRTRASGPNS

SEQ ID NO: 48192 - protein, 134 aa, Sorghum bicolor
  Clone ID: LIB3481-018-P1-K1-A2.pep
MAAAAVTPGGTGGTGAATSRFAAACGALSHYVKQAAEAERKHARPAAVPVRPLPLMPGADVSDYCSRDGGLDHLAQAAQMMTIVYGGRVLVLDDVPADKAAGLLRLAGDATGAAAAQEGAGTEAGGAMRGRGQV

SEQ ID NO: 48193 - protein, 187 aa, Sorghum bicolor
  Clone ID: LIB3481-018-P1-K1-B7.pep
RPTTSAKCPQCAKRFALEHIINLYAPGNLWDRHIQAPVTSGPSGSETDLLKQVLDILQEPASIEKEYGVHFDEIVKRFRLPERNIWDALMQHVDMGNIYNTIDDFHFMPAVFEWHPSVQQSYYQQRVLTLQAPVTSGPSGSESDLLKQVLDILHEPANIEREHVHVDEIVKRFRLPERNIKDAIMQL

SEQ ID NO: 48194 - protein, 72 aa, Sorghum bicolor
  Clone ID: LIB3481-018-P1-K1-B8.pep
SDFLLVPAAAMAESSARSSRGSASAGRGGGGGYDGRRVAVYIPRKPTGLHSGHILLSTTGIISKRPIPIKFI

SEQ ID NO: 48195 - protein, 99 aa, Sorghum bicolor
  unsure (1)..(99): unsure at all Xaa locations
  Clone ID: LIB3481-018-P1-K1-C6.pep
DVHLDGPGLLLQPSFFCRGTPVVLRDPALPPVLVYPVTHGEAPTVRAPGGSSLAKLVGQTRSAVXHAIGDGGTTSELARMAGVYLASDSQHAGVLSRPV

SEQ ID NO: 48196 - protein, 53 aa, Sorghum bicolor
  Clone ID: LIB3481-018-P1-K1-D3.pep
GQCRTPSASEFLRLVSQYSPPSPVLHTVIRVMRMLPKTIVPPLSHITGEFVRT

SEQ ID NO: 48197 - protein, 50 aa, Sorghum bicolor
  Clone ID: LIB3481-018-P1-K1-D6.pep
IDNRAKQKEPCLNKDEVTGFLMVQIIQLKLLLFFFVRYYSSISFLFTVSL

SEQ ID NO: 48198 - protein, 134 aa, Sorghum bicolor
  Clone ID: LIB3481-018-P1-K1-D8.pep
ALDPDPHRISLVTRQQTYHVPCPALMALALTAACAPAHLHAAHQHAKQAPCSAQLHRQYVVQHLIIASITPRSSPSSPPSATSTTPPSARFVTPPSTTPSISSSVGSTVSATLCATVCIPLDTAFEASARVSGR

SEQ ID NO: 48199 - protein, 48 aa, Sorghum bicolor
  Clone ID: LIB3481-018-P1-K1-D9.pep
IFASSFQCCLGCMKVFWPPSLGSRVSSAVSTSLYASINIPLGRALNAS

SEQ ID NO: 48200 - protein, 78 aa, Sorghum bicolor
  unsure (1)..(78): unsure at all Xaa locations
  Clone ID: LIB3481-018-P1-K1-E4.pep
RPPNLKMALTETLPLHPTRTLLVPLETMRDTTIWGYYVTANTRVFCNSWAIGRDPXSWPPPTVNPDRFGERVTLRRLG

SEQ ID NO: 48201 - protein, 95 aa, Sorghum bicolor
  Clone ID: LIB3481-018-P1-K1-E6.pep
RPPTRPVVGLNLDESKVRRAGPAENVRVKLSGVEEEDVMAGFVLSSVANPVGAVSEFIAQLQILELLDNAIFTAGYKAVLHIHSVVEECEIVELI

SEQ ID NO: 48202 - protein, 156 aa, Sorghum bicolor
  Clone ID: LIB3481-018-P1-K1-F1.pep
STHACVSFGYTFHQQRNDDDHHHHTGDAELVAAPPCPSSPVSRPVAHPPPTTAAPRLYPAIEWPLTEEIPIYHTPLPLAGAAAVTLANSRYYPPPPSSATPVEVEPVAVYPPAPETSACSLYPSVLPASAMYPPVDLAPVSCYPPAPRWDDLGLYS

SEQ ID NO: 48203 - protein, 25 aa, Sorghum bicolor
  Clone ID: LIB3481-018-P1-K1-G1.pep
KESIIASARLLHLVRQSFNYIISIG

SEQ ID NO: 48204 - protein, 172 aa, Sorghum bicolor
  Clone ID: LIB3481-018-P1-K1-G10.pep
SARLASQFLSPLDARNGRSVMQRLVPGPGSSASVNQRLGSSAGLNHVNGAPRIRSVVSIPNRERLDGSTHTTPPRPSEDSSPVESSGKVGLPLTDTNKAEGTSVENRKTSEAPASNGSVLSPAEDKNQPRIEDKDGFQKKTFSRMHDGETVGSATRIHTQETPACTRNCTLK

SEQ ID NO: 48205 - protein, 49 aa, Sorghum bicolor
  Clone ID: LIB3481-018-P1-K1-G2.pep
NQGALKKRARVGSMWLLILIIFKRPPLYFFFFFFFFFFFFFFSDAWVDG

SEQ ID NO: 48206 - protein, 33 aa, Sorghum bicolor
  Clone ID: LIB3481-018-P1-K1-G3.pep
QIGEMNYEHNLYPAMSPQVQSLCKSAVLCSSRK

SEQ ID NO: 48207 - protein, 65 aa, Sorghum bicolor
  Clone ID: LIB3481-018-P1-K1-G9.pep
QQEVVFINTIHWCVLDTDQTASVVMICCGRCRSVRSGRPIIVSRHDRERLRRPRCACTRRWLCGR

SEQ ID NO: 48208 - protein, 42 aa, Sorghum bicolor
  Clone ID: LIB3481-019-P1-K1-A11.pep
QLKARCMSEAIGNHCIYPNHHIFSTKRLSVYKHYVINMFLAI

SEQ ID NO: 48209 - protein, 52 aa, Sorghum bicolor
  Clone ID: LIB3481-019-P1-K1-A4.pep
FLSHHSWRICTYVYPSSSIHCGWCVPCTSHCGKYNVCPCKILCLAHIISARW

SEQ ID NO: 48210 - protein, 91 aa, Sorghum bicolor
  Clone ID: LIB3481-019-P1-K1-B1.pep
ARPGPWPPPPPICPKPAHANPERFRRDFDAGRIRGVWSGEFGKGRRRREACVSHTTLPLFSAAAAVRVRGRDWRSRLVRVRCDGRAASSAD

SEQ ID NO: 48211 - protein, 71 aa, Sorghum bicolor
  Clone ID: LIB3481-019-P1-K1-B11.pep
RVRGRVGCAVRIWSIKTGELLFAQSMSDTLFTAFCWPESSHDLCSSSLFDLNHSWGARLGSRAGLFYMHGT

SEQ ID NO: 48212 - protein, 88 aa, Sorghum bicolor
  unsure (1)..(88): unsure at all Xaa locations
  Clone ID: LIB3481-019-P1-K1-B3.pep
VRPRVRPRXRPRVRGVFPDTNTYNVVLQXLLEGRKLREAAAIFSEMIKNECWPNEENXSLALRMCLVHAIGRLGSKSGAAWWRMACHL

SEQ ID NO: 48213 - protein, 92 aa, Sorghum bicolor
  Clone ID: LIB3481-019-P1-K1-C11.pep
RPPEKDEAEDYLGIDLHLPLLQMVKSWQDGEASMTDGGSILSLEDSKGSIPARPAGFAESFTLADGRRGLDEEEDRASSWYRSHDLIISTGR

SEQ ID NO: 48214 - protein, 38 aa, Sorghum bicolor
  Clone ID: LIB3481-019-P1-K1-C7.pep
RPDMNSYGSLVRPLRISLLCSKVSYKCWRGSTQTARSH

SEQ ID NO: 48215 - protein, 48 aa, Sorghum bicolor
  Clone ID: LIB3481-019-P1-K1-D2.pep
RPMRLYYQVISSAADLHATQQSSRILYISCMRRALLTELVRHNPLLIT

SEQ ID NO: 48216 - protein, 42 aa, Sorghum bicolor
  Clone ID: LIB3481-019-P1-K1-D4.pep
KKISMEGFNSLYREFLSQLHKCSQIKASYHRIDCLDVVLRGR

SEQ ID NO: 48217 - protein, 65 aa, Sorghum bicolor
  unsure (1)..(65): unsure at all Xaa locations
  Clone ID: LIB3481-019-P1-K1-D8.pep
MAEEKHHHHHLLRTGRTXEQLEQPVXXCGYGYGEAAEYTETTXTEVVSTGCEDEYDTYKKEEKEH

SEQ ID NO: 48218 - protein, 48 aa, Sorghum bicolor
  unsure (1)..(48): unsure at all Xaa locations
  Clone ID: LIB3481-019-P1-K1-F10.pep
RAIYQIREANQMIEEFMLAANVSGAEKILRXLPLCSLVRGHSSPTKEM

SEQ ID NO: 48219 - protein, 86 aa, Sorghum bicolor
  unsure (1)..(86): unsure at all Xaa locations
  Clone ID: LIB3481-019-P1-K1-F7.pep
VRKVLMADFFMADQLTSQIPXVRHLEFTGCCFMAGTFRTHEYGSCTSSSLYKNLAYVLFLLSYYWRAMARLRRYLEEGHDLNQLVY

SEQ ID NO: 48220 - protein, 58 aa, Sorghum bicolor
  unsure (1)..(58): unsure at all Xaa locations
  Clone ID: LIB3481-019-P1-K1-G4.pep
PSQFPVSNFQAFINLKILLKNVEMQFSEAYTVALQAECVXSYPCFSSLQYNTISIGAR

SEQ ID NO: 48221 - protein, 65 aa, Sorghum bicolor
  unsure (1)..(65): unsure at all Xaa locations
  Clone ID: LIB3481-020-P1-K1-A10.pep
YWDKYKEXTQEXNLQRQTASAXDRRFRFVRPCLLPIFFHNMNSSTFVCISYTLSDYPLTRLLQKY

SEQ ID NO: 48222 - protein, 40 aa, Sorghum bicolor
  Clone ID: LIB3481-020-P1-K1-A12.pep
LDGPYKEIFFSLPVLTFLIQDLAVARYPIGRRLSYPSYSR

SEQ ID NO: 48223 - protein, 89 aa, Sorghum bicolor
  unsure (1)..(89): unsure at all Xaa locations
  Clone ID: LIB3481-020-P1-K1-A3.pep
PAADRETEHHIXTIXHLKMFRDFXRGFTKRRSESVQKVKLHHKEAGAEHHHECCCCTCDLPDNSTCFYHYFKKYMGTRYHKVVRTRGRT

SEQ ID NO: 48224 - protein, 76 aa, Sorghum bicolor
  unsure (1)..(76): unsure at all Xaa locations
  Clone ID: LIB3481-020-P1-K1-B6.pep
RPIKHGFSYNGKDFLYSGILGQPLEAYIFMGPIXYQKLKHMVLDMMHARASGPRVLLTWQPTEGGNRDGCLRXXEM

SEQ ID NO: 48225 - protein, 38 aa, Sorghum bicolor
  unsure (1)..(38): unsure at all Xaa locations
  Clone ID: LIB3481-020-P1-K1-B8.pep
SSGRPHGVPAVPRPRMRRRGXAGWHXXPGEAGGSDEVR

SEQ ID NO: 48226 - protein, 99 aa, Sorghum bicolor
  unsure (1)..(99): unsure at all Xaa locations
  Clone ID: LIB3481-020-P1-K1-C11.pep
VRWFNYRVARAAPESCADFLGSFVADKNKAEFVKGGKWLVWKFEGDRTLANYMSDRGFPSNLEPLMFGRVLXGLGTHDRDALVVKQVMRQLITSLKRIH

SEQ ID NO: 48227 - protein, 95 aa, Sorghum bicolor
  unsure (1)..(95): unsure at all Xaa locations
  Clone ID: LIB3481-020-P1-K1-D11.pep
MADKEDLKLLGLQLSPFVIRVCMALTMKGGSFEYVEEDLNNKSELLVKSNPVHKKVPVLIHNGKPDPFEQLXVDELFACSTILSDATPSSAPMVA

SEQ ID NO: 48228 - protein, 115 aa, Sorghum bicolor
  Clone ID: LIB3481-020-P1-K1-E12.pep
RPQGCFPDVCTYTILMNGSHKVRNLPMAREFFDEMLSKGLQPDCFAYNTRICAELILGDTHKAFQLREVMMLKGIYPGTVTYNVIIDGLCKTGNLKDAKDLKMKMVSDGLQSDCV

SEQ ID NO: 48229 - protein, 39 aa, Sorghum bicolor
  unsure (1)..(39): unsure at all Xaa locations
  Clone ID: LIB3481-020-P1-K1-E9.pep
GCLCDEPPRTQXVIXAIQIKSPPSLRSSVAKPKSRLYRT

SEQ ID NO: 48230 - protein, 76 aa, Sorghum bicolor
  unsure (1)..(76): unsure at all Xaa locations
  Clone ID: LIB3481-020-P1-K1-F5.pep
TESMSGPPKVINKTVDGKLLEPYEIAAXEVPEECMGSVVELLGKERGQMGDMEADXPEGTTWVNYKISTRGXIGLR

SEQ ID NO: 48231 - protein, 61 aa, Sorghum bicolor
  unsure (1)..(61): unsure at all Xaa locations
  Clone ID: LIB3481-020-P1-K1-F6.pep
RPPTRPVKERVLQPDAQVNGWLSDRYSQSYARATALETLDTRTETYILLDLPEELVXERLV

SEQ ID NO: 48232 - protein, 65 aa, Sorghum bicolor
  unsure (1)..(65): unsure at all Xaa locations
  Clone ID: LIB3481-020-P1-K1-F9.pep
SARSCVGISWDQSVSECARADALQGAEILFEPTALGSEPHDANLDPRXHCERVMQGHAGANLVPL

SEQ ID NO: 48233 - protein, 112 aa, Sorghum bicolor
  unsure (1)..(112): unsure at all Xaa locations
  Clone ID: LIB3481-020-P1-K1-G6.pep
RPLRHKELDFKFNLISVYGPAQTEHKANFLSELVRVCSKDTLPIVIGGDFNIIRIPIERNNDNYCDRWXFMFNAVIDSLNLREIELSGRKFTWANNMPNQTFEKXXRVLVCT

SEQ ID NO: 48234 - protein, 41 aa, Sorghum bicolor
  unsure (1)..(41): unsure at all Xaa locations
  Clone ID: LIB3481-020-P1-K1-H10.pep
RAGXPTLPRLRFNKEGNLLAVTTVDNGCKILANADGLRTLR

SEQ ID NO: 48235 - protein, 42 aa, Sorghum bicolor
  Clone ID: LIB3481-021-P1-K1-A1.pep
AVIQSICKPCACSQITGMFADSAVVLHYFKRASTGKHTINAQ

SEQ ID NO: 48236 - protein, 62 aa, Sorghum bicolor
  Clone ID: LIB3481-021-P1-K1-A4.pep
SGSTVSDVVNFYVSGHFDAVDYHGFICGINGRRDQHHGWVDHLSLRTLNMDQKLVFWMPLLS

SEQ ID NO: 48237 - protein, 33 aa, Sorghum bicolor
  Clone ID: LIB3481-021-P1-K1-A6.pep
GFRVDHASGSYYLHCTYSNRESLLRGTHHKIVT

SEQ ID NO: 48238 - protein, 75 aa, Sorghum bicolor
  Clone ID: LIB3481-021-P1-K1-A7.pep
GPDSGSPTRSDLCFSLAAVHGRTWSTACTRGFQPRASYENGARRDPSREERMQTNRAILCVGSDIISSVRYIVLL

SEQ ID NO: 48239 - protein, 100 aa, Sorghum bicolor
  Clone ID: LIB3481-021-P1-K1-B11.pep
DPCADAQAAANANPAAAAAAAAEVDAQVLPPRDVAALSCEKERGHHRRAEDDDGRLVRVRHCCRFVLALHCTLRDQIERRRRDESSTRFGCAVVHAMQPD

SEQ ID NO: 48240 - protein, 68 aa, Sorghum bicolor
  unsure (1)..(68): unsure at all Xaa locations
  Clone ID: LIB3481-021-P1-K1-B3.pep
VSLCVCRRIYYQPGHICHSIPXASRASECCDTXTSGVRDDCTAGRDRGTPSLKVSTHKSGMCAPECSA

SEQ ID NO: 48241 - protein, 84 aa, Sorghum bicolor
  Clone ID: LIB3481-021-P1-K1-B6.pep
MASQSDNLLVEIEGTLLSTLSDKSSGHSLTDQLTHMTQNDYLLNSGLEGIGSTGKKWKCSPKMIKTTSEEAERQLCTDMTRGVI

SEQ ID NO: 48242 - protein, 51 aa, Sorghum bicolor
  Clone ID: LIB3481-021-P1-K1-B7.pep
VLDVISYLKNTSLVNLEESRRVFGCRNLSSLDVYLGCHMRWSIEYPILIKK

SEQ ID NO: 48243 - protein, 89 aa, Sorghum bicolor
  Clone ID: LIB3481-021-P1-K1-B9.pep
SSLVESLQSKSLVRKHLTLGTHNIASPLITYIKIEWPTLTSVLYLVSQSNQMSAVSSSALSWRMRDWSPQLESLSSFDLRENKPCATKI

SEQ ID NO: 48244 - protein, 59 aa, Sorghum bicolor
  Clone ID: LIB3481-021-P1-K1-D11.pep
LHSEREPPRVAHGDFARLKVDHRLIAVRHSPHSGPAQQVTSHQVRRVAADHAARDSLHS

SEQ ID NO: 48245 - protein, 53 aa, Sorghum bicolor
  Clone ID: LIB3481-021-P1-K1-G1.pep
GFSLSQPQVFTRLEGCWMLSARLSLSLLPDTCAAGLSPRHVSSERTFGRREHG

SEQ ID NO: 48246 - protein, 46 aa, Sorghum bicolor
  Clone ID: LIB3481-021-P1-K1-G4.pep
STIMCRAGTVLFCCHRSIDVCTCFPKHLGAGITTAGNTCPSCLRVG

SEQ ID NO: 48247 - protein, 63 aa, Sorghum bicolor
  Clone ID: LIB3481-021-P1-K1-G9.pep
CCLSLRVLAMDPGFLTRHCIVLHVGLQAMMLSHICNVCCHVSSLRSSIYESSLVGNIVRVSAR

SEQ ID NO: 48248 - protein, 62 aa, Sorghum bicolor
  Clone ID: LIB3481-021-P1-K1-H10.pep
SGRRRRLDASASTHRERAESSWDGSGPGGEGTRGASWTPASGGGRWRARLNRPWERCTARAR

SEQ ID NO: 48249 - protein, 44 aa, Sorghum bicolor
  Clone ID: LIB3481-021-P1-K1-H12.pep
AIVPPRPRPRPRGVRSVSCDEVLDNYMRLHGLEPWSTMLRHPLQ

SEQ ID NO: 48250 - protein, 59 aa, Sorghum bicolor
  unsure (1)..(59): unsure at all Xaa locations
  Clone ID: LIB3481-021-P1-K1-H3.pep
NCSXCISNYNIDHFRLDPIERDPNLSRSSMVSMFTEPDTLPSSHVETPIGIAIGRVVDR

SEQ ID NO: 48251 - protein, 92 aa, Sorghum bicolor
  Clone ID: LIB3481-021-P1-K1-H8.pep
VRTTAVAFVTAAAAAVRDDDGGGGGPSAPSSSPATPPWPEQFHAVVITNLSAHGGGGGLQLIDLYYDWPRGRDLNIVRDQVSGEPQWNVEWT

SEQ ID NO: 48252 - protein, 70 aa, Sorghum bicolor
  Clone ID: LIB3481-022-P1-K1-A5.pep
LNNLLRDAALRFKDFEYNSKILKEEVEKYKRHAERLEPCITDTVHFMNQSIVQKKKILVEGAQATMLDID

SEQ ID NO: 48253 - protein, 55 aa, Sorghum bicolor
  unsure (1)..(55): unsure at all Xaa locations
  Clone ID: LIB3481-022-P1-K1-A7.pep
IHPARARVLYLGPLCVETPSYLTXELPNDYGWDTAGLSTDLETFIKNRELEAIHS

SEQ ID NO: 48254 - protein, 97 aa, Sorghum bicolor
  unsure (1)..(97): unsure at all Xaa locations
  Clone ID: LIB3481-022-P1-K1-B3.pep
LPLLSLHDWMGLDVVPDASKTFNDSIXHTTQTMIRNGPMVVFEFPSSAADTEAIDTKLAALTTTKGVTTIINGCDSVAAEQKADAAVQTHHISTGGG

SEQ ID NO: 48255 - protein, 38 aa, Sorghum bicolor
  Clone ID: LIB3481-022-P1-K1-B5.pep
TVPQEVTVVRVQQPLVVRVRVRCRHGPLPSSELPVHGR

SEQ ID NO: 48256 - protein, 61 aa, Sorghum bicolor
  unsure (1)..(61): unsure at all Xaa locations
  Clone ID: LIB3481-022-P1-K1-B6.pep
RPAKNGVKFGEAAXLKASAQILSKGWLNYLSSTYLVHAQSILTIWACQVVLIGSVEGYRVS

SEQ ID NO: 48257 - protein, 58 aa, Sorghum bicolor
  Clone ID: LIB3481-022-P1-K1-B7.pep
MEGDPELIDDSEFYQQLLKEFLESCDRRALESALYALKKQQVKKRKLVDRRASKSTKI

SEQ ID NO: 48258 - protein, 58 aa, Sorghum bicolor
  Clone ID: LIB3481-022-P1-K1-B8.pep
GNRSRTSGGRIRTYGKTSCGALLTYRKTRSLTGVCLVPTRTRVSPRVRPRVSPRVRGR

SEQ ID NO: 48259 - protein, 39 aa, Sorghum bicolor
  Clone ID: LIB3481-022-P1-K1-B9.pep
MSWLTYVDDHLMCEIDGHHLSAVDIFCLDRSLWAQSTGF

SEQ ID NO: 48260 - protein, 91 aa, Sorghum bicolor
  unsure (1)..(91): unsure at all Xaa locations
  Clone ID: LIB3481-022-P1-K1-C10.pep
STDDGLKFFEFLQLAQTLCLPIACREGPSSXQEASSSTIAAFLKDCCNGIELARXTPRLHXGSLLATMGHSEPFHLYYXLIGNLECSNYYY

SEQ ID NO: 48261 - protein, 64 aa, Sorghum bicolor
  Clone ID: LIB3481-022-P1-K1-C11.pep
LDPRTKLSSMLILFSHGSSTIAVGEQVINHRVSLSPHSFISCKWHHPPIQVFKSCRLWTCCAVP

SEQ ID NO: 48262 - protein, 56 aa, Sorghum bicolor
  Clone ID: LIB3481-022-P1-K1-C5.pep
RPGDLDPATAKAVAGVAGPVLSAFGYLIILRIVMSWYPRLPVTEFPYMVAYAPTEP

SEQ ID NO: 48263 - protein, 137 aa, Sorghum bicolor
  unsure (1)..(137): unsure at all Xaa locations
  Clone ID: LIB3481-022-P1-K1-C9.pep
SGTDDGLGFFEFLQLAEDLGACPVWVVNDGASIYQEVSSATIAAFVKDVVNGIEFARGDPETAWGSVRAAMGHPEPFQLYYVSIGNQECSKYYYKDNYVKFYFAIKACYSDNKIISSCDRSAIXPINPTDLDECQVY

SEQ ID NO: 48264 - protein, 51 aa, Sorghum bicolor
  Clone ID: LIB3481-022-P1-K1-D5.pep
YMIHLFLLQSFLVFFLPKLAISLRCALSHDLSPSHLSFSQLTAHHNTCSYS

SEQ ID NO: 48265 - protein, 73 aa, Sorghum bicolor
  Clone ID: LIB3481-022-P1-K1-D8.pep
VGQLRRQNQVTAAAAAAADEEEHAVFATSGRGGVHRPRYEARLQGHCCCRGWDGRLSHTPYARPARVGVPGFG

SEQ ID NO: 48266 - protein, 62 aa, Sorghum bicolor
  Clone ID: LIB3481-022-P1-K1-E12.pep
LHSLSVMDERNLQCPNLKKIDLNKSRVKNQGCELDQSSPKIWDSTEILVTSYPKSILPIRKN

SEQ ID NO: 48267 - protein, 58 aa, Sorghum bicolor
  Clone ID: LIB3481-022-P1-K1-E3.pep
SADAWVFSFFKRKINLMQHYAHANTLLDQMKEGPSMIYMHQRTDKHTHTTEYKLKRHG

SEQ ID NO: 48268 - protein, 28 aa, Sorghum bicolor
  Clone ID: LIB3481-022-P1-K1-F2.pep
IHIYLPKPFPILKFFFFAPNLIFLRCFY

SEQ ID NO: 48269 - protein, 74 aa, Sorghum bicolor
  Clone ID: LIB3481-022-P1-K1-F6.pep
DDAQVPPLSVMCYRLAVDPAVPLRVARHLRVRRRHSAAPRVAGPDIRVSGHGECVGQAGDGAGGHVCLSVGSPD

SEQ ID NO: 48270 - protein, 45 aa, Sorghum bicolor
  Clone ID: LIB3481-022-P1-K1-G10.pep
VDRCIANERLCTCHKNWHPQKVYTTRPSVFYDLGILDTHSDVSCV

SEQ ID NO: 48271 - protein, 37 aa, Sorghum bicolor
  Clone ID: LIB3481-022-P1-K1-G6.pep
LPLETRKFPIVSSPCASATFFVRSRSDSIHFILFHES

SEQ ID NO: 48272 - protein, 65 aa, Sorghum bicolor
  Clone ID: LIB3481-022-P1-K1-G7.pep
TVRYPVRPTRPRTHRSFGSCRIRSVIDRGNLHAKSKICGERMHQSDPILLMPTPMRPSQVPRYER

SEQ ID NO: 48273 - protein, 97 aa, Sorghum bicolor
  Clone ID: LIB3481-022-P1-K1-G9.pep
VRFVGMTDIATKEAFDWVSNIPKLVKTLCIMLRLSDDVKSYEVSFFVHEQGTKLPKLKGEGLIWVIASILNTKHGCDTGTTSTPMPFASVPILSPNR

SEQ ID NO: 48274 - protein, 59 aa, Sorghum bicolor
  unsure (1)..(59): unsure at all Xaa locations
  Clone ID: LIB3481-022-P1-K1-H12.pep
ACAHASAIGRTYHVHLVRLYGFCFDANTKAXSLXYLENGSLEKYXYGDVDGSTSTRLEW

SEQ ID NO: 48275 - protein, 105 aa, Sorghum bicolor
  Clone ID: LIB3481-022-P1-K1-H3.pep
RPVSYMIPPSDNNAETMVRPNRTSGAEEVTGRLADIDAYSDVLYDELSFNSRRHSSRSQPPTARALEAIACGFLATKHKGREASIPSSSKSSRPVRLPRRSPDVA

SEQ ID NO: 48276 - protein, 102 aa, Sorghum bicolor
  unsure (1)..(102): unsure at all Xaa locations
  Clone ID: LIB3481-023-P1-K1-A10.pep
SADAWADAWAPGGLYRTPLGRLIFKTDEMIQVVEAPDIVRNKVSFSIFGLEGAVSLKGXLNVLDQXWIQVIFEAPELEGGFLGFQFRGEREVKLEITYLDQK

SEQ ID NO: 48277 - protein, 54 aa, Sorghum bicolor
  Clone ID: LIB3481-023-P1-K1-A2.pep
QFVKIRRSNARVGLACFQEVHKLTNKKRQRYLIKDGFRCIIYKRECRKQQQFRT

SEQ ID NO: 48278 - protein, 118 aa, Sorghum bicolor
  Clone ID: LIB3481-023-P1-K1-A3.pep
VRSWLPARSIVLECLKSRENIDLSGEIMVLDRFCAWKLHLFELEEELKTDPLTKYVLYQDERSKSWRVQAVGVAPDRFESRKALPEKWRGMRDDELSAENGIPGCVFVHMSGFNGGNK

SEQ ID NO: 48279 - protein, 95 aa, Sorghum bicolor
  unsure (1)..(95): unsure at all Xaa locations
  Clone ID: LIB3481-023-P1-K1-A8.pep
RAKGYAIIFYRGKNYRRPQIMKPRNLLTRRXALARSIELQRREALKHHISSLQGKIWKLQSQLVQTKVASEKXDLKLLQTVEDDLSSDDDDDVKG

SEQ ID NO: 48280 - protein, 86 aa, Sorghum bicolor
  unsure (1)..(86): unsure at all Xaa locations
  Clone ID: LIB3481-023-P1-K1-B1.pep
MMELQEALLESNQATKGANEIPSAANGDNDEWSEVQRLQTRITTFQNTEIDXWQRKIQVTTGAAALKGKLHAFNQNISDQVAGYMR

SEQ ID NO: 48281 - protein, 44 aa, Sorghum bicolor
  Clone ID: LIB3481-023-P1-K1-B5.pep
CRLVLVRVGGRVGCKRPRMLLALKLKSWSTAFPLMGFNSWKTYY

SEQ ID NO: 48282 - protein, 84 aa, Sorghum bicolor
  unsure (1)..(84): unsure at all Xaa locations
  Clone ID: LIB3481-023-P1-K1-B8.pep
SAYAYSCNYSINSIHXSAYLTIHVTPGDAWSYASYXDIPSHATALSYNDLLKSFLTCYIPLEFTIAGTIFQGRTQAKTLGTHLF

SEQ ID NO: 48283 - protein, 60 aa, Sorghum bicolor
  Clone ID: LIB3481-023-P1-K1-C9.pep
SGENVTTIIPAAKWLTSTELEGGVETCVLGALCLIGHCFLVGAYLVMQVMESLESLYIYA

SEQ ID NO: 48284 - protein, 50 aa, Sorghum bicolor
  Clone ID: LIB3481-023-P1-K1-D10.pep
SGRCRPATTAPDPTLIRIQPYVHEAHLPDPRGMSFHTSNTPIALIRTKHG

SEQ ID NO: 48285 - protein, 79 aa, Sorghum bicolor
  unsure (1)..(79): unsure at all Xaa locations
  Clone ID: LIB3481-023-P1-K1-D7.pep
VRFVEDERAFNSCVDARFAALDADRDGRLWGAEMTXELMALRVREAHFGADAPAPDAELAGLYGALFARFDRDGDGAVD

SEQ ID NO: 48286 - protein, 61 aa, Sorghum bicolor
  unsure (1)..(61): unsure at all Xaa locations
  Clone ID: LIB3481-023-P1-K1-E1.pep
PALRLLVSTXWWLVYCALCTMXTSVLFFCAIRSNQDNTAXDFTIKQYWLTDIISSLSVSHS

SEQ ID NO: 48287 - protein, 141 aa, Sorghum bicolor
  unsure (1)..(141): unsure at all Xaa locations
  Clone ID: LIB3481-023-P1-K1-E10.pep
DRPRGGEGPERPPSQWEPSXRGCLLFLVDSKLXFHTLENIVERAVVPWYAEFRNTGLERSKALKNDLELFNQHGHTISVTISPGTTYAFLPEELLIRDPKHLFAFLYVSFLILLNPYVCKKFLYNSYKNNLIFYLRLFSIF

SEQ ID NO: 48288 - protein, 111 aa, Sorghum bicolor
  Clone ID: LIB3481-023-P1-K1-E5.pep
VRSRVTRNHFSLDSKSTIGVEFATKSLQMEGKTGKAQIWDTAGQERYRAITSAYYRGAVGALLVYDITKRQSFENVHRWLRELRDHADSSIVIMMVGNKSDLIHLRAISED

SEQ ID NO: 48289 - protein, 75 aa, Sorghum bicolor
  Clone ID: LIB3481-023-P1-K1-F2.pep
SAYLHLLDGFAGSGRPFRPDASRSVARLLAYQRASVKRAYVERARMLGFEPASPRTATANGAAADGQYGYLASPT

SEQ ID NO: 48290 - protein, 121 aa, Sorghum bicolor
  unsure (1)..(121): unsure at all Xaa locations
  Clone ID: LIB3481-023-P1-K1-F5.pep
RPERFKLLSHLKFPWSVNDTSASPDGKLVAGLGDSSECLVADAQSGKEIASLNGHLDYSFSSAWHPDGRVLATGNQDTTCRLWDVRNLSRSXTVLKXRIGAVRGLKFSSDGRFLAMSEART

SEQ ID NO: 48291 - protein, 73 aa, Sorghum bicolor
  Clone ID: LIB3481-023-P1-K1-G12.pep
SDPVATRRHASPARCYQARRSARRAQATLTHPDRSGGFSRELDRDRPAPQNSGEITTTLSRTLNVGVSPSHAL

SEQ ID NO: 48292 - protein, 51 aa, Sorghum bicolor
  Clone ID: LIB3481-023-P1-K1-G6.pep
KKANGRYIWQTGHERQMFLKCTPSASYAYSFKYTRIRRTGQPLQGTSHFRS

SEQ ID NO: 48293 - protein, 110 aa, Sorghum bicolor
  Clone ID: LIB3481-023-P1-K1-G8.pep
VRKYAWVLVTRPIEFGGLGILDLEKFRRALGLRWLWFSWTNPERPWNGTKLPIDVVDATLFAAATRVTVCNGRKASFWLSSWVDGQAPAIMCPLLYKHSKRKKRSIREGL

SEQ ID NO: 48294 - protein, 46 aa, Sorghum bicolor
  Clone ID: LIB3481-023-P1-K1-H1.pep
KCFHIVSCDDCKSIPLSFTNSNDTRSTSSLLKVPFLLFRSKNIALF

SEQ ID NO: 48295 - protein, 75 aa, Sorghum bicolor
  unsure (1)..(75): unsure at all Xaa locations
  Clone ID: LIB3481-023-P1-K1-H10.pep
RPFICLLFCHADMVRGLMCNLMASEVRDILRLECYVTKDIEFMFVCFWMMLRNLLQMCLMDDATXDPLSFCVVFN

SEQ ID NO: 48296 - protein, 73 aa, Sorghum bicolor
  Clone ID: LIB3481-023-P1-K1-H5.pep
RPTRAVKELKNGRLAMFSMFGFFVQAIVTGKGPLENLADHLADPVNNNAWAYATNLVPALKLSVAITPCFESV

SEQ ID NO: 48297 - protein, 52 aa, Sorghum bicolor
  Clone ID: LIB3481-023-P1-K1-H7.pep
VRPRVRHKATVAEFLSNNYDWVSIFTLGTLGKLISFMKILYPSSRCICSNHT

SEQ ID NO: 48298 - protein, 58 aa, Sorghum bicolor
  Clone ID: LIB3481-023-P1-K1-H9.pep
EGCSNQFFMVWSNLQGGSDSIELFRSPHVVSVSVCSLESVLSSVHLSYTVRVVNVLGR

SEQ ID NO: 48299 - protein, 44 aa, Sorghum bicolor
  Clone ID: LIB3481-024-P1-K1-A11.pep
GACSQCSQSFNRSTQFDSVFIVSIYKVRFRSSHIILIFCSCTGR

SEQ ID NO: 48300 - protein, 147 aa, Sorghum bicolor
  Clone ID: LIB3481-024-P1-K1-A5.pep
GRPRVRKKSQWQDVIDLNLTGVFLCTQAATKVMMRKKKGKIINIASVVGLTGNVGQANYSAAKAGVIGFTKTVAREYASRNINVNAIAPGFIASDMTAELGEELEKKILSTIPLRRYGQPEEVARLVEFLALNPPTSYLTGQVLTID

SEQ ID NO: 48301 - protein, 72 aa, Sorghum bicolor
  unsure (1)..(72): unsure at all Xaa locations
  Clone ID: LIB3481-024-P1-K1-A8.pep
THFVYLLQLQTYVRAILAIYLXLLFTNYSIFTLLPTNNFSIFNLLKLIITLLTYQSFLFYVPYLFILFKIFI

SEQ ID NO: 48302 - protein, 79 aa, Sorghum bicolor
  Clone ID: LIB3481-024-P1-K1-B10.pep
KRPPIIFSNFLRHQRALLVAAGQVQMLVSGWTRPASSFDHSFTHSLVIITSNPTPTLNNLPQKQTKKLLLMDQGSIKRS

SEQ ID NO: 48303 - protein, 40 aa, Sorghum bicolor
  Clone ID: LIB3481-024-P1-K1-B9.pep
RAVHPFQPTSMAAHPLLSYTALVCCRRAPARAVWERSHLP

SEQ ID NO: 48304 - protein, 68 aa, Sorghum bicolor
  unsure (1)..(68): unsure at all Xaa locations
  Clone ID: LIB3481-024-P1-K1-C12.pep
FNYSNLYHLLFCLIHXHQXNEDFYLHLIXIPQXIXXLXNSINYIISHFLFSINHILIFQTKLSISLFI

SEQ ID NO: 48305 - protein, 88 aa, Sorghum bicolor
  unsure (1)..(88): unsure at all Xaa locations
  Clone ID: LIB3481-024-P1-K1-C2.pep
VRSGTGNRRVLLLALRMKPESSNGVTVTAVNXAWNLIDRSKKLITSVNTVYKVVWVGVGQAFIVQLLLSRSTCKQIMRKMYNEQSMEC

SEQ ID NO: 48306 - protein, 59 aa, Sorghum bicolor
  Clone ID: LIB3481-024-P1-K1-D12.pep
KKNPHYFSFQNISLFLLIYTPFYPFLIPFFFYPQFPFFFKPLNPPFVFLLFFPQSLFPK

SEQ ID NO: 48307 - protein, 77 aa, Sorghum bicolor
  unsure (1)..(77): unsure at all Xaa locations
  Clone ID: LIB3481-024-P1-K1-D7.pep
RPRRLAPVPDPPRGRXRGGDVCVSGCHGRRGPASSGEHMAIKSGTWARRTTQRRGGGTAPLIEPTELLLPRASVLWF

SEQ ID NO: 48308 - protein, 52 aa, Sorghum bicolor
  unsure (1)..(52): unsure at all Xaa locations
  Clone ID: LIB3481-024-P1-K1-D9.pep
XIPXRPTRAKKKKISASLNNPNLLTRTFYIIILPDYFRNSILFLSFYNSYHS

SEQ ID NO: 48309 - protein, 123 aa, Sorghum bicolor
  unsure (1)..(123): unsure at all Xaa locations
  Clone ID: LIB3481-024-P1-K1-E1.pep
RPIDFTTAEHKIHXHLARNPFGQVPSLQDRGLHLWESRAICKYTALMNKPAELLREGNLQESTICGRVSSRCXSNHYTAALNPILYECLVSPMFCGTTDQKAVEENLEKLXMALEVYEAHLDK

SEQ ID NO: 48310 - protein, 105 aa, Sorghum bicolor
  unsure (1)..(105): unsure at all Xaa locations
  Clone ID: LIB3481-024-P1-K1-E11.pep
TCAATPSPQSHTYIKHCQSRSIMAFLSIMYTQRPLXSLPSTKASTNLSDYLSYAYFPAPTPGASAHRPFGDTYVYSLDFFLDRXSPAYYNVLAKRLWSYNKHFRS

SEQ ID NO: 48311 - protein, 140 aa, Sorghum bicolor
  unsure (1)..(140): unsure at all Xaa locations
  Clone ID: LIB3481-024-P1-K1-E5.pep
RASSAKWHQTLSKVHTALGGLNIYDLLEPFLDRTNTKEGIPQKNQLASRFKDLGVTWKALSVRNXMPGPAWPLRASGRDGRVPLWQELAGLSPRGIPWMNDESATAWLNNDYLRSAIHAEPGRSIGPWQVFTELDFDHDA

SEQ ID NO: 48312 - protein, 136 aa, Sorghum bicolor
  unsure (1)..(136): unsure at all Xaa locations
  Clone ID: LIB3481-024-P1-K1-F3.pep
VRKWGDKCHFAHGEKELGKPKLMGSYMPPPVGPRRXTGHFAPPPMASPGLATPASFGASATAKISVDASLAGGIIGRGGVNTKQISRVTGAKLAIRDHESDTSLKNIELEGTFDQIKNASAMVSELIVSISGNAPS

SEQ ID NO: 48313 - protein, 128 aa, Sorghum bicolor
  unsure (1)..(128): unsure at all Xaa locations
  Clone ID: LIB3481-024-P1-K1-F5.pep
VRDCYVDSMVKLTIPEDGGRPLTDGEIVSLGSELLSAGTDTTATALQWILANLVKNPAMQDRLRDEVSSVVVGADGEVREEDLQAMPYLKAVVLEALRRHPPGHFVLPHAVHEDTTLDGYXVPAGAPV

SEQ ID NO: 48314 - protein, 70 aa, Sorghum bicolor
  Clone ID: LIB3481-024-P1-K1-F7.pep
CADAWADAWGVAHVVVAAFRKCGVEVAEDASTLHECEDLDGMFAIQGSRRLAHTDQFRFLDKAAAETAAL

SEQ ID NO: 48315 - protein, 57 aa, Sorghum bicolor
  Clone ID: LIB3481-024-P1-K1-F8.pep
HAETHSAAYLECGYLIDLPGALDETECMKCSPIYQHVFINQSNMIAFDSYKINAHAS

SEQ ID NO: 48316 - protein, 74 aa, Sorghum bicolor
  Clone ID: LIB3481-024-P1-K1-G11.pep
CGILKSNGEDWLHQKKIISPKLLLDRSTGMADLIVHSAQPLLKSWKERVDRNEGITHINIDDDIRAYFAHVISR

SEQ ID NO: 48317 - protein, 49 aa, Sorghum bicolor
  unsure (1)..(49): unsure at all Xaa locations
  Clone ID: LIB3481-024-P1-K1-G12.pep
IHPVVKMCGITSARDAXLAVKAGADLIGLILWPNSKPSVSFLEAKEFSR

SEQ ID NO: 48318 - protein, 45 aa, Sorghum bicolor
  Clone ID: LIB3481-024-P1-K1-H6.pep
NCNHCVFSASFITANRIYRITNKTYVSIELPYSEFAYFELFLPSD

SEQ ID NO: 48319 - protein, 69 aa, Sorghum bicolor
  Clone ID: LIB3481-024-P1-K1-H8.pep
TSLTIMLPHSCSNLNKNYGAFLRDFFSILNLTFFPIFIINLSFYKFLIRPAMYFDLIVDSQPIVHYYNI

SEQ ID NO: 48320 - protein, 43 aa, Sorghum bicolor
  Clone ID: LIB3481-025-P1-K1-A4.pep
NKHLSIIPNMVNVNIRIRNINPSSTYVGQSTFLQHSKSVDKDV

SEQ ID NO: 48321 - protein, 79 aa, Sorghum bicolor
  unsure (1)..(79): unsure at all Xaa locations
  Clone ID: LIB3481-025-P1-K1-A5.pep
VRSLDDRCLMHMLRFLSPXPRWRLLACHPQLWLRVXRPIRDAMEPAVYPNREAAVFAAGPGDTICIAVGGAHVACNIQI

SEQ ID NO: 48322 - protein, 56 aa, Sorghum bicolor
  unsure (1)..(56): unsure at all Xaa locations
  Clone ID: LIB3481-025-P1-K1-A6.pep
YRQLSRTNSRHSPVASISRLXKTVRHDLPCPCQGSVRDCFPSGKYSAASLKSRMNA

SEQ ID NO: 48323 - protein, 44 aa, Sorghum bicolor
  Clone ID: LIB3481-025-P1-K1-B1.pep
STMCLHGTMSSELQETSLVCNPHLKIPMLSQTHYLCIKLLNNCR

SEQ ID NO: 48324 - protein, 52 aa, Sorghum bicolor
  Clone ID: LIB3481-025-P1-K1-B6.pep
PFVWFGYSIQNLNVLFIAPASPHNHTAHVVGHGSIRSEETAHPRREASPGWM

SEQ ID NO: 48325 - protein, 81 aa, Sorghum bicolor
  Clone ID: LIB3481-025-P1-K1-B8.pep
VSNIKIIGLNILGVDERPMQNTLLTPPFADVVNMSPTQFGLQKQNQLPLQIPRSFPVPGYSRMVYKEDRDDDYYYDGSDNV

SEQ ID NO: 48326 - protein, 83 aa, Sorghum bicolor
  Clone ID: LIB3481-025-P1-K1-C5.pep
RPANDWDNKRLNPGNDNYPLSTAGPNNLFLGVEQGAGSSNGQGAFSKFDNGSSMALPFGPGMCGLMGKGAKWRDGDWFGNNWN

SEQ ID NO: 48327 - protein, 56 aa, Sorghum bicolor
  unsure (1)..(56): unsure at all Xaa locations
  Clone ID: LIB3481-025-P1-K1-C8.pep
RPGRWRGQRNDQRALGGQREGGDLCREEEAEPXCGLDLHRAEAGTGEQEQXMNCYI

SEQ ID NO: 48328 - protein, 44 aa, Sorghum bicolor
  Clone ID: LIB3481-025-P1-K1-C9.pep
CVLLELVDQELCTEQHFQMGYVLLSRRWRTVNIHRINLHLRCEH

SEQ ID NO: 48329 - protein, 113 aa, Sorghum bicolor
  unsure (1)..(113): unsure at all Xaa locations
  Clone ID: LIB3481-025-P1-K1-D7.pep
VRKQNREHHHDASQIGMCVNAYPGVYGAGEVSQIPIAVGQXVIMPEIIVPNYILFVQNLVHETTPMMLQMLLCXYHVFKVVLLVLAXPVIVFLEYGDEGQATVAMNNLXSFKI

SEQ ID NO: 48330 - protein, 52 aa, Sorghum bicolor
  Clone ID: LIB3481-025-P1-K1-E1.pep
RGLLLLWEHEKTVVAHGRRRKHTTVRGAGDGERTSRRERKDVVLAIAAIVGR

SEQ ID NO: 48331 - protein, 51 aa, Sorghum bicolor
  unsure (1)..(51): unsure at all Xaa locations
  Clone ID: LIB3481-025-P1-K1-F5.pep
RPAGGPIGXVVDPLYPGGSLYPLGLADDPEGFGRLKVKELKNGRLAMFFMF

SEQ ID NO: 48332 - protein, 60 aa, Sorghum bicolor
  Clone ID: LIB3481-025-P1-K1-F8.pep
NSPINNANTSYLLLLYFVEVQRLPSNAVRRFHILVDNSTWNGSRHYSPKYLSAELVKSGR

SEQ ID NO: 48333 - protein, 128 aa, Sorghum bicolor
  Clone ID: LIB3481-025-P1-K1-G12.pep
LSSCNHTVPSKRTAFQQFPWPVGPHKPQGELLEVPQQHHNHPSQLQHLGRCRHWVVCTWRKNAPYNGRCRIHGVVGARTPWSPSDMFRAGAGVGVERVPGWGGLPWLGASRARGEEGRVIGSRMPWHG

SEQ ID NO: 48334 - protein, 60 aa, Sorghum bicolor
  Clone ID: LIB3481-025-P1-K1-G2.pep
KWSKKYLKIVRHKLKQWDLNSHSTPANGKFTLKINICQLRVYTVILFFLFILQYSGFLLI

SEQ ID NO: 48335 - protein, 111 aa, Sorghum bicolor
  unsure (1)..(111): unsure at all Xaa locations
  Clone ID: LIB3481-025-P1-K1-G5.pep
LCSSPLSQRPPASPLRLTTHHLLLAGGRLAGATRASGEEIRRAHHKGAEQGGRWRARRNGGPAAGRRQRWCRVALGLGRCTVLSYLGLAPRGQGCAGPASHWGXPADRLAV

SEQ ID NO: 48336 - protein, 51 aa, Sorghum bicolor
  Clone ID: LIB3481-025-P1-K1-G7.pep
EQAYDSKAPVLLRPCSSYRPPHLVTHNVASSGLIPSSVISSNRVIALITRT

SEQ ID NO: 48337 - protein, 66 aa, Sorghum bicolor
  Clone ID: LIB3481-025-P1-K1-H2.pep
SVKGEKQLVEKLLQTEINLLRSIRDGSALMQHMEDFYYVTLLENVKSRYQVVDGANDEYRQLTSVS

SEQ ID NO: 48338 - protein, 83 aa, Sorghum bicolor
  Clone ID: LIB3481-025-P1-K1-H5.pep
FSSSYNLGAYAWPSTLVTNACCRYRSAYAMSSPLLGLVCSPLAICDGAASPHGDTFSNGTDWYQQWLSGCGIGPRWRRGSGPW

SEQ ID NO: 48339 - protein, 47 aa, Sorghum bicolor
  Clone ID: LIB3481-027-P1-K1-B11.pep
DCGFLCANPLVDRVAPHLGKNGFLVIFGLCFRRVGCQSVVWLRSDAC

SEQ ID NO: 48340 - protein, 67 aa, Sorghum bicolor
  Clone ID: LIB3481-027-P1-K1-B3.pep
EQQLFFLSKWIKVDLGLHFLGYARDCSGQFQNLNLWNKGSGLLLFWMGLQPQTSIASFQLLPCTYLM

SEQ ID NO: 48341 - protein, 85 aa, Sorghum bicolor
  Clone ID: LIB3481-027-P1-K1-B4.pep
SVIIREHILITNLFTCLWFNEVDRFTCRDQISFSTVRDKIRARVGWMPEMFMDCERRNFVVQVLPLTQTHYVIRSCPTFFCCTAA

SEQ ID NO: 48342 - protein, 116 aa, Sorghum bicolor
  Clone ID: LIB3481-027-P1-K1-B5.pep
VRVPLHYFGQTSSTSLPSMDPPASHQTSFPPASASLPSLAAAGLAQPPPVAARSGQRARWRSSSSRSSREWLASCRCGPLVVRLHHKATTAVAPQPFPADPPHRARPLHQYGVGLP

SEQ ID NO: 48343 - protein, 55 aa, Sorghum bicolor
  Clone ID: LIB3481-027-P1-K1-C11.pep
SFLPTLLAMKASTKEPSLHRELLTALWCHCLLGDPIAHHARHNKVHGTQTLHHPA

SEQ ID NO: 48344 - protein, 100 aa, Sorghum bicolor
  Clone ID: LIB3481-027-P1-K1-C5.pep
VRFRLIHRPNNQLDEKRRLRMALDVARGMNYLHNCTPVIVHRDLKSPNLLVDKNWVVKVCDFGLSRLKHSTFLSSRSTAGTAEWMAPEVLRNEPSDEKCD

SEQ ID NO: 48345 - protein, 106 aa, Sorghum bicolor
  Clone ID: LIB3481-027-P1-K1-D10.pep
RPVALSEALGTCTRLKKLDLRDNLFGVDAGLALSKTLPKLPDLVELYLSDLNLENEGTIAIVKALKQSAPQLEVLEMAGNEINAKAAPDLAECLTAMQSLKKLTLA

SEQ ID NO: 48346 - protein, 68 aa, Sorghum bicolor
  Clone ID: LIB3481-027-P1-K1-D11.pep
VMLVSALSQMVVLHSPFLLACRPHQARRLIKLGAWCLPDPAVRSAVARESPERERAVLGGALGGCGSD

SEQ ID NO: 48347 - protein, 103 aa, Sorghum bicolor
  Clone ID: LIB3481-027-P1-K1-D6.pep
SAHADDAADAAVLLMERYSGAEHVNVGSGREVTVRELAETVREVVGYEGRVVWDTSRPDSVMRRLLDSSKMAALGWEPKVELRDGLKKLYEWYLSGRAASFQP

SEQ ID NO: 48348 - protein, 100 aa, Sorghum bicolor
  Clone ID: LIB3481-027-P1-K1-D7.pep
SAFVMKGYLGEEDSTSEIFDSEGWLRTGDLCYIDQDGFGYIGDRLKELIKYKGYQVVSASVTSILISILMTQHSIRASDLLQTCSVSLPSPLNADGIIYV

SEQ ID NO: 48349 - protein, 44 aa, Sorghum bicolor
  Clone ID: LIB3481-027-P1-K1-D8.pep
VRLRLLRATTALTRLHTMPLPSPDDMKTRGVRSYPRYSSDYKCD

SEQ ID NO: 48350 - protein, 69 aa, Sorghum bicolor
  Clone ID: LIB3481-027-P1-K1-E11.pep
LTVLRTMLLSVGTTPPCDTGHGTRLSEPLREHASIEDDLCSCSCSVLDHRVARSPSYAYTHLTFRICLK

SEQ ID NO: 48351 - protein, 58 aa, Sorghum bicolor
  Clone ID: LIB3481-027-P1-K1-G2.pep
LKCRRDLIKIKNQSHRPGHASASCCGGGAGIQHHPTPSLHNRPPLHTGGVNLHQIIRT

SEQ ID NO: 48352 - protein, 80 aa, Sorghum bicolor
  Clone ID: LIB3481-027-P1-K1-H7.pep
ADSKPVESLAHHHDRAVPAVSFVLVLVSRCAQEAHAAHDGCGALQGDADLVASEAQPAPAALSQHDGCSDVRCTVARAVI

SEQ ID NO: 48353 - protein, 89 aa, Sorghum bicolor
  unsure (1)..(89): unsure at all Xaa locations
  Clone ID: LIB3481-027-P1-K1-H8.pep
RPVGSAEIIFSGKAQPGVTASDVNVEEVRMIVDEDVGGFGFTSENELINGKAAIIGXLLLIDFELLTGKGLLKXTGFLDFIYAVSGAFN

SEQ ID NO: 48354 - protein, 65 aa, Sorghum bicolor
  Clone ID: LIB3481-028-P1-K1-A12.pep
SDLIYIHIKRPARHAVIHCTRSFTNECHLTVVDFAHRFCSTDQTLPTLPRTTSVIPSLMNCHTQT

SEQ ID NO: 48355 - protein, 53 aa, Sorghum bicolor
  Clone ID: LIB3481-028-P1-K1-B10.pep
SSTSPRGQSFSCSAARHLRRRHAACCPSTARAAPGLPPKEEVAAPALSLMWSR

SEQ ID NO: 48356 - protein, 63 aa, Sorghum bicolor
  Clone ID: LIB3481-028-P1-K1-B7.pep
QAGYPRPGGPQVLPKASLLSQPPASSLMTALLVHPTRALRTVPELDAAARRRVQRRGGGGGAR

SEQ ID NO: 48357 - protein, 37 aa, Sorghum bicolor
  Clone ID: LIB3481-028-P1-K1-B9.pep
PRCGTIKLSLTQQRSEKYETVPPTYELYTWRCCLIHR

SEQ ID NO: 48358 - protein, 70 aa, Sorghum bicolor
  unsure (1)..(70): unsure at all Xaa locations
  Clone ID: LIB3481-028-P1-K1-C10.pep
QTQKGHAAVLYWLKTNVSSQEDSSTRIIYGRSANAFNSAXLAKKEYIDGFLAGGASLKAPYFVTIVNSVT

SEQ ID NO: 48359 - protein, 66 aa, Sorghum bicolor
  Clone ID: LIB3481-028-P1-K1-C11.pep
GAGVDAERPGEVRRRPGRQRGGVRPAADFGRPASRGPRLGTRLPSLSSRRWCWCLFSHASADAWST

SEQ ID NO: 48360 - protein, 60 aa, Sorghum bicolor
  unsure (1)..(60): unsure at all Xaa locations
  Clone ID: LIB3481-028-P1-K1-C2.pep
IVVGGQEHLCXERAAAQRQHPRPPLRAHAHRHAQFAVVAAIRLVLVSRVRLCCCFGASAR

SEQ ID NO: 48361 - protein, 91 aa, Sorghum bicolor
  unsure (1)..(91): unsure at all Xaa locations
  Clone ID: LIB3481-028-P1-K1-C5.pep
VRLRVHLLEYRQARKTLDVCLTQMKAFADRWASGADVVIAYDPLWAINTGXVATPDQAQEDHAGLPDWLTTNLLPIVASSTRIIYGGSVNA

SEQ ID NO: 48362 - protein, 73 aa, Sorghum bicolor
  unsure (1)..(73): unsure at all Xaa locations
  Clone ID: LIB3481-028-P1-K1-C9.pep
DICGTFMLRYTAFSATDAKRNAGDCHVPXLAPLPIGLKELLVQVGTIRITGTGMNPARSPCAAIIYNRDHAWS

SEQ ID NO: 48363 - protein, 104 aa, Sorghum bicolor
  unsure (1)..(104): unsure at all Xaa locations
  Clone ID: LIB3481-028-P1-K1-D5.pep
PATTTTAGRDAGDGSLGEAGGEALRVLAQLDRKLDSLPYDLAAAIDSGRIGGDIGDRFNELXAYGFIKWLLTFKGFTERLLSYQRLLTKLGIQCGISFQGQTAP

SEQ ID NO: 48364 - protein, 57 aa, Sorghum bicolor
  Clone ID: LIB3481-028-P1-K1-D6.pep
TTRPLVQAPPRPEVGIRGKPHLFSVASLEFKPGGEVYLGSEARDQSAEANMLAGLVT

SEQ ID NO: 48365 - protein, 58 aa, Sorghum bicolor
  Clone ID: LIB3481-028-P1-K1-D7.pep
TNQTLKYNIKSTPGINFTLQEHYTPYIPKKLSPTIRIFTESPTQEQIPSGTALQFPKA

SEQ ID NO: 48366 - protein, 58 aa, Sorghum bicolor
  unsure (1)..(58): unsure at all Xaa locations
  Clone ID: LIB3481-028-P1-K1-E5.pep
ASAQSHSXRSKSNQKARLXIGSEARGXXXVANMSAVLVTYEAIVGRFYQIRRTVMQML

SEQ ID NO: 48367 - protein, 59 aa, Sorghum bicolor
  Clone ID: LIB3481-028-P1-K1-F7.pep
TTLTHWSGRTLPSSQRYMHLSHKLIWRLAYHIYTLGSTVTILLHNVMKASKHLGNRMLN

SEQ ID NO: 48368 - protein, 65 aa, Sorghum bicolor
  Clone ID: LIB3481-028-P1-K1-G3.pep
PKARLEHNYIGTFLGILSALGLLIAQCHVLIMFASFLFHILLWISFANMSCNAGLLNLSISRTSF

SEQ ID NO: 48369 - protein, 63 aa, Sorghum bicolor
  unsure (1)..(63): unsure at all Xaa locations
  Clone ID: LIB3481-028-P1-K1-H4.pep
SGSHSVAFGTGGMKRPGRTPFAGPQRLISVEDVICALEREPXMTKSRLIYRLHERFPVDSTVD

SEQ ID NO: 48370 - protein, 56 aa, Sorghum bicolor
  Clone ID: LIB3481-029-P1-K1-A7.pep
GWLKLGVIEVVIGGVGDSMGFLKYVESGVEYVKVNAVRVKVLDLILDMNMCECGVF

SEQ ID NO: 48371 - protein, 71 aa, Sorghum bicolor
  Clone ID: LIB3481-029-P1-K1-B2.pep
QMVSSIDLTSLNQRPGWRPTSHSCNNRNSLCRGPRLRVESCNLLTADLHLSHSPGGIALALDCTICNRSPI

SEQ ID NO: 48372 - protein, 92 aa, Sorghum bicolor
  Clone ID: LIB3481-029-P1-K1-B9.pep
PSNCNCCSSYMFNNKYPHTKHKNTLQQATIFLIVTSKNTAATSILILPQFLQPHLPPLHLLHTAPSATPTTSYRPTTTHWKRRPTICMLLII

SEQ ID NO: 48373 - protein, 107 aa, Sorghum bicolor
  Clone ID: LIB3481-029-P1-K1-D1.pep
RRTPTRPQSRLSHRNLNTQSKQAALCFYQPADRNGHGTVLTCLLRSLGRPPGCYGVSFVCPSARRRRRRRWGCPHGWGDVGRHVVGAAAEVVLDGRLPSGPGAGGAA

SEQ ID NO: 48374 - protein, 88 aa, Sorghum bicolor
  unsure (1)..(88): unsure at all Xaa locations
  Clone ID: LIB3481-029-P1-K1-D10.pep
MAGKGAKATATNSSDKDKGNKACIPVSHSSHTSPQEKEKSSPKKDVYQLFTENVNDNKQLXSRXSIMQETRVEYFLEKNFNTFIKNHP

SEQ ID NO: 48375 - protein, 52 aa, Sorghum bicolor
  Clone ID: LIB3481-029-P1-K1-D12.pep
MEGIESLETKKYPPFIFFFFMLFFLFFKILFLFFFFFFFFFFFFFFFGRVGG

SEQ ID NO: 48376 - protein, 105 aa, Sorghum bicolor
  Clone ID: LIB3481-029-P1-K1-D7.pep
SCFMLQRSRVQHIYNHRKRKENPLKTLMPVTHTVTCYNHKMYNCITGNLHPCRLGSAISDNHFFLLFLSALAANQISTHTRHQQGLNLKFAMLTISPDQHSLPTK

SEQ ID NO: 48377 - protein, 185 aa, Sorghum bicolor
  unsure (1)..(185): unsure at all Xaa locations
  Clone ID: LIB3481-029-P1-K1-F5.pep
SGKPYLREHSCLIFPPPRGRRPLAVIKFLGGAFIGAVPEVTYGYLLELLAREGFLVVCVPYNVTFNHEAAAREVFQRFHACYDALLASGLPEAGLSGLDIAELPLYSVGHSNGALLQLLVGSYFSEKIPKANAIVSFNNRPASEAVPYFEQIGPLFKXLMPMMEASPVYSVARNASGDAWKALFD

SEQ ID NO: 48378 - protein, 53 aa, Sorghum bicolor
  Clone ID: LIB3481-029-P1-K1-F7.pep
STALAVLEVAEAAQALSQSLKNFLLSIASGGVVLVAIVGAVVAVSNFDPVKRT

SEQ ID NO: 48379 - protein, 132 aa, Sorghum bicolor
  unsure (1)..(132): unsure at all Xaa locations
  Clone ID: LIB3481-029-P1-K1-G1.pep
VRPPPSGVSSFYGGESRAPSXRDRPAPTPSLQGRHARTVPDEVSRLQRENEELKMELLRMKMHMREPPAALPQPSGAPPPGRRPPPKKAAGGSGGFMNNVSKKLGRLNPFLRLDAVGTEPPKDRRRRRSIEW

SEQ ID NO: 48380 - protein, 128 aa, Sorghum bicolor
  Clone ID: LIB3481-029-P1-K1-G4.pep
SAHTLTFTLTSLSIYNTTQTRRLGSSLGRARAPPRAGRNPQRNPHPTRPSRWHSAARAPTRRATTEDTTDVTTSAPTRPRPVRIGVAILCLFSCSSCPALGGGATLRPMLSGIDSIGRTTIDSTIDNR

SEQ ID NO: 48381 - protein, 52 aa, Sorghum bicolor
  Clone ID: LIB3481-029-P1-K1-H6.pep
LSDSHESSCLTCANIMSSASCTTNCLTPFVKVLNKGVRNLKGYNDNTPLLHG

SEQ ID NO: 48382 - protein, 137 aa, Sorghum bicolor
  unsure (1)..(137): unsure at all Xaa locations
  Clone ID: LIB3481-029-P1-K1-H8.pep
MEARRSSAALVGVAVVALLVVLVPETSRAERFVVGDAARWTWGYNYTDWVIKKGPFFQNDTLVFMYDPPNATVHAHSVYLMRNAADYQSCNLKAAKLVANXHAGAAKVRVVLKKRKQHYFVSGERGGFHCTMGNMKF

SEQ ID NO: 48383 - protein, 46 aa, Sorghum bicolor
  Clone ID: LIB3481-029-P1-K1-H9.pep
KSSQHFYSHPSPPSYHSSIPTLSTLNSPSLKLIPNFYLTIYNVPSF

SEQ ID NO: 48384 - protein, 78 aa, Sorghum bicolor
  Clone ID: LIB3481-031-P1-K1-A5.pep
GVRAQVAEQKTAVQKAQENFTRRKNLAAGGAISQEELSHARDDLTSAQSALNNVQHQLNSSNALVDDTVVSNHPDVKA

SEQ ID NO: 48385 - protein, 146 aa, Sorghum bicolor
  unsure (1)..(146): unsure at all Xaa locations
  Clone ID: LIB3481-031-P1-K1-B3.pep
VRPAVYHIWKMDKMDFLVCVCALAGVIFISVQEGLAIAVGISIFRVLMQITRPKMMVQGNIKGTDIYRDLHHYKEAQRVSGFLILAIEAPINFANCNYLNERIKRWIEEESFEQDKHTELHFIILDLSAVPTIDTXGIAFLIDIKK

SEQ ID NO: 48386 - protein, 93 aa, Sorghum bicolor
  unsure (1)..(93): unsure at all Xaa locations
  Clone ID: LIB3481-031-P1-K1-B8.pep
LPXRLXVPRRLVLIFFAALSWAIWKNRNSMVIQKVFPANPDVVLYNAITLLQMWRELTKDADKIQSSKIVEGLETWISKLDRLQTFNSEIAIL

SEQ ID NO: 48387 - protein, 72 aa, Sorghum bicolor
  Clone ID: LIB3481-031-P1-K1-C2.pep
PDSRLVGSILSSFFFFFFIFFFFFFFFFGFVFIQKERPPLLKNPNLPPPPCKIISLLLGTPNSINCPPKTTQ

SEQ ID NO: 48388 - protein, 120 aa, Sorghum bicolor
  unsure (1)..(120): unsure at all Xaa locations
  Clone ID: LIB3481-031-P1-K1-C5.pep
SAPTTTPEIQRANLGWTVLNMXAVGINDLLSFDFMDPPASQALISAMEQLYSLGALNEEGLLTRLGRKMSEFPQEPPLSKMLLASVDLGCSDEILTIIAMIQTGNIFYRPREKQAQADRK

SEQ ID NO: 48389 - protein, 75 aa, Sorghum bicolor
  Clone ID: LIB3481-031-P1-K1-C7.pep
SAAAPLVDNTCSDSFDLYNGRFMYNKNSTELLNRVEWAMDSVKKKLFDGLHDVLRKQLFEGSPHAPNVSSSNVRK

SEQ ID NO: 48390 - protein, 66 aa, Sorghum bicolor
  Clone ID: LIB3481-031-P1-K1-D5.pep
KRGLCTRSMSLIETTAGSYRTETQGHNTSTCFWQGNGLPSDLTWRRYSHGSSACCSRWMCTCSRTP

SEQ ID NO: 48391 - protein, 101 aa, Sorghum bicolor
  unsure (1)..(101): unsure at all Xaa locations
  Clone ID: LIB3481-031-P1-K1-D6.pep
ARSIDGHKDILEGDTYLKQGLRLRRLYITTLNVFQAYTLKRITDPSFKXVTPQSPMTNELAVKNKPATLTKLNPASEYPSWLADTLILTMKGIAAGMHNTG

SEQ ID NO: 48392 - protein, 81 aa, Sorghum bicolor
  Clone ID: LIB3481-031-P1-K1-D8.pep
VIDYWLLRDLAKRGFSLGRLRFVMWGFCQSPGCKMKASEMILGYRWDQLWCGTYVYVSLDPFISSDRFFFFFFFFFFFFRT

SEQ ID NO: 48393 - protein, 167 aa, Sorghum bicolor
  Clone ID: LIB3481-031-P1-K1-E5.pep
VRRPLGAELSSCPDSEPLGRVGLGLYGRLLPVTTANFKATCTAAAYRGTLVHKLLQGQFFAAGRQGSRRDKGEVEPPSGLVRNSETVNPKAFELRHARPGTLSLCLGQNDDDDDIKLNPNYHNVEFLVTTGPGPCPELDGQNIVFGTVLERMDVITSIATIPTYKPA

SEQ ID NO: 48394 - protein, 64 aa, Sorghum bicolor
  Clone ID: LIB3481-031-P1-K1-E9.pep
CFFVILSFIFCFCFLVFFFFMNHFFSLNPATTASLQCYTIRRTIYMSTYHFLNVCRLIIATVRP

SEQ ID NO: 48395 - protein, 62 aa, Sorghum bicolor
  Clone ID: LIB3481-031-P1-K1-G5.pep
YIVHGLHDGVHARMPVIISTSRAHSPTHSSVMMSDMYVGRHAGNIWCGICCIITNHMSNLMS

SEQ ID NO: 48396 - protein, 75 aa, Sorghum bicolor
  Clone ID: LIB3481-031-P1-K1-G7.pep
RRASGKDWYRARFLPLERAINFVFFTGLRFYIRNSFFFFISFHTLPPLCYILFCIVNLHQESYLVFLFNFDPSTS

SEQ ID NO: 48397 - protein, 172 aa, Sorghum bicolor
  Clone ID: LIB3481-031-P1-K1-G9.pep
SGGMRAIAELLIPQLEFLNEEGAQAELWALSKIFLDTLAQETGQKVTAIFPDAGAAALLKYQWKDAQFKCASLGDRKPVDPEDEVAVMIIPDHQMLEAVERIASQLSDDPIKPLVMWNPRLVSGDVGVGSNVRNLRRNFLSTFTTVYSMRPLPTGAVFRCFPGQWKVFMMIK

SEQ ID NO: 48398 - protein, 153 aa, Sorghum bicolor
  unsure (1)..(153): unsure at all Xaa locations
  Clone ID: LIB3481-032-P1-K1-A12.pep
VRRSVPDYDGLSRLKIVTMVLYEVLRLYTPLAAVHRRTYKPMELGGVRYPAXXVMLMLPLLSIHHDKDVWGPDADEFRPERFAEGIARAAASGGDAPPAFFPFGWGPRTCIGQTFALLEAKIGLAMILGSFVFELFPXYSHAPFPVVLLQPEH

SEQ ID NO: 48399 - protein, 177 aa, Sorghum bicolor
  unsure (1)..(177): unsure at all Xaa locations
  Clone ID: LIB3481-032-P1-K1-A2.pep
PTRLKVSWRGADEAKRLVDEEGYTVLDIGQDXRERAQXKSSTHVPLFIENQDNDIGTIVKRQLHNNFAXLFFGLPFTKLNPDFARTVKDKFSPESKVLVVCQESLRSAAAADALEKEGFQNIACITSGLQTVKPGTFESVGKSELQNAXKAGLVTIQGKISVVLXGTVLISAYLVIT

SEQ ID NO: 48400 - protein, 44 aa, Sorghum bicolor
  Clone ID: LIB3481-032-P1-K1-A3.pep
LQCYTKAAVASHAADGWPLTHTGGSRASCGTLCFSFMRSSNGLV

SEQ ID NO: 48401 - protein, 37 aa, Sorghum bicolor
  unsure (1)..(37): unsure at all Xaa locations
  Clone ID: LIB3481-032-P1-K1-B10.pep
XYSFPIXIHTLLLDSNHHIKSGQRGLYLKSSLLLCPL

SEQ ID NO: 48402 - protein, 159 aa, Sorghum bicolor
  unsure (1)..(159): unsure at all Xaa locations
  Clone ID: LIB3481-032-P1-K1-C3.pep
SAHACAVFCYTEFAVEIPVAGGSFAYLRVELGDAARFIAAANLILESVIGXAVARSWTSYLASLINKPASALRIHAPELAPGYDELDPIAVVVIAVTATLAMLTAKGTXRVNWVASAXHVVVIGFVIVAGFIHANPANLRPFMPYGVPGVFRXAAIVYF

SEQ ID NO: 48403 - protein, 75 aa, Sorghum bicolor
  unsure (1)..(75): unsure at all Xaa locations
  Clone ID: LIB3481-032-P1-K1-D5.pep
SKSVCQVCSVNLMEGDIIVSGSDGLFDNIFDQEILSIISESPGSLSKTMXNFYTAKALAELARKHSVDVTFDSPY

SEQ ID NO: 48404 - protein, 68 aa, Sorghum bicolor
  Clone ID: LIB3481-032-P1-K1-E7.pep
PDLHINSLSRLQGHYRHFYTSYSFTAALTKRFSAFPTALSSQQIFHSHSSQQLFQNLHLNQTGPDAAT

SEQ ID NO: 48405 - protein, 54 aa, Sorghum bicolor
  unsure (1)..(54): unsure at all Xaa locations
  Clone ID: LIB3481-032-P1-K1-F10.pep
IKSKQIYIHIXSAAGVFYSNIRIHSTXPLFLFXRLLNSLPCPSQYHLLDKPFSP

SEQ ID NO: 48406 - protein, 41 aa, Sorghum bicolor
  unsure (1)..(41): unsure at all Xaa locations
  Clone ID: LIB3481-032-P1-K1-F11.pep
QXTHLHFYSKQILSFYTSKLISYILLHIAFNTTSIVPIFQS

SEQ ID NO: 48407 - protein, 58 aa, Sorghum bicolor
  Clone ID: LIB3481-032-P1-K1-F3.pep
TNPIRNTFTSQPRHLVHLKKKKTVFDINLIDFQFPIQYRPTVFAFLNVDKLPVCTLTS

SEQ ID NO: 48408 - protein, 149 aa, Sorghum bicolor
  unsure (1)..(149): unsure at all Xaa locations
  Clone ID: LIB3481-032-P1-K1-F6.pep
MSSLAFGFQAVLSLYASKRISGIVVHIGFNTTSVVPIFQGRVMYEIGVETVGQGALKLTGFLKELMQRRNISCESLYTVRTIKEKXCYVAADYEAELRKDTQASYAXDGEGWFTLSEERFKTPEILFQPHMGGMRAMGFAXAVTLCMDH

SEQ ID NO: 48409 - protein, 82 aa, Sorghum bicolor
  unsure (1)..(82): unsure at all Xaa locations
  Clone ID: LIB3481-032-P1-K1-F7.pep
RRVRGQLQLHSRLAILRXVLHHDRHLVVVLPVVVNVGGEFVWLVVYLVLELPVELAAEYRRGYRRSERLIRVLVPVVRAEVL

SEQ ID NO: 48410 - protein, 151 aa, Sorghum bicolor
  Clone ID: LIB3481-032-P1-K1-H4.pep
MRGKGALLLVRRLNELAHCRPPAQVCMPYSGISELKMAAAASMAARGGALVAISRPSRRMGGCRAEPPRFLVVSCDARTADVYSSLAAKILGPPMTFNAAKLKVEFAGEDKQPPSFPRAYTLTHCDFTANLTLAVSGPMTTSEQLRSWQST

SEQ ID NO: 48411 - protein, 38 aa, Sorghum bicolor
  unsure (1)..(38): unsure at all Xaa locations
  Clone ID: LIB3481-032-P1-K1-H6.pep
RPNQIKKSLGAKRRSXVLNSKRLPLRLXNRLFVXXMXC

SEQ ID NO: 48412 - protein, 40 aa, Sorghum bicolor
  Clone ID: LIB3481-033-P1-K1-A3.pep
LTLRNHYLSVSLHYILHVCSTLMTPSNLITPFIFLFTHTP

SEQ ID NO: 48413 - protein, 85 aa, Sorghum bicolor
  Clone ID: LIB3481-033-P1-K1-A8.pep
SWQSHLQGHTNRGPIIIFFLNKNQPKLPWQAYIQITINVLLNQGSICIPPTGINLPSLFFPTKTPRAGITTNMHACVCVTRLYSI

SEQ ID NO: 48414 - protein, 50 aa, Sorghum bicolor
  Clone ID: LIB3481-033-P1-K1-C1.pep
KRIPPSILLHTINLKTIFPDTKKKSLTKTPPLAPDSTLTLHKLPSLKQTN

SEQ ID NO: 48415 - protein, 134 aa, Sorghum bicolor
  Clone ID: LIB3481-033-P1-K1-C10.pep
VPCVWLCILPDDDTFAMADLQFLFFLTCRRYLLLLLWSVVAAVRCAGLAHGCSSSRCFVVHGVGLVKALHEQLGHHAVVHEVEDQLESTDLNEREYVAGVGGRAVQQLRVQDLGDDVSRRQSLDPAGERMTPAW

SEQ ID NO: 48416 - protein, 106 aa, Sorghum bicolor
  Clone ID: LIB3481-033-P1-K1-D11.pep
MGGELWIVSKMGKGGFFERLISWEKGRFWEKRGWKKKGSEMDLGGDKKKKKRGKEGEERLRIFRGGGVCFFFFFFFVCFFFFFKSFFFFFFFFFFFFFFFPTRPRT

SEQ ID NO: 48417 - protein, 57 aa, Sorghum bicolor
  Clone ID: LIB3481-033-P1-K1-D4.pep
GAHPSGKRKMLRKSLQHLCSSSEIGAALDNIGLPVTARPSDLILDDFVRLHNHLTKV

SEQ ID NO: 48418 - protein, 158 aa, Sorghum bicolor
  Clone ID: LIB3481-033-P1-K1-D5.pep
VRDNEVKNYWRTRVQKHAKQGECDVGRHRFHDAIRNLWMPRLIERIHADESSSAAVAAAAAAAENVSRYYTGASPSHELSSSQPAAAYGNAVPVGNCARAPSPDASSSVTGSSWSREASPPSQLQSSSCSTMAGCSTSTDQCHNNGCSSATSVVDMFH

SEQ ID NO: 48419 - protein, 106 aa, Sorghum bicolor
  Clone ID: LIB3481-033-P1-K1-E6.pep
IQLPCPLLLQPSLLTKTLPITQLNSPFNTSSLSPPLPNTTIIPHPIPFPNNYTPLIANPTHPLPPLNLKHSHRYSHHYRYTFLHPTPRSFHSLPSLYTHVPPISPS

SEQ ID NO: 48420 - protein, 131 aa, Sorghum bicolor
  Clone ID: LIB3481-033-P1-K1-F11.pep
RPPTRPSSYSTEDEQRLPVWRNTSFDTLDGTKGVGRLHRLMGYGSASELLRHSPDLYESFSERTTPDVRQHDRKGKGVCIDDGDGDDDYDVDDSDEEDIGALKRSARKGSGWALPWMPGKGTPAAGAIRIK

SEQ ID NO: 48421 - protein, 84 aa, Sorghum bicolor
  Clone ID: LIB3481-033-P1-K1-F2.pep
ENMPRVVSSVILHHGTSLAVGTQGHTSGIPSGNMSSTLESRQQALTSVVERIVREHSIDLHFTLIQRSFSCLPRCRWRVLSSFR

SEQ ID NO: 48422 - protein, 97 aa, Sorghum bicolor
  Clone ID: LIB3481-033-P1-K1-F6.pep
LNQIHISLPNILQPSHFQKPSIFPTYSPHSHFLFSTYLNNFHTPYPFPIPNKYSILNLNIILYPKPHPLIPSIFTYTPTHTLSLTYLLMLFFLFHPF

SEQ ID NO: 48423 - protein, 186 aa, Sorghum bicolor
  unsure (1)..(186): unsure at all Xaa locations
  Clone ID: LIB3481-033-P1-K1-F7.pep
SAKLTRTEAGAAFGNPMVYLEKXLTNPRHVEVQVLSDGQGHAIHLGDRDCSLQRRHQKVLEEAPAPGIDEKSRQEVFARCVKACIDINYRGAGTFEFLYENGNFYFIEMNTRVQVEHPVSEMVTGIDIVKEMLSIAAGNPLSYTQDDVVIRGHALECRINAEDPTKFIPSPGTVKHFHAPGGNGVR

SEQ ID NO: 48424 - protein, 162 aa, Sorghum bicolor
  Clone ID: LIB3481-033-P1-K1-F8.pep
SGRASCSGCSKSAFLGAQTDLSLGDVYFHNARASERGQHHLSSLGGLHFHGIDGGPRNMSLGGFPGASSSYGRSGSRRRRASKLHKSYYENKSPWFQESSDRVPQLLLTNQQPINSLPQWLTKDAETGTSRINADMWPSMVPAPGRSAADPPRGGFSLFVTT

SEQ ID NO: 48425 - protein, 163 aa, Sorghum bicolor
  unsure (1)..(163): unsure at all Xaa locations
  Clone ID: LIB3481-033-P1-K1-G3.pep
GGIGRTKSEQLAPLQSLSRTPSAETVLSMPADATSLSRKPSFGRKRRSASVGGGNNRTHIRKSRSAQLKLDVEDLVSSGAALSRASSASLGFSFTFTGFTSPLQHMCSPDPPPPFSDDDDSPMDIEAGTRRXKKLMXEPTLPIYLKFAEVKYRVAXKGSPREI

SEQ ID NO: 48426 - protein, 77 aa, Sorghum bicolor
  Clone ID: LIB3481-033-P1-K1-G4.pep
TRPEIPGGGDSSPNSSGKTHGYTWPMIKFPMGGTCGTPIIFHTKSYQMKLKSKTHARALLTTGTMNSTNDIILVHDT

SEQ ID NO: 48427 - protein, 128 aa, Sorghum bicolor
  unsure (1)..(128): unsure at all Xaa locations
  Clone ID: LIB3481-033-P1-K1-H11.pep
RRNSPISTVTACFYIGETSYXXFYNYSKYNKLNNILSGAYIYFLFQSPKQIKYKNFLQNINPLVFKIFTTQNKHSSIFAKSKNYSHRLQEDKKILNFFNIYIQSYLIFQKKKKRPAFLLLHSTLNLFY

SEQ ID NO: 48428 - protein, 121 aa, Sorghum bicolor
  unsure (1)..(121): unsure at all Xaa locations
  Clone ID: LIB3481-034-P1-K1-A10.pep
SGLASQHRLRVRREEGRKEGMVFFFKRGANPXXKXXLXNLIIFPHMPLSPARVTPFFPSPISLSNRSSFSIPNVTPPFSSHSPPSSLFFLSSLPIHFSSPYLPLLSFSILTLCPLSSSSPF

SEQ ID NO: 48429 - protein, 125 aa, Sorghum bicolor
  Clone ID: LIB3481-034-P1-K1-A3.pep
AHAAHAAHASGALCLEVYAVGMMLRSYWTYAALQDCNCRSLGSLIFRSIRYFRPESRAKWSNLMAQHNLISFCLLDKPTMLTKVLSVLGLKAHCDSWLYIRHIDVSLELKVLVFKELKDKTVGIV

SEQ ID NO: 48430 - protein, 172 aa, Sorghum bicolor
  unsure (1)..(172): unsure at all Xaa locations
  Clone ID: LIB3481-034-P1-K1-C4.pep
ASGDFVAYFRRRFLRTLSMASHHHGVTYELNEGREIITGYAEWARRHAGDKEQLGDTATPEASENRAADPAHADMFKRAAVFTQGYWTGARAETWLLDLLVVDPPHQRKGFGRSLVLYGVELADKDGVCASMIASEAGDGXYASCGFKGLGWMQEGEGNPLRDVPGWRNLFP

SEQ ID NO: 48431 - protein, 57 aa, Sorghum bicolor
  Clone ID: LIB3481-034-P1-K1-D2.pep
ASDFISHVFKTMVLKFCIIQTFRDGIEFMQLVIKMNLDSYKIAMLVGWWNWPTAFYF

SEQ ID NO: 48432 - protein, 90 aa, Sorghum bicolor
  Clone ID: LIB3481-034-P1-K1-D6.pep
HRFCILERSPAPTVLISGHDQYFSFTSANTSMNSSPQPAFGMTNTNTAFGMASPVNDQMNEDSMADDTSQAAPAPAPIFGSSSFGQQNIS

SEQ ID NO: 48433 - protein, 69 aa, Sorghum bicolor
  unsure (1)..(69): unsure at all Xaa locations
  Clone ID: LIB3481-034-P1-K1-E8.pep
IFKFDFSEALKKKKMLKNVFLTLVREFQRVFIKFFXIIIWRAILLKKQTKKKKKKKKKKKKKKKKGRLD

SEQ ID NO: 48434 - protein, 157 aa, Sorghum bicolor
  Clone ID: LIB3481-034-P1-K1-F12.pep
YGDRELSIRQAVVDWVIDRSRVCTRGHWRPSEDEKLKELVALYGPHNWNAIAEKLQGRSGKSCRLRWFNQLDPRINRSPFSEEEEELLLASHRVHGNRWAVIARLFPGRTDNAVKNHWHVIMARRCRERMRLSNRRGGGAAGAAVAGAGAVEDDNNP

SEQ ID NO: 48435 - protein, 48 aa, Sorghum bicolor
  unsure (1)..(48): unsure at all Xaa locations
  Clone ID: LIB3481-034-P1-K1-G11.pep
LFRSNTXXXXSFSFSXLGATQFLNRNETXNKXXFCHGLKKKKKRVVVY

SEQ ID NO: 48436 - protein, 67 aa, Sorghum bicolor
  unsure (1)..(67): unsure at all Xaa locations
  Clone ID: LIB3481-034-P1-K1-G5.pep
MTPHNNPVFLHCQYFFFXEIPTQTYPNFNFIGRLLAPRLNSLKRIXASTVCLLFIRPTPSIKYSFNY

SEQ ID NO: 48437 - protein, 93 aa, Sorghum bicolor
  unsure (1)..(93): unsure at all Xaa locations
  Clone ID: LIB3481-034-P1-K1-H5.pep
HLATSQPPTPTPSYSGGSASGSXPLGLLQLYRATLIRLITCSHDLSTPKHAAMKFTYLDNAGTGVRDSMADKKHVLLKLTDAYINHSSHCDCV

SEQ ID NO: 48438 - protein, 97 aa, Sorghum bicolor
  Clone ID: LIB3481-035-P1-K1-A7.pep
VIYGFIFNRIVFVALLLPLSNHHALWNIDSPLVTFQLDQCLQQELVLPIISPGTTSSSPGPLLEPSTSYHLQLLFSSPATFSPLAQRLSPYHEIPNL

SEQ ID NO: 48439 - protein, 93 aa, Sorghum bicolor
  Clone ID: LIB3481-035-P1-K1-B6.pep
LHLYCAPTGDTAGAPKRRVPLYQESSFPTRPSKLISFLSRDLYSINWPAVYNLDDWKNPALTQLNRLVLHLALGSYTNSEQAPTLPPTQHLRN

SEQ ID NO: 48440 - protein, 117 aa, Sorghum bicolor
  Clone ID: LIB3481-035-P1-K1-C2.pep
MASANDEDRAAAAGILRLLMGMAAAAPASALPRGGGGAGGPGLVVVQHVFLDGDGDLFSGGVGGGVPPASKAAIAALKEVKAGEVEGGGELGECAICLDGVEDAGKEMPCGHRFHGG

SEQ ID NO: 48441 - protein, 107 aa, Sorghum bicolor
  Clone ID: LIB3481-035-P1-K1-C5.pep
RPGSTGQRDAPGRVFKNRKMPGRMGGVQRTVKNVWVYQIDPARNLLYLKGQVPGPQGSFVFVKDSIYKKPDTALLPFPTYFTQEGEPEDLEPLIADLGDVDPFMAAD

SEQ ID NO: 48442 - protein, 63 aa, Sorghum bicolor
  Clone ID: LIB3481-035-P1-K1-D8.pep
QTVDLVFRLVFPWEQHCLVDVLVSVVVKVVELLVDVRLEGSLEGTQELARSVVGPGRGAWRRD

SEQ ID NO: 48443 - protein, 173 aa, Sorghum bicolor
  Clone ID: LIB3481-035-P1-K1-E11.pep
EFSPPADPSEKKADDAGTGKDIMRERRRQVFFSGIITAVGIVLHNIPEGMAVFLGSVKGLHVGLNLAVAIALHNIPEGVAVALPIYFATKSKKQAFVVAAGSGLAEPLGVIAVAFLFPSSLNPDILEGLLGSVGGVMAFLTLHEMLPLAFDYCGQKQAVKAVFVGMACMSASL

SEQ ID NO: 48444 - protein, 138 aa, Sorghum bicolor
  Clone ID: LIB3481-035-P1-K1-E2.pep
MAGACAVAVPVATPTARGRGIDGCGSLARGGSNISRRVNCRRDSPRVPVPTRSRVVTRLAGRDPGEAGTDTGVGQILKGDSGYLWTLVLGSLGGAAVIKYGSILLPDITRPNIVVALLMVSLPVVAAVLLLLKASSAD

SEQ ID NO: 48445 - protein, 48 aa, Sorghum bicolor
  unsure (1)..(48): unsure at all Xaa locations
  Clone ID: LIB3481-035-P1-K1-E6.pep
PXHNKLNQLYLTRYPETLLPNIYQSPTSCLHHISKLIIIICIIPLKYI

SEQ ID NO: 48446 - protein, 100 aa, Sorghum bicolor
  Clone ID: LIB3481-035-P1-K1-F12.pep
MIVPPTSPSPRSRRCRSISSESSTAASAAADIANEEADPVDEEEEEEEEEVVDPQAEVCYLDPDADPESIREWELDFCSRPILDAPGKKVWELMVCDATL

SEQ ID NO: 48447 - protein, 117 aa, Sorghum bicolor
  unsure (1)..(117): unsure at all Xaa locations
  Clone ID: LIB3481-035-P1-K1-G11.pep
YAHAFSQALFGVFDGHAGKKAGEFIGENMPKFITKEFKKVNGGEIERAFKRSYLKTVEEFLNRDESCGTCCVTNGLQKGXLVVYNAADFRAALNPAGKADALTSYHQDYQEDKKDRI

SEQ ID NO: 48448 - protein, 52 aa, Sorghum bicolor
  Clone ID: LIB3481-035-P1-K1-H1.pep
GWQEGSGDHTRGYGARGSLIRWNVEGVVGPLRYSHRQGCVKISGSRFSSQSC

SEQ ID NO: 48449 - protein, 57 aa, Sorghum bicolor
  unsure (1)..(57): unsure at all Xaa locations
  Clone ID: LIB3481-035-P1-K1-H12.pep
RSVHXVHKGXXPPPSSRAAGXXSCVGPGSHVTASSXXFSSSFFFFPPEXXMAXVAGA

SEQ ID NO: 48450 - protein, 160 aa, Sorghum bicolor
  Clone ID: LIB3481-035-P1-K1-H3.pep
SIGGRREAHQAPLSSRKAKKKEQLPRPHGSNRPSKPPVSSTPSSGAGKGNQNPYQPSPNAPPSPANGSRHSTPKLPPTSSCGKGHQQPSQPPPATSQGAVFNVVDFGAKGDGVTDDTKVNSFFALQMLCFKQNSIIKLSSIMHYLSQKSQNCNFFREFAI

SEQ ID NO: 48451 - protein, 52 aa, Sorghum bicolor
  Clone ID: LIB3481-036-P1-K1-A8.pep
LMMYHLMKYGARTKYTITLPLFQIIRYFNFSRYMFFYTLRYTLYLDINIYKC

SEQ ID NO: 48452 - protein, 167 aa, Sorghum bicolor
  unsure (1)..(167): unsure at all Xaa locations
  Clone ID: LIB3481-036-P1-K1-B1.pep
DPRRLDGSSVQAPFMSSTKKQYIVSYNNLKVLKLPWQQXGYKRQFSMYILLPXQDGIWSLSEKLSSEPEFLDKYIPMQKVPVGQFKVPKFKISFGFEASKLLKGLGLQLPFSAQADLSELVDSPEGQNLSVSSVFHKSFCRSELRNELRAFCAICLTSCAPVILDAL

SEQ ID NO: 48453 - protein, 123 aa, Sorghum bicolor
  unsure (1)..(123): unsure at all Xaa locations
  Clone ID: LIB3481-036-P1-K1-B4.pep
RPQGLKMLAIFKNHEAETSILEDFDFYEQREKAVLSSRQQQKQQCSKTGKQVSRLSATSEQIVTGILXTAFAEAVQLEETNDKEDKPRIEDAAAADNVPAAPVKIEEAMLKTAEVGGLLKESG

SEQ ID NO: 48454 - protein, 100 aa, Sorghum bicolor
  Clone ID: LIB3481-036-P1-K1-C1.pep
PGRQKIVGRNSIVKDQVNDPLTEKISERSEPTFTLDGGRDLQDDASHELPQQLEDNNVAKKETIPLQSLLPLPVPKSPSESWLSRTLPSVTNKPPLPSFF

SEQ ID NO: 48455 - protein, 117 aa, Sorghum bicolor
  unsure (1)..(117): unsure at all Xaa locations
  Clone ID: LIB3481-036-P1-K1-C10.pep
RSVTPWFLMKAIAKRFQDTKSGGSIVFLTQIVGAXRGWYPGSXTYGTSLGAIHQLVLLSAMELGKHKIRVNAPCRFLHLQDKYPIFVGKENAYKATAEVLPLLKIAEIHRSSLSFIV

SEQ ID NO: 48456 - protein, 78 aa, Sorghum bicolor
  Clone ID: LIB3481-036-P1-K1-C4.pep
QGWLLFTSHLCWYADINENKETDWPGPPMTWTCKPTAVPKVSIGTAGQTSCSKLSLRLTLSKHQPKWQDVYRAYLPPD

SEQ ID NO: 48457 - protein, 74 aa, Sorghum bicolor
  unsure (1)..(74): unsure at all Xaa locations
  Clone ID: LIB3481-036-P1-K1-C8.pep
KKPPXGGKERKPAEPQXXREGTGPXGGGTTPNXRXGGPPTGKQPRGGTEDPPGHQPEXGDNKAEPRXKNERGRG

SEQ ID NO: 48458 - protein, 120 aa, Sorghum bicolor
  unsure (1)..(120): unsure at all Xaa locations
  Clone ID: LIB3481-036-P1-K1-D1.pep
PSTTRPWTMRAVAVSSSSSLNPDAPLFIPAALLXVRNWSPHNFTSWAPPLFSSTLSLEHAHLYEMAEQLDSAGLLPDEEDLFYYYQLEQAPSSFYPSPAFILLKTGTDLPLSLASILDLP

SEQ ID NO: 48459 - protein, 119 aa, Sorghum bicolor
  unsure (1)..(119): unsure at all Xaa locations
  Clone ID: LIB3481-036-P1-K1-D2.pep
PLKRHGCLRRRXSLSRRRRRWEAHSRSPPPRPSRSPAPSSSSRSAARTSPTPPTRSRRLRRSWRRARRSTPPCAHASCRRQRSGRSVGRRRLGDSWAKGGCGSRPTSSTIKAHRPPVVT

SEQ ID NO: 48460 - protein, 117 aa, Sorghum bicolor
  unsure (1)..(117): unsure at all Xaa locations
  Clone ID: LIB3481-036-P1-K1-D3.pep
PGPTRPRPXTPXIXITPXHLFFXIAIYGFFEFLSSEEGVYNFATYPXPXNSFSHRCXSYKLWLEHXNMTDYITIIIVHILYMENSGPAWSDKADYGIVWASIAVHTIQSEIPVFFQS

SEQ ID NO: 48461 - protein, 110 aa, Sorghum bicolor
  unsure (1)..(110): unsure at all Xaa locations
  Clone ID: LIB3481-036-P1-K1-D4.pep
MASWATFGVGAPFQXLKXRGGLPIARRSTNGERISCMQDXVWPIQSIYQLPPLSTEELLKQHQKMEYLLRSNCWVPCRLEFSKVGFLDRENNSRSPGFNDCRHYKRYFIF

SEQ ID NO: 48462 - protein, 67 aa, Sorghum bicolor
  Clone ID: LIB3481-036-P1-K1-D8.pep
GLHLSENHFSILVSRSIYMLWTHEQNSDLSIYLKALSIYETISSFYSIEHHTKKPSFSVQDFLQYTT

SEQ ID NO: 48463 - protein, 89 aa, Sorghum bicolor
  unsure (1)..(89): unsure at all Xaa locations
  Clone ID: LIB3481-036-P1-K1-E1.pep
PHTADNMRATWDIIDGLENHRHNYFHSHSQFTACNIGMYAKDCIGHGGSDSLHSYIPSLNHIIEDIXVLLDKIINENSCVPXYLLGHST

SEQ ID NO: 48464 - protein, 152 aa, Sorghum bicolor
  Clone ID: LIB3481-036-P1-K1-E10.pep
PQRLGRAVRVPTSPPSFLLHLQPIPAGPSHVCNGSAPSQPRRRGPTPTQQLRLRRGSLDCCSRSVRPPRRRLAVSAVQETKDGEAKTAEEITEKYGLEFGLWKVFSSKDDEERGGEGKKSRTDQAIELLAKYGGAYLATFIFLSIDSFTLCY

SEQ ID NO: 48465 - protein, 110 aa, Sorghum bicolor
  unsure (1)..(110): unsure at all Xaa locations
  Clone ID: LIB3481-036-P1-K1-E4.pep
GRPTGRVGKKXLTPXXVLCKSYPSEFTAYFHYCRSLRFXYKPDYSYLKRLFRDLFIHXGYQLDYVFDWTIIKYPQFIDKNKLHVCMHFIYLHPFINQCDFYFVLHFSIFL

SEQ ID NO: 48466 - protein, 92 aa, Sorghum bicolor
  Clone ID: LIB3481-036-P1-K1-E9.pep
RPSMGTNISSNDSSKEQIIQPFALQLQLQLLLPCLHYVKHDPIFIHLITLTLTSIHDLCTRDISQTLFQTLNLLINILINILLNLSLNLYTI

SEQ ID NO: 48467 - protein, 104 aa, Sorghum bicolor
  unsure (1)..(104): unsure at all Xaa locations
  Clone ID: LIB3481-036-P1-K1-F1.pep
NLAMRPKLFHLDSHLCPDFSRICYSLGENPPLHKNYQMNSHQVGSLEIAMPSPGPILIIYRSTTCPVRHPLHVTGAITYDRHLEPPTGCAXYIPGCIIPALHSL

SEQ ID NO: 48468 - protein, 65 aa, Sorghum bicolor
  unsure (1)..(65): unsure at all Xaa locations
  Clone ID: LIB3481-036-P1-K1-F2.pep
HKLKFLQSILIIFNIGSRDINNLMAISSSFKEFQLXNYLXVYPNYIIMLLISCHMKTTTMSLITL

SEQ ID NO: 48469 - protein, 110 aa, Sorghum bicolor
  unsure (1)..(110): unsure at all Xaa locations
  Clone ID: LIB3481-036-P1-K1-F4.pep
NPPVDPLLXQLLGQIAXHKDILEGDPYLKQGLRLRNPYITALSVFHAYTLXRIRDPXXVTPHPPLSKEFAYENKPAGLVKLNPASEYPPGLEDTLILTMKGIAAGMQNTS

SEQ ID NO: 48470 - protein, 132 aa, Sorghum bicolor
  unsure (1)..(132): unsure at all Xaa locations
  Clone ID: LIB3481-036-P1-K1-F6.pep
PTRPGRAGGGKSTFIQSLFRIVEPRGGTIXSTMXTALRIXLHDLRGRLIIIPQDPTMFDGTMIGNLDPLNEYPDHRVWYIFYKCQLGDISRQNPNKLDSTVVENGXNLSISQIQLFFLLMVLLKQNNLLVLD

SEQ ID NO: 48471 - protein, 59 aa, Sorghum bicolor
  unsure (1)..(59): unsure at all Xaa locations
  Clone ID: LIB3481-036-P1-K1-G9.pep
LPLLQHLECSVFIFTKLYXLSXHSPFPTCHNIIIYPTPISLPNIFSSLMSNFTFSFFSH

SEQ ID NO: 48472 - protein, 19 aa, Sorghum bicolor
  unsure (1)..(19): unsure at all Xaa locations
  Clone ID: LIB3481-036-P1-K1-H4.pep
VEVSLDCLNCIINILFXLV

SEQ ID NO: 48473 - protein, 94 aa, Sorghum bicolor
  Clone ID: LIB3481-037-P1-K1-A10.pep
SAFLTVGARIYKLSVEGDLAALASAPALGSDPLASLTAHVSRGFLLVGQPSTGRILRVDMEDGATRTVSCPLTPPTPTAVAVRTDGAEVVGGAE

SEQ ID NO: 48474 - protein, 126 aa, Sorghum bicolor
  Clone ID: LIB3481-037-P1-K1-A4.pep
HHTSVDMPLDADLFAVPARQNAPKQVHIQLADHTGTSMFTSWVTGDATGISSLLYGLVDVKLDLTIKGSISRYTYYNYMYEYMHHKTLTNLQYRSRYHYAVGVTVRNTLRTSWFRTPPELGLDVPL

SEQ ID NO: 48475 - protein, 177 aa, Sorghum bicolor
  unsure (1)..(177): unsure at all Xaa locations
  Clone ID: LIB3481-037-P1-K1-C8.pep
GNRAAGHASADPSAHASAHSSVERFVWLVSLQSYXHSRAHPCCHDVEPRPCHHGHGCCRHHCKPECSSCRGYCCRPRAQEPSAPRKPPAGKEPKRRLPPRNHCRPVLKGAPFIVCSSCFKLVQVPADFAVSTRTVRKLRCGSCSTVLSYSYRDPARKKAYQDSVDQCSIYGSELHGG

SEQ ID NO: 48476 - protein, 147 aa, Sorghum bicolor
  unsure (1)..(147): unsure at all Xaa locations
  Clone ID: LIB3481-037-P1-K1-D5.pep
AARVRGLVGVNGPLPAPAPAPGLEATPAPTXDLVPVSNLPRPLSISDLSPAPMHGSQLRVAYQGVPGAYSEAAAAKAYPGCDAIPCDQVEVAFQAVELWIADRAVLPVENSLCCSIHRNYYLLLRHRLHIVGEVQLPVHHWLLGLPG

SEQ ID NO: 48477 - protein, 81 aa, Sorghum bicolor
  Clone ID: LIB3481-037-P1-K1-D6.pep
VKNPAARPTSPHSSSHAYLIHLAVPYPTTPFLSIVAPHPNYLVLFYSKQTNFRSRFTCSLTRLLFLISRTTINTILMPLIL

SEQ ID NO: 48478 - protein, 44 aa, Sorghum bicolor
  unsure (1)..(44): unsure at all Xaa locations
  Clone ID: LIB3481-037-P1-K1-D8.pep
IHPSFFFARCYNXQEVYFKTSSSTYPTXSISFSPILTLINSSSA

SEQ ID NO: 48479 - protein, 107 aa, Sorghum bicolor
  Clone ID: LIB3481-037-P1-K1-E7.pep
SLTSLHKKKSKDSSFTKISSAKTSNTGANSNIPVTSSPINQALVLFSRILQRGWPRNCVRVDQRPQAIRFRQPLELHSFKINGEYMSPLPEEHKARDHPDDIYIISV

SEQ ID NO: 48480 - protein, 98 aa, Sorghum bicolor
  unsure (1)..(98): unsure at all Xaa locations
  Clone ID: LIB3481-037-P1-K1-F12.pep
SVPNLKASTASPNITQPIQEWNNGKDEYIVSXSRIDHIAFDKVDFPDADLIANFMDIVRSAVRNTPSGAKGIYWKTAYFISSMVPSIKLNIKEMLDYG

SEQ ID NO: 48481 - protein, 79 aa, Sorghum bicolor
  Clone ID: LIB3481-037-P1-K1-G3.pep
MPGLDNIPSRIKKKTACSYRELEERKQRLQKLEKLYADMALQKELKKPGRKRKLKLNEDEETDNQTSQPVYKWRAQRKR

SEQ ID NO: 48482 - protein, 57 aa, Sorghum bicolor
  Clone ID: LIB3481-037-P1-K1-H11.pep
SSTMWWAGSTEARASYWLKSSFPVSYSLTWSRSFLLMLTRFYALTRSLFSNNYQYEL

SEQ ID NO: 48483 - protein, 95 aa, Sorghum bicolor
  Clone ID: LIB3481-037-P1-K1-H7.pep
VRDEYLYVSRIAVLPSFMRRKVGTELLKACESLGLKWRHTCMVLRAYEDDDGARGLYAKAGYRVVSRDPDCVTWVGRRRRVAMIKEKPVPWDRIG

SEQ ID NO: 48484 - protein, 62 aa, Sorghum bicolor
  Clone ID: LIB3481-038-P1-K1-A11.pep
IIILLTHTSTPYILYLLIINIQNTKCIKTILFKTLASKSINILHILCHSYNHLTHPVNFTYN

SEQ ID NO: 48485 - protein, 98 aa, Sorghum bicolor
  unsure (1)..(98): unsure at all Xaa locations
  Clone ID: LIB3481-038-P1-K1-A6.pep
GRACGSNKKPVPNGIVYGKPXHHIMAHGKFQRNNISLPXNKTGLNLGTLTILNSYWVNDVSSYKYFEIILNYINHTAIXTNPKINFLXTSIHKHHELL

SEQ ID NO: 48486 - protein, 103 aa, Sorghum bicolor
  unsure (1)..(103): unsure at all Xaa locations
  Clone ID: LIB3481-038-P1-K1-B11.pep
SSITGIQRYKKEGQGFCRRHEGRRHSSRFDLAGAEDGRGLSQSAQVNLASCNMSWTTVVCCWRPKLGMTARSKRHRDSSKTIYPSXRSPTTVKVHGAPTRPRT

SEQ ID NO: 48487 - protein, 121 aa, Sorghum bicolor
  unsure (1)..(121): unsure at all Xaa locations
  Clone ID: LIB3481-038-P1-K1-D1.pep
RRMEAYICKSIRGCMQRYRQGTLWKNKPRLLRGKGRNWKCRVTLSSISPFTQSIPIPXIHTRLSIYQHKASQASSSKQKSIQRCPCNREASASLPRIPFPWALASNFCAVLEFNSETTVQI

SEQ ID NO: 48488 - protein, 172 aa, Sorghum bicolor
  unsure (1)..(172): unsure at all Xaa locations
  Clone ID: LIB3481-038-P1-K1-F1.pep
MEVDSELTNSVTVLKYEPDPADSSNAIVKQDLVIDGKHGEEPDPDDTACQDVLKSGNLTERITEQSRNSTVLKSEPDPDDHVVDSNSNELQRIEEPVAALCSRLQKSIETLRLQATPAEAESAIHTLXKDIKNVIEHPNDIKYKRLRKSNPHFQRSVANYKAAMEVLEXIGF

SEQ ID NO: 48489 - protein, 164 aa, Sorghum bicolor
  unsure (1)..(164): unsure at all Xaa locations
  Clone ID: LIB3481-038-P1-K1-F10.pep
VGRVGATPVILPTNISXNCWLGTXLLAXKINEKXRLLILCSPSNPTGSVYPKELLEKIADIVKKHPRLLVLSDEIYEHIIYQPAKHTSFASLPGMWERTLTVNGFSKAFAMTGWRLGYLAAPKHFVAACGKIQSQFTSGASSISQMAGLAALNLGYAGGEAVLN

SEQ ID NO: 48490 - protein, 98 aa, Sorghum bicolor
  Clone ID: LIB3481-038-P1-K1-F2.pep
RPIDVRKARKEQLKKEESMGQVWRYCYCCRGHCIGWPVLLPQQCLQLNEESCMRPIWCREQRIRSILQFFFLYHCKCVVLLLLHIYTTRSRRLYKSRC

SEQ ID NO: 48491 - protein, 168 aa, Sorghum bicolor
  unsure (1)..(168): unsure at all Xaa locations
  Clone ID: LIB3481-038-P1-K1-G1.pep
SDTRAIIMDEFLQRYKWCPGQEAXCLKLVERKVVRQFNSILCDEKRKVRVKLVASRKSKEALDAARSKQTNLAGKELKQQHRNPASAGSEDDDPLQWKPFPPEWMQPKWWEMLCEHWASEEVLQVSAQKRKNRYTGGCAQHTAGSRSIAMHRKLMIIENGGKPVSDIE

SEQ ID NO: 48492 - protein, 212 aa, Sorghum bicolor
  unsure (1)..(212): unsure at all Xaa locations
  Clone ID: LIB3481-038-P1-K1-G12.pep
MEHRAKYNDGDDIPPLVIGVSAPQGSGKTTLVFALDYLFRVAGRNSVTLSIDDFYLTAKEQNELRDRNPGNALLELRGNAGSHDLQFSVETLESLIKLTKEGMKMKVPRYDKSAFGGRGDRADPSVWTEVEGPLEVVLFEGWMLGFKPLPNEEVKKVDPQLEVVNKNLEAYYGAWDRFIQSWIVIKIREPNCVYQWRLXAEVAMRADGKPGM

SEQ ID NO: 48493 - protein, 116 aa, Sorghum bicolor
  unsure (1)..(116): unsure at all Xaa locations
  Clone ID: LIB3481-038-P1-K1-G2.pep
VRARRPAWLVVQESLVSLESRCGVESXSETIXLRARVRRELRARGNRFCKAVGLFPVGGRSGSAPGLPFGRGSGAPLFPISGGNGEASASSSSMAASSMETRSLSAASLATASLSN

SEQ ID NO: 48494 - protein, 111 aa, Sorghum bicolor
  unsure (1)..(111): unsure at all Xaa locations
  Clone ID: LIB3481-038-P1-K1-G3.pep
MSGMQHHSKGSGSRSSSSWRQVNPGSSFXPCPSLPYSTRTPTGKCPVNTLXLLSCMDTLNCLLHSIIPTKARHTCWPLLSCVSYLDSPLXLCTTIKGKALRVSVCYLTHLV

SEQ ID NO: 48495 - protein, 107 aa, Sorghum bicolor
  unsure (1)..(107): unsure at all Xaa locations
  Clone ID: LIB3481-038-P1-K1-H11.pep
TGCSAGCDARPWPGTWRGGACCCWWWSCPWAVRWGVPWCASWCSSGGSGGAYGSAYHTGDSPLICPLICQATMRNAMRVADAVNDVSAGVIEYWVLFTVFIRVFINX

SEQ ID NO: 48496 - protein, 68 aa, Sorghum bicolor
  Clone ID: LIB3481-038-P1-K1-H12.pep
LGRSIGVVLLDITVFPIRGFFSRAFSLVLGGFFQSLLLFHHGQLILFSVTLHPQLFRLYACVCKLCSF

SEQ ID NO: 48497 - protein, 149 aa, Sorghum bicolor
  Clone ID: LIB3481-038-P1-K1-H9.pep
VRGRVGFQNNSNVRLLLKYGDAGSHMIFAASDMFIVPSMFEPCGLTQMISMRYGSVPIVRRTGGLNDSVFDFDDETIPMELRNGFTFLKADEQGFDSALERAFNYYHRKPEVWKQLVQKDMKIDFSWDTSASQYEEIYQRAAARARATA

SEQ ID NO: 48498 - protein, 40 aa, Sorghum bicolor
  Clone ID: LIB3481-039-P1-K1-A1.pep
DDICTFLAVVIFNMLEPGNISRAICGDQIGTLVDQSGRIT

SEQ ID NO: 48499 - protein, 64 aa, Sorghum bicolor
  unsure (1)..(64): unsure at all Xaa locations
  Clone ID: LIB3481-039-P1-K1-A11.pep
KQQHHHXHYYLHXXTXKQSSIXXISSDVQCFSSNVFDPTNXKHSANYSVNGGVSINHNGCNFHN

SEQ ID NO: 48500 - protein, 41 aa, Sorghum bicolor
  Clone ID: LIB3481-039-P1-K1-A12.pep
STHTYRHAYHYTITQVHNKTRAEPITLWALSPTSLFEISCP

SEQ ID NO: 48501 - protein, 65 aa, Sorghum bicolor
  unsure (1)..(65): unsure at all Xaa locations
  Clone ID: LIB3481-039-P1-K1-A7.pep
QXNHXLLYYKQGVHSNYILXXIXLYTPIKHPQNLYDRCFFFLTQKLPTTFPPLLTYQHPLNHLLP

SEQ ID NO: 48502 - protein, 48 aa, Sorghum bicolor
  Clone ID: LIB3481-039-P1-K1-B10.pep
TLPNLNHLTTHTPFSPSPNKPIFSHLSSYKTFFHLLIPNLTPPSTLHK

SEQ ID NO: 48503 - protein, 124 aa, Sorghum bicolor
  Clone ID: LIB3481-039-P1-K1-B11.pep
MNIFQLWLWLIDFMMQVVCTKQNPNCRACPFSGSCIYYNSLLARKPLPLPEKHEYEQGEQQAKMIASGSCTPSFQQMYQYQIPISSTTETPPIHNCEPIIEMPPSPEYEHNRTPNEQENSYGDY

SEQ ID NO: 48504 - protein, 77 aa, Sorghum bicolor
  Clone ID: LIB3481-039-P1-K1-B2.pep
LPSCCLILITSSKYHHPYIFPDTLPNLLTAINLHLLIPSLLNFTCSHLKPNNYCFNTSHVFFTWRDLLQLKYIHYPY

SEQ ID NO: 48505 - protein, 74 aa, Sorghum bicolor
  unsure (1)..(74): unsure at all Xaa locations
  Clone ID: LIB3481-039-P1-K1-B4.pep
FEKPNLHTTYIQHHNLFYKIHLKSSYFSKFYNTNPXXNPILTQLNPITXHTSNSISPNIQYSHSENPSQHQLNL

SEQ ID NO: 48506 - protein, 71 aa, Sorghum bicolor
  Clone ID: LIB3481-039-P1-K1-B8.pep
NNSYLYLPIKQKHLKTHLLGYWCTSTAHTLNKPTCRAKQAVSQIDANQTIHPKPYIPNKLPTTLDDLNGHS

SEQ ID NO: 48507 - protein, 61 aa, Sorghum bicolor
  Clone ID: LIB3481-039-P1-K1-C10.pep
SSTIFYYTTMRTTKISFHTLFTSFFRYPTLSPKYPTTSHNIALLTTPLTSLSHLILFYLPT

SEQ ID NO: 48508 - protein, 60 aa, Sorghum bicolor
  Clone ID: LIB3481-039-P1-K1-C12.pep
STFFHYDDMILLKTKLSCLITLIPLIRFSFSILLLLLICISFSSPCMYIILSREDYFPSK

SEQ ID NO: 48509 - protein, 117 aa, Sorghum bicolor
  unsure (1)..(117): unsure at all Xaa locations
  Clone ID: LIB3481-039-P1-K1-C4.pep
SAYTQNRATAHYRSLTGLLTTTGGMYLLSSGSXSLLRLLNINSCSNTLINFEAIPLQTSNPLQLTLTHDPSLVFIPYMASINAYNIWSHTTFRTFTAHYQLHNRCYYSXHDQELYTS

SEQ ID NO: 48510 - protein, 54 aa, Sorghum bicolor
  Clone ID: LIB3481-039-P1-K1-C5.pep
RPPTPTHHPILLHILINAILHTRPVYKPWQALIKNHFAHYVLQKFLDLYHDQNL

SEQ ID NO: 48511 - protein, 62 aa, Sorghum bicolor
  unsure (1)..(62): unsure at all Xaa locations
  Clone ID: LIB3481-039-P1-K1-C6.pep
KKAAGCVIRHGPHRLEPFXVFIKWRSMFSIAVFRPVSLCSCISKHLVMARIGLLSASFSVNA

SEQ ID NO: 48512 - protein, 44 aa, Sorghum bicolor
  Clone ID: LIB3481-039-P1-K1-D11.pep
IIQVVKKIFKYFNKKLLKKGKWNNTKILKSLLANESIILKKIFK

SEQ ID NO: 48513 - protein, 145 aa, Sorghum bicolor
  unsure (1)..(145): unsure at all Xaa locations
  Clone ID: LIB3481-039-P1-K1-D2.pep
AYSQTSQINDLYLIPMLYSLYLWGAFNKQATISTNTXFSSNYSHPYLFKKIQNLLHTIFFSPHKXNDKLKLIQDCNALSNSTRQELLLIYAYVFEINXSLYFLQLKKSSGDCSLYTKLYETLSEDLWTLKIHQFLKQDSIRQEIG

SEQ ID NO: 48514 - protein, 63 aa, Sorghum bicolor
  Clone ID: LIB3481-039-P1-K1-D5.pep
PSQSLTFHYQNYYQRMSYQIKFSIKKTSFTIIYFYFPPTSDLQTTFIMTTYLFHTSHCHIFFT

SEQ ID NO: 48515 - protein, 131 aa, Sorghum bicolor
  unsure (1)..(131): unsure at all Xaa locations
  Clone ID: LIB3481-039-P1-K1-E10.pep
RPGRHPQVALFAVFNGHTXKKAGEFSAEDIPKFIAHEFKKVNPGEIEXSVKRCYLKIYYYFLNRDKXQCTCYVTTVLQKGGLVLSNAXDCLPVLILACKAEALTSNHLTSREDENDKIDNFGGFVVNYLGT

SEQ ID NO: 48516 - protein, 162 aa, Sorghum bicolor
  unsure (1)..(162): unsure at all Xaa locations
  Clone ID: LIB3481-039-P1-K1-E12.pep
RPREIYRGSPDNPXETQRYHDGVRMGSFGLMLNSVVLGFTSVVLEKLCRKWGAGLVWGVSNIIMTLCFLAMLVITYVAQNMDYPSTGEPPTGIIVASLVVFTILGAPLAVSNRLLFLFHHNDLYPLPALSNIVHVVYSIHFLICRSHTVYHMQWLLIVLKIL

SEQ ID NO: 48517 - protein, 125 aa, Sorghum bicolor
  unsure (1)..(125): unsure at all Xaa locations
  Clone ID: LIB3481-039-P1-K1-E2.pep
ASSEINLQFXIHNSESHXIXXXGVGFYIMPEKXQTXHPHXSNXXXXXXYXISLENDVNSISSSKSTHQEKQSSKSISPYVWCSLTYAQTELQPDNCAKIPLKVCIFAPFTYNFSNYKLQYKVHPS

SEQ ID NO: 48518 - protein, 55 aa, Sorghum bicolor
  Clone ID: LIB3481-039-P1-K1-E4.pep
SYITTLYNITLPTSLISHNSRSPYLTNKFLCLSINYNVSRMTTDPQFSYPIPCLT

SEQ ID NO: 48519 - protein, 136 aa, Sorghum bicolor
  Clone ID: LIB3481-039-P1-K1-E5.pep
IPGRRASPTPFLSSQRGSVLRHHRRLRKNYERSPPLSIPQRAYVQRRSPPPLEGYGDATKGMKPLSQYPIKRQTETSVPFESCPSGCYIPKTILGSLRFPFQFVDPISSEPIYIIPSFFAGDTLSSLIRKAKKSHN

SEQ ID NO: 48520 - protein, 111 aa, Sorghum bicolor
  unsure (1)..(111): unsure at all Xaa locations
  Clone ID: LIB3481-039-P1-K1-E6.pep
MRRYXPPYXXPPKKAYCGRRRSPPPPRKRYVLLNKDGNESLLVHNIPLSVRSEELRIPFQMFDPLRDVYIPKDYYSQEPRRFSFFELFYPYYSSXTQYHINPQIFFFPKNT

SEQ ID NO: 48521 - protein, 69 aa, Sorghum bicolor
  Clone ID: LIB3481-039-P1-K1-E7.pep
RTAKSSKRYFYCTGNGCYCMFGLVVFHFIDKLKIGITMARHVQLQTYKLHVIFCIYSHLHFSLHPAVLH

SEQ ID NO: 48522 - protein, 77 aa, Sorghum bicolor
  Clone ID: LIB3481-039-P1-K1-E8.pep
QILLLYNILVHLHQYPTSKSLPCHVHQLIPKLIYNITIHYIQLSCDPLNLSIHTPLSAHLQTTILYTTQSLEIQKLI

SEQ ID NO: 48523 - protein, 57 aa, Sorghum bicolor
  Clone ID: LIB3481-039-P1-K1-E9.pep
NFLPILRFISDRSHLSQTRTYLSLHVISMQVETVSFNCYYLEKHYTSYYIHILPSYF

SEQ ID NO: 48524 - protein, 74 aa, Sorghum bicolor
  unsure (1)..(74): unsure at all Xaa locations
  Clone ID: LIB3481-039-P1-K1-F11.pep
VQKPPKITPLSFHKPXPSXXMNVPILNPALPPPPPNXINSILXKNXYNTIYRCXNLIFSLQXXXHXFIHXXXFS

SEQ ID NO: 48525 - protein, 126 aa, Sorghum bicolor
  unsure (1)..(126): unsure at all Xaa locations
  Clone ID: LIB3481-039-P1-K1-F12.pep
RPGESRTRGARRAALAMGCXQGSSQGLASGKXXASAAAACGGSGSSTRPRVDLIWLAACGCPRLLCWLFQALHLPHSRSTGPGVSLLKSQVQNSGLQNPSSASCSSPVGDAFSTWLMRDLGVQLQT

SEQ ID NO: 48526 - protein, 93 aa, Sorghum bicolor
  unsure (1)..(93): unsure at all Xaa locations
  Clone ID: LIB3481-039-P1-K1-F4.pep
RPPQHPHCPPLPVKTLLHSMLHEPDQLKPTGNSTIHXTTSTTPSPSTNHANCTWPNKISLMSPKITPRTLTCPTSCFTTPAPAATLLTSTSFP

SEQ ID NO: 48527 - protein, 74 aa, Sorghum bicolor
  unsure (1)..(74): unsure at all Xaa locations
  Clone ID: LIB3481-039-P1-K1-F8.pep
PRLNYXFHYGLNVIQFSLFYYYFKLNFLTNPVTNHVQNTQHHNQFLIFFCIITSRTIDNPIIILNLFSSTFLIP

SEQ ID NO: 48528 - protein, 53 aa, Sorghum bicolor
  unsure (1)..(53): unsure at all Xaa locations
  Clone ID: LIB3481-039-P1-K1-G4.pep
KSHPTFLTPSLTTTXTLSPANVLFNNQTIYFSISALHIPTNPTSPSTTNHYPL

SEQ ID NO: 48529 - protein, 69 aa, Sorghum bicolor
  Clone ID: LIB3481-039-P1-K1-G9.pep
FNLGYNIKKLLSLKKRKVNFDFLKGPPLFFFFFFFFFFFFFFFFFFFFFFNLLSFFFFFFFFFFFFFFF

SEQ ID NO: 48530 - protein, 111 aa, Sorghum bicolor
  unsure (1)..(111): unsure at all Xaa locations
  Clone ID: LIB3481-039-P1-K1-H10.pep
SEIYQLPPTPTKDHLMXRHWWQCSTKQEACNSALNAINALXVVLQIASFIYGQFLAILFETLLTSTVQTSAILFSSVLYFTKPXYLFNFIHKIFYSQDYIHAYNYPILKYL

SEQ ID NO: 48531 - protein, 132 aa, Sorghum bicolor
  Clone ID: LIB3481-039-P1-K1-H12.pep
VRPRVRLFRAELRRALELYRGVDGSGYRSPVPGPVPGEDDALYDPFYEHCDADGSGAEYHAEIRDKMLRIMLGVGYGLSYEAIHDDGDNERGSVLLQDAEHDAARIQARVQDDHSKVKAEADAAAGANGRPK

SEQ ID NO: 48532 - protein, 98 aa, Sorghum bicolor
  unsure (1)..(98): unsure at all Xaa locations
  Clone ID: LIB3481-039-P1-K1-H7.pep
VRSHPHPLPISLAPPLLTXTVAASSEGGSSTXAEIASVAAADGAAAALRSVLSRAHLLLSLTLLAPTSVRVSSVSKTKPILPNPNTSNSLNIYSFNNN

SEQ ID NO: 48533 - protein, 61 aa, Sorghum bicolor
  Clone ID: LIB3481-040-P1-K1-A10.pep
LLINHGTSCLYTQHNPYTFHLPNSHSLCFLPFLSPPFSSFPPQSLNQDLPLFFLLILYITS

SEQ ID NO: 48534 - protein, 89 aa, Sorghum bicolor
  unsure (1)..(89): unsure at all Xaa locations
  Clone ID: LIB3481-040-P1-K1-A8.pep
VRFNGVDADVFARFKVLXSRADDVNCFSEIXCXEPQEASKRPYAVEDDVMVRLKVLKSRPDNITSLIQESNKHQLDASANSADNVDDAV

SEQ ID NO: 48535 - protein, 135 aa, Sorghum bicolor
  unsure (1)..(135): unsure at all Xaa locations
  Clone ID: LIB3481-040-P1-K1-B11.pep
TXXXXGGSADAYTNTNRPAPPPPLTXRTTTRVMXNYQAMEAXXFXILFTXGVRAYWRRXKYHRLAYFSFCTKPQSQSLHLFSAFFLCCALISLLISLTFFYYIFFFFFFFFGWVWVFYLLLFFLYFFLFFLYFFF

SEQ ID NO: 48536 - protein, 68 aa, Sorghum bicolor
  unsure (1)..(68): unsure at all Xaa locations
  Clone ID: LIB3481-040-P1-K1-B8.pep
LILTIYRYSNFPXPRSCLIYKHTSPSLSSKLTISSHNHNRLLHNLNNTKPNFFSYKNSSTTIPSFHFS

SEQ ID NO: 48537 - protein, 70 aa, Sorghum bicolor
  unsure (1)..(70): unsure at all Xaa locations
  Clone ID: LIB3481-040-P1-K1-C10.pep
DSPCXCPLKPAGGGGTLNVTSSLCKALTPPSFPFFPFFLRTFRRFSPQTLNIGLPLRVPFKGLPELDPQK

SEQ ID NO: 48538 - protein, 120 aa, Sorghum bicolor
  unsure (1)..(120): unsure at all Xaa locations
  Clone ID: LIB3481-040-P1-K1-D2.pep
GFHFELLRDEHGWLRAQKKVLGFWLKDLGELGRVQLDVVTVQGRQMLTARSHGQRLAIGERIEPPPLPVAWADTIGTYQVLSTHEXDAPLSGISARLEEGFLVIRGQLHNEPLTDYILLP

SEQ ID NO: 48539 - protein, 111 aa, Sorghum bicolor
  Clone ID: LIB3481-040-P1-K1-E11.pep
RPSRLSGKLLKEAANYEIKKELGKHGGRVAAVNLESRAGLLAARQGLARAASRYVGLRSVMTFLGPIMWGTLLADIVIQMLGTDYARIVQAIYAFAQIRLTRTSYIEPDEE

SEQ ID NO: 48540 - protein, 76 aa, Sorghum bicolor
  unsure (1)..(76): unsure at all Xaa locations
  Clone ID: LIB3481-040-P1-K1-E12.pep
MLTRGSCSCSAASRASARRVASSGHLLLVVLSRPVLMAAAAAVAPYXVALAYTTTRTQASNDSLGYLLCCCCRTGR

SEQ ID NO: 48541 - protein, 59 aa, Sorghum bicolor
  Clone ID: LIB3481-040-P1-K1-F2.pep
RPKKKKKKKKKKKIKKKKKKNNRCRSVNILHTPTSKHHTFFLLSPKFNSLPLLLHLLTL

SEQ ID NO: 48542 - protein, 143 aa, Sorghum bicolor
  unsure (1)..(143): unsure at all Xaa locations
  Clone ID: LIB3481-040-P1-K1-G2.pep
CGETKIAVARKFSYHELSSATNDLSKDRKLGAXXFGEVYRGELLGPHQVAVKRLMRQMEVRTQKDYKTEIMTLGRISHRNLVKLVGWCHDDGELLLVYELVTNRSLDEHXHGSERLLTWPERYMILRGIGSAVEYLHSSDDNP

SEQ ID NO: 48543 - protein, 63 aa, Sorghum bicolor
  Clone ID: LIB3481-040-P1-K1-H10.pep
IKRLESLDHNCAKLTWFLFDDRQKMCKLILIKNTISSIHDQSYRNLTAKNLKIIFIHFGFEEY

SEQ ID NO: 48544 - protein, 72 aa, Sorghum bicolor
  Clone ID: LIB3481-040-P1-K1-H12.pep
RPLFQFKYRHVCLLFSDRNTRSASTLLHLYLIILYLDSYLEYLEKRGLFRLGYDSYGRKCLHQGWLSLPTVR

SEQ ID NO: 48545 - protein, 80 aa, Sorghum bicolor
  unsure (1)..(80): unsure at all Xaa locations
  Clone ID: LIB3481-040-P1-K1-H7.pep
DPRVRQTTTFHXLPNHIPHHLYHXQGPDDSIKKTSPTPPIXPLSPATPLPFLLANHTLAQHTHKSTPINTPLLITLTPPS

SEQ ID NO: 48546 - protein, 93 aa, Sorghum bicolor
  Clone ID: LIB3481-040-P1-K1-H9.pep
SAVSVMLAPDLPLCAIGDERRLMQTILNISGNAVKFTKEGHITLVASIVKADSLREFRTPEFHPTASDDHFYLKVQVKDTGCGISPQDLPHVF

SEQ ID NO: 48547 - protein, 47 aa, Sorghum bicolor
  Clone ID: LIB3481-045-Q6-K1-A3.pep
GSPLFKGLWGKTANVARKKRNKAKKLGARGVVTVTVLLSVTHSTAAI

SEQ ID NO: 48548 - protein, 63 aa, Sorghum bicolor
  Clone ID: LIB3481-045-Q6-K1-A4.pep
VSFGAAFLSSCWRHRRRTCAGLVRAPVILMERTGRSSRLGSRRCRPRDVGASGWRRSAPGRPR

SEQ ID NO: 48549 - protein, 119 aa, Sorghum bicolor
  Clone ID: LIB3481-045-Q6-K1-A8.pep
GVLPLFWSSSCFSFFVPWCGCSSCLWPLWLVPVMSVWCPGLVLPSLPSCLHVVLLCSSAACLLLRLVPLWLVVCLSVGLLLIRRVSLSVLRFVLSVTFPLLPAVLSFCLSSPPPPPVPC

SEQ ID NO: 48550 - protein, 104 aa, Sorghum bicolor
  Clone ID: LIB3481-045-Q6-K1-A9.pep
SSLASSWRMVAPLQTTFFLNESTPHLVVGGVFFLKPSVVEADAAHGLFSASRSGHVQSLKYLSGPTLKHWSVSSLCVEAFVWTVPCLSYFHGPVAFLCALPKTI

SEQ ID NO: 48551 - protein, 39 aa, Sorghum bicolor
  Clone ID: LIB3481-045-Q6-K1-B1.pep
FHQLCCQSIASAGKYSAPYHMMRWLPLCDLVAEVSLQHP

SEQ ID NO: 48552 - protein, 65 aa, Sorghum bicolor
  Clone ID: LIB3481-045-Q6-K1-B2.pep
KCFTTYVISCLCFIEASLLMDIWFLSNAATFHTDAIVSDLIVVLRCSSLCPCFLDHSMSWLYKVV

SEQ ID NO: 48553 - protein, 69 aa, Sorghum bicolor
  unsure (1)..(69): unsure at all Xaa locations
  Clone ID: LIB3481-045-Q6-K1-B4.pep
LLHSRWTMLGARGCVFPELLARXGIKFGXAVWFKAGSKILSEGGLDYLSNPKLIHTQSILCHLGTNRTC

SEQ ID NO: 48554 - protein, 112 aa, Sorghum bicolor
  unsure (1)..(112): unsure at all Xaa locations
  Clone ID: LIB3481-045-Q6-K1-B6.pep
FAFXAAAAGRXAFXARAPXPPVLPCFPLRLGXWFPFPFFXAXXAXXWPSPAPAGAFRLALSLPPPPPRLVSPPPVIRPPPPFWASFPLVPCXGFCWVXLPGVSFFXFVFPPP

SEQ ID NO: 48555 - protein, 68 aa, Sorghum bicolor
  unsure (1)..(68): unsure at all Xaa locations
  Clone ID: LIB3481-045-Q6-K1-B8.pep
VLVRCASQGAWRRAPAXGPPPLXLAAFALVASSRRCWRCPRRCXCGRRGCLRAPRRPWVRAASFLPAG

SEQ ID NO: 48556 - protein, 92 aa, Sorghum bicolor
  Clone ID: LIB3481-045-Q6-K1-B9.pep
CGPGGFGTTVSPAACRVAWSHNSPFRAALRQVFVVKKKTAPHKKRSRLVLKKKIMGSLAGVWCLGLGKIGLKGYGMDWCLCLHLCSTTPPPP

SEQ ID NO: 48557 - protein, 101 aa, Sorghum bicolor
  unsure (1)..(101): unsure at all Xaa locations
  Clone ID: LIB3481-045-Q6-K1-C9.pep
VPELSRVXTHAFFKKKKKKKKRGGGEKKKKKKKKKKKKKKKKKKKKHKKWGRPLLVGSPFCGPRFFFFFVPPIYSALLVGGALPLFFTTRVFWANPGGFPT

SEQ ID NO: 48558 - protein, 79 aa, Sorghum bicolor
  Clone ID: LIB3481-045-Q6-K1-D8.pep
PCAAGLSPPFLCPPACVAGYPLSPPPSRGWPSVRLFSFVLLLASPWSSLLRGAGVQVVVAVAMGARAFLFWVRPPPRVL

SEQ ID NO: 48559 - protein, 113 aa, Sorghum bicolor
  unsure (1)..(113): unsure at all Xaa locations
  Clone ID: LIB3481-045-Q6-K1-D9.pep
PRRRREKAYHNSRIYKERTKRWHDKRIKHKEFKPGDKVLLFNSRVKLFGHGKLXSKLDGPYKVIDTSTHGAITIQDDIGNTFKVNGQRLKIXLEPQNNLVEELDVIEFIEFSH

SEQ ID NO: 48560 - protein, 89 aa, Sorghum bicolor
  unsure (1)..(89): unsure at all Xaa locations
  Clone ID: LIB3481-045-Q6-K1-E2.pep
KPGGRTTPFXSALGLALTKGYRXNRPTALIGDGLLNAASAGLLHYMALEELFFVDFMGPKLQGSVRLQLLSFLAXLLGAGGMSIMAKWA

SEQ ID NO: 48561 - protein, 92 aa, Sorghum bicolor
  Clone ID: LIB3481-045-Q6-K1-E3.pep
HIRRTNGTGAGIVVSVSHMIGCSQHGLGCRSALPFGRFRGAIVAVNLGHAPFFGWYVANLKNVLCPGLIASKSSGKGGVFHNTNFLGQARVF

SEQ ID NO: 48562 - protein, 65 aa, Sorghum bicolor
  Clone ID: LIB3481-045-Q6-K1-E4.pep
SCRSQMVTCMRFPYCMQCAISNQCLPGLEPRQKRIAVTNAHPWYNVGQQPLPQERRATHSFLLVA

SEQ ID NO: 48563 - protein, 69 aa, Sorghum bicolor
  Clone ID: LIB3481-045-Q6-K1-E5.pep
PHYEPPDVDQAVDHPEAHEGPSAKPLNKSLSSNKPRDRKTRSATKKKHWGRHWLIKPLLHALHQCPLSC

SEQ ID NO: 48564 - protein, 66 aa, Sorghum bicolor
  Clone ID: LIB3481-045-Q6-K1-F4.pep
HVELSPHGHTQLGRVQCRAQKTPPQKKARGVRVKKKQRRPTLRPHQVGQVRPLAVPRLAPGGGGAE

SEQ ID NO: 48565 - protein, 58 aa, Sorghum bicolor
  Clone ID: LIB3481-045-Q6-K1-G10.pep
KVTESLTNSSSENPPNKSHCQTDNFSYPLPDQLAREADTQKMAVTVQLGVMNHDCTND

SEQ ID NO: 48566 - protein, 165 aa, Sorghum bicolor
  unsure (1)..(165): unsure at all Xaa locations
  Clone ID: LIB3481-045-Q6-K1-G3.pep
GSFCPGPVPSLCCLRLALGGWXPRSRWCXGVRAXXXRSSRPGFGCAPRFLLVGFVAPLSLFXWAASRFWVGRWPLWXAFCARPASLXLLVAXAASPLPLCFGVXLRVFSLWRLXCVGPSFXLVSPGCXXVLVAGARPFAGVVPLGPPLAVCFWASFFFCWSPSPR

SEQ ID NO: 48567 - protein, 108 aa, Sorghum bicolor
  unsure (1)..(108): unsure at all Xaa locations
  Clone ID: LIB3481-045-Q6-K1-G6.pep
ALVAPPARAQGLPSLGRRAFSFAVVCGTGKKIKTFFLFGIGGGLSGGEVFFLRKVKGKGVYQFVVXYRANVDGYSPMYNENEWAPNGSVLVSGTTGLLNXAKTLTGLL

SEQ ID NO: 48568 - protein, 70 aa, Sorghum bicolor
  unsure (1)..(70): unsure at all Xaa locations
  Clone ID: LIB3481-045-Q6-K1-H2.pep
RPFAHPPPRLSLKPHNHQPGEPPGLPPAAVKSGLKTHQPPLGQXXVRXKKKSFSHTKRVSSGLKKTKNIL

SEQ ID NO: 48569 - protein, 71 aa, Sorghum bicolor
  Clone ID: LIB3481-046-Q6-K1-A3.pep
SRGINMGKSRFSPPNQLFRSGLRYSIGECIRLLLLRRHAYVRLDQHSGPPFFFFFFFFFFFFPPPFFYFLF

SEQ ID NO: 48570 - protein, 103 aa, Sorghum bicolor
  Clone ID: LIB3481-046-Q6-K1-A6.pep
MYLLLLQWILHNWNDEDCVRILKRCKEVVSTREPKGKVVIIEVVVGSQSKQMLEAQFVSDLCMMLLTTGEERDRDKWQRIFQDAGFTQYKISPVLGFRSLIEL

SEQ ID NO: 48571 - protein, 85 aa, Sorghum bicolor
  Clone ID: LIB3481-046-Q6-K1-A9.pep
TYALHSDVGGGGLIVSHLNSISTGASVFTDVRRLGKNRSRSPNFNRLCSTCPLYASLAVIGEQGPPPMRGCPTVVVSLEWLNEDA

SEQ ID NO: 48572 - protein, 40 aa, Sorghum bicolor
  Clone ID: LIB3481-046-Q6-K1-B2.pep
PSLVPACLDLDNYTMVSEAAHPTIGDGTCQSDVFYKDHAC

SEQ ID NO: 48573 - protein, 85 aa, Sorghum bicolor
  Clone ID: LIB3481-046-Q6-K1-B3.pep
QQCCIFLGASNHIPISRMKIDLSCFYTKWKPDTLVTTMGNFHTRVAYSLRPSSDCGIPFLNVSYFVTDNNVYLIIFVICTGARFT

SEQ ID NO: 48574 - protein, 63 aa, Sorghum bicolor
  Clone ID: LIB3481-046-Q6-K1-B6.pep
GGAGRFTNAGHTAGAGRQHVRALRSERVRALDRGRSCVFYPKLWCDLFGWGEIFFTPELLNVC

SEQ ID NO: 48575 - protein, 82 aa, Sorghum bicolor
  Clone ID: LIB3481-046-Q6-K1-C1.pep
RTVFPPTKLSNHLPTFSQTKFSTNKGREKSSAIPQINKVNVQCISQQQVEPSQLIFEEHEQHNTWRAFISYHINKGQKLMSA

SEQ ID NO: 48576 - protein, 169 aa, Sorghum bicolor
  unsure (1)..(169): unsure at all Xaa locations
  Clone ID: LIB3481-046-Q6-K1-C10.pep
DLHXISYGVLXFMWLKFFLIWRYFRFWSLVGGVETPENMPRCINNCHDLESFWKSWHASFNRWLVRYLYIPLGGSRRKLLSIWVIFTFVAVWHDLEWKLVSWAWLTCLFFVPEILVKSLSNKFQASSSLGILVHREFKAIAGAVTISCLMVANLVGYVVGPSGIKVLLF

SEQ ID NO: 48577 - protein, 82 aa, Sorghum bicolor
  unsure (1)..(82): unsure at all Xaa locations
  Clone ID: LIB3481-046-Q6-K1-C12.pep
STHAFGHDPSQPGGGGGGXKKNPFLQPXTXLLLYLPXPSHSXHLXIYDVFSAFFRSLSVLCKWGGGGGPLQXXLGLMTLGGN

SEQ ID NO: 48578 - protein, 104 aa, Sorghum bicolor
  Clone ID: LIB3481-046-Q6-K1-C2.pep
RPVEKIYKKTKGVGKKKKKKRKKQKKKKNNKQKKSRVVRFRGPSLRSAGEARVFFFSGGDYFVVAGGICRAARRVKAGGGRTEWPWSKPPCERLAKWEGGWDAS

SEQ ID NO: 48579 - protein, 75 aa, Sorghum bicolor
  unsure (1)..(75): unsure at all Xaa locations
  Clone ID: LIB3481-046-Q6-K1-C4.pep
AQLPQVSHPNSSQAFKNIVGFDLSCXQPPPDIAICIKHNRAHLQVLVEVSPHTMCLKVGQRTACFRAPSPHYNGL

SEQ ID NO: 48580 - protein, 192 aa, Sorghum bicolor
  unsure (1)..(192): unsure at all Xaa locations
  Clone ID: LIB3481-046-Q6-K1-D10.pep
KPYDLDPQRWEGVTHVICXPGTTAFPSKRWDGDNTPERVDWDGIRNLVSALPQTIKRLGLVSSVGVTKYNEIPWSIMNLFGVLKYKKMGEDFVRISGIPFTIIRPGRLTDGPYTSYDLNTLLKATAGERRAVVIGKGDKLVGEVSRLVVAEACIQALDIESTEGQIYEINSVKGEGPGTDPEKWEELFRSVQ

SEQ ID NO: 48581 - protein, 36 aa, Sorghum bicolor
  Clone ID: LIB3481-046-Q6-K1-D7.pep
PCSRSESAYIVTDTLFKVMSTSMNFLGPLPPRESVV

SEQ ID NO: 48582 - protein, 97 aa, Sorghum bicolor
  unsure (1)..(97): unsure at all Xaa locations
  Clone ID: LIB3481-046-Q6-K1-E12.pep
KFKGERRGTWPERKGKEGKQGGVGVCTREAVQVAREAQAPGALRWERDRAGGHFPFTVEATVGYGXGGAGPLPLGKERGXWGEKKNSPPPPPVWVRV

SEQ ID NO: 48583 - protein, 69 aa, Sorghum bicolor
  Clone ID: LIB3481-046-Q6-K1-E3.pep
LKKKNAYRKKGGATLLTPKKRTLASKNITLVLRHLILFQWPAINNCLPGKTLLLPIYISLEHIPFPLDG

SEQ ID NO: 48584 - protein, 49 aa, Sorghum bicolor
  Clone ID: LIB3481-046-Q6-K1-E6.pep
TLRPYVCRDYSFGVEAQKEHKPGAMNTNSSTRTQYHTRCFPYKILQELT

SEQ ID NO: 48585 - protein, 157 aa, Sorghum bicolor
  unsure (1)..(157): unsure at all Xaa locations
  Clone ID: LIB3481-046-Q6-K1-E8.pep
HPPDQQRGIFAGKQLXDGRTLADYNIXEEXTLHLVLRLRXGMQIFVKTLTGKTITLEGESSDTIDNVKAKIQDKEGIPPDQQRLIFAGKQLEDGRTLADYNIQKESTLHLVLRLRGGMQTCVKTLTGKTITLEVETSDTIDNVKAKIHDKEGITPEP

SEQ ID NO: 48586 - protein, 107 aa, Sorghum bicolor
  unsure (1)..(107): unsure at all Xaa locations
  Clone ID: LIB3481-046-Q6-K1-F10.pep
QFGGGGGVFFLKPFSSYPPFPCCFFAEKARSPRPSHFLPXLNAEWDTPCTVSLTPKRGGFTRNAPGTLSSALAPGPCAFFLFFFATCAGFPLSPLNCRLPFRFRVTV

SEQ ID NO: 48587 - protein, 195 aa, Sorghum bicolor
  unsure (1)..(195): unsure at all Xaa locations
  Clone ID: LIB3481-046-Q6-K1-F11.pep
FWKGLRTSTGGWPXHCRTYLTRVAGCRLRNPRWLKDTPADAGADDEEFLEDSMDAQDLALRLSIDGEKSSLNTNDPLSSDPQDQVQKIMNKIKQSSALPPSMSSGGDGAKNAAEATGGTMNKYPLLRRRRRLFVIAVDCYEDDGRASKKMLQVIQEVFRAVRSDSQMSKISGFALSTAMPLSETLQLLKLGKIPA

SEQ ID NO: 48588 - protein, 102 aa, Sorghum bicolor
  unsure (1)..(102): unsure at all Xaa locations
  Clone ID: LIB3481-046-Q6-K1-F12.pep
MARVEGVPVIARRPYSARARRPASTPAAAFDPLXXLADDPEAFAELKVKELKNGRLAMFSMFGFFVQAIVTGKGPLENLADHLADPVNNNAWAYATNFVPGQ

SEQ ID NO: 48589 - protein, 39 aa, Sorghum bicolor
  Clone ID: LIB3481-046-Q6-K1-F2.pep
LAAFSAGRLGELPNRVRFSEQQVSHNHAPYTVPYDRASP

SEQ ID NO: 48590 - protein, 166 aa, Sorghum bicolor
  unsure (1)..(166): unsure at all Xaa locations
  Clone ID: LIB3481-046-Q6-K1-G12.pep
MAASGDHVGGDPPESTQLRLGDDIAWSFFIGVYDRDGGGGGNSYPKXVVKNHPGDVSGGSSQRFSGNLKPTAAPIIGLSRKLGGSVRRHQHPPAMFPKKAKTGGGGRAPKAAVPEPGSPKVSCIGKVLSDRERARLGHRPPRGGARAPGCWGGLGLLMRRSRSRHS

SEQ ID NO: 48591 - protein, 149 aa, Sorghum bicolor
  unsure (1)..(149): unsure at all Xaa locations
  Clone ID: LIB3481-046-Q6-K1-G3.pep
GPLPLSRPVAHGGCPAGRLLWLSPGFSPSRRCPPPPPGLISRAPARPLGLAGSRPFAWVLSCGPPFFFSFGRVRPVLQGCFVGLPPGLPPPPVVSLRSPAFVLAAAFPCPCSSVPPXASPGRLVLPPSSLFAFPLFXPPPPRRFFLKIF

SEQ ID NO: 48592 - protein, 71 aa, Sorghum bicolor
  unsure (1)..(71): unsure at all Xaa locations
  Clone ID: LIB3481-046-Q6-K1-H12.pep
TDSHGKFNPTKKGRKREYQFIGHGAFPXQKGRSIPYPSCRYVMLPTRSIEEASCCQQXISHPTPHILAPIW

SEQ ID NO: 48593 - protein, 56 aa, Sorghum bicolor
  Clone ID: LIB3481-046-Q6-K1-H6.pep
RYWTTATWLPKKNRHPTKTTGVVIKKKKGAPMKRTWYESTYPRTEEPGSVLRADPG

SEQ ID NO: 48594 - protein, 102 aa, Sorghum bicolor
  unsure (1)..(102): unsure at all Xaa locations
  Clone ID: LIB3481-047-Q6-K1-A11.pep
RVXPTPFLSILKLYLSSGDGWVVFYAAFRSCPELLWXMDQQXYPNRIIFGPXXVXXVGSGXTFHAKKYXRRVSRVGGGREIXYVYQESXWSLKFPEKISXLL

SEQ ID NO: 48595 - protein, 120 aa, Sorghum bicolor
  unsure (1)..(120): unsure at all Xaa locations
  Clone ID: LIB3481-047-Q6-K1-A12.pep
PXSTHASLCXAQQRKVGGGGGHSFLVFYRSALTGKRSIPSLRASRTKIPGFLDAVKQNWEALVQSNCAGGGGGINLQRLSKGLQKWGQWKVGNISSSVRIGQGDPSSFGNRERLYGALCS

SEQ ID NO: 48596 - protein, 90 aa, Sorghum bicolor
  unsure (1)..(90): unsure at all Xaa locations
  Clone ID: LIB3481-047-Q6-K1-B10.pep
HSQASNNFLYPKKRSAEGARAHRTLQGLQPPEAANFENKTTFNELNQLAEEAPRRAQXARPREVSTPQGKKESLAKQKGLDMETTQQSYT

SEQ ID NO: 48597 - protein, 47 aa, Sorghum bicolor
  unsure (1)..(47): unsure at all Xaa locations
  Clone ID: LIB3481-047-Q6-K1-B6.pep
PFFFLFFFFFFFFLFFXFFFFFFFFFFPFFFFFFFFFFFFFFCNRQP

SEQ ID NO: 48598 - protein, 183 aa, Sorghum bicolor
  Clone ID: LIB3481-047-Q6-K1-D6.pep
VLPAALPRASCGAGPGGRAPPAPRAGARPQRVRPRRSEPDRAPPGGRAGARPLVPRSTRPAGGGRAPRPAPAPAPHSSARWTRPARAPRRRSPTRTPVEAPRARSEPSARAVPAPISGGREPAPIYGGRVASTGGYVIVDEKLPRFVVPDLTGFKLKPYISQCARDLTASTSATSAETTENKS

SEQ ID NO: 48599 - protein, 67 aa, Sorghum bicolor
  unsure (1)..(67): unsure at all Xaa locations
  Clone ID: LIB3481-047-Q6-K1-E1.pep
PPPPQKKKKKXXNPPPPKKKKTPSXXXXXPXXGGGGGXKKRGGGGANFISXPHKQGTEANECLVTTS

SEQ ID NO: 48600 - protein, 139 aa, Sorghum bicolor
  unsure (1)..(139): unsure at all Xaa locations
  Clone ID: LIB3481-047-Q6-K1-E12.pep
KGPSIFFLQHFYCHFARFIWNTVHATFGXFNRRGAMGNIHMFGSWLLGFWPKYKNQIILGTTAICXAIWLNRNDMVFNKAKPNIFLQEVFRATYWTXIWSLLHKEGERLNINNNCWILEXVIMEVFTKFGWKLQNRIES

SEQ ID NO: 48601 - protein, 102 aa, Sorghum bicolor
  Clone ID: LIB3481-047-Q6-K1-E2.pep
PWVWRGRFFYSVVIGENAWGRPYVKGLGAIPLFPTVGLIGRGAWARALLSKAFAPWWVGGMAPLPVPAPLPAAVRAVSSHFVRFFGGALSGGPFWGFPLGFP

SEQ ID NO: 48602 - protein, 112 aa, Sorghum bicolor
  unsure (1)..(112): unsure at all Xaa locations
  Clone ID: LIB3481-047-Q6-K1-F12.pep
PLNRKSYXXVANARXYVXXLGSXLERXRPFFFFXFELXIVSXLCWFAXNNKXXSGKGAAXXIPFTXPYXXYMGTXXTSXIPQXXPILYXXHGXXHLXRLVTXLFGXXAMXXC

SEQ ID NO: 48603 - protein, 187 aa, Sorghum bicolor
  unsure (1)..(187): unsure at all Xaa locations
  Clone ID: LIB3481-047-Q6-K1-F2.pep
PSVKKKKKKKKKKKKKKKKKKKKKKKKRGGPLLRVPRLFYRVPCQRFEFSYVGPLNSISWARGFTKVRAGENPWRSPTNSLGIKSPFPQWGXSKGAPPDRLSNLLATRIGHGAPPCSAPLTAGAVGVPPTLPVPFASALAPVFFVFSPSFFASSAGFPRKVLNWGFLLGSQFSVYRNLPPKNFVWGK

SEQ ID NO: 48604 - protein, 101 aa, Sorghum bicolor
  Clone ID: LIB3481-047-Q6-K1-F8.pep
NWGNQRFSQPQGVKNRARKFNLGAPKKKKKPGNPPHQKLDPLKRAPPFFFFFFFFFFFFFFFFFFFFFFFFFFFFFFFFFFFFFFFFFLPLSFFFPTRQRT

SEQ ID NO: 48605 - protein, 159 aa, Sorghum bicolor
  unsure (1)..(159): unsure at all Xaa locations
  Clone ID: LIB3481-047-Q6-K1-H11.pep
QNHXXPEGIELXIMSXQQFELEPHXISRXXGXPRHGXQLXSTEXTLXLKGTXLGEMAAXPSGSRFAATXTXHXRXXVTXLXXTTLLLSLQWDXXIXXAXRKRACXXPPPPLRLINXXHNKKEKENRHTIQGXPALAPWRXRRSLPLMAXHPPPPPLTAA

SEQ ID NO: 48606 - protein, 61 aa, Sorghum bicolor
  Clone ID: LIB3481-047-Q6-K1-H6.pep
RDEHDLTVVLIEHDMGMVMSISDHIVVLDHGNVIAEGGPEAIRNDPKVIAAYLGADEEELV

SEQ ID NO: 48607 - protein, 123 aa, Sorghum bicolor
  Clone ID: LIB3481-048-Q6-K1-A12.pep
YKFNSLGGRWGGVPTSSSLLYKEEFEKMKEKAPENFRVDYAVSREHTISSGERMYIRGGGGEYKEELWELLKKDNTYVYMCGLKGMEKGIDDIMVSLAEKDGIDWFDYKKKLKKGEQWNVEVY

SEQ ID NO: 48608 - protein, 101 aa, Sorghum bicolor
  unsure (1)..(101): unsure at all Xaa locations
  Clone ID: LIB3481-048-Q6-K1-A7.pep
KRTLXXYFGSCCXXXXFATHQARTPDYPPKRSXRWWRARRXRCRRRXXSQNTPPPPSGGVGVGRRKRRRLSGTVAGWLARSLVGLVHEERRTDAGGGQAED

SEQ ID NO: 48609 - protein, 40 aa, Sorghum bicolor
  Clone ID: LIB3481-048-Q6-K1-C7.pep
MYALHADVLGSSYSETSSPLHWPVCFTTNAPWETRGGGPT

SEQ ID NO: 48610 - protein, 90 aa, Sorghum bicolor
  Clone ID: LIB3481-048-Q6-K1-D2.pep
IRAGCFPSFGVHLSLQCCTKSPSSSPGLRACRQKLIIWSTFSTYCSFSSFYRWKRTGNHLKNVFACGSWLSRKHILASYFLMDHLSIAVW

SEQ ID NO: 48611 - protein, 124 aa, Sorghum bicolor
  unsure (1)..(124): unsure at all Xaa locations
  Clone ID: LIB3481-048-Q6-K1-E3.pep
MREKELSYVIEALCTLPGVGPKXAACIALFSLDQNHAIPVDTHVWKVATQYLLPELAGKSLTPKLSVIVADAFVTRFGSYAGWAQNVLFIGQLPAQKLVVAQVNSDNGTTKPTKRKRGVQPKPC

SEQ ID NO: 48612 - protein, 127 aa, Sorghum bicolor
  Clone ID: LIB3481-048-Q6-K1-G10.pep
VLLFWAPPNHFFFAFFYNTPNWGGGGGFFFFIRLVAKTPFCPTVVVIRQRPPPVGRPLTIAPASRAEWGPPPVAAPQNAAVCGGFLAAGSTTLGGSLLPPPYLYFLPSLTASAGVPRQAFIRGFPLG

SEQ ID NO: 48613 - protein, 57 aa, Sorghum bicolor
  Clone ID: LIB3481-048-Q6-K1-G5.pep
FVLKFYMDAIIDVIVPFISHVPNYCLRSWISNHIMNHQMRLHQLIIRLRLKRHHQRP

SEQ ID NO: 48614 - protein, 105 aa, Sorghum bicolor
  Clone ID: LIB3481-048-Q6-K1-H11.pep
ISKICGLSAVMNVSGILEIAEKWYGAKGKLQGEYGAPLKPGKISERRKGGVLFAIVSKGVSRGLSSPTQLGNSGVKKKTPPPPPRSSFWIKKKKNWASSVVNGRA

SEQ ID NO: 48615 - protein, 195 aa, Sorghum bicolor
  unsure (1)..(195): unsure at all Xaa locations
  Clone ID: LIB3481-048-Q6-K1-H4.pep
FRTNFTVTRSPVTLILLLLLCAAATAAVPRYREAPHFTNSAAAQCPPPLHPSDADAACSPHAAVHVAMTLDASYLRGTMAAVLSVLRHASCPESIHFHFIASASPKSRATAEELGATVRASFPSLAFRVYPFADEARVAGLISTSIRGALDRPLNYARSYLASTLPPCVRRVVYLDSDVVLTDDIGXLAXTPLPG

SEQ ID NO: 48616 - protein, 191 aa, Sorghum bicolor
  unsure (1)..(191): unsure at all Xaa locations
  Clone ID: LIB3476-001-Q6-K1-C8.pep
MAAVFFHHVVGDLTVGKPEVAELHDTDTLDDAARAIAASPEGAVPVWRPRAAPYDPPSGARFIGMISALDIAAFVAAAGVGDRAMRAVVGEVVQPNPALLREIDPGTRLIDALELMRHGVKRFLVRKSGSWKGITKRXSVLFNGKWLKNMESTSPNAASSSSMPLSPPSGSADXFCCLSREDVLRVLIGCL

SEQ ID NO: 48617 - protein, 90 aa, Sorghum bicolor
  unsure (1)..(90): unsure at all Xaa locations
  Clone ID: LIB3476-001-Q6-K1-D5.pep
MEDDTITLQHQGGEEQHNAVSYQVEVXKDRGLLDSLLDRKRHEDQHKKQVDELATDMEKATAAEPETDEEEHEARGETTESLLAMLHRFS

SEQ ID NO: 48618 - protein, 66 aa, Sorghum bicolor
  Clone ID: LIB3476-001-Q6-K1-G5.pep
MRRLKLGRGREGGTGAPAMVHVSLYRNYGETLKKPRPPSEKEPPDAELKLVGEYGLRCKRELWRVQ

SEQ ID NO: 48619 - protein, 104 aa, Sorghum bicolor
  Clone ID: LIB3476-001-Q6-K2-A5.pep
THLRNTSTTVISTLNTDRRPNSPSSTSIAWQTVAASVGLEVLEQAVPPDHLVAVAALHVAYRVHCRAGPPADGEPGRGPLGLRLGPPQRLPATTLLLVHGDAAA

SEQ ID NO: 48620 - protein, 105 aa, Sorghum bicolor
  Clone ID: LIB3476-001-Q6-K2-C1.pep
GRVGDTLGGDGNVWLIYWEALCSIHLLGNIWPSLLHHILYGPISVTHRTKAVHLPYWTRRYAFYVLVTLILPCLAGLLPFASLSDWKELAVQYLKSRFSGSNIED

SEQ ID NO: 48621 - protein, 91 aa, Sorghum bicolor
  Clone ID: LIB3476-001-Q6-K2-D1.pep
SPSCLGRSLVVADFPNAGGRGLAAARDLRRGELVLCAPRAALLTSDRVTADDPRIFVCVRAHRPRLYYEQILIACLLAEVLKGRNSFWYPY

SEQ ID NO: 48622 - protein, 170 aa, Sorghum bicolor
  Clone ID: LIB3476-001-Q6-K2-D3.pep
DAWVLICSSILSTEGVVRAIPFRKLRHDTIVADVLSVKEFPRNLLLEVLPPGFGIICTHPMFGPESAKHGWGKLPFVFDKVRVAEDGDQAAKCDQFLSIFEQEGCRMVEMSCAEHDRYAAGSQFITHTIGRVLSQLNLKSTPINTKGYETLLQLTKNTVSDSFDLYYGLF

SEQ ID NO: 48623 - protein, 138 aa, Sorghum bicolor
  Clone ID: LIB3476-001-Q6-K2-E6.pep
MSHSRSKSDSIRVLRTDSADSASPRCHAQHQQEAGELKDQNSTTKMLSSATELPCSLKREVQVLEKRLNDQFVMRRALEKALGYKPCAIHASSENCIPKPTEELIKEIAVLELEVICLEQHLLTLYRKAFEQQYSPVN

SEQ ID NO: 48624 - protein, 112 aa, Sorghum bicolor
  unsure (1)..(112): unsure at all Xaa locations
  Clone ID: LIB3476-001-Q6-K2-F12.pep
FTNRIPGXGWXVSLGLAAVPAAVVVLGALLVPDTPSSLVLRGDTDSARASLQRLRGPGGGGDXXLKDIXRAVKDARRNDKGAYERLXRGKGYGHYLVMVXAIPFFFELTGVI

SEQ ID NO: 48625 - protein, 141 aa, Sorghum bicolor
  unsure (1)..(141): unsure at all Xaa locations
  Clone ID: LIB3476-001-Q6-K2-G4.pep
GFNQDTYAASIDAGGDATLSFPGAPPFKASDLPGVVDSDPEAAMAILQTLHRMAASDGIVVNTFVELETRAVRALRDGLCVPGRATPPVYCIGPLVSGSGGGXEMEHECXRWLDTQXDSSXGVLCFGRPGTFFERQLKEVA

SEQ ID NO: 48626 - protein, 122 aa, Sorghum bicolor
  Clone ID: LIB3476-002-Q6-K1-D8.pep
MISAKRIVWMAKKWQRMAALARKRLTATPRKEDADCPCSASTSVAVKGHCVVYSSDGRRFEVPLAYLGTAVFSELLSMSREEFGFAGANGRITLPCDAAVVDYMMHLLRRDASEEIARAFLS

SEQ ID NO: 48627 - protein, 119 aa, Sorghum bicolor
  unsure (1)..(119): unsure at all Xaa locations
  Clone ID: LIB3476-002-Q6-K1-E12.pep
PXXXPPGXGXXPPAXAAPHPRFXRRGTAPATQRPARGGRPPRAVWGRTPATAPPPHXRRPLALRPRPGLPPPRRGRPATHLPRRRRRRRRQTRVPEWWGRGARRRDPYPRADGLVGGRR

SEQ ID NO: 48628 - protein, 69 aa, Sorghum bicolor
  Clone ID: LIB3476-002-Q6-K1-G1.pep
PSLLCAYSGLAPSGSLGQESHLVDPSCRCPVPQARHRHDRVSSSAHSVLAVDSMGGPSSLEATGPVKSR

SEQ ID NO: 48629 - protein, 167 aa, Sorghum bicolor
  unsure (1)..(167): unsure at all Xaa locations
  Clone ID: LIB3476-002-Q6-K2-A3.pep
IEDEDERISSLAKLFFHELSKKGSNPIYNLLPDILGRLCNQHLKEETFCNIMQFLINSIKKDKQMEALVDKLCNRFAGVNDVRQWEYISYCLSQLTFTEKGLKKLIDNFKMFEHALSEDSVMNHFRSVISKCKKFAKPELKVCIEEXEEKLSKVHQEKKEQEETTKN

SEQ ID NO: 48630 - protein, 70 aa, Sorghum bicolor
  Clone ID: LIB3476-002-Q6-K2-A6.pep
YIQNSKVGSSSKTHLKFAVNNRAALVPRTRAPLQGTQYGATRRKLVRMRVRWNTVVTEKPASEIKQSKYA

SEQ ID NO: 48631 - protein, 144 aa, Sorghum bicolor
  Clone ID: LIB3476-002-Q6-K2-C1.pep
GRAENPKEDYSSGVQEAERNKLVFFEGSSYNFDLEDLLRASAEVLGKGSYGTTYKAVLEDGTTVVVKRLKEVVVSKKDFEQQMEIVGRVGQHQNVIPLRAYYYSKDEKLLVFDYVPSGSLAAVLHGNKASGRAPLNWETRVKIS

SEQ ID NO: 48632 - protein, 67 aa, Sorghum bicolor
  unsure (1)..(67): unsure at all Xaa locations
  Clone ID: LIB3476-002-Q6-K2-C7.pep
KSPQQPRARQSTVSLAGLLRPHHPQALRLTPSYKYSPDNAXTPWGGHLISSHPSXTXXNLXKXPFFP

SEQ ID NO: 48633 - protein, 184 aa, Sorghum bicolor
  Clone ID: LIB3476-002-Q6-K2-D3.pep
ILSHIISLTSVSSNSPMVFPEALLQQILKSMIHTDIDTRVGAHHMFSAIIVRGPSHLRSESEYLYETKKQSRTTSVFASATALLEKLRREKESLSSDKPRNIVHDDVKEMHEEDKRKNPAYFSKLVSSFIERCAKRSSSVEETNIAMLTEDQTNQLLSSFWIQANQTDNTPFNYEAIGHSYSLT

SEQ ID NO: 48634 - protein, 143 aa, Sorghum bicolor
  unsure (1)..(143): unsure at all Xaa locations
  Clone ID: LIB3476-002-Q6-K2-E2.pep
GNFVNEPSLRSVLSDPLSGAFLEDAMVLSCGHSFGGLMLKKVLETARCSICNGEVDEASLFPNLALRAVATVVKMEDDRRLFHNAALRKRRKEVTEHMDAQRRSGSSKDSIELGLDAESPKAFKGVQYPFVAXERVXIMGNKR

SEQ ID NO: 48635 - protein, 52 aa, Sorghum bicolor
  Clone ID: LIB3476-002-Q6-K2-G1.pep
VFLMQHKHDSRGTTTGTRLTNSLQLRSCFRLLLPSLWHHLSSREIHHSCCMV

SEQ ID NO: 48636 - protein, 97 aa, Sorghum bicolor
  unsure (1)..(97): unsure at all Xaa locations
  Clone ID: LIB3476-003-Q6-K1-A11.pep
HSSTPHPTWLSALLATRHMAPAFTSLLPAATSAAASRLPSAGAGAASTFARLPHHPTXWGGGLXHXSTYFYFTXXHTIIFLXKXXLNXYLTXQXQXX

SEQ ID NO: 48637 - protein, 43 aa, Sorghum bicolor
  unsure (1)..(43): unsure at all Xaa locations
  Clone ID: LIB3476-003-Q6-K1-A5.pep
AAQXLAYDECHFVWEPRVYLEVLDISXNCFVVNKNKEQDDLKF

SEQ ID NO: 48638 - protein, 52 aa, Sorghum bicolor
  Clone ID: LIB3476-003-Q6-K1-A6.pep
YVRSTDWLCAVHQPTILNYETPNNIKNHIYLIKLNNLTGKIGAKQRLIRTTN

SEQ ID NO: 48639 - protein, 55 aa, Sorghum bicolor
  unsure (1)..(55): unsure at all Xaa locations
  Clone ID: LIB3476-003-Q6-K1-B11.pep
GPSGRRGXXKXEPRQPGHRXEGPEXEEXSGETEEDRRSERERWPQAPGEASWKKP

SEQ ID NO: 48640 - protein, 31 aa, Sorghum bicolor
  Clone ID: LIB3476-003-Q6-K1-B9.pep
LAMRSHPSATSFLEALSPFRPPKFQAITRIH

SEQ ID NO: 48641 - protein, 104 aa, Sorghum bicolor
  unsure (1)..(104): unsure at all Xaa locations
  Clone ID: LIB3476-003-Q6-K1-F8.pep
LLSSSTDDFWASGLVFVMVRRHLAFMLNGQIMLDRPLAPSSHDYCKILCVKPVAAPYLGVNFRVEGFNLLSTSSRLIXSFEGRCIFQEDTDFIAKNAEXEDRDE

SEQ ID NO: 48642 - protein, 102 aa, Sorghum bicolor
  Clone ID: LIB3476-003-Q6-K1-H4.pep
VLSAPTTRLAGARPAATPPRPAARSRHRPAARGARPTRPNASYLHAGGGDNTTQLQELIANLETIPNTWSPGPHINPIQIEKDGDTNLHMDWIADFANMQAM

SEQ ID NO: 48643 - protein, 112 aa, Sorghum bicolor
  Clone ID: LIB3476-003-Q6-K1-H7.pep
RAGGGRSQSQQGRAARGRPCGRHARTRRGRRDDTCRPPPPPARTAMAPPPPQCASKPLCARSVLQVGDMAEEEAPPTPPPPKLLYIAVADGGGRRAFWYTRNVLQSTLYLMG

SEQ ID NO: 48644 - protein, 82 aa, Sorghum bicolor
  unsure (1)..(82): unsure at all Xaa locations
  Clone ID: LIB3476-003-Q6-K2-A11.pep
HTNSGGGTITXXKLVLXXTXSXDYLGPKIVSHYGSHASSTTQIIKQLITXLKNNTNFDMGAFFLGALKRXYERYXAHXHEGE

SEQ ID NO: 48645 - protein, 54 aa, Sorghum bicolor
  unsure (1)..(54): unsure at all Xaa locations
  Clone ID: LIB3476-003-Q6-K2-A5.pep
RLALSNKXSGGVVXXQIPRLLTQXSFIQAHLXNXQMLXHILVGTLIFPMMDLYL

SEQ ID NO: 48646 - protein, 39 aa, Sorghum bicolor
  Clone ID: LIB3476-003-Q6-K2-A6.pep
ADGWAPSTILNYETANKIKNHIYLMKLNNQTGTIELNKS

SEQ ID NO: 48647 - protein, 54 aa, Sorghum bicolor
  unsure (1)..(54): unsure at all Xaa locations
  Clone ID: LIB3476-003-Q6-K2-B8.pep
LIYGHLMCKLEMPDLYWSKIGGGKIHYXNXXTIXXPFXXTXLXPXXLYKTIIFQ

SEQ ID NO: 48648 - protein, 59 aa, Sorghum bicolor
  unsure (1)..(59): unsure at all Xaa locations
  Clone ID: LIB3476-003-Q6-K2-H4.pep
PTRGGGRNTALIQELIANLETISKTVPPXSHINPIQIEKDDDTNLHMDXIAECANMQAR

SEQ ID NO: 48649 - protein, 96 aa, Sorghum bicolor
  unsure (1)..(96): unsure at all Xaa locations
  Clone ID: LIB3476-003-Q6-K2-H7.pep
SLSKLFDFYIPAPIXVEAMLSPSLMCSCLATFSNPPPHSGFNAHSVGGGAMPVRPHEADGRQVSSRRPRRVRAWRPHGRPRAARPSWLWLRPPPAR

SEQ ID NO: 48650 - protein, 78 aa, Sorghum bicolor
  unsure (1)..(78): unsure at all Xaa locations
  Clone ID: LIB3476-004-Q6-K1-F3.pep
MDTEAVLIFMLDNELLDKQKELIXLGERAVLVTLLFDLNIHDAYKPLVEAIWRFNVGDINNFPHVAWSFVNDGLSRTS

SEQ ID NO: 48651 - protein, 75 aa, Sorghum bicolor
  Clone ID: LIB3476-004-Q6-K2-F12.pep
DLWDQKKKRGGKKKKKKKKKKKKKKKKKKKKKKKKKKKKKKKKKKKKKKGGGRFKKKNFRGGGIKKKIFFLWQQK

SEQ ID NO: 48652 - protein, 62 aa, Sorghum bicolor
  Clone ID: LIB3476-004-Q6-K2-F3.pep
MDPTAVLIFILDNELLDKQKELIVLGERAVLVTLEFDLNIHHAYKPLVEAIRRFNVGDINNF

SEQ ID NO: 48653 - protein, 36 aa, Sorghum bicolor
  Clone ID: LIB3476-005-Q6-K1-A10.pep
RGNWNGKEIPVGWVGTVPKPFLMVGAGGDCEASGSL

SEQ ID NO: 48654 - protein, 144 aa, Sorghum bicolor
  unsure (1)..(144): unsure at all Xaa locations
  Clone ID: LIB3476-005-Q6-K1-A5.pep
QMICCCNKMDATTPKFLKAPVLIRLVREVFFNLKKGGFHPXRINLVPIFVLKGTTLFKRSTTLNCSRAPPLFEALNXINDPKRLSNKPLRFPFKDVYKIGGMGTVPVERVETGFIKPVMVATFGPRALTTEVKSVEIHNKVLQE

SEQ ID NO: 48655 - protein, 137 aa, Sorghum bicolor
  Clone ID: LIB3476-005-Q6-K1-B5.pep
VFSSKAFVAGAVAYFLDNTLHRRDGTVRKDRGHHFWDKVKVPLRLDPPRGEFYFLPFQPNQVFPILLILLLLTENRKCCSIRLLFDFAIATPKWLFFLLLVDPWSWSSESCKAKPTLFGRNGEMAGYFGWKWGWVLG

SEQ ID NO: 48656 - protein, 54 aa, Sorghum bicolor
  unsure (1)..(54): unsure at all Xaa locations
  Clone ID: LIB3476-005-Q6-K1-B7.pep
MSCCGGNCGCGSGCKCGSGCGGCKMYSGNGLSXQVTTTVKTFVMGVAPSSKGHA

SEQ ID NO: 48657 - protein, 92 aa, Sorghum bicolor
  Clone ID: LIB3476-005-Q6-K1-D12.pep
FAGAVSRTCVAPLETIRTHLMVGSNGDSMTEVFQSIMNTEGWTGLFRGNLVNVIRVAPSKAIELFAFDTAKKFLTPKADESPQTFLPPSLVA

SEQ ID NO: 48658 - protein, 133 aa, Sorghum bicolor
  Clone ID: LIB3476-005-Q6-K1-E8.pep
DALHKYAIAHRFHYKFVKNDSSRVTAECTDGGCAWRIHASKSHSKEFMVKKVFGTHTCESETIKSHRLASQKWVASVIKEKIRDSPNYRPRDIANDLQREYGLCLNYSQAWRGKAIARKELYSSDEEACNQLP

SEQ ID NO: 48659 - protein, 212 aa, Sorghum bicolor
  unsure (1)..(212): unsure at all Xaa locations
  Clone ID: LIB3476-005-Q6-K1-F12.pep
YAKINEDWQDKDTTSVPKSKVRKKKLSDMLGSQWSKDELERFYGAYRKYGKDWRKVAGAIRDRTSDMVKALYNMNKAYLSLPEGTATAAGLIAMMTDHYNILDGSNSDRESNDSPKVSRRLQKRGRAKLQSVSKTSDTHYTDLLQPQPASSSYGCLSLLKKKRSGDLFVGNRPRAVGXRTPRVPVASMTXRDDRGASNRQAKPDANHGDDEG

SEQ ID NO: 48660 - protein, 130 aa, Sorghum bicolor
  unsure (1)..(130): unsure at all Xaa locations
  Clone ID: LIB3476-005-Q6-K1-F9.pep
METRRPRRGGKKRFLLPLALLCLAVLLPGALLPPSASASSSSPAVGGGSRKRRWVGFDYYVLALQWPGTICRETSNCCDTNGCCRSKPLKWFTIHGLWPQYNYXGWPSCCRPTKFNINKILMLMPILEKY

SEQ ID NO: 48661 - protein, 76 aa, Sorghum bicolor
  Clone ID: LIB3476-005-Q6-K1-G10.pep
MEPAALPQVPRVKLGTQGLEVSKLGFGCMGLTGSYNAPLGDEAVAAVDAHAFRRGVTFFDTLDAYGHQTNKTLLGK

SEQ ID NO: 48662 - protein, 84 aa, Sorghum bicolor
  Clone ID: LIB3476-005-Q6-K1-G11.pep
TTATLALDDGFDDDGDSNDGGDGDDDSDGDDGGDFDTVSGGHGGHGRRCVRRCVRRCIITGKRGVVGLGHRKRCVRRCRRRCYP

SEQ ID NO: 48663 - protein, 185 aa, Sorghum bicolor
  Clone ID: LIB3476-005-Q6-K1-G12.pep
ICLPQNGISAIDAPGMPFYDPEATSTLLGELNTLIKRTDIREVKLLPYHINDPEFADALVDAFLSMDVKASSSAQPNQGLNIKRSCSSGQKISDSSVIWRPPVDFPDAKPETLRKTRSILHKLKEQISEGIPVIGAGAGTGISAKFEEVGGVDLIVLYNSGRVRMAGRGSLAGLLAFADANAIVP

SEQ ID NO: 48664 - protein, 84 aa, Sorghum bicolor
  Clone ID: LIB3476-005-Q6-K1-G5.pep
ISFFLQFLPMHLHWKAATNGQPYNLLLFSSQNIKMERRNHIPRSGSKKNSGNHKRKRGRGGNRSISKLRPPSVLPPTGRRLIRS

SEQ ID NO: 48665 - protein, 116 aa, Sorghum bicolor
  unsure (1)..(116): unsure at all Xaa locations
  Clone ID: LIB3476-005-Q6-K1-H10.pep
GRVGPVPAGAVPIPPDANSHSMATHGKTGYRQPRPALHAEALSPLPWSCRDALADPHWRXAMEDEYAALQGNHTWDLVPRPAKANVVTGYWIFKAQLTADGSLQRYKASVCASRVH

SEQ ID NO: 48666 - protein, 111 aa, Sorghum bicolor
  Clone ID: LIB3476-005-Q6-K1-H4.pep
SSGRSCKESREKRPDGLDRQVRVGAEDAGEDAVEVGEVGGGVTRGWGSRRRRPWRGSPPRWSRRPWRGGGRGGLVRIGGGSDETLTLGSLDTRGVGFRGGRGEKEGVWVQN

SEQ ID NO: 48667 - protein, 120 aa, Sorghum bicolor
  Clone ID: LIB3476-005-Q6-K1-H7.pep
PTRPPTRPDEVLPRIKRLGYNAVQIMAIQEHSYYASFGYHVTNFFAPSSRFGTPEDLKSLIDKAHELGLLVLMDIVHSHSSNNTLDGLNGFDGTDTHYFHGGPRGHHWMWDSRLSHYGSW

SEQ ID NO: 48668 - protein, 49 aa, Sorghum bicolor
  Clone ID: LIB3476-005-Q6-K1-H8.pep
RTAWAFPQLLPDTLDESVSPWPERETGLLLSSTSARPTRASGLLHHDLV

SEQ ID NO: 48669 - protein, 86 aa, Sorghum bicolor
  Clone ID: LIB3476-006-Q6-K1-A9.pep
MGKSYQTVSAEYSEVTEKARLMLRALIDDKSCAPLMLRVSWHSAGTIDVWSRTGGPFGTMKNPAVLAHGAYAVLDIEVRLVEPIQE

SEQ ID NO: 48670 - protein, 87 aa, Sorghum bicolor
  Clone ID: LIB3476-006-Q6-K1-B4.pep
SAHALCSGSVRSVTKEVYQLPVLPARTLIAPRHLCRVSSLFDTPRSVCDRGMALVYPHIRARRPGRSTEGSTLPSKIEGGRLSVLAS

SEQ ID NO: 48671 - protein, 101 aa, Sorghum bicolor
  Clone ID: LIB3476-006-Q6-K1-C10.pep
MRSTVVPLYQPARLAGLIPVMQSYVDILVANIAGCPDQDCIPFCQLSLRMAIDIIGKTAFGIEFGLSKNAAGGSGETEGGEGDDNVREFLKEYKRSMEFVK

SEQ ID NO: 48672 - protein, 64 aa, Sorghum bicolor
  unsure (1)..(64): unsure at all Xaa locations
  Clone ID: LIB3476-006-Q6-K1-C11.pep
FSFFCKLAKENKYSPLRTQTQXCEKMCHVVQRHKSVQRENVLKTKKTKKMLMVTGNTIIKVDGR

SEQ ID NO: 48673 - protein, 84 aa, Sorghum bicolor
  Clone ID: LIB3476-006-Q6-K1-C5.pep
LKHALHVPLDSQQASQRTAQALSNVLYAMRKAIYRMLYCMQTLRSTRLNAELMKQVHVADHGDHQLNKMLADIHADFNTDNISG

SEQ ID NO: 48674 - protein, 70 aa, Sorghum bicolor
  Clone ID: LIB3476-006-Q6-K1-D12.pep
MPVLLREMEDHSVHPMSKSNHGSLSGNGYEMKHSGKKVCDKDSSSESDQSHQEASAVSESSPAEHTSTQS

SEQ ID NO: 48675 - protein, 99 aa, Sorghum bicolor
  unsure (1)..(99): unsure at all Xaa locations
  Clone ID: LIB3476-006-Q6-K1-D3.pep
LLSYLRXFSLHRAPAASVGKRRCRVPLPETTDGMGLGLGFGLRGWRVYGCWCRCRRRYGSGIDRPRRSCEATVEAGLRAELARRRQWRTQGSPGTQELN

SEQ ID NO: 48676 - protein, 100 aa, Sorghum bicolor
  unsure (1)..(100): unsure at all Xaa locations
  Clone ID: LIB3476-006-Q6-K1-D4.pep
LLRVWSSSDLSPVAELAGHGEGVSDLSFSPDGRLLASASDDRTVRIWDLAVGGGARLIKTLTGHTNYAFCVSFSPHGNVLASGSFDETVRVWEVXSGKCL

SEQ ID NO: 48677 - protein, 99 aa, Sorghum bicolor
  Clone ID: LIB3476-006-Q6-K1-E4.pep
PRVRKGPMEYAPELFDEQKDQAAVEKILKVVFLDVNAQSPQLEKVNNQIAEAEAALEARKKPPEENGPKIVGEGLVIDEWKERRERYLAQQQVEVVDSV

SEQ ID NO: 48678 - protein, 53 aa, Sorghum bicolor
  unsure (1)..(53): unsure at all Xaa locations
  Clone ID: LIB3476-006-Q6-K1-E9.pep
MENLRSENGHQGVAMEGVKFAPEMANTNRRALSDIKNIIXGPHQHLSVSKRGL

SEQ ID NO: 48679 - protein, 77 aa, Sorghum bicolor
  Clone ID: LIB3476-006-Q6-K1-F1.pep
MEAAMDLMRRMPPRSAETALNALLSLLPDHSLDLLSQVDLPLQVCMDKESLKAYILCQYNRDADFYRSPWSNNYDPL

SEQ ID NO: 48680 - protein, 69 aa, Sorghum bicolor
  Clone ID: LIB3476-006-Q6-K1-F2.pep
MADWGPVIVATVLFVVLTPGLLCTLPGRGRVAEFGSMHTSGLAILVHAVLYFALITIFLIAVGIHVYAG

SEQ ID NO: 48681 - protein, 105 aa, Sorghum bicolor
  Clone ID: LIB3476-006-Q6-K1-G2.pep
EHHLPAPPLHPHHNPFLPSSQCPSLQDFRGMAPMLGKRPMYGADVVAGGGDEVNGCGGGGGANEDELSDDGSQAGEKKRRLNVEQVRTLEKNFELGNKLEPERKL

SEQ ID NO: 48682 - protein, 51 aa, Sorghum bicolor
  Clone ID: LIB3476-006-Q6-K1-G3.pep
SMVSLFHNKMYPTKTCLSVSAHDAGSVMIRLSVAADHTTAVDDLVRHEILA

SEQ ID NO: 48683 - protein, 97 aa, Sorghum bicolor
  Clone ID: LIB3476-006-Q6-K1-G9.pep
KESSNSDEKCNEFASAESEDSVSGVLYDMLQKEVIALRKACHEKDQSLKDKDDAVEMLAKKVDTLTKAMESDAKKSRRELAAMEKELAAVRMEKEQY

SEQ ID NO: 48684 - protein, 61 aa, Sorghum bicolor
  Clone ID: LIB3476-006-Q6-K1-H1.pep
YGSPTRIMDHLVQPWQVTLLVQSVSAPPRLSVSAMHHMSSQLVGVRPDHLFRCSTVHRLYM

SEQ ID NO: 48685 - protein, 63 aa, Sorghum bicolor
  Clone ID: LIB3476-006-Q6-K1-H4.pep
VNLAGLPALVVPCGFVEGGPAGLPVGLQLIGSPFCEGNLLRVGHIFEQTLQNLSFVPPLLAES

SEQ ID NO: 48686 - protein, 74 aa, Sorghum bicolor
  unsure (1)..(74): unsure at all Xaa locations
  Clone ID: LIB3476-006-Q6-K1-H7.pep
MDSSSSSTFTQSQSQPDFYYLYKLLLIGHSDFCKSILLLLFTYDSFXDLYPTIGVVFKVKMVNTCCINLMLAIW

SEQ ID NO: 48687 - protein, 124 aa, Sorghum bicolor
  Clone ID: LIB3476-006-Q6-K1-H9.pep
KNLEQKLRMRQQYMIAQVAQIYPVRPLDEQSSDHKPGFTSNITKTRNAEPVLPNGSQNRPLVILGLQLSKLSVKKTGYFSDKTEVQKSSTVLGYAAHAVSLIASYLNVPLRYPLRFGGSRSYVL

SEQ ID NO: 48688 - protein, 106 aa, Sorghum bicolor
  Clone ID: LIB3476-007-P1-K1-A1.pep
NGYNLADIIAQHVGFGKSPPAYLSLTPLSRQRDLLRGRVGTNYASGGSGILDVTGNGTITLREQVALFAKTKARILRAGLVSRERLDGLLGRSLFVISTGGNDFGA

SEQ ID NO: 48689 - protein, 128 aa, Sorghum bicolor
  Clone ID: LIB3476-007-P1-K1-A4.pep
AVLSTVIALIICCLAAWLLILRFRGPSDTAQGFPRTVLPKFSRSSGTGHTLLVGAGRYSSPSGPSGSLGSSIATYAGQAKTFKFAEIDKATNGFDDSKVLGEGGFGCVYQGTLEDGTTVAVKVLKRYD

SEQ ID NO: 48690 - protein, 139 aa, Sorghum bicolor
  Clone ID: LIB3476-007-P1-K1-A5.pep
LFGALRCHGIGMIVGALGVSKEQLRDALLEGNAHGLGVEALRMLTQMVLSNEEELNLKYFKDDSLTRLCPVDAFLKAMLDVPFAFKRVDAMLYIASFYLEINQLRMSYAILEGACQEMRNSRLFHKVLEAVVNFGNFMN

SEQ ID NO: 48691 - protein, 99 aa, Sorghum bicolor
  Clone ID: LIB3476-007-P1-K1-A6.pep
MKLVWCPDTGSKAYIDGVRAIANVDSADASPELAELLAAMAGGWNARLIVDAPDSASSTSTTTSLALAACVRRTGGRYALLDVDDDAPAPSTEDEATTN

SEQ ID NO: 48692 - protein, 85 aa, Sorghum bicolor
  Clone ID: LIB3476-007-P1-K1-A7.pep
SALRPSRSTARSPAPMGPALTAVSQVAASRRCAVAAKAEVASRRMRRRMGSSGARWRCAIAARRARTGGFGGRDLGRVVPWPWWL

SEQ ID NO: 48693 - protein, 64 aa, Sorghum bicolor
  Clone ID: LIB3476-007-P1-K1-B1.pep
CESCLVAPVKLVYNVFESTIDAISFLIDIRNLCFMYVSVVLSCQQHQSITNPPNFHGETCFRLI

SEQ ID NO: 48694 - protein, 138 aa, Sorghum bicolor
  unsure (1)..(138): unsure at all Xaa locations
  Clone ID: LIB3476-007-P1-K1-B2.pep
ADEISRRKQSAIEEIRKVFFSPVTPVNVSEWRTGHQRCPPELQEEVLEALHPPSQITSLCIRNYDGQRYPRWLSGEQDTRDLNSTDISHLQYLMFWDCNGSSIPPKIGKFFVHIFRLTVTGCSWTSLPDNXDHLESLK

SEQ ID NO: 48695 - protein, 62 aa, Sorghum bicolor
  Clone ID: LIB3476-007-P1-K1-B4.pep
TVHRALPLHSATDETSRSTSINGCTCHQSVAVQTFPFGITSFPYLSSFGCYIRSTVKSTSLV

SEQ ID NO: 48696 - protein, 63 aa, Sorghum bicolor
  Clone ID: LIB3476-007-P1-K1-B9.pep
PAYRSSTPQSCWPTSRAEELEGTAIGMENDPLDYRYISSPFSYSNSLNSITTASFGKRTGYFI

SEQ ID NO: 48697 - protein, 75 aa, Sorghum bicolor
  Clone ID: LIB3476-007-P1-K1-C10.pep
ANAHMQALIHAAQDRLLTIRESARLHGCADSFRFRGTVKDRYRQTGNARSVPVGRALGVALAMAYLNKTGDDHLM

SEQ ID NO: 48698 - protein, 113 aa, Sorghum bicolor
  Clone ID: LIB3476-007-P1-K1-D2.pep
HSWLSLCLTSEDLSSHASLAAPSSSTHTHLNRPPSATAMSVRFLLRSAAFLAILAAATPTPSADVPQPVPEPEVKPSDTDALTIFRHGADAHGILSSNWSTGDACTGHWLRVG

SEQ ID NO: 48699 - protein, 129 aa, Sorghum bicolor
  unsure (1)..(129): unsure at all Xaa locations
  Clone ID: LIB3476-007-P1-K1-D7.pep
AASEHTTANRILRHGEREETSATDTKIPTRMHMKTEMCILMEGVNAFXGTSIRYMIKLIEIYSTXPTIGYKDETAEYKNISFTDXDVCGHDKSKPLRRHVLTXTQGIILHVDMNDNDRVSESTDELHRM

SEQ ID NO: 48700 - protein, 87 aa, Sorghum bicolor
  Clone ID: LIB3476-007-P1-K1-E11.pep
VLDLSADGDGSVEPDVGVGAGDPLFLLLLLLLLIRDAAVWSGVLGGDGGVGLCGVGDGATCSSSATPPLSAAFSAAVGEARVSSPFS

SEQ ID NO: 48701 - protein, 114 aa, Sorghum bicolor
  Clone ID: LIB3476-007-P1-K1-E4.pep
MASALPQEKEQQQARRPMHAGVGGAGANGRHHAYSRKDKSLGLLCSNFVVLYNRDDVESIGLDEAAKCLGVERRRIYDIVNVLESVRILVRKAKNRYTWIGFGGVPMALRELKE

SEQ ID NO: 48702 - protein, 64 aa, Sorghum bicolor
  Clone ID: LIB3476-007-P1-K1-E7.pep
LPSTSSAIFNKLKGKFSVFHQGIPEPLFIKHCASTHTPSLLGSSLVSVGSLPYLSGGIQQSSQA

SEQ ID NO: 48703 - protein, 156 aa, Sorghum bicolor
  Clone ID: LIB3476-007-P1-K1-F4.pep
HASVKAVHAPLLWLVVEWPEQSYETAEMVRSSGVMYRHLVCRKNTTSVRKIAVCQRNNAIYHIKRHHLDGINAFADEERSYSADVFEEMQKIRRFGSWPVAIHVGTKYRAVLEGPICKGNRVMGWHTVQTAQKKSLTRRFPIGFSAFAFNSTNVWD

SEQ ID NO: 48704 - protein, 59 aa, Sorghum bicolor
  unsure (1)..(59): unsure at all Xaa locations
  Clone ID: LIB3476-007-P1-K1-F5.pep
PGVSGRPVRCSPSVRPVPMRAVRCRPVPAPAPVPAPMPPPVPAPXPPVPMPAPPPVPAL

SEQ ID NO: 48705 - protein, 79 aa, Sorghum bicolor
  Clone ID: LIB3476-007-P1-K1-H12.pep
MSFILRFIMLGEATTWKEFALEASCCRDYTDLGKMLLKFQNMILPDYISCEWLQNFFEMWNQKCMNAHDAETFEMLCEE

SEQ ID NO: 48706 - protein, 73 aa, Sorghum bicolor
  Clone ID: LIB3476-007-P1-K1-H6.pep
ACVTSFSNFVKHFVAQENLYLTKLPLHTKSVTNRQLSTKLSLHAMIAIHPLASRLSAVKTSLKEQPHEVLHFI

SEQ ID NO: 48707 - protein, 96 aa, Sorghum bicolor
  unsure (1)..(96): unsure at all Xaa locations
  Clone ID: LIB3476-007-P1-K1-H7.pep
RTRGLVLDRDGRPXFFFFFFFFXPLTSHSALHFVATTNRQSQRILLHSDYNTGNQNQQEKAKKKESYKQANPWRPLGKQRHLLISSTLQQPQLWLL

SEQ ID NO: 48708 - protein, 144 aa, Sorghum bicolor
  unsure (1)..(144): unsure at all Xaa locations
  Clone ID: LIB3476-008-P1-K1-A11.pep
TTFLKDDLDYLIQCLQQPFEEAQKVGALXCFEQVEKFASQFPDLAFIDLLDKFRETCRIDKTYFMCQQDSIKKVANMLERVQGLSLKDRFTFXFGSINIRDSKAXFHLLRFATNYCQSRRVSIAMGVPRGSARNDSELLDLETK

SEQ ID NO: 48709 - protein, 84 aa, Sorghum bicolor
  Clone ID: LIB3476-008-P1-K1-A5.pep
MSCCGGNCGCGSGCKCGSGCGGCKMYPDMAEQQVTTTVKTLVMGVAPSSKGHAEGGFEAAAGARAENEGCKCGPNCSLNPCTCK

SEQ ID NO: 48710 - protein, 62 aa, Sorghum bicolor
  Clone ID: LIB3476-008-P1-K1-A9.pep
TKGGKGLLSAKTTDAYSSEKDNSNNTLMSRSSITRLQFPAPRIHHEVKHMTQANGQFCSTSN

SEQ ID NO: 48711 - protein, 58 aa, Sorghum bicolor
  unsure (1)..(58): unsure at all Xaa locations
  Clone ID: LIB3476-008-P1-K1-B10.pep
APAPHRPHVEQVVHHXPXXRPRGXLAVEEPVQEEQRDGDEGRQGQRHREEGGRLRTRG

SEQ ID NO: 48712 - protein, 126 aa, Sorghum bicolor
  unsure (1)..(126): unsure at all Xaa locations
  Clone ID: LIB3476-008-P1-K1-C2.pep
GSLDITKLLDELEIPSRSQNSISSSVLLVKKLLQFDKSSRPAYYGTWRKKSSTVSARQPFQRDEELNYDVQSDEEWEEDDPDDPGERLSXFEEDDEKTMNEHDSIIDAERGAENKFVVPNDYLSXD

SEQ ID NO: 48713 - protein, 84 aa, Sorghum bicolor
  unsure (1)..(84): unsure at all Xaa locations
  Clone ID: LIB3476-008-P1-K1-C4.pep
QHGDSGDFEDQHEDSPDDAKEEEEYESIEXENLRESDFPADSDSENPRVSHEFGNSDDPRSENGDADFPSESAIGGTKFTAFTG

SEQ ID NO: 48714 - protein, 107 aa, Sorghum bicolor
  unsure (1)..(107): unsure at all Xaa locations
  Clone ID: LIB3476-008-P1-K1-D8.pep
PDNKLLRKKQIDLQNKKKKSSQKKITGFXDSRISVVDGLNLVHKYKGFRNTNSQISACLAANGRYVISASEDSHVYIWRNDDNLGQGRSKGNATVTNSYEHFHCQDV

SEQ ID NO: 48715 - protein, 130 aa, Sorghum bicolor
  Clone ID: LIB3476-008-P1-K1-E1.pep
GKTTLLHFVVQEIVRSEDAKSEKAVGDEARNIVKDEMFRKQGLKVVSGLSNELGNVKKAASMDFDVLHSYVSKLQAGLGKIKSVLLLEKQCTQGQNFFARMRDFLKEAEIEIKQVRCDEERALGRVKRSL

SEQ ID NO: 48716 - protein, 135 aa, Sorghum bicolor
  Clone ID: LIB3476-008-P1-K1-E12.pep
PTRPVLLSRVYASAQRWNDVGMIRRLMSEEGFKKEPGFSSIEMDGLVHQFVAGDTSHPQSEEIYEKLDEIQQRLTSAGYTPDLSEAPMVADIDRTMGATLRLHSERLAISFGLLNATPGAPIRILKNLRVCKDCH

SEQ ID NO: 48717 - protein, 23 aa, Sorghum bicolor
  Clone ID: LIB3476-008-P1-K1-E4.pep
YLNRNSFDNKHKFTLGFIHCQHF

SEQ ID NO: 48718 - protein, 115 aa, Sorghum bicolor
  Clone ID: LIB3476-008-P1-K1-E9.pep
GFDAALGDPLGGCCITPNGYALLLTKLLGFAQGRIVMALEGGYNLRSIANSVCACAKVLLGDKFTFNAPEMQPFESTWSVIQAVRNELKTCWPVLSSKLPENVSLRIRPSPSEVN

SEQ ID NO: 48719 - protein, 147 aa, Sorghum bicolor
  unsure (1)..(147): unsure at all Xaa locations
  Clone ID: LIB3476-008-P1-K1-F10.pep
DFFALFLDPTMNYSSGIFKXVEDESLEAAQLRKVRVLIDKANVEQGHHVLEIGSGWGTLAMEVVKRTNCKYTGITLSEKQLKYAQRKVKEAGLEDHITFLLCDYRQIPMGHKYDRIISCEMIEHVGHEYMDDFFSCCEQHLKEHGLF

SEQ ID NO: 48720 - protein, 91 aa, Sorghum bicolor
  unsure (1)..(91): unsure at all Xaa locations
  Clone ID: LIB3476-008-P1-K1-F11.pep
VELDVAAATVGDERRRLAVAPAVLPVGQVGIGRRQLEPSSSSSSXAHRRRRSRRSHRHLPHLHLALRRPESDLAPNPSPRKATSTEVVVLA

SEQ ID NO: 48721 - protein, 87 aa, Sorghum bicolor
  Clone ID: LIB3476-008-P1-K1-F3.pep
MDPSTQNNGVHTREHLQRAIGGDSCPGDAIINDFLDDEAEEEDDSDNDMMRFKDNEEDDGSDENEVFNDLIAAGYEEKEADNEKRNE

SEQ ID NO: 48722 - protein, 46 aa, Sorghum bicolor
  Clone ID: LIB3476-008-P1-K1-G4.pep
MIQQYINQKTSAVKLSTQRYKAFLNGLPYISNTDRTYYCILCKPGI

SEQ ID NO: 48723 - protein, 61 aa, Sorghum bicolor
  unsure (1)..(61): unsure at all Xaa locations
  Clone ID: LIB3476-008-P1-K1-H10.pep
LCIVGSTMIILHAPQERTPSSVEQIWNLATQPSFLCYAAIAXGVSLFLMLYCAPRYGQTNI

SEQ ID NO: 48724 - protein, 155 aa, Sorghum bicolor
  unsure (1)..(155): unsure at all Xaa locations
  Clone ID: LIB3476-008-P1-K1-H6.pep
HSITDHLRPAGRHRLNRVARIGRRRARDXELGKWRAXCAVEWSYARKEIGRLGRHPVVGGWRQHESMRRGTEGSDTRAPPPPRDGSERRTGCRRLVVVSERRTAAGSRWNGRREQSRGPRGDDGPTAMGGKWQQDCERRRRIWKREGGDGGCGSD

SEQ ID NO: 48725 - protein, 54 aa, Sorghum bicolor
  Clone ID: LIB3476-009-P1-K1-A12.pep
LQVMRSAAVVVIGVVSCARGAGFIPGEPRVLRRRVMVFNGRSGTGPSWKKRRVG

SEQ ID NO: 48726 - protein, 52 aa, Sorghum bicolor
  Clone ID: LIB3476-009-P1-K1-B10.pep
AYLRDSKAISHSTPTTSVHPFNNTMRDYIAIHISQPGIHVRNASLTAVLPGA

SEQ ID NO: 48727 - protein, 85 aa, Sorghum bicolor
  unsure (1)..(85): unsure at all Xaa locations
  Clone ID: LIB3476-009-P1-K1-B11.pep
LDAEASQKEKLEEEIDVLRSQLLXMSMEAXDETRRSLDKGDGPGKIFPGLDSLVSQTRGSQPREQSNGPKQPIAKLFEQVGLKKI

SEQ ID NO: 48728 - protein, 57 aa, Sorghum bicolor
  Clone ID: LIB3476-009-P1-K1-B12.pep
VVRWVCIRFMIYFACGIFVEQDWLMCNYLAHSWLMTDCSRHIVHEVVSIFVEIEYIV

SEQ ID NO: 48729 - protein, 121 aa, Sorghum bicolor
  unsure (1)..(121): unsure at all Xaa locations
  Clone ID: LIB3476-009-P1-K1-C10.pep
ARTRGFIFSKIIGEGGYGRVYRGVIEDGVXVAVKLLTRKHHNRDREFIAEVEMLSRLHHRNLVKLIGICIERSTRCLVFELVPNGSVESHLHGSDKIYGPIDFDTRMKIALXASRGLAYLH

SEQ ID NO: 48730 - protein, 95 aa, Sorghum bicolor
  Clone ID: LIB3476-009-P1-K1-C12.pep
MSRSLWIPVKLLHEAAGHVVTVELKTGEVYRGAMVECEDNWNCQLENITFTAKDGKVSQLEHVFIRGSRVRFMIIPDMLKNAPMFKRLEARIKGK

SEQ ID NO: 48731 - protein, 95 aa, Sorghum bicolor
  Clone ID: LIB3476-009-P1-K1-C4.pep
MDLDPASSSVDNFKTPELTKENGLQEDEKGESSMYDERQPKRRKRTLMNNEQIDELEKALVDEPEMHKKRCSNCRVWSKKVSLQGFKITASQLKN

SEQ ID NO: 48732 - protein, 48 aa, Sorghum bicolor
  Clone ID: LIB3476-009-P1-K1-C6.pep
KHMEVGVVKVLVARLSGFYRIWFSWTIFSTKMSAAISPFILERCVSVR

SEQ ID NO: 48733 - protein, 84 aa, Sorghum bicolor
  Clone ID: LIB3476-009-P1-K1-C7.pep
HFIINLTYLYTIIRIESDRTFQPYIFLKTHIQQLYIFLIKYSLTHYLQYFITPPKNSILSIIHLYIYYVTNYLIHSILITYLIL

SEQ ID NO: 48734 - protein, 127 aa, Sorghum bicolor
  Clone ID: LIB3476-009-P1-K1-C8.pep
AGIWNGGGGAGQKNLFVASFFFDRAAEAGCVNANAAVAKVKPSDFRQAAERACSLSVKNAEATFPGVPKDNIPYICMDLVYQYTLLVDGFGVDPNHEMTLVKKVPYSDAYVEAAWPLWSANQVASSS

SEQ ID NO: 48735 - protein, 65 aa, Sorghum bicolor
  unsure (1)..(65): unsure at all Xaa locations
  Clone ID: LIB3476-009-P1-K1-D9.pep
MAAAPVEVGAQGTVGSLVLREVEYFRRMEVAGGHGKKSSSKVVGASXRQRQRQPVERQRQEAEAD

SEQ ID NO: 48736 - protein, 74 aa, Sorghum bicolor
  unsure (1)..(74): unsure at all Xaa locations
  Clone ID: LIB3476-009-P1-K1-E1.pep
SENAHLHLLNPVTSILVLNTRSQRSRCCVLVCSRNKSNYTSLFKAAAVTSPASGSTIAGSNTSKSSTSSXKGRG

SEQ ID NO: 48737 - protein, 124 aa, Sorghum bicolor
  Clone ID: LIB3476-009-P1-K1-E4.pep
MVHMGFLSLYTSSHAGSKLSKTSARDQVFEEVRRLVELYKDEELSITITGHSLGAAISILNAVDIVSNGVNVPAGGGGSAACPVTALVFACPDVGDRFFRAAFHSFRDLKALHVKNSPGRVPMY

SEQ ID NO: 48738 - protein, 93 aa, Sorghum bicolor
  unsure (1)..(93): unsure at all Xaa locations
  Clone ID: LIB3476-009-P1-K1-E7.pep
LVQGIPCNINLISFNPHGXSQFEPTAYYFIIDFXTFLIHXHLTVFVLLIRHYYHISTFGHLGEPLYYHFPLLLIPNKFHFSLLLLTSHTVNLS

SEQ ID NO: 48739 - protein, 100 aa, Sorghum bicolor
  unsure (1)..(100): unsure at all Xaa locations
  Clone ID: LIB3476-009-P1-K1-F2.pep
EYVKHTNTIPKXTALLXKSGNMIIKYTMGELEXHKLPLSXYNISMDFESLNPGQQIYEKLISDMYLXQIVQIILLKLPHDTSLFGHIAPSNLHQPFISIT

SEQ ID NO: 48740 - protein, 50 aa, Sorghum bicolor
  Clone ID: LIB3476-009-P1-K1-F4.pep
PTRPALYANCCQSNPWKFADPITHNLVDMSIIGQSYGISEHFSQILNHVI

SEQ ID NO: 48741 - protein, 146 aa, Sorghum bicolor
  unsure (1)..(146): unsure at all Xaa locations
  Clone ID: LIB3476-009-P1-K1-F5.pep
LKGFEGNHPFHNYTARAKYRKVLAGRHPRAKGASLTLKSMSSEMGMAESSSLESTSSDDDEDLNISSIDSGASENIFVNDILKFSESRVQIQARWLHEPDESDRLNASHFRDIITCSCGXVQTSSXIQFVDCPYGGIFMLHQSGKW

SEQ ID NO: 48742 - protein, 130 aa, Sorghum bicolor
  Clone ID: LIB3476-009-P1-K1-F7.pep
RSNRRRPCPLLDAIDLLDGPSPPFFGKSRARSTSVSSSPPPPAVSPPSPPSPPASPPRKRRRDDAGDEEGVSDVVGALRAIGEGFLRAEERRMEAARETQRMRMEMALRHLDAQRRLMDALVGRIVDALD

SEQ ID NO: 48743 - protein, 132 aa, Sorghum bicolor
  unsure (1)..(132): unsure at all Xaa locations
  Clone ID: LIB3476-009-P1-K1-G1.pep
VDAAYFAMAYLNVTNVPVMVTETGWPHKGDPCAEPDATSDNADTYNSNLIRHVMNSTGTPKHPGVAVPTYIYELYDEDTRPGSTSEKYWGLFDMNGXPAYTLHLTGSGXLLANDTTNQTYXVARDGADPKML

SEQ ID NO: 48744 - protein, 61 aa, Sorghum bicolor
  Clone ID: LIB3476-009-P1-K1-G2.pep
SRHFLYSSPAQPLGPEDLTWRMIAGKVVEIKGQIRRSQRLVRESRSVCTCECRVGNTTRML

SEQ ID NO: 48745 - protein, 115 aa, Sorghum bicolor
  unsure (1)..(115): unsure at all Xaa locations
  Clone ID: LIB3476-009-P1-K1-G4.pep
MAXPPPXPPPAAASAPPAAASGSPPPAQVVGNAFVHQYYNILHQSPELVYRFYQEASRLGRPAGTGADGMDTVTTMDAINEKIVSMGIDRAEIKAVDAQESLXWRVTVLVMGHLT

SEQ ID NO: 48746 - protein, 90 aa, Sorghum bicolor
  Clone ID: LIB3476-009-P1-K1-G9.pep
FIGTCLVMNYFSQKANYLATSLLKFYGWCLLKNVFSAGCLHWQMGLSKLVPNIDVASLPPFSMPFLRMHCAAIMKCFMCAYYHPLLSILP

SEQ ID NO: 48747 - protein, 150 aa, Sorghum bicolor
  Clone ID: LIB3476-009-P1-K1-H9.pep
VIDADAHKHERTLTPMNARMHTLPLWAPPRNQVGPANLEIDEVTTGASLSTDMSPTTESIAALNPGINPEKCEHLCQVGDLNPGGQVSPQGTQPADLNSINGETICFWADHWLSGRTVAEIAPNLIKLIPKEGVKNRTVAQTLETAGWPT

SEQ ID NO: 48748 - protein, 63 aa, Sorghum bicolor
  unsure (1)..(63): unsure at all Xaa locations
  Clone ID: LIB3476-010-P1-K1-A11.pep
FKICCIKFSHSCHLFSIIKYCINFSTVSHCYLVYFDHEIGACTYILGDLVLKLIANLLSKHXL

SEQ ID NO: 48749 - protein, 77 aa, Sorghum bicolor
  Clone ID: LIB3476-010-P1-K1-A2.pep
DFLPCGLTLLLLGAKIFAVLVSLFKLKLFLFYDFDGSWKYGLHLYLTLLISGENHSDMENDFTSCFFWLALLANENV

SEQ ID NO: 48750 - protein, 46 aa, Sorghum bicolor
  Clone ID: LIB3476-010-P1-K1-A3.pep
IAPCTGTLSALVALFTRRVPDTFASALAPAHFAFFPFFFATFAGFS

SEQ ID NO: 48751 - protein, 100 aa, Sorghum bicolor
  Clone ID: LIB3476-010-P1-K1-A8.pep
AAGREVHVVSRDGRLLDPSIRSLQLIRDRCNAFDTEAWYMLPPVLRMVVEGAEKTDLTEVSIAIGALAHQMEAGEHEVRHGDRLTSLERFMDASYTTHPV

SEQ ID NO: 48752 - protein, 178 aa, Sorghum bicolor
  unsure (1)..(178): unsure at all Xaa locations
  Clone ID: LIB3476-010-P1-K1-B4.pep
VTFSSSGYILTSEIDGTIQMKSYLTGNPEIRLALNEDLSIGRTGSSYDYRSSSGGGTVILDDCNFHESVHLDSFDIDRTLTLIPPDGEFPVMNYRMTQEFKPPFRVTALIEEAGPSRAEVLLKIRADFSANATANTITVQMPVPSYTMRASXELEAEAVGQTTDFKEGSRRLEWNLKK

SEQ ID NO: 48753 - protein, 155 aa, Sorghum bicolor
  Clone ID: LIB3476-010-P1-K1-B7.pep
LRKHCSEFRHIYCNPVKKVFHPIHDQSFYLTQEHKRKLKEEYGIEPWTFEQKLGEAVFIPAGCPHQVRNLKSCIKVALDFVSPENVGECVKLTGEFRRLPSFHKAKEDKLEIKKMALHALNEAVNFDPCSSEGLKNWGGENSCGDESADEKPMPK

SEQ ID NO: 48754 - protein, 63 aa, Sorghum bicolor
  Clone ID: LIB3476-010-P1-K1-C1.pep
LLWRSMKHISTGKSTLLLGRTQIVAAGSDNYEHNLCSSSILTMCLCIHHILMLFRCKLFFFGW

SEQ ID NO: 48755 - protein, 174 aa, Sorghum bicolor
  unsure (1)..(174): unsure at all Xaa locations
  Clone ID: LIB3476-010-P1-K1-D3.pep
HASAIMSGKLTAEQLTKFTLYAEWLILSTWWIGDNWSSLMQSVGASEKVFRLMDLLPSKQLSSEGLKLEKLKGKIQYADVSFSYPSRPTVPILGGLNLTLNPNEVVAIVGLSGSGKSTIINLLLRLYEPTNGQILIDGXPLTELDIKMVKEKKWFVGQEPRLFPNGYSSNIXIW

SEQ ID NO: 48756 - protein, 106 aa, Sorghum bicolor
  Clone ID: LIB3476-010-P1-K1-E1.pep
ISHLPFSSDSLLPTENNRRMKAIDRETKTILRGIIEKRHEAMKNGEPTTTRDDLLGMLLESNMNYTDSDGKSSRGITLEEVIEECKLFYFAGTETYRVLLTWTIES

SEQ ID NO: 48757 - protein, 67 aa, Sorghum bicolor
  Clone ID: LIB3476-010-P1-K1-E12.pep
ISVGTIVFLHGHDSTALILLSWWNYSLCFTPWWCNVFLPTCRVQVVQLLFGGYCLVGECQEGAPGRS

SEQ ID NO: 48758 - protein, 96 aa, Sorghum bicolor
  unsure (1)..(96): unsure at all Xaa locations
  Clone ID: LIB3476-010-P1-K1-E5.pep
GLAGSSPPLRVSTTAAARPAGAAAAEPRRIVAAEAGAYPAGAPGLHRLWTGSHPPQTAAVVPRRGGAQPPPPSQLVSPADSVKLMRASFIEMXGAM

SEQ ID NO: 48759 - protein, 148 aa, Sorghum bicolor
  Clone ID: LIB3476-010-P1-K1-F11.pep
RVRDGTAFAAFPASSSTAAAALAVDVHPPPQAPCIPDDFLDEDIPVVMEPDEIVPVIEEDPVVPMDISGEVEAEGNAAQGGKAIKDRIDLESAQTKKASPKDLKEIAGSFWVAASVFSKKWQKWRRKQKLKKEAAVSKAAAAAMPPPE

SEQ ID NO: 48760 - protein, 147 aa, Sorghum bicolor
  Clone ID: LIB3476-010-P1-K1-F7.pep
APGRGSERAPAARLGLILGEHGGRVAMPMPMPAPPPRPWPSFPERPMMGAAVGLRLPENRCEVPLLLAWGPAPGWWFLRRDLGLVFSLSESSRSYTPLISDHVISSPMRRRVDSAGSPKRAAAAAMRGKEGSDRARERGEADTRLGT

SEQ ID NO: 48761 - protein, 139 aa, Sorghum bicolor
  Clone ID: LIB3476-010-P1-K1-G1.pep
CIISFSKGNRADGASSRSIFSTISNCTEVIGDALLGNIIFMIILLLGVRFILKLSFDVIRYRDVLFAVIISSYFKLFLFTMMVWEFPSSVIFIVEMFVLSSNVVALRVVSQFPKAHLFPVCLVAHAAKYLTQRWILGTP

SEQ ID NO: 48762 - protein, 184 aa, Sorghum bicolor
  unsure (1)..(184): unsure at all Xaa locations
  Clone ID: LIB3476-010-P1-K1-H1.pep
AEIGMVLNNVRLVAKAREQGNDLFKAAKFSDASMAYGEGLKYDPSNSVLHCNRAACWSKLEKWEKAVDDCNEALRIQPNYTKALLRRAASYAKLERWVDCVRDYEVLRKELPSDKEVAEALFHAQIALKATRGGGVSNMKFGGEVEIVSNVEQLRAXIKFTWGICVYFMSAMNQQCTQITPSVN

SEQ ID NO: 48763 - protein, 134 aa, Sorghum bicolor
  Clone ID: LIB3476-010-P1-K1-H7.pep
PRVRTNSTIVGWLLASMSPSVSKMVEGMHTAAQIWRTLSNMYSRRGNVMVMMEIQNKADAVKQAGQSVEQYASELQYLWGELDYYAPLRMRDPQDTLDVQKWIEDRRVTHFLKNLDPEFERRRAAFCHQDSLPT

SEQ ID NO: 48764 - protein, 111 aa, Sorghum bicolor
  unsure (1)..(111): unsure at all Xaa locations
  Clone ID: LIB3476-011-P1-K1-A1.pep
LQSLSLKELYNGQCFSYLITQSPNLKTLKIIRCSGDWDIVLQDVPRDSLLAELHLEKLQVXRPGVAALIGLEVLYLAKAPEVTDVGLAELAAKSPCLRKLHVDGWKANPGW

SEQ ID NO: 48765 - protein, 60 aa, Sorghum bicolor
  unsure (1)..(60): unsure at all Xaa locations
  Clone ID: LIB3476-011-P1-K1-A4.pep
TVLLAKTILEEAKLXRPQDTKESVVLNVDQATLGNISGRIRKEVLQSCVKKSWRIEAQSY

SEQ ID NO: 48766 - protein, 122 aa, Sorghum bicolor
  unsure (1)..(122): unsure at all Xaa locations
  Clone ID: LIB3476-011-P1-K1-A5.pep
HASDAVVAGRQQQEQXVVAVVAIRAGHPDLHHFRGQGVYRGRCGSRFNHAVAVVGYGEDAATGEKYWIVKNSWGTKWRDGGYIKLKRQQVPAAAGSPAAAAAGGYCGPAVRVRPPFVPTMTM

SEQ ID NO: 48767 - protein, 139 aa, Sorghum bicolor
  unsure (1)..(139): unsure at all Xaa locations
  Clone ID: LIB3476-011-P1-K1-B1.pep
MAAGLQVFGQPASTDVARVLTCLFEKKLEFELVRIDTFKTHHKLPEFIRLRDPNGQVTFKHGDKTLVDSRDICRYVCNQFPNDGNKTXYGSGALERASIGQWLQAEAQNFGPPSSALVFSWHFIXSSSHLGILRTPAVC

SEQ ID NO: 48768 - protein, 158 aa, Sorghum bicolor
  unsure (1)..(158): unsure at all Xaa locations
  Clone ID: LIB3476-011-P1-K1-B11.pep
VAGLELLNSICAVHRPARSMIVSIGAVPQLVELLPELATECVEPALDILDALSAVPEGRVALKDCPRTIPNAVRLLMRVSEACTRRALSMLWTVCRMAPEECAPAAVEXGVAAKLLLVIQSGCAPELKQKASELLKLCXPNYTDTLFIFKCKLTRTIQ

SEQ ID NO: 48769 - protein, 143 aa, Sorghum bicolor
  unsure (1)..(143): unsure at all Xaa locations
  Clone ID: LIB3476-011-P1-K1-B12.pep
PNPPAPYVGGSLQALDNAFKWAEKYKLGVIIDLHAAPGSQNPWEHSSSRDGTQEWGTTDANIAQTVQVIDFLASRYATSSSLFAVELMNEPLAPGATLDSLTKYYRDGYDAVRKHSPTAXYVVMSXNRPASGNSTELLQFASG

SEQ ID NO: 48770 - protein, 124 aa, Sorghum bicolor
  unsure (1)..(124): unsure at all Xaa locations
  Clone ID: LIB3476-011-P1-K1-B2.pep
GRVGEHAIAYTAPSQQQVYGAKATINVWDPAIEESNGFSLSQLWILSGSFNGSDLNSIEAGWQVSPELYGDSRPRLFTYWTSDAYEATGCYNALCPGFVQTSSRIAIGXASISPVSSAGGARTT

SEQ ID NO: 48771 - protein, 103 aa, Sorghum bicolor
  unsure (1)..(103): unsure at all Xaa locations
  Clone ID: LIB3476-011-P1-K1-B3.pep
VTTLSQIKAFLSHRSPANQHSLTSSIQLVHDLSIHPLVLPTTSSISSSSSSTVQSITAAEMRRCGIIISSPLAAAAVILLLVAGCFHCAAAARXLPSSVPVPA

SEQ ID NO: 48772 - protein, 135 aa, Sorghum bicolor
  Clone ID: LIB3476-011-P1-K1-B6.pep
MYPNYTSYDPVLTGKCHVNFSALSYVMEKTAYDCSIPLAPLVADVICCPQVNSLMNIFQAAYGSGNNTLVLNQASANACFSDIVNILASKGANTNIPELCTLRPSNLTDASWPVKDVSSFEKIVNTSKLLNACSS

SEQ ID NO: 48773 - protein, 120 aa, Sorghum bicolor
  Clone ID: LIB3476-011-P1-K1-B8.pep
MAAEYDERYQGNGDTATAEGGHAQAEYAAPAAAVAPAAGGSPPADSKPAGFSDHADGRSSQPQHETQSHDSGSSKSRERDRERDKSKDRERDRDRGREKERDRDKGRERGDRDRRACRHH

SEQ ID NO: 48774 - protein, 133 aa, Sorghum bicolor
  unsure (1)..(133): unsure at all Xaa locations
  Clone ID: LIB3476-011-P1-K1-C8.pep
GKGRNSVWYPYLSQLPSYYTILATFDDFEVEALQVXSVDDAIWVAQKAKSAIKSDWEDVTPLMKELEFKPKLLMFKSWLWAFATVSSRTLHIAWDEAGCLCPVGDLFNYAAPDDDTALEAEDAAELTNYQQEK

SEQ ID NO: 48775 - protein, 118 aa, Sorghum bicolor
  Clone ID: LIB3476-011-P1-K1-D12.pep
EKLSTHACRNIRAHPRCGSPRCDGRTCYRGAGGQDQHDHLIRDMRDDEDGTDWQRVPHALHRAMRRVLPRLEELRLHNQASPTDARTRAPTMTLSTIRITWTRPPPVTTSYPNATTGP

SEQ ID NO: 48776 - protein, 84 aa, Sorghum bicolor
  Clone ID: LIB3476-011-P1-K1-D8.pep
WWYRTFNAMFSFLQKLKMSRIYFIYFPVIRKKSVNKIKLQLEHRFIGVTDTLFCHQKGLIKSTTKQPYARVTNKTIFPHRKENK

SEQ ID NO: 48777 - protein, 147 aa, Sorghum bicolor
  unsure (1)..(147): unsure at all Xaa locations
  Clone ID: LIB3476-011-P1-K1-D9.pep
LAKSTLKIEEEFKQLMSTYSKPIEPDRLFDCLPKSLRPTKGDHEDGGSNSDHPSKGLETAVYRTPTLIPPRILPLMNDIAQQLVQAGNQQTCYKIYRDSRASALEVSLRKLGVEKLTKDDVQKMQWEALEAKIGNWIHXMRIGSNYY

SEQ ID NO: 48778 - protein, 123 aa, Sorghum bicolor
  Clone ID: LIB3476-011-P1-K1-E3.pep
FAFHLRDCTQLSGDRVLLIHVTDRFCSYNAEFLLLCFYCQSRSLFNSTYYYQELHLEWNCCFFWVFSPYLHFSGTFMLFLLFTLLQSRGYIILLFVPRYPNRQLFLHFYFCFSCSHVSTMASD

SEQ ID NO: 48779 - protein, 129 aa, Sorghum bicolor
  Clone ID: LIB3476-011-P1-K1-E5.pep
VADITTDPRKDTRLPRGKPDPSVCPPPVCEIRLYYLLTPCATVRDPPPQHQQQWRRTRLGGYGRRSRGSVRGRGGTRGEARLARMPPATDPAGARVAPSRELSIWPEQWRKVAAAQRERPQRWSKLCGC

SEQ ID NO: 48780 - protein, 120 aa, Sorghum bicolor
  Clone ID: LIB3476-011-P1-K1-E8.pep
RFNQPVVSEQQQQQQQQAWKQKFMGSQSMSFGGLVSLNSPTSKDGSADNKIGRDVQNQSLFSPQVDSSSLLYNMVPNLTSNVADNNISVIPSGSTYLQSPMYGCLDDSSGLLQNTGKNDP

SEQ ID NO: 48781 - protein, 96 aa, Sorghum bicolor
  unsure (1)..(96): unsure at all Xaa locations
  Clone ID: LIB3476-011-P1-K1-F10.pep
ARSAPAIDAHRTCKAEQTEKALLTPNXGLLSSTKSMEGEKPGMGGNLLWASTGRGIMTANEAMVGSYSVKIXLYTATVSIKCRILAETGHSAKMNR

SEQ ID NO: 48782 - protein, 131 aa, Sorghum bicolor
  unsure (1)..(131): unsure at all Xaa locations
  Clone ID: LIB3476-011-P1-K1-F12.pep
LRNAVSKTYNRISDLRKEIQSLKKGLLVAKEASAKAIKELEEAKSVLEIVEGQPAIAERPGRIRRLESHVKNAEDKERTIEESLEVKGALLARALEESKDLLKLLFKSFVDVLTXRLPPVSVDGKIPNLRT

SEQ ID NO: 48783 - protein, 64 aa, Sorghum bicolor
  Clone ID: LIB3476-011-P1-K1-G3.pep
FILPLNGHSMMSSTLSLGCIILQTINTFQVSVKCNVSYSVNLAKIEITTSSVDGTVQAGIHIGR

SEQ ID NO: 48784 - protein, 135 aa, Sorghum bicolor
  Clone ID: LIB3476-011-P1-K1-G9.pep
LVDLSGNGFNGSLPSDFGGARLRLLNVSSNKLAGAVPTELAALVPANATVDLSRNNFTGAIPQAGPFAAQPAAAYEGNPNLCGPPLKQACSIPSSLSNPPNATDSPPAFAAIPKEPRRAPPGTPGQPPSEQDKLR

SEQ ID NO: 48785 - protein, 67 aa, Sorghum bicolor
  Clone ID: LIB3476-012-P1-K1-A1.pep
PRDESFEPSYSIIGQCLSNKNESATVPFFASFCELNKALVVDVKLSQSQVARRWGTFWFLDSVYQCY

SEQ ID NO: 48786 - protein, 64 aa, Sorghum bicolor
  unsure (1)..(64): unsure at all Xaa locations
  Clone ID: LIB3476-012-P1-K1-B12.pep
IRYSRNEMYISLLSVHHSHLLVWXALTELCTYYCVETYRIPSHHIEYTDRRSSLPTPATILSLH

SEQ ID NO: 48787 - protein, 139 aa, Sorghum bicolor
  unsure (1)..(139): unsure at all Xaa locations
  Clone ID: LIB3476-012-P1-K1-B2.pep
MLAAAAREKEEEAREQLRQAVAEKAAADEARAQAKRHAELAEQELASAKRMRRQAQVELSRAHALREHAVRQVNATLXQITCLGCRHKFRARAPQLMMDAAVAGRVACSYMSSVVTAEGGDAEVVDDEPPPLDGADAML

SEQ ID NO: 48788 - protein, 155 aa, Sorghum bicolor
  Clone ID: LIB3476-012-P1-K1-B8.pep
HGLTEIAERIAAELGENVPCLPEGKSHSLLIPPAPLTACGDWPLLRVMRGIFEGGLDATGRAELEEDDEASGADWGDEDLDIVDASEVVANGGDYFDAEEGEPNEEDGEEGGWDLEDLELPPDTETPKSAGNARSAVFVAPTAGIPVSQIWTQKS

SEQ ID NO: 48789 - protein, 153 aa, Sorghum bicolor
  Clone ID: LIB3476-012-P1-K1-C6.pep
NKRLLNTDRLGRPESLSVEASPTVGSDSASDIGDTEQSRKQTAQHSPSSAAKPGHEAVGSISHRAPQRRQSIAKEGQDGSSSSSSHSKWNLAQKQYSNSPLIRGLHGSSRLEEFGGSIPPAASTALVKLTNRLNFLKERRALLASEMQKLELG

SEQ ID NO: 48790 - protein, 129 aa, Sorghum bicolor
  Clone ID: LIB3476-012-P1-K1-D2.pep
ILGVKLHLLPLNIHFGDLGLTTDPMGSCSLLDAFQSDQASVSNSEKSLAPFACEDLLVTCNFGHEKEKGIKIINLEFKCGYAIANIDERMFHKKHMIPEYNTVSLNTGDSIRDNSAIKQTSKSKSILPL

SEQ ID NO: 48791 - protein, 45 aa, Sorghum bicolor
  unsure (1)..(45): unsure at all Xaa locations
  Clone ID: LIB3476-012-P1-K1-D4.pep
MVGGQLVXGIGVHSKNLSSSPLQLKFGCLFPLIYNDVSFFTITGC

SEQ ID NO: 48792 - protein, 125 aa, Sorghum bicolor
  unsure (1)..(125): unsure at all Xaa locations
  Clone ID: LIB3476-012-P1-K1-E4.pep
SLTIARCDRITSLDFVRVPTLRSFRYYGCPSNLPFSIPRDAVLSDLYIQLYSYDPVPMKEWNIDKLRKSLPEELSSLGVLTICYKALTGASVLPADGASAQLTNFNLHSLKELHXTHVRNESCQP

SEQ ID NO: 48793 - protein, 125 aa, Sorghum bicolor
  unsure (1)..(125): unsure at all Xaa locations
  Clone ID: LIB3476-012-P1-K1-E8.pep
TNLALMLHVSPNKHGALVPLXETXARHGAPARILCSPSTESTPRAFSPHSRPPSESHPNRTRRRVLQHRTHHSTLSSTALYIQVKWPQHTITISIQSSPLLQFPAKKETSNHDQHQENCSAGQEV

SEQ ID NO: 48794 - protein, 128 aa, Sorghum bicolor
  Clone ID: LIB3476-012-P1-K1-F11.pep
MSEPSKVIHIRNVGHEIAESDLLQLLQPFGVVSKIVMLRAKNQALLQMEDIHASVSALQYYTSVQPSIRGRNVYMQFSSHQELTTDQSSHGRNSDQESEPNRILLVTIHHMIYPITVEVLHQVFKAYG

SEQ ID NO: 48795 - protein, 172 aa, Sorghum bicolor
  unsure (1)..(172): unsure at all Xaa locations
  Clone ID: LIB3476-012-P1-K1-F12.pep
FLIIAPASIFCAFVAKGLMDRFSYALGLPVMIAAVLFTAYDLSLLLLTSGRDPGIIPRNAHPPEPEGFDGNAEVGANQTPPVRLPRVKDVVVNGITVKTKYCDTCMLYRPPRCSHCSICNNCVERFDHHCPWVGQCIGLRNYRFFYMFVFSTTLALPDVFGFCWVLIXKIRN

SEQ ID NO: 48796 - protein, 123 aa, Sorghum bicolor
  unsure (1)..(123): unsure at all Xaa locations
  Clone ID: LIB3476-012-P1-K1-F2.pep
NTQFLVEYFALDLLMDNEGICQGVIALNMEDGTLHRFRAANTILATGGYGRAYFSATSAHTCTGDGNAMVARAGLPLQDLEFVQFHPTGIYGAGCLITEGSRGEGGILRNNEGERXMERYAPT

SEQ ID NO: 48797 - protein, 80 aa, Sorghum bicolor
  Clone ID: LIB3476-012-P1-K1-F9.pep
RPIGPVCHQYFTIYEHCFRLAADQHKPNFSTVDRINTWWAYSPEQQSWCQPLPGRCTRYCHMRSSPVPCLLECGFYACST

SEQ ID NO: 48798 - protein, 106 aa, Sorghum bicolor
  Clone ID: LIB3476-012-P1-K1-G1.pep
FLQVYRKKSTGGFSSVPYVVALFSSVLWIFYALVKTNSRPLLTINAFGCGVEAAYIVFYLAYAPPKARLRTLAYFFLLDVAAFALVVVVTLFVVREPHRVKFLGSV

SEQ ID NO: 48799 - protein, 172 aa, Sorghum bicolor
  unsure (1)..(172): unsure at all Xaa locations
  Clone ID: LIB3476-012-P1-K1-G11.pep
PTRPDSSTAPAGRLPPSPWVSSQTVHARLFSPPSFVRTFFPLCCWDRIGKESLKVGDHIYSWRAAWVYAHHGIYMGDDKVIHFTRGSGQEVGTGTVVDILLVSSAPKRSNTPCPVCTNETSDTSTETNGVVSSCLSCFLAGGALLPFEYAVNPALXLAKARRGNVHSACSDP

SEQ ID NO: 48800 - protein, 125 aa, Sorghum bicolor
  Clone ID: LIB3476-012-P1-K1-H2.pep
MSKQAEAASLLYKSNLNSGSVLEYALAFTSAALDRHYSKWSATPKTGFIDITTSKDFYRIFSGLQYSYLEDSINNPSKKQEMLGDSVAWAGCTIMYLLGQQQHFELFDFSYQFLNVAEVESAQFH

SEQ ID NO: 48801 - protein, 68 aa, Sorghum bicolor
  Clone ID: LIB3476-012-P1-K1-H7.pep
GARAVVSVLCYEPHESALNNDKRCDPESKVSSPAGKAHVKVKSVDGLHLHDEPPHPGVVGCVVTLVEI

SEQ ID NO: 48802 - protein, 48 aa, Sorghum bicolor
  Clone ID: LIB3476-013-P1-K1-A10.pep
GPAVSSVRLIRSGGSHGFRTRVIDGTRSITHAAGTAPSRRLMPLSARW

SEQ ID NO: 48803 - protein, 90 aa, Sorghum bicolor
  Clone ID: LIB3476-013-P1-K1-A12.pep
GGAGAGAGSRPPQGEGNARRRHYHLLLRWRRRRRGGAAAGAQQCKLPMPLLAPLAARLQLTHSQEGGEGRERPGRRSEEEEGGGGRFLMA

SEQ ID NO: 48804 - protein, 127 aa, Sorghum bicolor
  unsure (1)..(127): unsure at all Xaa locations
  Clone ID: LIB3476-013-P1-K1-B11.pep
AHAKLLVESGXXSDIGIITPYSAQVTCLKMMRNKDAKLKDLEISTVDGFQGREKEAIIISMVRSNSKKEVGFLSDHRRMNVAVTRARRQCCLVCDVETVSNDRFLKRLVEYFEENGEYLSASEYQSS

SEQ ID NO: 48805 - protein, 105 aa, Sorghum bicolor
  unsure (1)..(105): unsure at all Xaa locations
  Clone ID: LIB3476-013-P1-K1-B3.pep
SSIGALANTIDPXXSADDEDEEEEERYVLVGMQTSGGDKIRLVAVADQRYVAITGXAKGFSYCPNWFFREGKRHRLVVTAALANDGGSSHAEVVASNLLRGLKTN

SEQ ID NO: 48806 - protein, 124 aa, Sorghum bicolor
  Clone ID: LIB3476-013-P1-K1-B6.pep
MVRPHREDEEAASPLIAAPAGGGRSHAADAHVLSAAFLFVFSAYSAAQNLQSSVNTEGDLGTVSMGILYTSFTLFSVVASPVVTRIGPKRALIVGTSGYVLFILANLVPTWYTMVPASLYLGFT

SEQ ID NO: 48807 - protein, 131 aa, Sorghum bicolor
  unsure (1)..(131): unsure at all Xaa locations
  Clone ID: LIB3476-013-P1-K1-D12.pep
MGSYPPVSPRGSGSVPAQRAELYSKMARDLDERGAAFLKGGETXQSLTLSDLFDTAADGAVVPRLKAADPPVRANVLYMDPKFAAVISKAVKDVXLPYFDQAIWFQNTSMYHFSMFHASHHLEPIVATEDE

SEQ ID NO: 48808 - protein, 61 aa, Sorghum bicolor
  unsure (1)..(61): unsure at all Xaa locations
  Clone ID: LIB3476-013-P1-K1-E8.pep
PSSSAFHCHLWVTIAASRPQQATPHRLPPPETLGRNHQCPHFPVAPRQQMNPTEXXXALII

SEQ ID NO: 48809 - protein, 100 aa, Sorghum bicolor
  Clone ID: LIB3476-013-P1-K1-F11.pep
DVSVENMDHASSSSLEVKSDVRMENMDQAPSSLKSDTSMENMDHAPSWCSLGENGYFDADPEWLIHAESAMQQYEEQSRGSQSQATSQVFDLYSGVTSAV

SEQ ID NO: 48810 - protein, 60 aa, Sorghum bicolor
  Clone ID: LIB3476-013-P1-K1-F3.pep
CLLHAVSIDCIVLVHTHTNLIISDYCYPSAALSSFALVNLRLQVFSFYTLYENWFQLKGL

SEQ ID NO: 48811 - protein, 73 aa, Sorghum bicolor
  unsure (1)..(73): unsure at all Xaa locations
  Clone ID: LIB3476-013-P1-K1-F8.pep
VGTLVPLSLCCCCRGAGGGVGVCRHAAGGGRQAAARRRSKRKRRRCGRISARRVGDPGPHGRVXXXGGVSEMP

SEQ ID NO: 48812 - protein, 132 aa, Sorghum bicolor
  unsure (1)..(132): unsure at all Xaa locations
  Clone ID: LIB3476-013-P1-K1-G1.pep
KLIEQLERRRAXXXPPWCSPKSLVKPTVLASSLGPLATRTQESQHARARLTSLGPAVSTPRSPHXLSPPLHSPVGRVARRMVATMASSLLLRPRAVLPHHPSSSSSSRRPLPAPRVQLQPIIQQKPGLAARS

SEQ ID NO: 48813 - protein, 41 aa, Sorghum bicolor
  Clone ID: LIB3476-013-P1-K1-G9.pep
LNGIEWSPTDTLEKEMLPNDSSMERARMLSGLERCHQPQGM

SEQ ID NO: 48814 - protein, 157 aa, Sorghum bicolor
  Clone ID: LIB3476-013-P1-K1-H12.pep
CCYLLAWYVQLDIPCLIGKGGLIISDSLNHNSIVNGARGSGATVRVFQHNSPAHLEEVLREQIAGGQPRTHRPWKKIIVIVEGIYSMEGELCKLPEIIAVCKKYKAYTYLDEAHSIGACGQSGRGGCELLGVDPTDVDIMMGTFTKSFGSCGGYIGA

SEQ ID NO: 48815 - protein, 65 aa, Sorghum bicolor
  unsure (1)..(65): unsure at all Xaa locations
  Clone ID: LIB3476-013-P1-K1-H4.pep
AAWSIGASEGDGKPPRLCKRDSPFTCLSEPPLPLYNLSSPSSERSLSVRXXLKARTNEYSHAHDT

SEQ ID NO: 48816 - protein, 61 aa, Sorghum bicolor
  unsure (1)..(61): unsure at all Xaa locations
  Clone ID: LIB3476-013-P1-K1-H5.pep
PFAGWCLVLSSWLRRRVGRGRDREEVGVDGSGSRGGGGCRRASRRSVXCQGQAGRGGADAW

SEQ ID NO: 48817 - protein, 57 aa, Sorghum bicolor
  Clone ID: LIB3476-013-P1-K1-H6.pep
HKFSLSTTNVISNMTKIILNDKQSLQMLLKMFVIFVILETLISKAIHYASTTKFSFI

SEQ ID NO: 48818 - protein, 140 aa, Sorghum bicolor
  unsure (1)..(140): unsure at all Xaa locations
  Clone ID: LIB3476-014-P1-K1-A11.pep
QPTCPVCLERLDQDPGGILTTICNHSFHCSCISKWTDSSCPVCRYCQQQPEKSMCSICGTLENLWICLICGHVGCGRYKGGHAIEHWKETQHCYSLELETQKVWDYAGDNYVHRLIQSKTDGKLVEYNCHXDHTAEEPVF

SEQ ID NO: 48819 - protein, 104 aa, Sorghum bicolor
  unsure (1)..(104): unsure at all Xaa locations
  Clone ID: LIB3476-014-P1-K1-A2.pep
GAIVYRASPLLACLPCLAACCRGNCSCGSGCIFRSGCGGCKMYPYMANQQVTTTAKTLVMGVAPSSKEHAEGPTXAAAPAGAVNEGGKNGPNCSCNPCTCKGAG

SEQ ID NO: 48820 - protein, 48 aa, Sorghum bicolor
  Clone ID: LIB3476-014-P1-K1-B3.pep
QARSVYESAATYTKCIGYMTSDYARDRLISALREIRRTTLHGIGSVSR

SEQ ID NO: 48821 - protein, 49 aa, Sorghum bicolor
  Clone ID: LIB3476-014-P1-K1-B4.pep
LGLKDSSRKLQVDCVISLSIFSASYMCRKIRCDGKSEKFCKIFWELNKA

SEQ ID NO: 48822 - protein, 99 aa, Sorghum bicolor
  Clone ID: LIB3476-014-P1-K1-B9.pep
SYTSSRGAVASSANLSHGGALYSSSHPGALPSAPSSPPAAATGRRCRSRRQLLQLQISPPPPWPPPPRADGRRGPAAARGGRARAEAEHQHRPDPRGRA

SEQ ID NO: 48823 - protein, 110 aa, Sorghum bicolor
  Clone ID: LIB3476-014-P1-K1-C3.pep
SLVHITVIHTRRLTRHSTRKATPKAQAQERARQPAMQRAMTQTTTHEATEEVTNDVTTAANTKANRQAKHPTKQPAEVKAGVKTKPNTKAAPVGAPVFPAALVAAVAADA

SEQ ID NO: 48824 - protein, 123 aa, Sorghum bicolor
  Clone ID: LIB3476-014-P1-K1-C9.pep
RSSAVVSSPLETAKTHHPLLSQRRRKPGIKAKLNSLCIQLRKNCAHPDLLEAAFGTTSLYPPVNKLLEQCGKFQLLDRLLTSLLARKHKVLIFSQWTKVLDILEYYLDSKSLRVCRIDGSVNL

SEQ ID NO: 48825 - protein, 138 aa, Sorghum bicolor
  Clone ID: LIB3476-014-P1-K1-D5.pep
HICMMGDPGVAKSQLLKHIINVAPRGVYTTGRGSSGVGLTAAVQKDPVTNEFVLEGGALVLADMGICAIDEFDKMEESDRTAIHEVMEQQTVSIAKAGITTSLNARTAILAAANPAWGRYDMRRTPAENINLPPALLS

SEQ ID NO: 48826 - protein, 157 aa, Sorghum bicolor
  unsure (1)..(157): unsure at all Xaa locations
  Clone ID: LIB3476-014-P1-K1-E1.pep
VLNGLLIRSDRAEAASIPVGIIPAGSDNSLVWTVLGVRDPISASLLIVKGXFTALDILAVEWIQSGQIHFGSTVSYYGFLSDVLELSEKYQKKFGPLRYFVAGILKFLCLPSYFYELEYLPVSKEMAVNGKGTDQDKTHLSNVYTDVMHSRSKREGI

SEQ ID NO: 48827 - protein, 108 aa, Sorghum bicolor
  Clone ID: LIB3476-014-P1-K1-E12.pep
EVKSLHVAEEASQAFAPTSRAILGALSNVGSSRSSSALSNSERQQWWHKPCGPLLLSTASKQKMVTAYDIRDGDVVMKWEVSNPVMGMEYSSPLQWRSRGKVVIAGSE

SEQ ID NO: 48828 - protein, 92 aa, Sorghum bicolor
  Clone ID: LIB3476-014-P1-K1-F1.pep
GASGMSSRAGEEIGGAGRSPRSLLFSRASVSWPRARLAAREILPLSDLARSRSRPPMRRPAPTPRRLAPPSAWKRDYGHSRGDGLRLAPNRA

SEQ ID NO: 48829 - protein, 55 aa, Sorghum bicolor
  Clone ID: LIB3476-014-P1-K1-F5.pep
SQISGRTPYIVTTTQKVYNTYNRYMYSSVGITKQKDGCSWENRAAKTSKHTSGFA

SEQ ID NO: 48830 - protein, 145 aa, Sorghum bicolor
  unsure (1)..(145): unsure at all Xaa locations
  Clone ID: LIB3476-014-P1-K1-G12.pep
MGAPPSAARSRGGPRRALRRSAAALFLATLIALPFAVLYRAAVWRSLGASWGWEWDSLPSSFAASKEEGAEADDXEDLKLERILKKASMRDNTVILTTLNAAWASPGSVIDLFTGSFRSGVRTNLLLKHLVVVAFDWKXYEQCAK

SEQ ID NO: 48831 - protein, 58 aa, Sorghum bicolor
  unsure (1)..(58): unsure at all Xaa locations
  Clone ID: LIB3476-014-P1-K1-G7.pep
ATQHPWLLSSTGFAGKAVNVPSXIFTQARVTMRKTAAKAKPAADCRSPWYCLKRLIYM

SEQ ID NO: 48832 - protein, 90 aa, Sorghum bicolor
  Clone ID: LIB3476-014-P1-K1-G9.pep
LYFAVYLSGCPSGSLSLYVTVYGTVQPESDTKAPTSVQEVMHEACREPGHQPEHQLEDVYLRVDMGYTKAYVKEATQEVTAAENVEEGDP

SEQ ID NO: 48833 - protein, 56 aa, Sorghum bicolor
  Clone ID: LIB3476-015-P1-K1-A6.pep
PQRLGRGAWPRPSSMAEGDRHADRAQDAQRPLRWPADLRQVRSPAVAPPSGQLYCI

SEQ ID NO: 48834 - protein, 135 aa, Sorghum bicolor
  Clone ID: LIB3476-015-P1-K1-A7.pep
SYAWTAYLTILGDAVHTGIWGQLIEKVVKEAIASVDGYNADRREAVRKAAQSLNLKTEAAMAIFSKAVRKLFLSYIQRAKEAGNRIETAKELKKLISFNIVVVSELLADIKREISPVAETEASSAASESWGEDDD

SEQ ID NO: 48835 - protein, 107 aa, Sorghum bicolor
  unsure (1)..(107): unsure at all Xaa locations
  Clone ID: LIB3476-015-P1-K1-A9.pep
MVRDTAYYDVLEVSPTATEAEIKKAYYVKARQVHPDKNPNDPFAAARFQELGEAYQVLSDPTQREAYDSYGRSGISREAXIXPAAIFAMLFGXELFEDTLAAAMDHG

SEQ ID NO: 48836 - protein, 132 aa, Sorghum bicolor
  Clone ID: LIB3476-015-P1-K1-C1.pep
GLTKQRKPWVRRIQPTKTELKKPQDYTGPKLESLLFHEFLRARFTPSYVLGAASNCWLALMDRLLTGGVPKSERQAIKKKMLDLVDIYYLALDAPKEGNKITVPGELKVKKYPHFMERDEKKSYTSTSVLGK

SEQ ID NO: 48837 - protein, 148 aa, Sorghum bicolor
  Clone ID: LIB3476-015-P1-K1-C10.pep
STGQLTGARCCACAERTPPRGHPAAAPLSHPRRVPFLPPRLRPLAAAGRSAGLSLTVAIGGGGRGGMESLRGGDDALVLVPVPVPVRRRYAAVAQFAGHVGGPEEGIESLRGETLGVAGRQEEDCGGYCSVQRPAASRQPAASQCGGL

SEQ ID NO: 48838 - protein, 150 aa, Sorghum bicolor
  Clone ID: LIB3476-015-P1-K1-C6.pep
PRVRSSEILYGNGFDALFVRWSNRSGATTINGQTEVAIDIDGFPPHTFSPSALGSLLERHCSIQAYRFSMTRGLCRVDAYTLSKYSIPKSGEIGLQYTGPHGVTNVALTVTMTTYNYSEAPAFVENEFHADPVTLGSADSDAYFDTYEPG

SEQ ID NO: 48839 - protein, 139 aa, Sorghum bicolor
  Clone ID: LIB3476-015-P1-K1-D6.pep
MGGQKKGNPRAISKIVKERTGEIDKKRSLITPVLRIVTSFTSLVDSADFLEVKNKIVREIVDFTKQHQSVFNSILRENMTGANLLTLEQLNQWVSILSKVWAYEENEECSYIQDLFSLMHSLFSPRFWVSKFYAITKHY

SEQ ID NO: 48840 - protein, 167 aa, Sorghum bicolor
  Clone ID: LIB3476-015-P1-K1-E11.pep
EERHLSGVWPMDDPAQFIRAGTSPNQRHGRFDLLENLQRSSSFDHHEHLDRSLSLHERLHRGGQGIHSLERSGSLPGGGPGPNPDVINALARHHGLGQLETHGDIYPLGQMPMLPSGVHPQQHRLQEQLPGSHIGRLERHWSDANGQLQNSLMESSRINQLQIEAEK

SEQ ID NO: 48841 - protein, 134 aa, Sorghum bicolor
  Clone ID: LIB3476-015-P1-K1-E5.pep
QAVNEEHQQEKCDQEKEIYLLRSQISEQGLVNYHQLEEIHRINLLLDESIQTFLQKEVLEQNYVSLQKAMGEEIHRLESQLDQSKVHFAHLLSQIQDKEQSIAKLKNEEFNVLSRLMSEVLKANGIHVNFEWIN

SEQ ID NO: 48842 - protein, 89 aa, Sorghum bicolor
  unsure (1)..(89): unsure at all Xaa locations
  Clone ID: LIB3476-015-P1-K1-E9.pep
MKKIFGAKKDKGPSPFIQDATERINKRGETVDEKIKKLDEELARYKEQIRKTRPGPSQEAIKARAIRLLKHKRMYEEQRNMXYNQTYNL

SEQ ID NO: 48843 - protein, 109 aa, Sorghum bicolor
  Clone ID: LIB3476-015-P1-K1-F10.pep
RATTPVRIKLIQAESLEVIEGLMLSEQRVSFPGGQLFKVHTLKATLKMQVLQQWKHLFDVVAHLPVLRSLELTRDDDFCADEEVELPMPACFGDSLRHLRLNGYRASGA

SEQ ID NO: 48844 - protein, 111 aa, Sorghum bicolor
  unsure (1)..(111): unsure at all Xaa locations
  Clone ID: LIB3476-015-P1-K1-F11.pep
RFDITSGSLFLCGASRLAXDFFFSRRPDVETFCDICPDVTVSLQQQIVGPFSFRVESSVAFDPRSQDHFVRVDDPIFAIDWALKVLGSAKATAWYSPKHQEAMVELRFYET

SEQ ID NO: 48845 - protein, 42 aa, Sorghum bicolor
  Clone ID: LIB3476-015-P1-K1-G11.pep
ADEPHVLNVRCRPLFRSATVGSPRRTGIGARVCAVTVVMYLV

SEQ ID NO: 48846 - protein, 72 aa, Sorghum bicolor
  Clone ID: LIB3476-015-P1-K1-G5.pep
LLALRATLDARLTATTLTLHNLSPNRAWPLLTLNTGLLVIYENTARLDGGSRRLVSLRLPDSFCAGRLMALT

SEQ ID NO: 48847 - protein, 136 aa, Sorghum bicolor
  Clone ID: LIB3476-015-P1-K1-G8.pep
ESKLFFKQATSWRPSAASDLMISVSSELSLRNPSLGARVPQLPVQVLTLEATNMTSENLTLTVITPEASGSSSVVSLNSDPATPNGSFDGVNQSEKRSGLGKHGIGFQRLNSVLAGSPQEGDNGGNRMSNASDCTH

SEQ ID NO: 48848 - protein, 92 aa, Sorghum bicolor
  Clone ID: LIB3476-015-P1-K1-H1.pep
MVEAVGTFESRGPGVAGMSSTLEEVQMQETLAFSETIKDLKTLRSQLYSAAQYFELAYMQEDKKQAMTKNLKEYAVKALVNTVDHLGSISFK

SEQ ID NO: 48849 - protein, 149 aa, Sorghum bicolor
  Clone ID: LIB3476-015-P1-K1-H7.pep
CSIPAQPSALLLLRAPAPSSLLLPPPPPPTPCRDSRSRSSAARLYRHSPWPTRRTPPPLLLPPPRRASPAPQPSAPPPSRPWPSPPSASASRSPSCPRTPTPCTTTTTTTATTTTSPSGSSSTSSSPPLTRRRRRIRSSASPTPTSTPT

SEQ ID NO: 48850 - protein, 147 aa, Sorghum bicolor
  Clone ID: LIB3476-017-P1-K1-A1.pep
KARSSTIPRRPDSSLKSSVQGSTPVRRMKLVDSPSTNPKIMERNFGQRDISSASRAARANNSATTKKSNLTESALVKDIYTTSQAVPAPVVVPRDILEDKTVSNVRRGTGDTAAAPDDFRTPFHKRKPSLSGSAADSDSSSVYTEPD

SEQ ID NO: 48851 - protein, 87 aa, Sorghum bicolor
  unsure (1)..(87): unsure at all Xaa locations
  Clone ID: LIB3476-017-P1-K1-A9.pep
SYVTNFITAVSSSADSSGHCRRQCPILDMIMHIHTIGICIGSRMHILMNFSMHXSLYRIVNTIRLFIHLSSHIHSCHKLCHKLCLPK

SEQ ID NO: 48852 - protein, 142 aa, Sorghum bicolor
  Clone ID: LIB3476-017-P1-K1-B11.pep
VAGKALRVDSRVFNSKHGTVLDSGTTYAYLPEQAFVAFKDAVTSKVHSLKKIRGPDPNYKDICFAGAGRNVSKLHEVFPDVDMVFGNGQKLSLTPENYLFRHSKVDGAYCLGVFQNGKDPTTLLGGIIGRNTLVTYDRHNEK

SEQ ID NO: 48853 - protein, 82 aa, Sorghum bicolor
  Clone ID: LIB3476-017-P1-K1-B6.pep
SVAVHAVIAPFSLSYVAALYGAPASDQQICSAISHQYVSACKGSTSTVPQRTLPLTNDHTSTPSPYPTSLPLSLSRLYRVSS

SEQ ID NO: 48854 - protein, 83 aa, Sorghum bicolor
  Clone ID: LIB3476-017-P1-K1-C12.pep
WCSEGVTAASSLCWLVLDTCCSHLQWSCLLVVGLTSSDLVFIVDVTVAITVSLLWSPVTTGTAFGSGASIFASLTITEHCSGP

SEQ ID NO: 48855 - protein, 150 aa, Sorghum bicolor
  Clone ID: LIB3476-017-P1-K1-C2.pep
DHFEQTDTIYRYPGIHLRGPPPLSLFCAFKDYPVGVTKGRHWFGSLYQLYDESEISLNNAQTIDWSEHCHCKATDLLQFIDIKIAGYRHTQPGHAKIFGFFAARDKIEPLRNYVYRRGVDNYEAVSVNQKTGMARLSLTSPARGICITSH

SEQ ID NO: 48856 - protein, 116 aa, Sorghum bicolor
  Clone ID: LIB3476-017-P1-K1-C7.pep
NDVPWSSTSPILFYPPILFHVDMKERSSMHGASQPAGCCTKPGQEACRDIRKRYRHQCQRGPGFARDGEAAELGVNLPRPPASCEVTRVCAAVMPPCQRGSQRCGRCRRRRCVRRG

SEQ ID NO: 48857 - protein, 45 aa, Sorghum bicolor
  Clone ID: LIB3476-017-P1-K1-D3.pep
SEHCFIHSDFHLVLYCFYSFIQNFFANNIQKMLVIFLSCLYLSML

SEQ ID NO: 48858 - protein, 157 aa, Sorghum bicolor
  unsure (1)..(157): unsure at all Xaa locations
  Clone ID: LIB3476-017-P1-K1-E1.pep
ERWFVEASPVPIPLPFGKLEDMVRRPVYPPVRECFFHFSAESVRKLKAKANAEMHGAGXGHGDGRRVVSSLQSLLAHLWRASCRARELAPDRETTYMLLVGCRARVKGIPXEYMGNAVTVAVARSTAGDVVSKGLGRAAWLLNRAVAAFDEASVRDD

SEQ ID NO: 48859 - protein, 169 aa, Sorghum bicolor
  Clone ID: LIB3476-017-P1-K1-F11.pep
QKNPDQSSTQETTPDDDHWSDPVESSFDDDVGMPHPADIEDPVGDYSDDEDPWKPLNPHEPGNLKIRPYRRVKGSPRVVIGTLKKKTVIFLFPMAKMDGVIIPEHAKSFEAQQSQQEEHYGSQSPPRFEKFLRSFEFGEENPNVFGDLKDDDGSNTGLNFDNDDPDMPN

SEQ ID NO: 48860 - protein, 98 aa, Sorghum bicolor
  Clone ID: LIB3476-017-P1-K1-F12.pep
GKLHASTDTQDSDHVEDQHSIIPVFNEHKTLAKLLKGTLWDICSRAQWCTRSQRYIVHGYWLQTSTATGRLCMEEPNLQCGEHLKEFCTGKSNKDYCM

SEQ ID NO: 48861 - protein, 95 aa, Sorghum bicolor
  Clone ID: LIB3476-017-P1-K1-F2.pep
EQAGDTTIREATSTAVAQSPSEAARAAILPRLRVSLSYTQLVGSTRVALRSGIRFYSDKVLKYRRLTTNSAMKSYRLSVLSDTEVCGVNGSHLIY

SEQ ID NO: 48862 - protein, 107 aa, Sorghum bicolor
  Clone ID: LIB3476-017-P1-K1-H3.pep
SASVGRRGLAGEPGDEGVGAASAPLVVLHGAAQREEARERQRGHRRRLVVCGVGGRHAQAQPLQQQRCRGGQRGRRRRHFRSSATREGRGRDRARTGGAAAVVCTMM

SEQ ID NO: 48863 - protein, 148 aa, Sorghum bicolor
  Clone ID: LIB3476-017-P1-K1-H7.pep
NQMQSVVQSAMAATNTTTTTGVMPPGARPQLSSNGSSGRGSREAEDPATKAQLKAMAAKALWMLARRHVGVCKSITESRALLCFARLLQSGDGGAGTDLQLHSAMAIMEITRVGEHNLALGQFAFKPSATAAKAVVEQLLPIGRKGDD

SEQ ID NO: 48864 - protein, 90 aa, Sorghum bicolor
  unsure (1)..(90): unsure at all Xaa locations
  Clone ID: LIB3476-018-P1-K1-A1.pep
PIQTRRGRCGEWANCFTFYCRAFGYDARLILDFTDHVWTECFSNLYGRWMHLDPCEGVYDNPLLYEKGWNKKLDYVIAISXKDGVRDVTK

SEQ ID NO: 48865 - protein, 171 aa, Sorghum bicolor
  unsure (1)..(171): unsure at all Xaa locations
  Clone ID: LIB3476-018-P1-K1-A5.pep
KEQYCDAFLTAHFEVPGEMFSLAMEAKRRAMGVVGSTQNILDFIKDHLMRALDRNVDDHLQFVLGTESGMITSIVAAVQELFDLYSSQERANIEVEXVFPVSSDAISKTSNXSHHVGSSMATNLDNLTIVPGVSSGEGCSIHGGCASCPYMKMNTLXSLLKYCHQLPDKNN

SEQ ID NO: 48866 - protein, 67 aa, Sorghum bicolor
  Clone ID: LIB3476-018-P1-K1-A7.pep
SEVWPKLDMTAFETAVFLSRIRWRAEDHFVKQGKEPSRQVQPQHHTLKQHLKLPSEAELLENDTIWS

SEQ ID NO: 48867 - protein, 92 aa, Sorghum bicolor
  Clone ID: LIB3476-018-P1-K1-A8.pep
DQIGTYYYFPSLAFHKAAGGFGGIRVLSRPQIPVPFPPPAADYTVLIGDWYKANHTDLRYVLDSGKAIGFPDGLLINGRSLNGYTFTVQPGR

SEQ ID NO: 48868 - protein, 141 aa, Sorghum bicolor
  unsure (1)..(141): unsure at all Xaa locations
  Clone ID: LIB3476-018-P1-K1-B10.pep
KRVAVVVGGSVAGLACAHAVAGAGWELVVLEKAAAPAAGSGTGAGLGLDAQSMEILSRWIPGWGIDAATLPLAVDXATDSETKAARTLARDEDFXFRAAHWGDLHRRLHRXLPPAVTVLWGHQFLSFEAPDDTPGRRDGAC

SEQ ID NO: 48869 - protein, 125 aa, Sorghum bicolor
  unsure (1)..(125): unsure at all Xaa locations
  Clone ID: LIB3476-018-P1-K1-C3.pep
VMMRLFSPRKTTLLFVIRDKSKTPLENLEPILREDIHKIWDTVPKPHAHKETPLSEFFNVEVVALSSYEEKEELFKEQVSNLRDRFQHSXAPGGLAGDRRGXPTSGFSFSSQQFWKALRRTKXLI

SEQ ID NO: 48870 - protein, 155 aa, Sorghum bicolor
  unsure (1)..(155): unsure at all Xaa locations
  Clone ID: LIB3476-018-P1-K1-C7.pep
VWSEWNGKYRDTVRQFIKGTDGFAGAFAECLCGSPQLYQAGGRKPWHSVNFVCAHDGFTLADLVTYNNKYNLSNGENNRDGENHNLSWNCGEEGXFASLSVRRLRKRQMXNXFVCLMVSQGVPMVYMGDEYGHTKGGNNNTYCHDHYVNYFRWDK

SEQ ID NO: 48871 - protein, 177 aa, Sorghum bicolor
  unsure (1)..(177): unsure at all Xaa locations
  Clone ID: LIB3476-018-P1-K1-D12.pep
LNVIPIDTNLKPNSSQPHETTPPIKRLLHAWHDILEKLPVDATKRAIHTFAEVVHTILVHQDEELKLRMKIXETRRDFEKKRRQFDDWAQKXLGQRTSIPDGDNPAPRADPXAERKAVVDKLENALKDLEDSYKTQCKVVRDKSLNLLRSNLPELFRVVSEFSLQSAGYFKGLWSIA

SEQ ID NO: 48872 - protein, 117 aa, Sorghum bicolor
  unsure (1)..(117): unsure at all Xaa locations
  Clone ID: LIB3476-018-P1-K1-D5.pep
IPDNLSKVLVFCDNLAQSSSPEGRSSSPWKPLIKRYGNANRPTVRLNIPTVVSGNTAMYSTQIYQKDCNGVIPKLASRKIDAANLESMLQGKKVDAFFXLEIYGYQQNAGIRWLLRG

SEQ ID NO: 48873 - protein, 77 aa, Sorghum bicolor
  Clone ID: LIB3476-018-P1-K1-D9.pep
RKKKRFNAAFLAPLYPHGSNDICGQMMARSIAVVLHLKQRRASFPSNVVVAEHHGATLRSWPPMLLSSKLAYHHPCV

SEQ ID NO: 48874 - protein, 118 aa, Sorghum bicolor
  Clone ID: LIB3476-018-P1-K1-E8.pep
PRVRFLPSVTKLKTPEAIHRYSEPCDARASSSLNSSPTYSTETSVSKEAKKHLSNRWKKTHQCQHQETDSDSFSTLGDMLSLSDQNASKVATHKRHPGHVQRQECRVIDAKLMWHQQQ

SEQ ID NO: 48875 - protein, 60 aa, Sorghum bicolor
  Clone ID: LIB3476-018-P1-K1-F12.pep
NRFLYNLFYILYNEYIEVFMRIVFTTILTIFTRIFTNNIYENSNHNFLMNYAFLMYGSLA

SEQ ID NO: 48876 - protein, 96 aa, Sorghum bicolor
  unsure (1)..(96): unsure at all Xaa locations
  Clone ID: LIB3476-018-P1-K1-F8.pep
MEINIVDKYEKLEKVGEGTYGKVYKAQDKATGQLVALKKTRLXMDEEGIPPTALREIXLLNLLSHSIYVVRLLAVEQGRKNGKPVLYLVFEFLDTD

SEQ ID NO: 48877 - protein, 137 aa, Sorghum bicolor
  unsure (1)..(137): unsure at all Xaa locations
  Clone ID: LIB3476-018-P1-K1-F9.pep
ACVIPGYVVEGTLAKTIINEPREVTLANGLTAPLHMSVHYISFSAHADFPQTSNFLDELRPPNIILVHGEANEMSRLKQKLKTQFDGTNIVSPKXCQSVEMYFTCEKMXKTIGRLAEKVPEGGESSGGLLVKKGFTY

SEQ ID NO: 48878 - protein, 182 aa, Sorghum bicolor
  unsure (1)..(182): unsure at all Xaa locations
  Clone ID: LIB3476-018-P1-K1-G10.pep
QLQRIGVLGSGDTISKHPTFDTXLKILWANHGDAISIQYSGTPALKGDFVRYGKRTTQGILNDLRNALARYYLNNFVDGTKQDAMDLLQGHYITSVSRXMAVPSKAGLLESYAXFRLAFALVMGALMFMMMSLRQARNDVRHLLLSLMWAGLCIAITHFVRANGRTFTNRPRFHQSRHWTMQ

SEQ ID NO: 48879 - protein, 100 aa, Sorghum bicolor
  Clone ID: LIB3476-018-P1-K1-G2.pep
LLLTHSGAISYAVVVSAEIVTVGWYSGKDQGKLLLNCYFRTGCSAALLTSSGTAAPVKYRLASLTRTNQIANDRSYRSGYREEDDEGITGFTLGQGGAAW

SEQ ID NO: 48880 - protein, 103 aa, Sorghum bicolor
  unsure (1)..(103): unsure at all Xaa locations
  Clone ID: LIB3476-018-P1-K1-G4.pep
MFLSRIVLRDLDSIDSPASMASSKKVVTRDEWERKLRDVKIRKEDMXRLVMNFLVTEGFVDXADKFRIESGTQPENDLATITDRMEVESRQSGMSGATRNNDL

SEQ ID NO: 48881 - protein, 77 aa, Sorghum bicolor
  Clone ID: LIB3476-018-P1-K1-G6.pep
IPLPVGSVLVLNGNGADVAKHCVPAVPTKRISITFRKMDPAKRPFDFKDDPELLNLAPLGTAVQETGIYQMRQGQAT

SEQ ID NO: 48882 - protein, 148 aa, Sorghum bicolor
  unsure (1)..(148): unsure at all Xaa locations
  Clone ID: LIB3476-018-P1-K1-G8.pep
LALLLLFSACYTGPSSAADCDPADRAALLRVKAQLGDPAGLSSWLPSTNCCAWDPAVFCDAAGRVTGLALYSLPDVSARVPPALGDLAALLLQVXSVPGLAGPVPAXLRNLTRXLDLDINGTSISGPVPGCLLAGRRNLRTLVIANSK

SEQ ID NO: 48883 - protein, 78 aa, Sorghum bicolor
  Clone ID: LIB3476-018-P1-K1-H1.pep
NLPLCICTIKCVVDSENQQNLMKNNLPSKKLLLHIFCTKIIPLVCCNLYGLSLQFSIQRIKNTNRQNHKPKVHKLNTH

SEQ ID NO: 48884 - protein, 137 aa, Sorghum bicolor
  unsure (1)..(137): unsure at all Xaa locations
  Clone ID: LIB3476-019-P1-K1-A11.pep
EGVARPKKEFAKEAKKFANIRHPNVVGLRGYYWGPTPHEKLILSDYVAPGSLASFLYDRPGRRGPPLTWAQRLKIAVDVARGLNYLHFDRAMPHGNLKATNILLDGLDLNARVVDYCLHXLMTQAGVVEQILDLGVL

SEQ ID NO: 48885 - protein, 35 aa, Sorghum bicolor
  Clone ID: LIB3476-019-P1-K1-A5.pep
SLAFAALGSAEEICVRCRSRYQSSFRGVRFRFYFF

SEQ ID NO: 48886 - protein, 127 aa, Sorghum bicolor
  Clone ID: LIB3476-019-P1-K1-A6.pep
PPQGAQFDPGGGGRERGSRAAMVKDSEYYDVLEISTDASVAQIKKAYYLKAKLVHPDKNPGNPDAARKFQELGEAYQVLSDPVKKESYDKYGKEGLPQDNMIDPTAVFGMLFGSDYFEDYVGQLALA

SEQ ID NO: 48887 - protein, 58 aa, Sorghum bicolor
  Clone ID: LIB3476-019-P1-K1-A8.pep
ISMILRTIHSLDSILHLLQLCYCFSILCCICLEIAIYCIAASLCYILEASYLCPGLDT

SEQ ID NO: 48888 - protein, 147 aa, Sorghum bicolor
  Clone ID: LIB3476-019-P1-K1-B6.pep
HPRRRTRGERPRFQRRRRTPPSIVEQTPRCFDLLMATLPVKPLDGADGYLRWKESMLLRLHSVGVAHVLSDDPPAPAEAAGAAAAAAAAAKKWARDDAVCRGHILYALSDRIFPDYVRHGTGRAVWQAVARTLHVDKPRRSYSRQYE

SEQ ID NO: 48889 - protein, 66 aa, Sorghum bicolor
  Clone ID: LIB3476-019-P1-K1-C12.pep
ELSNLHWNWNKRIFKCCSSNEQVCCASQEFMGYAKARFARLQVKWTDKCISCSIDLGFVPVCFSRF

SEQ ID NO: 48890 - protein, 168 aa, Sorghum bicolor
  unsure (1)..(168): unsure at all Xaa locations
  Clone ID: LIB3476-019-P1-K1-D2.pep
HSLMASDSKFGTNKLKHPXFDQHKNAIPVAWIITPNFAHGEIHKWMGALYDRAHTKDPTWQLGGFIIDDPLADVRTIREVFHCPVLISLWRIRHAWHKNLVNKCSDIEKRSAMAKRLGDAISSICRGNGDVELFXGFLQDFVDCAGFLDYFEARWLPRLGXSCTFLLS

SEQ ID NO: 48891 - protein, 173 aa, Sorghum bicolor
  unsure (1)..(173): unsure at all Xaa locations
  Clone ID: LIB3476-019-P1-K1-D7.pep
VTGFSTASSFGPLHRGSWCTPPRLFLEDQFDAIPPEVGISQNSGSKKIKEEEGARRKNGAVKISPWTLARLNAEEVSKAAAEARKKSKILKPIAKHGISDNGSKPDHKLSYQRRLDRRGFPAELSLDPLATLSASGTESNYSDTATEICGXLAPLQLEARSAFQPSTAAFTKN

SEQ ID NO: 48892 - protein, 87 aa, Sorghum bicolor
  Clone ID: LIB3476-019-P1-K1-E1.pep
SVLMEIPEINEEIYWQYAVISRPKKVFRTEPKQVAKEIVNAIRSQLGLYIIASDITYRRPNFIIYLNNSHLQRQVVAASPIRTRNFQ

SEQ ID NO: 48893 - protein, 109 aa, Sorghum bicolor
  Clone ID: LIB3476-019-P1-K1-E10.pep
PEGNLYNLPDVCFTCNYGCQEPCSKPCNAHILEDYEHGRLFSLYEQIDHKVDFIEQELQHSEQPIVLVGHSIGAYIGPEVFKRFQNKIIFFVGLYPFLKMNTNSVTQSA

SEQ ID NO: 48894 - protein, 125 aa, Sorghum bicolor
  unsure (1)..(125): unsure at all Xaa locations
  Clone ID: LIB3476-019-P1-K1-E12.pep
RTRGLDFAQNWIWPIAQEHKIPCAMFLIFTAGFLAFAGSKQQNEAQPRTTTEDFMVQPPWIPFPTTMSFRRHEAEWIAAAYRPNASGVSDVDRFWQVHHPSCRLIVIRSCPEAEXPRLFPAPNKT

SEQ ID NO: 48895 - protein, 148 aa, Sorghum bicolor
  Clone ID: LIB3476-019-P1-K1-E9.pep
ADGISSQLSVGQISYDSGYGSAQARTTPTGLADPLSGSPGGTGLHSGFDPSRGNAYDGSHVANFSSSKTGTHDGSRGATGFDSLKGSGYDASKAHLIGQASATAAHGGLAGYYGSNQATSAPYAWGQSASTYGSVQVPPSYASGSNTF

SEQ ID NO: 48896 - protein, 66 aa, Sorghum bicolor
  Clone ID: LIB3476-019-P1-K1-F1.pep
HSCDIGQHGNTILPPGSISRWMSIHNGRRCYYVYGVWYVVVVMSSEPQLDNSCSHFPLAGWTFDSN

SEQ ID NO: 48897 - protein, 153 aa, Sorghum bicolor
  unsure (1)..(153): unsure at all Xaa locations
  Clone ID: LIB3476-019-P1-K1-F7.pep
LTSSSDRLPTADGISTNHMKEADSQTPVKLKLQLFPINEATRKALEKDDHNPHLELTLSSRKKISSVLEHLNRKWGNSNIASGELILFPYCANQEDLATYQRWTTRDAVAVADVFLSVNKPXVFRLKEWXFSLVELGARSSEISLTHFEDCMI

SEQ ID NO: 48898 - protein, 129 aa, Sorghum bicolor
  Clone ID: LIB3476-019-P1-K1-F8.pep
STYWLLQWSCFIVVASLLDHIMQRNSPRLFLSDLTVGPVRSAVCVRVMRRWIHDGNEPGGAVRYIAFVLADEKGESIYAQVLPSQVQKLGDLLQMGSTYIVAKFNVRASKTSYIPFEKKLMIEFTGFTT

SEQ ID NO: 48899 - protein, 154 aa, Sorghum bicolor
  Clone ID: LIB3476-019-P1-K1-G1.pep
MGSDTEAEQKRAPVALAPIAKPLAGKKLCKRTLKLVRRASEAKCLKRGVKEVVKSIRRGNKGLCVIAGNISPIDVITHVPILCEEANIPYVYVPSKEDLATAGTTKRPTCCVLVLTKPAKGELEGQVMEKLKTDYDQVMSEVAEVTSAMSKHPR

SEQ ID NO: 48900 - protein, 174 aa, Sorghum bicolor
  Clone ID: LIB3476-019-P1-K1-G4.pep
GRVGGRVGEDEIEAARMAAINKEIKRVLTEVLLKVTDDLFDEIATKVLNEDDSAESNEPAGVFGSKEPGLGGSRTKTSAKVVLPAKSTNSTDHKDSTGLSSPKGALLGLASYDSDDDDDDDNDAEADGKDKIPISNLSSNANAGAVNTEVLGDKSTLGKKNGNSNEQNSSLEVL

SEQ ID NO: 48901 - protein, 147 aa, Sorghum bicolor
  Clone ID: LIB3476-019-P1-K1-G6.pep
HTLTLHAAAARVPPPPHPVRHRRRPNPPQSAYTAPTPGPGSPLPSPVRRRRLAASCTVAAGVLSLSRGRRRDPKSRGNTKQQGATRQGVGSPGGLASPEAFVGVPQPQFVPSRTCRRGLGAPWHGATSPLHRLAAHVAWCPSAARPP

SEQ ID NO: 48902 - protein, 78 aa, Sorghum bicolor
  Clone ID: LIB3476-019-P1-K1-H1.pep
YARTLYVSCYLGTVVRPEGWLPWRGDFALRTLYYGEFDSRGPGANNTARVEWSSQTPEQHVKHFSKENFIQGHQWIAY

SEQ ID NO: 48903 - protein, 57 aa, Sorghum bicolor
  unsure (1)..(57): unsure at all Xaa locations
  Clone ID: LIB3476-020-P1-K1-A1.pep
MASFKVADASEYLAITGWGIXDVKLAKKAWVFVGQQCKKFDITPVNYEFEVHAMSSE

SEQ ID NO: 48904 - protein, 91 aa, Sorghum bicolor
  unsure (1)..(91): unsure at all Xaa locations
  Clone ID: LIB3476-020-P1-K1-A11.pep
SFQSHPRHIHSIIFTLQVAHPRHPYPLRHILSSSRIIDRPFWSTLFAHHPITXVLSCIFLEHYDAVTIQTLWSPCRCMLIRQYRWQHCHHK

SEQ ID NO: 48905 - protein, 147 aa, Sorghum bicolor
  Clone ID: LIB3476-020-P1-K1-A12.pep
PCREAYNYKYVAQSYWPLSQGTAHVIGYLPAALAPEDAGEAEGADNGGAHRGPHRGQAERAGAGARDGALHCGPPCPHSDSCIGRWTSTGTSGHRPCSGLLSVQLLRQMPRSSAEQVRKEIKKQIQEQRRVRRPLRGPWRELSARVP

SEQ ID NO: 48906 - protein, 173 aa, Sorghum bicolor
  unsure (1)..(173): unsure at all Xaa locations
  Clone ID: LIB3476-020-P1-K1-B6.pep
PRVRPRVRERMRVLYDRKREELKMLDEKGAEAHKLEATELYIRKLSTKISIAIQVVNTISEKISKLRDEELWPQTCELIQGLMKMWSVMLECHQIQLHAISQAKNIDSMIDTAKFGEKHMDLIKQLELQLLDWIAWFVAWVSCXKEYVKTLNQWLXKWVIYVPEETEDGDASF

SEQ ID NO: 48907 - protein, 77 aa, Sorghum bicolor
  unsure (1)..(77): unsure at all Xaa locations
  Clone ID: LIB3476-020-P1-K1-C4.pep
MSAAEAALALEEREMPPCPPGLRQYETMVVLRPDMSEEERLALMQRYEELLVAGGAMYGEXFNPGVIPLAYSIRKRN

SEQ ID NO: 48908 - protein, 173 aa, Sorghum bicolor
  unsure (1)..(173): unsure at all Xaa locations
  Clone ID: LIB3476-020-P1-K1-C5.pep
GILVQDLMSGVSRELDNWHKSSKEEEATKKDPETELDEILSHGTQDPKAIFLDKLDVLLAEHKMEEAVLALEAEEKKYLVADESGKESNAENTAFKAALIKRKAILEDQLVRYCGQPSLSMTELRKCLSGLIKIGKSSLAHXVLLKAYGSQLQKNGEAFLXNCSIYTQTYSAT

SEQ ID NO: 48909 - protein, 190 aa, Sorghum bicolor
  Clone ID: LIB3476-020-P1-K1-C6.pep
CTLISTRAGSLGINLHAANRVVLLDGSWNPTHDLQAIYRVWRYGQTKPVYAYRLMAHRTMEEKIYKRQVTKEGLAARVVDRQQVSRTISKEEMLHLFEFGEEELMEQNENGSTIIEKPSTSDTIKTSEPVPVDSLMLSLLMEQTRWISGYHEHEALLQENEEERLTKEEKDMALSEVESLRKAALDSERK

SEQ ID NO: 48910 - protein, 86 aa, Sorghum bicolor
  Clone ID: LIB3476-020-P1-K1-C7.pep
SVPPAQIQFSLLLSTPQIPVAIGRGCGFEGAVEGEHRLLLLGSAPARSTHQGRPSYLPPSPPPCLLPTLLADLVCVRLRSRPGAPL

SEQ ID NO: 48911 - protein, 173 aa, Sorghum bicolor
  Clone ID: LIB3476-020-P1-K1-C8.pep
WPCVPTFGADQFNDTDGEEKEQKEIYYNWYYVSVNGGFLFASTVLVWVQDNYGWGLGFGIPTVFSAVGVAGFLACMKLYRYQKPGGSALTRICQVVVAATRKVNVDLPTDSSLLYEMPGKESVIVGSRKLMHTDGLRFLDRCFTITTAEEKFLDTPNPWKACTVTQVEELKIW

SEQ ID NO: 48912 - protein, 132 aa, Sorghum bicolor
  Clone ID: LIB3476-020-P1-K1-D10.pep
MVVLQPDRFLSDLTSMYERSTEKGSVWVTMKRSTLKSKAQLQKMEKKGQEVEHRCLVRASDGKKSISTSVSLKEYAKFQASYATVLKAHMHALKKRERKDKKKAADAEKAVETAPNKQQKKASSKKSSGSKS

SEQ ID NO: 48913 - protein, 138 aa, Sorghum bicolor
  Clone ID: LIB3476-020-P1-K1-D11.pep
VAKILEVKAAMHAQYDLWEKEQEKLRLSKQGGDNNGGDFSGNKRESKTVYTYETINKPTGRYRGWMDLIPYEPDLEFGTEFELKHINWQVEKSTLELARCVVGLECFTGDTEIFSCSGTIGEYEDDTAYVVTSASLIT

SEQ ID NO: 48914 - protein, 176 aa, Sorghum bicolor
  unsure (1)..(176): unsure at all Xaa locations
  Clone ID: LIB3476-020-P1-K1-E1.pep
SLSSAENSEKFGNTKYGTVLFTDINLISGMEQTSFLFQQASAVGFSHSRILRTVVQHACSRFPSLVPCNNAWTALSRKLQPSKQIGAIHKGTSRQXVFVIFGGDTSERQVSLMSGTNVWLNLQGFDDLDVTPCLLAPANGYFSSHDQVFSDTSREVWTLPYSLVLRHTTVEVHAAC

SEQ ID NO: 48915 - protein, 78 aa, Sorghum bicolor
  Clone ID: LIB3476-020-P1-K1-E2.pep
LASPTIALVQGRPDRLGAGRALRRASGRRTIGPAAMEPPPARERARAAWIGARRRTGGAWMASSWCALTSPTRPRTRG

SEQ ID NO: 48916 - protein, 100 aa, Sorghum bicolor
  Clone ID: LIB3476-020-P1-K1-E6.pep
AFTVNGHVRTLTLKCYNWQLILDFVLPSVIFKLDIVVLGFALLVCYSVHSKFYKVLSIMAQYKQIILFHSAKITPCFILSSCHLIACPLSYIFYCYKYSW

SEQ ID NO: 48917 - protein, 52 aa, Sorghum bicolor
  Clone ID: LIB3476-020-P1-K1-F1.pep
NVKEVSGAKHVMFKAYVANALRLTRDDVEHGEGYNGPADANYTEGPAGTTGD

SEQ ID NO: 48918 - protein, 106 aa, Sorghum bicolor
  Clone ID: LIB3476-020-P1-K1-F4.pep
MRDFPSCFGESGVQIADASSSSSSAGKGAAQNLVTCLYQTQFSGRPCVISLTWSKSLMGQGLSIGVDDLSGHCLCKADIKPWLFSKKKGSKSPYVEDGKIDIFWDL

SEQ ID NO: 48919 - protein, 129 aa, Sorghum bicolor
  unsure (1)..(129): unsure at all Xaa locations
  Clone ID: LIB3476-020-P1-K1-F6.pep
LSLPAPNSELQPSNSLACLPAISPWRLQQPPGGRAAQSSRPRTTAPLRARACRSPAPAPARGHXPGSPSASRRRRRRGAGGPACARRPTTRARSAAAGTRSASSRRRRAPTASTGTDTASRASRLSLAG

SEQ ID NO: 48920 - protein, 133 aa, Sorghum bicolor
  Clone ID: LIB3476-020-P1-K1-G12.pep
RGLAKKARELAVLCDADVALLIFSDKGTLHHFAAYASMDRILDRYERYLLCEDRDVTEDYPEESEGNMSYDHVKMRSKLEALQKSQRNLMGEQLESLTFRELQQLEHQIDSALRNIRSRKDHILLNSIEELQN

SEQ ID NO: 48921 - protein, 159 aa, Sorghum bicolor
  Clone ID: LIB3476-020-P1-K1-G3.pep
TLQLQSLSLSTWHHGTKNVLRQRLSPHSVHLNLQDRRRAQGQRNKMPAYQYPNLTIIEEGQLQRDERDVFQAAVIFEVPPSAMHIIGHEEINNAIHQQLRVDINVQDISKFGSNYFIKTNCQQTTAPMLQHTFLKVGSHTLTLEPWNPYYNAIIFSCET

SEQ ID NO: 48922 - protein, 133 aa, Sorghum bicolor
  unsure (1)..(133): unsure at all Xaa locations
  Clone ID: LIB3476-020-P1-K1-G4.pep
TSLMDVSKKYGTDYRILHAITTVYSWYGQWGFKLNTGSFGITSKEYLKAVDNLSSTPLSHLFPHFRYPRNQLQDTIXFYQSLSKHPLTTIRELFLYVLWLATSKGINMHYGSMHKEHSHTHMQETWPDEEIKR

SEQ ID NO: 48923 - protein, 132 aa, Sorghum bicolor
  Clone ID: LIB3476-020-P1-K1-G7.pep
TDRANLICLSQWISIPYPLHWGAPTFRADHAFGMMAAAMDHIIETTGAFKAAARSASATPPPAYVLSRGIGWQGIGTLLDGLFGTGTGSTVSVENVGLRGSTRVGSRRVIQISAGFMILFSILGKFGALFAS

SEQ ID NO: 48924 - protein, 52 aa, Sorghum bicolor
  Clone ID: LIB3476-020-P1-K1-G8.pep
LIHIKHKGNHLTTMFKFCESLTTWILSSHGLNKSDNISIKEFGIDPNGKLYI

SEQ ID NO: 48925 - protein, 71 aa, Sorghum bicolor
  Clone ID: LIB3476-020-P1-K1-G9.pep
VQGPAHAHTPARRPPVARGRAPRSVSFVRSQSRRHPVGSPLMPYQIMSAPMPTPIDEQHRDDGTHGAALAS

SEQ ID NO: 48926 - protein, 139 aa, Sorghum bicolor
  unsure (1)..(139): unsure at all Xaa locations
  Clone ID: LIB3476-020-P1-K1-H1.pep
AIGAAISPTSVYNGRQFDISLLIWKDPHRGNWWLQLGSGPLVGYWPSLLFTHLGGHANMVQFGGEVVNSRPSGSHTPTQMGSGHFPREGFNRAAYFRNVQGVDGDNSXXPAAALRLVADHPGCYDIQGAYNRAWGNYFY

SEQ ID NO: 48927 - protein, 107 aa, Sorghum bicolor
  Clone ID: LIB3476-020-P1-K1-H7.pep
PKQPDSVHLRCDLGSSCRLRFSVCLINILLRHLTYTRQGRLEGAMLALLISLSLSDARVLVVFTSRLSGVTWEVFVDLDFLFASIISFFDISLTHDRGDLKELRLRF

SEQ ID NO: 48928 - protein, 46 aa, Sorghum bicolor
  Clone ID: LIB3476-021-P1-K1-A7.pep
RTRGRRQRINAHLATLRTLLPAASRMDKAALLGEVVRHVRELSGEA

SEQ ID NO: 48929 - protein, 163 aa, Sorghum bicolor
  Clone ID: LIB3476-021-P1-K1-A8.pep
RDHFVNIARRRALEANKLAAAQSESNEKQTNGLAHVGSEMMDDKLTAMQRESNKMQNNDPALFSTETLHSGKCDVNSDSKGGFFADQFENMANYRAHYEWTGPEIWKQTKGNLHAFVAAAGTGGTIAGVSRYLKEKNRSIKCFLMDPSGSGLFNKVTRGVMYT

SEQ ID NO: 48930 - protein, 144 aa, Sorghum bicolor
  Clone ID: LIB3476-021-P1-K1-C10.pep
MSERKHTELPDDNAPSKQEREPKQGGTRKPSQLVDTSTKATSEQVAAKLEESEMEKELCAEAEDPSEFITHRAKDFVSSMKDIEARFMRAAEAGNEVSRMLETKKIRLDICAKMPGSSGKLPTARFVSALRVCCNRDVILNQET

SEQ ID NO: 48931 - protein, 152 aa, Sorghum bicolor
  unsure (1)..(152): unsure at all Xaa locations
  Clone ID: LIB3476-021-P1-K1-C4.pep
VDPKPASTQDTTADSSDRDDDGGGGGGGNARSWPATERVSSYLWSQNSVHALCEKFGVNTKAFTPIPAGDRRACSPPPGGSICLYADALEAGMRVPFDPFFCEVLSHFGVAPSQLSPNCWRILAAXLALFRRRRRARRPRVPCSCTSSRLAC

SEQ ID NO: 48932 - protein, 137 aa, Sorghum bicolor
  unsure (1)..(137): unsure at all Xaa locations
  Clone ID: LIB3476-021-P1-K1-D5.pep
VSTPGVGAMDLWIALHPDPDSKPQIYDAILNGMEVFKLQLINGSLAGLNPIPSVAPANDGTTKKKSTVGPIVGGVVGGLVVLALGYCCLSMICKRXRNAGKDACLSDGHSGWLPLCSYGKSHTFSLAKLHTTGSYAS

SEQ ID NO: 48933 - protein, 72 aa, Sorghum bicolor
  Clone ID: LIB3476-021-P1-K1-D9.pep
PATKIFWRTHKIHMLNAHVIFFQMRQALATYLENNRAVITAFGFTLDRSHLHTIFMLEWTLFLWLLGKTIVL

SEQ ID NO: 48934 - protein, 82 aa, Sorghum bicolor
  Clone ID: LIB3476-021-P1-K1-E12.pep
SQERGRGRRERLRGRRRWSGSGSGGARRRGGCRGRRRRRAAGARPGASEAGPEAGERRERGGCDERDPGPGWSCAGGEARRG

SEQ ID NO: 48935 - protein, 157 aa, Sorghum bicolor
  unsure (1)..(157): unsure at all Xaa locations
  Clone ID: LIB3476-021-P1-K1-G3.pep
QLPDDVIVHCSEKNASMLTLDGVDVMGERLANEVLDVISRRPELTKISFLAHSVGGLAARYAIAKLCRHPDSASDGNTKGTICGLEAINFITVATPHLGSRGNKQVPLLFGSVAMEKVACRVVHWIFRRTGRHLFLTDDDEGQPXLVQRMVEDHDDL

SEQ ID NO: 48936 - protein, 100 aa, Sorghum bicolor
  Clone ID: LIB3476-021-P1-K1-G8.pep
RCTVQKQRPPHTPSQIKSHDDAVFKSNALPYHHTHTIPNPWRIEHHTIKIEFPNTKIPSSQTSFLVPQSKSPISQTSFLVPQSKSPSHYFMPKSRSHHHR

SEQ ID NO: 48937 - protein, 52 aa, Sorghum bicolor
  Clone ID: LIB3476-021-P1-K1-H1.pep
HPIPYLTSARPDLTARRFDPASVTPGQIRRSFAAAAGAGLAWRQFGLREGGR

SEQ ID NO: 48938 - protein, 80 aa, Sorghum bicolor
  Clone ID: LIB3476-021-P1-K1-H7.pep
HAFAHASAHASAHAFAHASAHASGGLVFGCVFTASLGYTAAVNLIELSMQYTPRVVYYYQELIVTAAASVLLYITASYYR

SEQ ID NO: 48939 - protein, 60 aa, Sorghum bicolor
  Clone ID: LIB3476-022-P1-K1-A9.pep
IYHIMKSLDIVYKAMNFWPFTCEVLGMICYSLRPVYGNNIIVTMPQLSKLLRQVMIIMSL

SEQ ID NO: 48940 - protein, 97 aa, Sorghum bicolor
  Clone ID: LIB3476-022-P1-K1-B11.pep
LMGLAPLPLSLPLQDMTQDFGLSRAKSLAVMRKLEWKLKMKPKRKEMIMRRAMMMMMMTTTMRWTSSDSFVCFFLQVMLKGKRKAYHVFRSIITSSL

SEQ ID NO: 48941 - protein, 165 aa, Sorghum bicolor
  Clone ID: LIB3476-022-P1-K1-B4.pep
AMSSRSSACQNTSRAPCKLAAQASHKYLKVVKGSDAKPHGIYVNKGSSASLVASRNSTATGKSPAKILVVPSSSQASAKTSRTAQVTSKRTAVPTSVNNVSQNKRKHTLVALDEKSPKREYVRRSAPSSARSSSENLPRAAKAPKISNVTNPGPRLKCAEFKSSS

SEQ ID NO: 48942 - protein, 99 aa, Sorghum bicolor
  unsure (1)..(99): unsure at all Xaa locations
  Clone ID: LIB3476-022-P1-K1-C11.pep
MQEVSVEPGRRPAQQPHHQFAGVDLRRPKGYATAPVQEATPAVKVAEGGEGGDPCPRCASRDTKFCYYNNYNTXQPRHFCKGCRRYWTKGGTLRNVPVG

SEQ ID NO: 48943 - protein, 151 aa, Sorghum bicolor
  Clone ID: LIB3476-022-P1-K1-C12.pep
ASEPYIRTDPEVCEECIGERESCALVEKLNYQNEDIHVYFVRGKEAPKSIKEACSKAAVVADRRTSKRSRRASSGNSISLKVSGSTSIYQLKLMIWESLGIVKENQKLHKGSDEIEDDLATLADKGVFPGDILWVRDSEIYENRDIADEIS

SEQ ID NO: 48944 - protein, 147 aa, Sorghum bicolor
  Clone ID: LIB3476-022-P1-K1-D1.pep
ENTEVVLAECTKNFGPWLVTHAMELLTADNDYADVMLHEERPNLGGISIEELHRLVYAQVLCSHSLTWQIAPTYLSSCLNQGLGLLEILLLKQPIQDNCLVLKTLEICRLYELENVSTIIMKIAGIYHWKHGRKGTGVYWFQQAHDK

SEQ ID NO: 48945 - protein, 31 aa, Sorghum bicolor
  Clone ID: LIB3476-022-P1-K1-D3.pep
RLRTRSLTDRPPAFFSRIQIVLVLDAFNFIC

SEQ ID NO: 48946 - protein, 123 aa, Sorghum bicolor
  Clone ID: LIB3476-022-P1-K1-E10.pep
SSSSPTPPPPKLRTESTKSSALSSSLLRALCRRGIACCCAVPLRRAAPNHKEKKGSSVRHCCCCSPSLTHSLTQVPTPCCGCVRGSRLPWLIRAGRLRNLAGRRQGKNASGMAMVLLALFQFQ

SEQ ID NO: 48947 - protein, 70 aa, Sorghum bicolor
  unsure (1)..(70): unsure at all Xaa locations
  Clone ID: LIB3476-022-P1-K1-E8.pep
IISHCSLRFDDFFHMQLGTAKMQLLAAHCWYKIFGAILFAHCARAILREXNVECGTACTVQEPAYDACIY

SEQ ID NO: 48948 - protein, 144 aa, Sorghum bicolor
  unsure (1)..(144): unsure at all Xaa locations
  Clone ID: LIB3476-022-P1-K1-F2.pep
ALHDPKHLFTQQFVANGRGLVAADGILVNTFDAFEPDAITALRQGSVVSDFPPVFAVGLLQPVRFEVAEKPAHYMRWLSAQPARSVVYVSFGSRKAISTDQLRELAAGLEASGQRFXLWVGRAPSWTETTPTSPTCLGTVPGAV

SEQ ID NO: 48949 - protein, 144 aa, Sorghum bicolor
  unsure (1)..(144): unsure at all Xaa locations
  Clone ID: LIB3476-022-P1-K1-F5.pep
GFAMEILLTLQVMVENMEPEKVILYPQLFWGCVALMHTDFVHIYCQVLELFCRVIDRLTFRDRTTENVLLSSMPRDEFDINGYASDLHRLESRTTSERLLSVTDTXKVPAFEGVQPLVLKGLMSTXSHGSAXEVLSRITIPTCD

SEQ ID NO: 48950 - protein, 93 aa, Sorghum bicolor
  unsure (1)..(93): unsure at all Xaa locations
  Clone ID: LIB3476-022-P1-K1-G6.pep
ETPFFIPHPLAARRRGERLPFPTTYSASRPGAAGSRSEPRNILAPIVGAMGANGHPPPASTAAQNGSHSGGGXGRRRVKGRESLTPSNGRARA

SEQ ID NO: 48951 - protein, 130 aa, Sorghum bicolor
  Clone ID: LIB3476-022-P1-K1-H11.pep
STQLQLYDLTCQNVAHLCQESGVNTCSISTGLDNHGTLNIQQQSANQTSSMVEHMPENGLQSDPVTNGCRQLLMSSNRTSPPVRVTKQQIATSPPVQVIEQQNASNSSLLTPHERQQYGPQTCQTVAHQD

SEQ ID NO: 48952 - protein, 36 aa, Sorghum bicolor
  Clone ID: LIB3476-022-P1-K1-H6.pep
EVLDAVGPVPVTAGLRRLGLVRVSCAWMIVPISEGP

SEQ ID NO: 48953 - protein, 77 aa, Sorghum bicolor
  Clone ID: LIB3476-023-P1-K1-A11.pep
IGNCKDRRQITQTGNTEPPAWQPGCGVRAACRLLLTHAATGSQDAGLRQPLLPLPLHRVTAPARAVQLRRAPCGPKT

SEQ ID NO: 48954 - protein, 168 aa, Sorghum bicolor
  unsure (1)..(168): unsure at all Xaa locations
  Clone ID: LIB3476-023-P1-K1-B2.pep
GSNMKSNIEAVWMGNSPPLLRLAIVDLALPKTPNDNSLSLFPDPLVPERFYCAHGGGLDMVTLHFLPFSYPEMSSTPPSVHPVLTTGNSETSSPFLSGFVIIADAYGHVQLVGITCLGECFVVEMKGWKEPTPLQLDIESKSTKDVEPSATGMISKELIXGPDPPILP

SEQ ID NO: 48955 - protein, 65 aa, Sorghum bicolor
  Clone ID: LIB3476-023-P1-K1-C4.pep
MPEISLIDQLSQNNLNPWCPTTIERAVLVVFLEPQAPRATMKLNPFHRDLCTVYSPTCLIMPEPQ

SEQ ID NO: 48956 - protein, 97 aa, Sorghum bicolor
  Clone ID: LIB3476-023-P1-K1-C8.pep
HLTFDISKYYIALTAQSMNQICTELAPCQPPQSKSIILFAWILTCRQPGGDTSIHGDSLGACLFLPKLLVKDYSLEKQTLVILPACEACSAGTRQDT

SEQ ID NO: 48957 - protein, 128 aa, Sorghum bicolor
  Clone ID: LIB3476-023-P1-K1-D10.pep
ARQSSSTHDDKDNSDSSAEGFRNKRQKYAAQSASDILGSEDATQGSKHTEIKAMVRDILFKDIIDKEHDAEMAYVDEVINGICNATDSVIGSGDASTKGGRGLKPSGSGVEGESSNAPGNNTDDTGAT

SEQ ID NO: 48958 - protein, 148 aa, Sorghum bicolor
  unsure (1)..(148): unsure at all Xaa locations
  Clone ID: LIB3476-023-P1-K1-D3.pep
VSDKSSGARRLQDAMVSGYVLQRAPGRDAGIPDWYSLSKTETETGAGPTSKNVATKESAASSRCIEDFEILHXDLQGLTDTIEFLKSLSELSGNDLKSSKKQRLERTAASVLXDWETEIYVARXAPGRLAVMGGXADYSGSLVLQMPL

SEQ ID NO: 48959 - protein, 51 aa, Sorghum bicolor
  Clone ID: LIB3476-023-P1-K1-D8.pep
HLNPIHCPSFYIVRDRQNPIYPQLNHLAALAKSLSWPNLKQSRTNPLSQHV

SEQ ID NO: 48960 - protein, 145 aa, Sorghum bicolor
  Clone ID: LIB3476-023-P1-K1-E10.pep
NKMKLKKIKKIYYIFSNSLIQFDQIRIIKETKKKESKKKNTTWMHGEVLYWRVKSIILRRRRGSAGERGQGGLVVRLPRRRRRRVRHAVHRWERQLAAARMVPAGAGAGAPALRRRRRAMRGRRRSRGGGGGVRRCRRGGPGPRG

SEQ ID NO: 48961 - protein, 106 aa, Sorghum bicolor
  unsure (1)..(106): unsure at all Xaa locations
  Clone ID: LIB3476-023-P1-K1-E4.pep
PPAYRYCQARRRVWRRLTGSCVLLTPPAAPTAPSLRPYAGSSHLTSKAKIYTDINILRPKESWDYQALTMHCREQAGYHVVLTVSTAXYTELSDGIHVNDNETCMT

SEQ ID NO: 48962 - protein, 99 aa, Sorghum bicolor
  Clone ID: LIB3476-023-P1-K1-E5.pep
ICPETAQTEPTEARDRRRGDRGTGSEGASTRAPRRWTTTPGARARRVGPPLRRRGTPGGGDAPARAPSPLVAVRAGHWAAERACGVCGWWRRERERERD

SEQ ID NO: 48963 - protein, 117 aa, Sorghum bicolor
  unsure (1)..(117): unsure at all Xaa locations
  Clone ID: LIB3476-023-P1-K1-F3.pep
DPRVRKKPAKDKKAEKGEAAAKPSKDEASKEAEVVTESKETKKGSSEPAKQDAAEEAGAEEXSGGCGGGGKKGKKNKKNKPKDGGEGEEAQAPAAPATAPAPDKKPPQQPVVGASAV

SEQ ID NO: 48964 - protein, 174 aa, Sorghum bicolor
  Clone ID: LIB3476-023-P1-K1-F5.pep
TDAHLYDDPDDASIPELLDSRFDADKVDALKRLLALIAQGVDVAHLFPQVVKNVASQSLEVKKLVYLYLLHYADKRQNEALLSINIFQKDLSDINPLVRAWALRTMAGIRLHVVAPLVLVAIKKCARDPSAYVRKCAAYALCKLCDLLPDESTALEEIVDILFNDNSPGVVGAA

SEQ ID NO: 48965 - protein, 173 aa, Sorghum bicolor
  unsure (1)..(173): unsure at all Xaa locations
  Clone ID: LIB3476-023-P1-K1-F6.pep
TPIGSEGSCAFIESMFIGPIEKTSSPDEISKCSSSMIEIEHNVNEKGTPVQFETQMDQVEPVRSSVRSKSRNIVVRANESEHCFSKQEGRMPSNTEVPEPLLPMKDKILELDYHSPPEINSQLCIPDTTQKWLGLSKSLSSAVIRQRRHHWDVVMLKDPMKRLWPIXYHDNPI

SEQ ID NO: 48966 - protein, 73 aa, Sorghum bicolor
  Clone ID: LIB3476-023-P1-K1-G4.pep
MTSLSSAVALASSCRACPAEGSRRARMVVTRAAASSPKLPNGLRLQMSVVGGVSAFGAAAEALAKGVVETLLI

SEQ ID NO: 48967 - protein, 124 aa, Sorghum bicolor
  unsure (1)..(124): unsure at all Xaa locations
  Clone ID: LIB3476-023-P1-K1-G5.pep
KGQVTPILLSIVSKDSSMLDGLEDASTEMDEANARLHETIISSAKTKNAEGPVEFSWMDDGAGLTANAYEFLSKMDKLTKEATSQVKLLAEGEDERLALTSTCSKYDQAXALGKTTIDVTRIAV

SEQ ID NO: 48968 - protein, 77 aa, Sorghum bicolor
  Clone ID: LIB3476-023-P1-K1-H11.pep
DSLHCTVIQQRNSQPHRPRLRKLWRKRTLLHLMIRTMLKSEGVFSPKPRSNECASIHFVVKVHVPLTIYIALSLGLM

SEQ ID NO: 48969 - protein, 126 aa, Sorghum bicolor
  Clone ID: LIB3476-024-P1-K1-A11.pep
MNPTLPSISFQSPCFKIQPDPQRSHWPPRQQSTRKPGLSLKLIRATLGPDANGGLHNADRRGATLPSSPLSDVVQEFYSSLNEKNSKRLDKLMAPDCIVEDTAYYKPLDAKCTRIYFKRLMESMGK

SEQ ID NO: 48970 - protein, 153 aa, Sorghum bicolor
  Clone ID: LIB3476-024-P1-K1-B10.pep
DAWAAVKPSAPPEHNDNVNEEEDEFAQLAQRKNKSVVSSDDASSSTGADLALVPIDQAVSESSSSGASNALVLLDPAPSTSTEPKELDMIDLLSLTLCSPTPETSTDSSAQDQNGPQQPAVTHNQNGPHEPTVTNGQRYPSSVPQYPSNYQPY

SEQ ID NO: 48971 - protein, 53 aa, Sorghum bicolor
  Clone ID: LIB3476-024-P1-K1-B12.pep
ISWSACSPIYFLFIQKANRLHACLVYSSCQVELCLWFGFVVMPVLPSTVNVVR

SEQ ID NO: 48972 - protein, 160 aa, Sorghum bicolor
  unsure (1)..(160): unsure at all Xaa locations
  Clone ID: LIB3476-024-P1-K1-C10.pep
DVILPELLKIETLIFKGRQVERETLTAAEQIPGSEIQQHIWNNYKKEMKYQWFISNGSGEDQSFEPLATKCSRSYKVRFEDIGRCLKCECFVIDIFGRSSELVSAVTAPILPGRPKIEKLEIEGRXFHTNLYAVQGTYSGGKEGQSKIPMAKAMVGSPVL

SEQ ID NO: 48973 - protein, 145 aa, Sorghum bicolor
  unsure (1)..(145): unsure at all Xaa locations
  Clone ID: LIB3476-024-P1-K1-E1.pep
WKGQRXNGARTRKVTIRACACVCMGRRIGGTRRRRWGPAGRLAEGAREAGEDAGESEAEAEDGAVGVGRAVAADGLHGLDEEAEAAHRRHVQRQRRRREGQRHEQLQHLLLMVFLDEQRLLAGAGSSSLDLGSLRPPVTRANPIR

SEQ ID NO: 48974 - protein, 110 aa, Sorghum bicolor
  Clone ID: LIB3476-024-P1-K1-E12.pep
MASSAGGYGVKQQAEAAATAARKRVMVVVDETSGSKHAMMWALTHVANKGDFLTLLHVLPHSGSGRGEEASSLANSLGTLCKASKPEGGGEALVIQGPKLGTVLSQVKKL

SEQ ID NO: 48975 - protein, 122 aa, Sorghum bicolor
  Clone ID: LIB3476-024-P1-K1-E6.pep
MKGKHTQDLYIRRDSHTVPVDTFSFLNSFLDKAAVVLWNEHDGSRNPWRLCTVTQVEELKILLRMFPIWATGIVFFTVCAQNSSMFIEQGMALDNQIGLSRSSSNSVIPSVISNGVRVPIMR

SEQ ID NO: 48976 - protein, 66 aa, Sorghum bicolor
  Clone ID: LIB3476-024-P1-K1-E8.pep
CQCECEAPNIWEDLKEASNTTTTSRCGDSIVGDDTGYLRFEDSKAVEMAPMTSVLADQCSLIINDH

SEQ ID NO: 48977 - protein, 79 aa, Sorghum bicolor
  Clone ID: LIB3476-024-P1-K1-F4.pep
ERGVQGYKKFVEDMEELTRTKVLEVKGLSTKQHLGPAMLHLLKKFTGLTKFKIDLLPVNTWMSHSNRFSHYLILVLIAK

SEQ ID NO: 48978 - protein, 131 aa, Sorghum bicolor
  unsure (1)..(131): unsure at all Xaa locations
  Clone ID: LIB3476-024-P1-K1-F7.pep
IEVQVIPRIVAQNLSSSKSPFVQCTLNLYSEVFIESTIFPAPVQEKLQFPSVHGGLRGKGRKWKLWRTSSGDQGSIWRGSRGGSQRSAASEASDDASSVAAPADPFTXPXAVATVTRAPARDFYAVRQEWA

SEQ ID NO: 48979 - protein, 105 aa, Sorghum bicolor
  Clone ID: LIB3476-024-P1-K1-G1.pep
MSQRNGLHNRVWTADRLAKTNLPHPEKCPLCDQEDETINHLIVGCVFARQVWSLVFQHLGLSQLAPQPSVTRFSGWWKRSSAAVPKEVRKGLNSLIILVTWEIWK

SEQ ID NO: 48980 - protein, 96 aa, Sorghum bicolor
  Clone ID: LIB3476-024-P1-K1-G11.pep
VSEGFAGKVVSDEVKQLAQGVQNKLRDLIGSEKFVEVYKSVRMGLKQKRDGRKQAQKIVAAVDPERHAKRKQRIASKHREHKRRKIMAMKIGRWMR

SEQ ID NO: 48981 - protein, 78 aa, Sorghum bicolor
  Clone ID: LIB3476-024-P1-K1-G12.pep
QPDGGDTHSVARSATKDMTMAARLHRLAACNLRRLSATHGCRPCGCPLATAGTPELLRMIRDFKWSNIKYVSESETCS

SEQ ID NO: 48982 - protein, 177 aa, Sorghum bicolor
  unsure (1)..(177): unsure at all Xaa locations
  Clone ID: LIB3476-024-P1-K1-H1.pep
NGSSTAFESGSQPSPSSLVDVKQDSSLNIGNDFSLFHSEMKCTGHGKCVCEEANSSEESQRHLSDTEEHIPSLKSVVGGMPQQPLVESREADSSSEPADTGDEGFQSSLSGSTEGSLSSTPADSDAGNEEASSLSEDTEPDDVYHPADISPEDKHFMMXLGWKEDEIVQVAPLDFDE

SEQ ID NO: 48983 - protein, 116 aa, Sorghum bicolor
  unsure (1)..(116): unsure at all Xaa locations
  Clone ID: LIB3476-025-P1-K1-B1.pep
KAHIRDGAAVVQYLSWLDNQMQENYGASGYFSEIKGSQKKENLATKLTEVSVSDKLEXFRATQENFKGLSFPTISSVGPNAAIIHYKPEASTCSEMDADKIYLCDSGAQYLDGTTD

SEQ ID NO: 48984 - protein, 103 aa, Sorghum bicolor
  Clone ID: LIB3476-025-P1-K1-B6.pep
TSSRSQIEVIILHPNFAKILTCPCSQDVITSRSSYLRRLLSESGDVAIALPAGLTFDAFAQAIATCYGSGEATAALSPASLAAAWAAAGWLELEPGAGPRGDP

SEQ ID NO: 48985 - protein, 57 aa, Sorghum bicolor
  Clone ID: LIB3476-025-P1-K1-B9.pep
RTRAVLFRDPNLYSSCGELKILLLGHLKQIQWGEIYKVPTWKTLGKHKFIGREQISL

SEQ ID NO: 48986 - protein, 136 aa, Sorghum bicolor
  Clone ID: LIB3476-025-P1-K1-D1.pep
PRVRYIATGSFSALLHGIKGVCEKTPLDWNTMMKIILGTARGIEHIHSEGGSKFAHGNIKSTNVLLDQERNPYVSDYGLSSLMSLAINTSRVGTGYRAQETYESRKFTHMSDVYSSGVLLMEMLTGKARLQSQGQD

SEQ ID NO: 48987 - protein, 101 aa, Sorghum bicolor
  Clone ID: LIB3476-025-P1-K1-D10.pep
ERFAKCQIVLLHASYPFSKEASYLASVYSQVYLDFGLAIPKLSVHGMTSSLKELLELAPIKKVMFSTDGYAFPETYYLGAKRARDVVYRVLSAACEDGDLS

SEQ ID NO: 48988 - protein, 59 aa, Sorghum bicolor
  Clone ID: LIB3476-025-P1-K1-D3.pep
RGQQSKKKGGVPFKGSKFTHPCLQGQSFFIGPPKLNSLPGFLKLLDWKNPAVPKLNCFL

SEQ ID NO: 48989 - protein, 139 aa, Sorghum bicolor
  Clone ID: LIB3476-025-P1-K1-D5.pep
GTFGSVWRAINKQNGEVVAVKKMKKKYYSFEECMSLREVKSLRRMNHPNIVKLKEVVRENDILYFIMEYMECNLYQLMKDRVKPFSESEVRNWCFQIFQALAYMHQRGYFHRDLKPENLLVSKDVIKLADFGLAREVSS

SEQ ID NO: 48990 - protein, 110 aa, Sorghum bicolor
  Clone ID: LIB3476-025-P1-K1-D9.pep
QDVRIVCHFNLPKSMESFYQESGRAGRDQRPSRSVLYYGLDDRRRMEFILRNPKINKAQPSSSSNELSEKALADFSQIVDYCESSSCRRKKIIEKLGEKVQPTLCQRSCD

SEQ ID NO: 48991 - protein, 119 aa, Sorghum bicolor
  unsure (1)..(119): unsure at all Xaa locations
  Clone ID: LIB3476-025-P1-K1-E3.pep
MSAEFCAAAGGGGAAVAMEFGVVGDVMGLQQGIAVTAPSPRDSSDLCLLKRAALTQAAAAAAAPYPSPFLDEQKMLRFSKAAHTLPSGLDFGGPSEQAXLLSRTKRPFTPSQWMELEHQ

SEQ ID NO: 48992 - protein, 132 aa, Sorghum bicolor
  Clone ID: LIB3476-025-P1-K1-E8.pep
ILPKSMDEAQSKSAFQMQVFKMPPDLNRTKLFPPANFKIAGASSLNPDYTCGQPVPVSPTAFPDPSGLDSTTLAVATWQVVCNITTTKGAKPKCCVTFSAYYNDSVIPCNTCACGCPANRRGPTCSTTAQSM

SEQ ID NO: 48993 - protein, 102 aa, Sorghum bicolor
  unsure (1)..(102): unsure at all Xaa locations
  Clone ID: LIB3476-025-P1-K1-F5.pep
QAMETLAAARRAKRRKPEARKSPEQEGGAIISPLVPATSAPESNPPGPGAGGDESHIQDPPPGAVGGEEDXVDRISLLPNAISGAQPLSTSTAVTFAPSMSS

SEQ ID NO: 48994 - protein, 75 aa, Sorghum bicolor
  Clone ID: LIB3476-025-P1-K1-G1.pep
VRDVYVGTSVTLDEIKRSGNARISGLGESGDNGVVLCFLIISVIHDFDGIRLHVGGRHDPSPTPLSSAAAQASRT

SEQ ID NO: 48995 - protein, 121 aa, Sorghum bicolor
  unsure (1)..(121): unsure at all Xaa locations
  Clone ID: LIB3476-025-P1-K1-G9.pep
PRPTPSGTVTTPVSRRSDSQWRFDTPTSEASMSMRRRKFSTLSSISYWMTQIRLAEAASKHSVSLGFFKLALESECEPLDRMREELKSYVARHGLATELEDPVKDILQVYDXAEDFEKLKI

SEQ ID NO: 48996 - protein, 122 aa, Sorghum bicolor
  unsure (1)..(122): unsure at all Xaa locations
  Clone ID: LIB3476-025-P1-K1-H9.pep
ARSGAPPPPASRDAAAATPSGRPRPGIRAPPRQRRASTSLSLGLSCACDVNAGVTLGRSSTAAVLVLVRHLVPLRRRHLHLHRHCRPSQGPRAADHGQGPGWSLRVRHXQDCNNNTKAKCAI

SEQ ID NO: 48997 - protein, 119 aa, Sorghum bicolor
  Clone ID: LIB3476-027-P1-K1-A11.pep
AAVVGHSKGGDVVILYASIYNDVSKIVNLSGRFDLKQGIEERIGEGSIDRINKEGYLDVKDKSEHVNYRVTKESLTERLNTDMHAASVSISKECRFLTVHGSADKTIPVEDAHEFAKHI

SEQ ID NO: 48998 - protein, 104 aa, Sorghum bicolor
  Clone ID: LIB3476-027-P1-K1-B12.pep
HDLPDDTEELFWGSPIRVQNEILPPKSLPEEYDAGKAESQFSSLSSDPHSMASQRAWKQPTQGPRPKSLLEIQAEEQLRAQKGLATETAKPATSVPSIPWNGMT

SEQ ID NO: 48999 - protein, 135 aa, Sorghum bicolor
  unsure (1)..(135): unsure at all Xaa locations
  Clone ID: LIB3476-027-P1-K1-B7.pep
PTRPVGLVPCVVLLLGLFFIPESPRWLANIGKEREFHASLQEFRGEDSDISEEATEIKXYIESIRRLPKARFQDLFQRKNMYAVTVGVGLMIFQQLGGINALGFYTSYIFXLQIPITLVGALLMDRSGRRALLLV

SEQ ID NO: 49000 - protein, 56 aa, Sorghum bicolor
  Clone ID: LIB3476-027-P1-K1-B8.pep
YSRSVINSSEVLPCKSETSKLIIYHILIKVAVRSHECKQIIFFFFNNCKIVYTLSR

SEQ ID NO: 49001 - protein, 154 aa, Sorghum bicolor
  Clone ID: LIB3476-027-P1-K1-C8.pep
MELSLSRSTPLSQEILALPTPEDYLNRVLPHDEVKVPVGPAGLFRLPTDSFPRNEMASRDGYGSRFSLTSMSPSYVWSSYHADHIMPALSFSDYGSGLSLDPYYDPPSSMLLSMPAAGGRSVPVSDFRIGDGSFLREFHGLATIRVMPSGDTTT

SEQ ID NO: 49002 - protein, 49 aa, Sorghum bicolor
  Clone ID: LIB3476-027-P1-K1-C9.pep
GIAPFHCFLVDPSLKWLITKRKYYDVHLEPRTEADSSNTENFRISSRLH

SEQ ID NO: 49003 - protein, 170 aa, Sorghum bicolor
  unsure (1)..(170): unsure at all Xaa locations
  Clone ID: LIB3476-027-P1-K1-D1.pep
KEVSKKLMSEKNLLDQKVQRLERMKSEEKSTMEKVYADECRNLKSQIAELEQKLKVATQSLNVAESNLAVRNAEVDSLQSSLKELDELREFKADVDRKNQQTAEILKRQGAQLVELENLYKQEQVLRKRYYNTIEDMKGKXIRXFCRLRPLSDKGRSFEEKNIVCSPDEF

SEQ ID NO: 49004 - protein, 139 aa, Sorghum bicolor
  Clone ID: LIB3476-027-P1-K1-D7.pep
LRQPCNYETAGPGRNDPTYDHTDTCSDMSISLSESDFQRKDHALSMPEHGGTNSEASDAVGSASAEKPTVDADYDEVTSASGPNHFPGVASRAGRVQYWMMEDSPLLEDGELSDAPPVDRPAAVTHHQPKEHTPAAATP

SEQ ID NO: 49005 - protein, 58 aa, Sorghum bicolor
  Clone ID: LIB3476-027-P1-K1-E10.pep
YSFHCYIQLCIHLRHNHRTSSGTRKYSLKSYVYFHICSLSASILAIHHVSLQVYHWPR

SEQ ID NO: 49006 - protein, 146 aa, Sorghum bicolor
  unsure (1)..(146): unsure at all Xaa locations
  Clone ID: LIB3476-027-P1-K1-E11.pep
SMLNHLRFYLPEMYPKLHRILFLDDDVVVQRDLTGLWKIDMDGKVNGAVKTCYGSFHRYAQYMNLSHPLIKAELNPNACGWAYGMNFFDLDSWRREKCSEQIHYWQNQNENRTLWKLGTLPPGLITFYSTTKPLEISXHVLGLGYN

SEQ ID NO: 49007 - protein, 67 aa, Sorghum bicolor
  unsure (1)..(67): unsure at all Xaa locations
  Clone ID: LIB3476-027-P1-K1-F1.pep
WAYYVDDEMSVGAAXAHKALNFFGTPSPRLSLGHYTCKEAWFFGPGGNHLKGAGFRLAGEKNNPTIC

SEQ ID NO: 49008 - protein, 153 aa, Sorghum bicolor
  unsure (1)..(153): unsure at all Xaa locations
  Clone ID: LIB3476-027-P1-K1-F11.pep
AKLVEAAARGXVRIKRRPHRGDNFTLMQAFVKADFWLIWLSLLLGSGSGLTVMDNLGQMSQAIGYKNAHIFVSLMSIWNFLGRVGGGYFSEIIVREHKYPRHIALTVCQIVMAVGHVLFAMAWPGTMYIASXLVGLGYGAHWAIVPAAVSELF

SEQ ID NO: 49009 - protein, 65 aa, Sorghum bicolor
  unsure (1)..(65): unsure at all Xaa locations
  Clone ID: LIB3476-027-P1-K1-F2.pep
ATFHLLCREATGAPDSTTAAXEVXDAMKSGSXERTSTYIAHRLTTSMPCDQIIDXENGKVFQEGP

SEQ ID NO: 49010 - protein, 123 aa, Sorghum bicolor
  unsure (1)..(123): unsure at all Xaa locations
  Clone ID: LIB3476-027-P1-K1-F7.pep
MRCSPLLKQSTNKVKLRHNAESKDFLWVFVMDQDVGALHGDNHAFHIELRRSLVQLVSSQPGEGQSFSAPAIPIVSVNGSCYMIALSKVFRQPNRQHRVIFPDGTTVMLRVEDIRMXGSLAAF

SEQ ID NO: 49011 - protein, 111 aa, Sorghum bicolor
  unsure (1)..(111): unsure at all Xaa locations
  Clone ID: LIB3476-027-P1-K1-F9.pep
MPSSSFSTCHSSSCVQIVDPNPASASAPDTTADSSDRDDDGGGGENGRSWSATERVPSYLWNQNSVHVLCKKFGVNTKAFTPILAGDRRACSPXPAGSVCVYADALEAGMR

SEQ ID NO: 49012 - protein, 112 aa, Sorghum bicolor
  Clone ID: LIB3476-027-P1-K1-G12.pep
LLLLLQRLLHQKRLLLLLLPEPLLLLLVVTATGAVHLLLRRGEDQIVTPGRTEPAHGSIHGSADWGRADRWIRGRILRRGSSRGTNAGRGGDIFFPLVFFFPPLRTRGRTRG

SEQ ID NO: 49013 - protein, 40 aa, Sorghum bicolor
  Clone ID: LIB3476-027-P1-K1-G2.pep
ILFSCEPYTSESSMSLMPVASVARLLRCTQCIAIISLVMS

SEQ ID NO: 49014 - protein, 97 aa, Sorghum bicolor
  Clone ID: LIB3476-027-P1-K1-H7.pep
MAKRLIPSLNRVLVEKLLQPKKSVGGILLPETTKQLNAAKVIAVGPGDRDRDGKLIPVSLNEGDTVLLPEYGGTEVKLAEKEYLLFREHDILGKLEE

SEQ ID NO: 49015 - protein, 83 aa, Sorghum bicolor
  unsure (1)..(83): unsure at all Xaa locations
  Clone ID: LIB3476-027-P1-K1-H9.pep
LIKKPHSKDKVKMPMSYSSYLTMVIFTSPTNILESLSKKKKHTRXMLYDRSNHYSQSAKLMVSIIIPKLRKNLNAHLASNQAS

SEQ ID NO: 49016 - protein, 66 aa, Sorghum bicolor
  Clone ID: LIB3476-028-P1-K1-A8.pep
LVIQPLLAGCTFTALAGCKLTYHFSSLSYISSIKSTYNPLLEPIGLQGIIVSQVKLFPAHPSRTDD

SEQ ID NO: 49017 - protein, 168 aa, Sorghum bicolor
  Clone ID: LIB3476-028-P1-K1-B2.pep
QVRVLTSPHPTPPHPAAAKAVDALFGSRLARDDLVLAGLESEKAVSGFHADNIAPAILGGFVLVRSYDPFHLVPLCSPPALRLHFVLVTPDFEAPTSKMRAALPKQVDVHQHVRNSSQAAALVAAVLQGDAGLIGSAMSSDSIVEPTRAPLIPGMAAVKAAALQAGAL

SEQ ID NO: 49018 - protein, 97 aa, Sorghum bicolor
  Clone ID: LIB3476-028-P1-K1-B4.pep
KHLVFCLKTLTEISCPSVTKLLMDPWLCPCFSLSLGAGMSLQSYPIEHGFQSAAATDCVGELRLHVSFLVINFRRNISSLTCWINSGIWIDHINTIS

SEQ ID NO: 49019 - protein, 109 aa, Sorghum bicolor
  unsure (1)..(109): unsure at all Xaa locations
  Clone ID: LIB3476-028-P1-K1-B6.pep
MASPPPALEILVREPDGCTVWSGPPYPPGTTTPPQRLPKTACSATSFSTDGARLLATVASASATVYDCRTLXRCKCFELPGLLAAALSPTGAXLQTFQKXSSPQEKNVT

SEQ ID NO: 49020 - protein, 121 aa, Sorghum bicolor
  unsure (1)..(121): unsure at all Xaa locations
  Clone ID: LIB3476-028-P1-K1-C10.pep
MAAALTRLRSAVERLGPSRARVRAFSAAAAEAEAASDSRAFTAAAVAAGSGLGIWLLSSNPQPLADSGLAEDAATAGGGGNSGFPAAFRRVGATGEREARFLFGDSYRRRVXFKYEKRIRT

SEQ ID NO: 49021 - protein, 80 aa, Sorghum bicolor
  Clone ID: LIB3476-028-P1-K1-C5.pep
SSRPLGQHPHARNLQHWALKAMNAPWILPEPLMVMALRMKEPSWKLPSAGPAFSRVDLGCARRCHLTTAGSVFQNLQNHH

SEQ ID NO: 49022 - protein, 45 aa, Sorghum bicolor
  Clone ID: LIB3476-028-P1-K1-D8.pep
PMSKHHWFSNQLLSPCWCAEYILRFVTNLYWSITKPLIGLVYWID

SEQ ID NO: 49023 - protein, 82 aa, Sorghum bicolor
  Clone ID: LIB3476-028-P1-K1-E1.pep
FAVVEVGGFHDVNVGTFHRKLKSVPHGEACVVGRDVSGDLTAKSVELGGDLRVHKDDKDLDSKTSKAWEGATIFSFDGELLA

SEQ ID NO: 49024 - protein, 93 aa, Sorghum bicolor
  Clone ID: LIB3476-028-P1-K1-E6.pep
LLVISLCFHLQVGPIAAYYKLPLNRVLVAFDDMDLPCGVLRLQPKGGFGRHNGLKSVIYHFRKNREFCRLRIGIGRPPGQDGPKAFVFQSSIG

SEQ ID NO: 49025 - protein, 77 aa, Sorghum bicolor
  Clone ID: LIB3476-028-P1-K1-F1.pep
PRVREARGQDGARRVKDHHASAGAAHLGERGSPQRQWMGDLTAKTDLSATLLNAPKLHVLFLRETSISLDPSTLMVL

SEQ ID NO: 49026 - protein, 167 aa, Sorghum bicolor
  unsure (1)..(167): unsure at all Xaa locations
  Clone ID: LIB3476-028-P1-K1-F11.pep
EQAKFWKQHPSLVKMELLIQAHLTCESFSLTPALLKDYRHMLELAPRLLEELVKIAVLPRNPHGFGWLRPAIGVIELSQNIVQAVPLSARKASGGNSEGIAPFLQLPHFTEATVKKIARKKIRAFQELCDMSVEDRAALLTQVAGLSEEQAXDVELVLEMIPSNEVD

SEQ ID NO: 49027 - protein, 49 aa, Sorghum bicolor
  Clone ID: LIB3476-028-P1-K1-F2.pep
YMYNSSLCCFVCILVSALKCNANRARIVGRTCPFIAVQTSIDSFLFLIQ

SEQ ID NO: 49028 - protein, 61 aa, Sorghum bicolor
  unsure (1)..(61): unsure at all Xaa locations
  Clone ID: LIB3476-028-P1-K1-F6.pep
TVLNYTFGVEILNMMKLTFTLKVSLFSPIKEKXPLSFAFDFIDPYFTLIYLSAEIPLDPDT

SEQ ID NO: 49029 - protein, 42 aa, Sorghum bicolor
  Clone ID: LIB3476-028-P1-K1-F9.pep
VVLVNAVLLILLLLTPHQALASPEDLIQILDCRAAFIDSHIE

SEQ ID NO: 49030 - protein, 136 aa, Sorghum bicolor
  unsure (1)..(136): unsure at all Xaa locations
  Clone ID: LIB3476-028-P1-K1-G11.pep
MASALSSLRYGDSLSVVGISAATAVLCEAISWLLIYRTATYNSLRASIERHSRKLDAMKSGSSSSSSSSGAGASSAQPASSRAKKMDRVETSLKDAARELSLAKLKSGAASPGALRVFGLXNSLFEADRRKLPSRP

SEQ ID NO: 49031 - protein, 155 aa, Sorghum bicolor
  Clone ID: LIB3476-028-P1-K1-G2.pep
EMLFRCQACQRTSELFGWVRDVFQQCAPGWDRDALLRELDYVCKIFRLSEDSKGRKLFRKCAELVERLRSGSAESTTPRILLQALQELDIDTSKSFENEEPGRLITPQEACNRIAEVVQEAVRKMEIVAEEKLRLYKCAHPCGEACERELEEKAR

SEQ ID NO: 49032 - protein, 167 aa, Sorghum bicolor
  Clone ID: LIB3476-028-P1-K1-G9.pep
QKRCDEARMNALSEEIDLLNAKIDKLSSERNELFEKNEQKDKELAGISEKDMQLQDKTAEITSLNKELVSLKDQVKMHLDELHNLKRLKNEKEETIGKLQIDIGSLKLQCDNLKTLLSKKESEKDNLASQVLKLRRSLETREGAKANGQNSDAKDNQHTNNKRTKHN

SEQ ID NO: 49033 - protein, 36 aa, Sorghum bicolor
  Clone ID: LIB3476-028-P1-K1-H6.pep
AIKIVSGACTIHHETFPGTLIGRIALTQHKSNYQII

SEQ ID NO: 49034 - protein, 108 aa, Sorghum bicolor
  Clone ID: LIB3476-029-P1-K1-C11.pep
GAQSLNFNSSSGGITFYFVGSRRSFTWAGVLKPSGLGQLLGFRSLTRLRQLPFLRGGLIPDVVPTGLAFLNGGWPAWCRGSFLVGGVNPPRFGAFPLGGLFPAPGLGF

SEQ ID NO: 49035 - protein, 195 aa, Sorghum bicolor
  Clone ID: LIB3476-029-P1-K1-D11.pep
QIVHRYHFASHLKRMSVIVRIQEKFYAFIKGAPETIQERLVDLPAAYVETYKKYTRQGSRVLALAYKLLPEMPVSEARSLERDQVESDLTFAGFAVFNCPIRSDSGAVLKELGQSSHDLVMITGDQALTACHVASQVHISSKPVLILTRIKTGGFEWVSPDETDRAPYSAVEVAVLSESHDLCINGDWFEMLQST

SEQ ID NO: 49036 - protein, 55 aa, Sorghum bicolor
  Clone ID: LIB3476-029-P1-K1-D6.pep
RKKKKKKKKKKKKKKKKKKKKKKKKKKKKKKKKKKKKKKKKKKKKKKKKKRGRPF

SEQ ID NO: 49037 - protein, 114 aa, Sorghum bicolor
  Clone ID: LIB3476-029-P1-K1-E11.pep
WACGPGSANCSAIQPGQPCYASDDIVAVSSYAFNDYYHRTQSSGGTCNFNGTANVTSTDPSHGSCIFAGSTGASGSKGGTASGPASPDSFASKSQSCWLIHLVATLLPILFVVM

SEQ ID NO: 49038 - protein, 91 aa, Sorghum bicolor
  Clone ID: LIB3476-029-P1-K1-F8.pep
RWRTSRCSRPQTKKTIARIATMRTMLGLILVSTLSSADAAGAGGDGGISHEELPPLIIIPETQTDIQPGSTNQPHSSPRYKKITGRSFAFG

SEQ ID NO: 49039 - protein, 123 aa, Sorghum bicolor
  Clone ID: LIB3476-029-P1-K1-H12.pep
ALYTTRSSSLRASSLALFRSGNAGWTASSSALSSAATCSAALPPTTMTSSTVSTTLISEPETSSLTRPRRARPASVSATRPSRRRKRRPRTLRQPPAPVVPSFWLSATPLAAPPARGWLGPTW

SEQ ID NO: 49040 - protein, 154 aa, Sorghum bicolor
  Clone ID: LIB3476-030-P1-K1-A4.pep
VDPVMVSTSGDTLSGPSTLATYRDELFSVADIVTPNVKEASKLLGDVSLHTISDMRNAAESIYKLGPKYVLVKGGDMPDSSDAIDVLFDGKEFTELRGPRIKTRNTHGTGCTLASCIAAELAKGATMLHAVQVAKKFVESALYHSKDLGWWPAL

SEQ ID NO: 49041 - protein, 145 aa, Sorghum bicolor
  unsure (1)..(145): unsure at all Xaa locations
  Clone ID: LIB3476-030-P1-K1-A5.pep
KEGAILSVVNCSSDSFSPTVLFSTEHCGIHKWDTRTNSESWSFKSSPEEGYISALVVGQCGNWFISGSSRGVLTLWDNRFLLPVNSWNYSTVSPIEKLCLLIPPPSSISSAGRPLVFVAAGCNEVSLWNAEKXSCHQMFRTASTD

SEQ ID NO: 49042 - protein, 128 aa, Sorghum bicolor
  Clone ID: LIB3476-030-P1-K1-B2.pep
IRFSCPTVTFSLSEDLGAAAARGLDSFQRVRLRFSARGASLRAARRRRRPPHPDQPSSAKPAARPGRGRWGTVTATACGGGGAPWPPRSSQGSSPSRTVATARGSRERVGGGRGAMVISDEEAAFGGA

SEQ ID NO: 49043 - protein, 84 aa, Sorghum bicolor
  unsure (1)..(84): unsure at all Xaa locations
  Clone ID: LIB3476-030-P1-K1-B7.pep
MSCCGGNCGCSSGCKCGSGCXGCMMYPDMAEQQVTTTVKTLVMGVAPSSKAHAEGGFEATDSARAENEGCKCGPNCSCNPCTCK

SEQ ID NO: 49044 - protein, 97 aa, Sorghum bicolor
  Clone ID: LIB3476-030-P1-K1-C11.pep
VRGDIVHFLGLYDFKSKTHQDACCPEGMCRAAVFALHVKEELASWPEQSTRQRTWLTVPEAASRCRYQWMQEALLTGFSDWHDKWSRGGGGTNCDPA

SEQ ID NO: 49045 - protein, 142 aa, Sorghum bicolor
  unsure (1)..(142): unsure at all Xaa locations
  Clone ID: LIB3476-030-P1-K1-C5.pep
VETTWETAIGKITSILEEQFSRMRTASHFLLIKDYVTLLGAAVNKYGYRITQLIEVLEKTRDKYHQLLLLECRKQVDDILTNDSYEQMVIKKEYEYNMNVTAFHLEHDDAIPXDFPYVTSFSSSVPDVCRIVRSFIEDSVSY

SEQ ID NO: 49046 - protein, 118 aa, Sorghum bicolor
  unsure (1)..(118): unsure at all Xaa locations
  Clone ID: LIB3476-030-P1-K1-C6.pep
RFFSAYMDSLEESFPKASNERLALERAAGRAIVDLVSCPASESVERRETGASWARRMRSAGFSPVAFSDDVADDMRSLLRRYREGWTLREPGADDGVAARVFLAWKEQPXVWTSAWRP

SEQ ID NO: 49047 - protein, 104 aa, Sorghum bicolor
  unsure (1)..(104): unsure at all Xaa locations
  Clone ID: LIB3476-030-P1-K1-D10.pep
MQYAAAEQAWYMPAATTMAESAVARVERLASESAVVVFSVSSCCMCHAVKRLFCGMGVHPTVHELDLDPRXRELERALARLLGYGPAGAPVVPVVFIGGKLSAP

SEQ ID NO: 49048 - protein, 90 aa, Sorghum bicolor
  Clone ID: LIB3476-030-P1-K1-D3.pep
ILTCFNFETTCFSHDWPYMFLHFLIGSVSLVVMIGARRRGGVKNWYKRIVLSAEWIQHLRLLLYSHVHDASRPAQSADLITTATKITALL

SEQ ID NO: 49049 - protein, 149 aa, Sorghum bicolor
  unsure (1)..(149): unsure at all Xaa locations
  Clone ID: LIB3476-030-P1-K1-E11.pep
KRVLARRTAAPRAGEGKDFLPLEGGPGKKLRKVQEPEEPENTATVVYIGHIPHGFYEDEMQGFFKQFGDIKRLRIARNRKTGKSKHYGFIEFESPVVAKIVADEMNNYLLFEHTLQVSLVPPEKVHPKLWKXVRRGFIPIDRVAIERKR

SEQ ID NO: 49050 - protein, 66 aa, Sorghum bicolor
  Clone ID: LIB3476-030-P1-K1-E7.pep
KIVSYNRFKQNKKILVVVFYFSLIQQFNTAKVSANQPNKCSTQPDLLDSMNQTSFCMSLVRPPAAN

SEQ ID NO: 49051 - protein, 131 aa, Sorghum bicolor
  Clone ID: LIB3476-030-P1-K1-E8.pep
FHSGIEVHGVEYAFGAHDFPTSGVFEVEPRQCPGFRFRKSIFLGTTCLDPIQVRQFMELQSVNYNGDTYHLITKNCNHFCKDMCYKLTGNKIPKWVNRLARIGAICNCLLPESLKISPVGHDPNSQSEDSE

SEQ ID NO: 49052 - protein, 82 aa, Sorghum bicolor
  Clone ID: LIB3476-030-P1-K1-F11.pep
DQQLIYHQFIVVYARKEDLRGISLQDLVPSTTWKTPKVHLQENYFRLGAREKRLWITKYICLQHRQYVKLKLYARASCWIIQ

SEQ ID NO: 49053 - protein, 95 aa, Sorghum bicolor
  Clone ID: LIB3476-030-P1-K1-F5.pep
RLVLVASGWLVVLRLQVRRRRCVGLLGLGRVQVRRLARLGRVAVAVYLDVRLAHREDARHDAAEYQQQRLADRPELLAAALVAGDCDLASVVALP

SEQ ID NO: 49054 - protein, 63 aa, Sorghum bicolor
  unsure (1)..(63): unsure at all Xaa locations
  Clone ID: LIB3476-030-P1-K1-G1.pep
MVLWELTAITAYFLGLRRTYXLALRXQRXLIPPNHPRIRDFVYRRTRDIFNGAVSVHKNIQQR

SEQ ID NO: 49055 - protein, 101 aa, Sorghum bicolor
  Clone ID: LIB3476-030-P1-K1-G6.pep
RCSGRCGYSPPHARGTGSLLRSCSWISGLPPSPTCFALLRGSICNSTHIALSAERPSAGRTIPSTYTDVDIAVGTWMSFVYSTVASYRIYSTTVATAWYWM

SEQ ID NO: 49056 - protein, 140 aa, Sorghum bicolor
  Clone ID: LIB3476-030-P1-K1-G9.pep
TEAASIPVPKLKNVHRLRTEHYVYELPDAHPLLQQLGLDQREPDDPTPYLLAIWTPDGIKEITKTPKPCCDPQMEGDLCNNEMCNNCTVEKENQSRYVRGTILVPCRTAMRGSFPLNGTYFQVNEVFADHRSSHNPIHVQ

SEQ ID NO: 49057 - protein, 160 aa, Sorghum bicolor
  unsure (1)..(160): unsure at all Xaa locations
  Clone ID: LIB3476-030-P1-K1-H11.pep
PRVRPRVRSDFFIELVGNIAKLNHPNLSELDGYCSEHGQCLLAYEFYKNGSLYDLLHLSDGYSKPLSWNNRVKIALRSARALEYLHETCSPPIIHKNFKSSNILLDDDLNPHISDCGFADLIPNQELQESDDNLGYRAPWVTMSWQYSQKNXVYRFGVHA

SEQ ID NO: 49058 - protein, 79 aa, Sorghum bicolor
  Clone ID: LIB3476-031-P1-K1-A11.pep
PPNPVSSLARLASPRLARRVAFFRVICSRLTLLPPRSLSPQHPDERARRPWSWSGRSPVPSDSLRERSLSVRGLARGVT

SEQ ID NO: 49059 - protein, 137 aa, Sorghum bicolor
  unsure (1)..(137): unsure at all Xaa locations
  Clone ID: LIB3476-031-P1-K1-B1.pep
FACSQTVVLACTMDDDLKHLRVSFSGVRQEDRGRRGGETIPTPSFQQRTSSRRGSLSNAEEYDAAYAATVAAVAYAIAAREEERLLASQESPSPYAAADKLSRGNXNKQQRTAAAADSMDELASTTTAESSKSPRTP

SEQ ID NO: 49060 - protein, 77 aa, Sorghum bicolor
  Clone ID: LIB3476-031-P1-K1-B12.pep
SNRLNNHVFVTFLCPIFFPLWIMKSSMTDYKLEGGKIKIYWPSCHCIVPFNLVTCCCISYYLHSLKRCIARMTFFKG

SEQ ID NO: 49061 - protein, 87 aa, Sorghum bicolor
  Clone ID: LIB3476-031-P1-K1-B2.pep
RNNTAFLAIELLNEPLAPGANLSVLMKYYQDGYNAVRRYTPASYVIMSNRLNIANQTEILQFVGSFDGAVLDVHYYNWFDKKFDNLT

SEQ ID NO: 49062 - protein, 69 aa, Sorghum bicolor
  unsure (1)..(69): unsure at all Xaa locations
  Clone ID: LIB3476-031-P1-K1-B4.pep
KGGSGLKFGDPKKKLCLRKQGDVKLGPLKRAPRDPNKQVKSWKHWVDKSGLFNSASLFFSXKXKYFDLF

SEQ ID NO: 49063 - protein, 34 aa, Sorghum bicolor
  Clone ID: LIB3476-031-P1-K1-B5.pep
MGRGKVVLQRIENKISRQVTFAKRRNGLLKKAYE

SEQ ID NO: 49064 - protein, 134 aa, Sorghum bicolor
  unsure (1)..(134): unsure at all Xaa locations
  Clone ID: LIB3476-031-P1-K1-B7.pep
IMMLPTGAKRMGDVELAIRFSTCGSMLDMLHAYGRPALPAMHHQRPIPAVNREALRLAAARITAAHLARSAEPPLRREVATWMLDAAEPRGFSMRKLRANWNRAVAALSWVADAARWXEDTRSWRNPTATAMAH

SEQ ID NO: 49065 - protein, 61 aa, Sorghum bicolor
  Clone ID: LIB3476-031-P1-K1-B9.pep
LILTPSLFPLDAIFIAAAIYLSDQPHIGASVRVLLCLTRPPARGVLVLLVLEQVVHVASAR

SEQ ID NO: 49066 - protein, 95 aa, Sorghum bicolor
  unsure (1)..(95): unsure at all Xaa locations
  Clone ID: LIB3476-031-P1-K1-C1.pep
LCDLDTGGWRLCLNPRPPYAPSVTFSLTRGAQSVHGDRRFGRLQIXHTTSTSFFDTTTSSTFAILYDAEPYDAPKAHYATVVESYTAITEEARAV

SEQ ID NO: 49067 - protein, 54 aa, Sorghum bicolor
  Clone ID: LIB3476-031-P1-K1-C2.pep
TLACVITMALLIDGGYYEQDIPAFVARLKWLNYSSYCYRLLVDIQVRNGGHYYD

SEQ ID NO: 49068 - protein, 149 aa, Sorghum bicolor
  unsure (1)..(149): unsure at all Xaa locations
  Clone ID: LIB3476-031-P1-K1-C8.pep
TSSDNKFTSIALSNFLAGAAAGCTTLVLIYPLDIAHTRLAADIGRTDXRQFRGIPHFIQTGVQKNRIRGIYRGLPTSLHGMGGHRGLDFGGFDTGKDVLVPLETPLWQRLVATQAVTFMAGLISYPLDTVRRRMMMQSGDGGQMYRXHS

SEQ ID NO: 49069 - protein, 114 aa, Sorghum bicolor
  Clone ID: LIB3476-031-P1-K1-D1.pep
MVTADPDGSGGAPDVSELFCHYNSLYFRDSLGSCAVSWAEDPLPNSDVSICDYYPGGGGCIILLSKSLCGSHNGSDLKNALLHEMIHGLYCIKYNNSNHSDHGAKFQKLVNTIK

SEQ ID NO: 49070 - protein, 144 aa, Sorghum bicolor
  Clone ID: LIB3476-031-P1-K1-E10.pep
ITSHLLLPFHESPSFTDWQRCIMELSGQVRQQRRLARVHGRPVAVMILSTRERDPMIPTKASLVGRWTQTCRRNLRVSIDSSSNHHSAQGQKTLESVIVISSRGHLIIVHRNDETREAGNGALVLTGNVLPGFLGSIFGAQLFF

SEQ ID NO: 49071 - protein, 92 aa, Sorghum bicolor
  Clone ID: LIB3476-031-P1-K1-E4.pep
QPPFSPLPCQAERRSLILSPRRSIVLSLNALLAAPRCPAPSILTTPVAPGSVSRTRGSSKGVAPLTARPPGTFDGAWSLRPHCSSAGPEPGS

SEQ ID NO: 49072 - protein, 137 aa, Sorghum bicolor
  Clone ID: LIB3476-031-P1-K1-F11.pep
RRFSVCDPVNLGGRPSDFDGNLRCPGSPDEDNIDMEVSDGAQISPFPHSYSASAASEQNDDQSNSSRYCLVASKQMVGIFLTVWVRNEIRDDVRNLKVSCVGRGLMGYLGNKGSISISMSLHQTSFCFICCHLTSGE

SEQ ID NO: 49073 - protein, 46 aa, Sorghum bicolor
  Clone ID: LIB3476-031-P1-K1-F12.pep
DNLDGRLIAIGRRLIGRPVSWSFWPSRRPWSSTSNRPGRLVAINRD

SEQ ID NO: 49074 - protein, 144 aa, Sorghum bicolor
  unsure (1)..(144): unsure at all Xaa locations
  Clone ID: LIB3476-031-P1-K1-F5.pep
MATAPHPHPHTSAIKRRKSQTKKVVCIPAPVAAPPPXVGGRPSTSGEVVPSDLWAWRKYGQKPIKGSPYPRGYYRCSSSKGCSARKQVERSRTDPSMLVITYTXDHNHPWPTQRNALAGSTRPPSPLVAARVIPSHHTILRVAS

SEQ ID NO: 49075 - protein, 104 aa, Sorghum bicolor
  Clone ID: LIB3476-031-P1-K1-G11.pep
PPGTLDNLVLAGPAAGRAATRLLAETAGSGRARQGETERSRSRAVGSERFRSRKSSSPEDGARQFLAAAHRGRRHPCVRGRLLAARRRAQHRYSVCRRQREQAV

SEQ ID NO: 49076 - protein, 57 aa, Sorghum bicolor
  Clone ID: LIB3476-031-P1-K1-G2.pep
KLQHACLKRLTMLSLPARSSPPSFDRCLDRLEGCCWRLWPRARASSQQICALLSLSK

SEQ ID NO: 49077 - protein, 117 aa, Sorghum bicolor
  unsure (1)..(117): unsure at all Xaa locations
  Clone ID: LIB3476-031-P1-K1-G6.pep
MARTNNKKVTTMLLVTTVAVLGLLLAVASSAACGCGRRRVHLQLYMHDVIGGPNRTAIRLIWGVGLPHESMPNRTFGDTVXIDDLVTDGPGIRRVGDGDGDGDTKAHRPGAGHLHAE

SEQ ID NO: 49078 - protein, 84 aa, Sorghum bicolor
  unsure (1)..(84): unsure at all Xaa locations
  Clone ID: LIB3476-031-P1-K1-H12.pep
PRVRLKTYIVGVMHNSRHAKGLENRTAIANGTSMDAYRDKGPNEDHSASAVDNGISVKLYVQQMEIIEDKTGSLLPXLKHSSXL

SEQ ID NO: 49079 - protein, 51 aa, Sorghum bicolor
  unsure (1)..(51): unsure at all Xaa locations
  Clone ID: LIB3476-032-P1-K1-A10.pep
YYXXLPLHXITFYRPQTLHXSNKNVWAXXWSLXXVFSRIRHXXPXSFSXGR

SEQ ID NO: 49080 - protein, 68 aa, Sorghum bicolor
  Clone ID: LIB3476-032-P1-K1-A12.pep
APKQIPQSASFVPVGQVQKVLMPYHQLGLETEHPRVHLSLTLAAAAGESRIAALLVAVLVSWIARSDA

SEQ ID NO: 49081 - protein, 49 aa, Sorghum bicolor
  Clone ID: LIB3476-032-P1-K1-A5.pep
RSTCNTGSVLTIALQLSYENYLRESDAGVARQYVRTVVASVQRVAMAIA

SEQ ID NO: 49082 - protein, 33 aa, Sorghum bicolor
  Clone ID: LIB3476-032-P1-K1-B1.pep
ASEGTRRDPFRSVAVDHRLGPRIGTLASKGGGG

SEQ ID NO: 49083 - protein, 71 aa, Sorghum bicolor
  Clone ID: LIB3476-032-P1-K1-B10.pep
CTEAYNIISFHMLIDNKDVVIHLMLNKNNAARPFRGSLLTYACILHFISIILLPKYNILLAVLQRLHCENP

SEQ ID NO: 49084 - protein, 133 aa, Sorghum bicolor
  Clone ID: LIB3476-032-P1-K1-B11.pep
GGLFSVLQDVEHAAVTVLDRWKITIKDNQGKLMAPPKFMNNYFGVGCDAKVALDIHNLREENPEWFYSQFMNKVLYAREGAKNIMDNTFDCFPWDVKLEIDGSKIDIPQDSEGILVANIKSYMGGVDLWKERG

SEQ ID NO: 49085 - protein, 148 aa, Sorghum bicolor
  Clone ID: LIB3476-032-P1-K1-D1.pep
STTTVKSFSIASLQQYTNSFSEENIIRDSRFGKVYLAKLPDGELLEILKIDTSNSKVPVDAFLELVVRISELRHPNILGLVGYCAEFEQRLLVYEYCSKLTLHDELRHVDDSSKPLSWNARLQVAAEAAKALQHLHDSCQPPVVHQNF

SEQ ID NO: 49086 - protein, 130 aa, Sorghum bicolor
  unsure (1)..(130): unsure at all Xaa locations
  Clone ID: LIB3476-032-P1-K1-D2.pep
RGTTTVKSFSISSLQQYTNSLSEENIIRDSGKIDTPNSKLPFDAFLALVVRISELLHANILGLVVYSSXLSSYYSSISTASCFTLHDLLRHVYFSTNTSSIHSSLXSAVEAPKSLQHLHDSCQPPVLHQI

SEQ ID NO: 49087 - protein, 58 aa, Sorghum bicolor
  Clone ID: LIB3476-032-P1-K1-D3.pep
CVSLPVEPKTKRYPVILQNAPTKFDSRYDTASYLFATISANAVLFLQKEMICSFRTRG

SEQ ID NO: 49088 - protein, 45 aa, Sorghum bicolor
  Clone ID: LIB3476-032-P1-K1-D7.pep
SLRRMQGAELKSCKYRLASRRAFVSSSLSPTHPLMMMIHRSGLIC

SEQ ID NO: 49089 - protein, 83 aa, Sorghum bicolor
  Clone ID: LIB3476-032-P1-K1-E12.pep
LRTYIQTPNQPPKGQVTIEDEMDDESDDYVFKDLIMVDSMVDRTNLMSNLVRNDSRLEFKVNIKVNIQTQSLNLSMNMVKAEI

SEQ ID NO: 49090 - protein, 43 aa, Sorghum bicolor
  Clone ID: LIB3476-032-P1-K1-E3.pep
QVPPALHHHMVHLAGKAAKVEWLLEDSVTGQADVARALKGLDC

SEQ ID NO: 49091 - protein, 121 aa, Sorghum bicolor
  unsure (1)..(121): unsure at all Xaa locations
  Clone ID: LIB3476-032-P1-K1-E5.pep
MDGRKRGKADGAKGASASRKRSRESESFQSGVGSKSKPCTNFFSTSGCPFGEGCHFLHYFPGGYQAVSKMTNLGGTTIASPGRMTMDGPPTPTVKTRLCNKYNTAEGCXKWGDKCHFAHGE

SEQ ID NO: 49092 - protein, 99 aa, Sorghum bicolor
  Clone ID: LIB3476-032-P1-K1-E8.pep
GATSLHLRQLHRRWCDGSIIVLPNLIPIEAHGDLRGEGAVLRHSDWNCHKSDSSWLTTKAMVVVRPTAGGNKYICYISMARPVREECDCHMETAEQIRR

SEQ ID NO: 49093 - protein, 97 aa, Sorghum bicolor
  Clone ID: LIB3476-032-P1-K1-F1.pep
TWTLLRTSWIICRSTTWTNTGTTDTISTGTTHLGHTLKLTNHTMETHLIDSTCMMMTWTLVSHVPDYDDVRLVQKSYDNRTTTHEIETYEGGDERSC

SEQ ID NO: 49094 - protein, 46 aa, Sorghum bicolor
  Clone ID: LIB3476-032-P1-K1-F10.pep
ASYSINQHYLQVTYQPTSTHKTITSITGGDIFYLSRGLNLFTLIFY

SEQ ID NO: 49095 - protein, 109 aa, Sorghum bicolor
  Clone ID: LIB3476-032-P1-K1-G11.pep
EGWTGSCAVAGGRMYIVAEYGEWRLKRYDEGRDEWRMVAGSGVPPEVRRPHVVAGEVGEVAGGRRRIYVVGAGLDVAVGTVSAAAAATAAPGVEEEVVEVGSVLGPLLV

SEQ ID NO: 49096 - protein, 125 aa, Sorghum bicolor
  unsure (1)..(125): unsure at all Xaa locations
  Clone ID: LIB3476-032-P1-K1-G6.pep
CKTTLTKLTQQWRPSACSPLQSPHPPPPFAPPPPPGRPAPXPPTPARPPPPGPRTPRAGDXTPSACRXPPSPSSSPPPPPPXGTPGSACGPTCRAGARRAWRPGGGGRRLLVGTRHPPVRYFLGL

SEQ ID NO: 49097 - protein, 112 aa, Sorghum bicolor
  unsure (1)..(112): unsure at all Xaa locations
  Clone ID: LIB3476-032-P1-K1-H3.pep
MRPPRGRGGGGRFGGGGGRGGGGGRFGGGGRGGGGGRFGGGFRDEGPPAEVVEVSTFLHACEGEAVTKLINEKVHYFNAPIYLQNKTQIGKXEEIFGPSTNXLFLWKMMDGI

SEQ ID NO: 49098 - protein, 49 aa, Sorghum bicolor
  Clone ID: LIB3476-032-P1-K1-H5.pep
VCIARSSICGWMLRSRSRYRFAWTPISVCCTSSKTSHAWPPTRLTMHSV

SEQ ID NO: 49099 - protein, 109 aa, Sorghum bicolor
  Clone ID: LIB3476-033-P1-K1-A10.pep
YAKLTGRPFRVFSLDTGRLNPETYQFFDQVEKHYGIRIEYMFPDASEVQELVRTKGLFSFYDDGHQECCRVRKVRPLRRALKGLRAWITGQRKDQSPGTRASIPLVQVD

SEQ ID NO: 49100 - protein, 101 aa, Sorghum bicolor
  Clone ID: LIB3476-033-P1-K1-B11.pep
MFLTVSDEDAICHRMVLVCGTSTCHMAVSKNRLFIPGVWGPFWSAMVPEFWLTEGGQSATGALLDYIIENHVASPLLSNHAASQSISIFELLNKMLLSMSH

SEQ ID NO: 49101 - protein, 147 aa, Sorghum bicolor
  Clone ID: LIB3476-033-P1-K1-B12.pep
RSFTKHSSVSSGGENLIRRLQKDSVVQVGSSNQTRWMQSDPHILTEGEIIEIGSQMDWHAEPDSGIVVANKRHETVSGEGLSSQNQEISQGGKMVNNGDGRQKNIVRGKVSLAHVINQAEACSQQGGWSRHKAISIAEKLEQDNLRL

SEQ ID NO: 49102 - protein, 109 aa, Sorghum bicolor
  Clone ID: LIB3476-033-P1-K1-C10.pep
AGNGRLNSPQHLCTAALGFSSSLQPPPLLSLRRRGQRRRRGGGETPPPAAGLVVGRFAVVVVAMMMMAPPWPDATCRPAALYLVGQRQRGQQRVTSSGWIYGRRWFGVE

SEQ ID NO: 49103 - protein, 118 aa, Sorghum bicolor
  unsure (1)..(118): unsure at all Xaa locations
  Clone ID: LIB3476-033-P1-K1-C2.pep
NEVELIAKLQHRNLVRLLGWCAERDEKLLVYEYXPNRSLDAFLFDRSKSAQLGWSTRHNVILGIARGLLYLHEDSLLKGVHRDLKASNVLLDHKMSPKISDFGMAKIFEDDSDGINTG

SEQ ID NO: 49104 - protein, 94 aa, Sorghum bicolor
  Clone ID: LIB3476-033-P1-K1-C7.pep
GGVHMAIKMCQFLERGNGGGLFIISPRDKKGIFAKPLKLGKARVFQIRKFKNRDERFYFRGPKRKGKLRKAGGRKLGPRKRPPPYGFYFFVEED

SEQ ID NO: 49105 - protein, 129 aa, Sorghum bicolor
  unsure (1)..(129): unsure at all Xaa locations
  Clone ID: LIB3476-033-P1-K1-D6.pep
EYFGDIVILPFMDRYELVVLKTVALCQYGVQNVTADYIMKCDDDTFVRLDVVLQQIAAYNRTLPLYLGNLNLYHSPQRSGKWAVTFEEWPEAAYPPYANGPGYVISADIARDIASRHTNHSLRXFKMEV

SEQ ID NO: 49106 - protein, 62 aa, Sorghum bicolor
  Clone ID: LIB3476-033-P1-K1-E3.pep
GGALIKDPTLLTAPSNDRDLLLGPLKQINGPSFNTDGPRKTCDYPNLIAFWENPLLHRWINT

SEQ ID NO: 49107 - protein, 125 aa, Sorghum bicolor
  Clone ID: LIB3476-033-P1-K1-E6.pep
MANMGAAILVCIVVLALDVTAGILGIEAQAAQNKVKKVTILFIQCEKPVYRAYQLGLAAAVLLVVAHAIANFLGGCACICSQLEFIKASINRKLAATTIILSWIALIAGFSLLARGAMSNSKSQT

SEQ ID NO: 49108 - protein, 133 aa, Sorghum bicolor
  Clone ID: LIB3476-033-P1-K1-E7.pep
LRVLGEQERWNIGVLLRMLTELLPFIHQKAIQTCPFASVNPSSTPENFSASCLKSYAAGDSEWSAFEWMHTDCLPNLIKLACLLPVKEDNLRTIITKYLLEVSGLYGKDYLEHIMLPVFLVAAGDIDSGDFTY

SEQ ID NO: 49109 - protein, 134 aa, Sorghum bicolor
  Clone ID: LIB3476-033-P1-K1-E8.pep
FYISHAQNIPFIENIEKRVQGATKLLDGSLERCFVDGLEHRDAKVIYNCLRAYAAIDNTSSAEELFRTTVVSPLIQKIVPQNYARAVAGASSDELEDDYQQIKECVKKDCKFILEISSSENSGLHVFDFLGNSI

SEQ ID NO: 49110 - protein, 85 aa, Sorghum bicolor
  Clone ID: LIB3476-033-P1-K1-F2.pep
VHLPFSTPLPVALPRIPSRPNPAPAPDTAGAVRVSTDPHDRALASTPAPRPRPRAGRAASISAAASAGVCMDPSGPAAGPSSSAG

SEQ ID NO: 49111 - protein, 145 aa, Sorghum bicolor
  Clone ID: LIB3476-033-P1-K1-F7.pep
EEYIKALDRAKGELYYNHSLGMQYSKITEQIFVGSCIQTEKDVKMLSETMGITAVLNFQSESERINWGINSETINSSCRENNILMGNYPIREVDSVDLRKKLAFCVGLMMRLIRKNYRIYVTCATGYGRSPSCVISYLHWGQDTR

SEQ ID NO: 49112 - protein, 164 aa, Sorghum bicolor
  Clone ID: LIB3476-033-P1-K1-G1.pep
VVKNHLSMVAFNNITRLAFGKRFVNAAGELDEQGREFKAIVHNGIKVGASLSIAQHIPWLRWLAPVDEQAFKAHGDRRDRLTVKIMEEQAKALKQHGAQQHFVDALFTLRDKYDLSDDTVIGLLWDMITAGTDTTVISVEWAMAELLRNPRVQEKLQEGAERRR

SEQ ID NO: 49113 - protein, 138 aa, Sorghum bicolor
  unsure (1)..(138): unsure at all Xaa locations
  Clone ID: LIB3476-033-P1-K1-G10.pep
VMDNPPMDGILHLLMESNVSAMPKTERWLSFKPYVLXHHVGAHLNYPMHAYMSKKPHGKCSKLAQQAFAPLAACLPRDVHIVNLKVPQAVRFPHTEAAEPRFAVLLHRRRWDTSYCKRGGLHCTTVGEVPLNLFYMFK

SEQ ID NO: 49114 - protein, 69 aa, Sorghum bicolor
  Clone ID: LIB3476-033-P1-K1-H1.pep
NMHPRNKALVTGGFLKREKKAFRVKPVGGIWGQVCWKFLFLNKKGVCSMWGKIFKAGGEPPVVYVLCCC

SEQ ID NO: 49115 - protein, 61 aa, Sorghum bicolor
  Clone ID: LIB3476-033-P1-K1-H5.pep
SNKLVLPCFSSSGSKADDPCSLSLDRDRDLESHSHEQQLRRTPRRLGLSRRSGHAEDHIGQ

SEQ ID NO: 49116 - protein, 64 aa, Sorghum bicolor
  Clone ID: LIB3476-033-P1-K1-H9.pep
DVAHDVQQSQKIPQDPSTLHDFGGMTRLTASDVQTSDYWLLTEGDVSMTDIWRTERILDNHSLS

SEQ ID NO: 49117 - protein, 116 aa, Sorghum bicolor
  Clone ID: LIB3476-034-P1-K1-A12.pep
DPRVRLEQKNTETLEKHRLLEEEKLSANKENIKLQKHVQDLEVQLQLAKQKIKVTEAESKCKEERYAATAEALRAEICHLEQSVQQFSRRISLLEGTFLQNKGHAEIRVFKRAFQM

SEQ ID NO: 49118 - protein, 147 aa, Sorghum bicolor
  unsure (1)..(147): unsure at all Xaa locations
  Clone ID: LIB3476-034-P1-K1-B10.pep
HAYDFPKQRIVVAGAGSAGIGVVNAASRTMARMLGNNEVAFESARSQFWIVDALGLITEDREDIDPDARPFARRKSELGHQGLNEGAKLVXRVKKVKPDVILGLSAVGGLFSEEVLEALKDSFSSRPAIFGMFNSTKNAECTPGEAF

SEQ ID NO: 49119 - protein, 72 aa, Sorghum bicolor
  Clone ID: LIB3476-034-P1-K1-B12.pep
ALRNLRSPRNFYFIRPKKSTTFPEPGSRPNKGPFSNTSKRSSLCIPFGKAFLIKSRIKFRTIPRSEELTLAA

SEQ ID NO: 49120 - protein, 143 aa, Sorghum bicolor
  Clone ID: LIB3476-034-P1-K1-C8.pep
EDLKTSISPVLNIPYRLEPDDGTSSAVIDMEYFKRLSIKFQRFLVEAKSKKLGCFYLSESLDEDMDYIFRVPEAYQRDEVHDFNHMPAETALYSDGNLEKYKDRHFCLYLGHQDGEMGQCNGPEAFANYFGLLDSLPHNGSKS

SEQ ID NO: 49121 - protein, 36 aa, Sorghum bicolor
  Clone ID: LIB3476-034-P1-K1-D5.pep
MAVTGTSVAAAATMLAAAAAIFITFVICFYLFLCAK

SEQ ID NO: 49122 - protein, 112 aa, Sorghum bicolor
  unsure (1)..(112): unsure at all Xaa locations
  Clone ID: LIB3476-034-P1-K1-E6.pep
LKEAGGETAKQQVHPPNSAKQLKQTVSDIRHDVQSQIKQTRQTKMQVNQIKKRLEKLHIGGLDNPIXSTTVVVVLIAPAALAALFTVPETLGEDLTQAPPGMSLGQASVASN

SEQ ID NO: 49123 - protein, 67 aa, Sorghum bicolor
  unsure (1)..(67): unsure at all Xaa locations
  Clone ID: LIB3476-034-P1-K1-E7.pep
SASTERGRRDGEEENGDLXCRGGEEEGDIGWRGRAGLGEGDGGGGAKREGDRSVAGPHQHLRATGSA

SEQ ID NO: 49124 - protein, 110 aa, Sorghum bicolor
  Clone ID: LIB3476-034-P1-K1-E9.pep
MVNPLFIFLPLLSVAAVPRAAGTDGPDPCAGRRIHIRSLPPRFNTDLLRHCGADAFPLADPSAAATSTPPCESLANHGLGPRTHPRSRSWYRTDARLLEAFFHRRILERD

SEQ ID NO: 49125 - protein, 71 aa, Sorghum bicolor
  Clone ID: LIB3476-034-P1-K1-F10.pep
AQRSCGAERPRQLALGDSAPDGAPDAPRRASHDGHAIRQRLGVARWQRRCGGGTGSGYGGDVTSVCHCTSR

SEQ ID NO: 49126 - protein, 124 aa, Sorghum bicolor
  unsure (1)..(124): unsure at all Xaa locations
  Clone ID: LIB3476-034-P1-K1-F4.pep
LKTQPGPRASPTQCSIKRDKTSSTVYLYLGFTSSPEGKGKCLMAATRIRRCSHTEYIISLGSEDLSQGRHAYIGQLRTDFWGTNLKIIHSQPPFXRCXALSRLSRRLFGSMRISPQVSAGNYGD

SEQ ID NO: 49127 - protein, 194 aa, Sorghum bicolor
  Clone ID: LIB3476-034-P1-K1-F6.pep
RTRGVIIGEPGVGKTAIAEGLAQRIVRGDVPEPLMNRRLISLDMGALLAGAKIRGEIEERLKAVLKEVTASNGQNILVIDENHTGVGARAAGGAMDAGNLVKPMLGRGELRCIGATTLDEYRKYIEKDAALERRFQQVYCGEPAVEDTISILRGLRERYELHHGVKISDGALVAAAVLSDRYITGRFWPTKPLI

SEQ ID NO: 49128 - protein, 109 aa, Sorghum bicolor
  Clone ID: LIB3476-034-P1-K1-F7.pep
MLESNCQSCVVETSNAVSISMLVSVDDMECSSNISSQEFLKPVSTCIYFPVCKELVAAQRIQNAYRRYLNNRNRITAAIKIQSQWRCYSVRKGFTKQVQAIVGIQTSIR

SEQ ID NO: 49129 - protein, 31 aa, Sorghum bicolor
  Clone ID: LIB3476-034-P1-K1-G11.pep
KVHSKKASIYFSIEINAPNKDALILVLKLFN

SEQ ID NO: 49130 - protein, 174 aa, Sorghum bicolor
  unsure (1)..(174): unsure at all Xaa locations
  Clone ID: LIB3476-034-P1-K1-H6.pep
KKAEVKMLLRMLQAYYNHVRAFEDTLVTKFFGLHCVKSGAHQKKVRFVIMGNLFCSDHTIHRRFDLKGSSLGRITDKPPAEIDEYTTLKDLDLNFIFRLQKHWYQEFQRQVDKDCEFLEQEKIMDYSLXVGVHXRGAIDIDGDKPATLCVSRWDRDLFXSDPNRWSKXKLGANM

SEQ ID NO: 49131 - protein, 79 aa, Sorghum bicolor
  Clone ID: LIB3476-035-P1-K1-A12.pep
MSAHLAVALFLALAVVPSARGSDVPSFPLSQAQSPSNSSSPSNSCSPPCHLDLSAELFGGVAEACGAGGGPASLDRGHC

SEQ ID NO: 49132 - protein, 152 aa, Sorghum bicolor
  unsure (1)..(152): unsure at all Xaa locations
  Clone ID: LIB3476-035-P1-K1-C10.pep
RTRGGWFAKFPQYKGRDLYITGESYAGHYVPQLAQRMVEFNKKEKLFNLKGIALGNPVLEFSTDFNSRAEFFWSHGLISDSTYNIFTTVCNYSRYVSEYYHGSLSTACDRVMSQVTRETSRFVDKYDVTLDVCISXVLMQSQILAPQQGAGA

SEQ ID NO: 49133 - protein, 55 aa, Sorghum bicolor
  Clone ID: LIB3476-035-P1-K1-C11.pep
WPPHAPTSQQHGACIHGGTQHPQITVNLICRSITYCISVLLYTWIYSCCLHASSS

SEQ ID NO: 49134 - protein, 94 aa, Sorghum bicolor
  Clone ID: LIB3476-035-P1-K1-C12.pep
CKLIKCLSMYVHAVGSAGHGAEAPAWGLLWPAHAATSPRPAAWSHAASRHRPLTVNLLRTPLHSRTSMGRRSPISRRLGQRSRPGPCEIWRTRG

SEQ ID NO: 49135 - protein, 113 aa, Sorghum bicolor
  Clone ID: LIB3476-035-P1-K1-C6.pep
MAGGQAPEASPGRYQRRRDEIDDDDCADVLGIDVRGPDADPFDIPAKRAPVERLRRWRQAALVLNANRRFRYTLDLKKEEEKEQIRRKIRAHAQVIRAALLFKEAGEKQNPDT

SEQ ID NO: 49136 - protein, 188 aa, Sorghum bicolor
  Clone ID: LIB3476-035-P1-K1-D1.pep
QHVRLLDSDHQMLTALANTGIEVMVGVPNDQLLRVGQSRSTAADWINKNVAAYTPATNITYIAVGNEVLTTIPNAALVLVPALQFLQSALLAANLNTQVKISSPHSMDVISKAFPPSAATFNSTWSSIMSQYPEFLKNTGSSFMLNAQPYYGYVGGQGRIPLEYALFRSLNPNSQISDPNTNLFIPKC

SEQ ID NO: 49137 - protein, 105 aa, Sorghum bicolor
  unsure (1)..(105): unsure at all Xaa locations
  Clone ID: LIB3476-035-P1-K1-D12.pep
MPGRRAIEVRLLPGGGDAAAPRWRMSLLENTFSGFLLQGAGAGADAAARAVFVGGSLFSPFLFGKFFDPADPFPLWXFESVVLLAALXRGNARTTVDWAETDXEY

SEQ ID NO: 49138 - protein, 149 aa, Sorghum bicolor
  Clone ID: LIB3476-035-P1-K1-D9.pep
RTRGLPPSVLDFNCRSPQELLKRVAVEIFGKMESLHVEVSEFLHRTELNIVNEDEPVKECVQRQIIEMKDLLKMERNEYEILLLPVMRESNHPMQTSIDILELNRLRRGLLLDAYIWDRRLCHVDSVLKAHGHISKTNPNSLDNLLYTR

SEQ ID NO: 49139 - protein, 132 aa, Sorghum bicolor
  Clone ID: LIB3476-035-P1-K1-E2.pep
EPVSVEETQLHHQAAISVEVGTSQTSSEPSSGIHPAAATDGSSSPPVTVVLDTAGDVPWMRCVPCTFAQCADYDPTRSSTYSAFPCNSSACKQLGRYANGCDANGQCQYMVVTAGDSFTTSGTYQLHVLTIN

SEQ ID NO: 49140 - protein, 74 aa, Sorghum bicolor
  Clone ID: LIB3476-035-P1-K1-E3.pep
PPKKKTSRQPENGFTQGMAAPGATDGCTGAARTSSTATTATSPPHMVVTWGGPRAPHHQRTGTGARLRANMPRQ

SEQ ID NO: 49141 - protein, 125 aa, Sorghum bicolor
  Clone ID: LIB3476-035-P1-K1-E4.pep
EHRRTLSFRSIQSRSSSQAPSRVGSGMDIDSLSSSEHHTSSSSSQWEESFTLAGVHQHASAGCPELFTLELTQHHRVQLIFIILNDPGASHEPHQPWSTHSGWEDQATYEQGESSTSTGWGTFLT

SEQ ID NO: 49142 - protein, 51 aa, Sorghum bicolor
  Clone ID: LIB3476-035-P1-K1-E8.pep
KPALHGISVLFSASGEACNDIMAYSLILSCCCYTCCVRRKLRQKLDIAVNI

SEQ ID NO: 49143 - protein, 176 aa, Sorghum bicolor
  unsure (1)..(176): unsure at all Xaa locations
  Clone ID: LIB3476-035-P1-K1-F12.pep
MPSPSRAPTTSAPVKKRSLFTGLLSSPFSKASLKQTSPSKPVASAFRRTASPTPARRSTEVPASAGNTLFKASSGGCGVDGDMKFKLPVPAAIKSEDEHQLRLLYTRELQWRLVNAQLGAAISXQTMGAEKXVCGAMDLILRMRKSVAIRKMQLQLLRNNCKLMAILRGQMXYPGR

SEQ ID NO: 49144 - protein, 102 aa, Sorghum bicolor
  Clone ID: LIB3476-035-P1-K1-F6.pep
TTAFLQAPVPAAAVAVRSSMDGMQPGGGGGHGYSAHGDGSKRSSSPPGGYRSGQGPSAPRCPKCLKMEKRFLKLEKQIKKLKLRQFYLGKKVWVHGSKLYDL

SEQ ID NO: 49145 - protein, 49 aa, Sorghum bicolor
  unsure (1)..(49): unsure at all Xaa locations
  Clone ID: LIB3476-035-P1-K1-F8.pep
QIIHLGVYKSSDPGICQIYKIPVNXILICAYRLHMKKSTLDKEKNSMQN

SEQ ID NO: 49146 - protein, 67 aa, Sorghum bicolor
  Clone ID: LIB3476-035-P1-K1-G10.pep
DHIVINLPQYINSRDFCPCQSFHTAQRYTSIRNNLSITPPKSTLTGPEYKTYADYYIDHEYTCPNRT

SEQ ID NO: 49147 - protein, 109 aa, Sorghum bicolor
  Clone ID: LIB3476-035-P1-K1-G8.pep
TGSGSRPPLPWCSWSYARASRAPAPPAAASALAAALATTPTTASSSDPPRAPPPPTTPASPRTPRQPCSPSPPRPPPPPPSWAAAPASWPCRRTPPRRSSRAWPVASSC

SEQ ID NO: 49148 - protein, 159 aa, Sorghum bicolor
  Clone ID: LIB3476-035-P1-K1-G9.pep
QSPGHPSTVEKNQDHEDSKHSGPSDESEPNQLRESAGDLPDGSASSSSPTKIDKSSDTETGESIHTGKEDTSDGNASQSQPAESTLASPDNITEADDKIAQEYDAPKELSSPQENSDTVDRVTHLEVKLHDGNINTEKSEDERNKMEAGEASVVYRRIM

SEQ ID NO: 49149 - protein, 113 aa, Sorghum bicolor
  Clone ID: LIB3476-035-P1-K1-H9.pep
GRGNSGSDTEKKVAEDGNASGPKIPPRPHGNRLESFRQQFHHLRPISRRFGDTHGLLSTWRRIFDQHLVNSMSRLEAPPEPSVSETAQHASRLGRMTTKLRARRLQREAENPT

SEQ ID NO: 49150 - protein, 132 aa, Sorghum bicolor
  unsure (1)..(132): unsure at all Xaa locations
  Clone ID: LIB3476-036-P1-K1-A4.pep
NNWNGAVYDVNIGGFNNNLHCLARCVSAIVGGSEYTRVEREQRINSLSNGHTDELQEAELPSRVSAEANIKSSMQIYVKLSAGIVLDSWNDTSXPHIVPKLIFLDQLCELXPYLPKSTLEVHIPYTILRSIY

SEQ ID NO: 49151 - protein, 138 aa, Sorghum bicolor
  unsure (1)..(138): unsure at all Xaa locations
  Clone ID: LIB3476-036-P1-K1-B10.pep
IXETMTANGFEIDVVTYGTLINGLCKAGRTQVALKLLRGMRIKGIRPTPKAYNPVIQSLFRRNNLRDALNLFREMTEVGEPPDALTYKIVFRSLCRGGGPIKEAFDFLVEMVNKGFMPEFSSFRMLAEGLLNLGMDDY

SEQ ID NO: 49152 - protein, 119 aa, Sorghum bicolor
  Clone ID: LIB3476-036-P1-K1-B12.pep
GRYSHEEEEEEENQRSLLRRTTIGNGPPESLYDWTRENDLGISNQGSPDQVFSRGHWRLVRCQNGKNLYFARLRIFEELQDVDYLARSCSRAMKAVGVVEASCEAIFQLVMSMDTTRFE

SEQ ID NO: 49153 - protein, 58 aa, Sorghum bicolor
  Clone ID: LIB3476-036-P1-K1-C12.pep
MGVNGHHEPRRGCNGTVCNGSVRPLDHFGDVDPWTAWAYKPRTISLLLMGTCFLIWAS

SEQ ID NO: 49154 - protein, 106 aa, Sorghum bicolor
  unsure (1)..(106): unsure at all Xaa locations
  Clone ID: LIB3476-036-P1-K1-D11.pep
VLKPDILAPGNLIWAAWAPNGTDESNYAGEXGFAMISGTSMAAPHIAGIAALIKQKNPKWSPSAIKSALMTTANTLDKGSHPLRAQQYTASEMMTLSRATPFDCGS

SEQ ID NO: 49155 - protein, 147 aa, Sorghum bicolor
  unsure (1)..(147): unsure at all Xaa locations
  Clone ID: LIB3476-036-P1-K1-E5.pep
QPTLVRSSLNSDPRNAQALRPAXCIQPTCFMPKLFGQRSKKSSGGGSAKKSKGAEPCRQQQAPTGLPELVVEPTGARSMSFVGTHEYLAPEIIKGEGHGSAVDWWTFGIFLHELMYGKTPFKGQTNRATLFNVVGQQLKSRTPHEHA

SEQ ID NO: 49156 - protein, 167 aa, Sorghum bicolor
  unsure (1)..(167): unsure at all Xaa locations
  Clone ID: LIB3476-036-P1-K1-E8.pep
AQSSTKGQIFRGSKIKVEEQEECSSISNARKEQENEDLSPLSVLEPTSLSESCWSSECSGSSSGGKGYSSLFDIKNAQGNFLINPASVDIEAKTTDSASSASVDTSDISDVTQCSKRSRHTELEYIADVLSGVNLTTDELXSLFVNQDTSALDPXLFEKMENIHVYT

SEQ ID NO: 49157 - protein, 183 aa, Sorghum bicolor
  Clone ID: LIB3476-036-P1-K1-F5.pep
FQPVIIFSFSRRECEHHAMSMSKLDFNTEDEKECIEQVFRNAIGCLVEEDRSLPAIELMLPLLKRGIAVHHSGLLPIIKELVELLFQEGLVKALFATETFGMGLNMPAKTVVFTSVKKWDGDTNRYIGSGEYIQMSGRAGRRGKDERGICVIMIDEKMEMSVIKDMVLGKPAPLVSTFRLSYY

SEQ ID NO: 49158 - protein, 38 aa, Sorghum bicolor
  Clone ID: LIB3476-036-P1-K1-G3.pep
RGAMHQRECTSWENLMNDETLTPEARAYLREEGHLHAA

SEQ ID NO: 49159 - protein, 126 aa, Sorghum bicolor
  Clone ID: LIB3476-036-P1-K1-G5.pep
ETMVWSRVKTHGHHPSPRAGCCGALCGTKWYIAGGGSKKKRHPETWVFDVLESKWSVCVVPPSSSITTKKGFSMVPLYYRDKIALVAFGGNKKEPSDKVEVLVVLQNEHCFSWRSAPDVEPLLYDD

SEQ ID NO: 49160 - protein, 142 aa, Sorghum bicolor
  unsure (1)..(142): unsure at all Xaa locations
  Clone ID: LIB3476-036-P1-K1-G6.pep
KSALRSSTDTIEINPFVQPPSLPTSTHPXRAPPAAGPSSPXXXPPXPXVGYWESRVRKPDTSKETRSPALSPPPQAANFRSXPAPTDAFPSRLPESSDQGDKSEDTTPXPKLKPLHWDKVRASSDRVMVWDQLKSSHSGNER

SEQ ID NO: 49161 - protein, 69 aa, Sorghum bicolor
  Clone ID: LIB3476-036-P1-K1-G7.pep
RVQAAVHTEMYREKLHNTLHDTKGEMKVYIRVWSLVTNELRTESCAKRYANSGQSIGLGHDAQRYAHSY

SEQ ID NO: 49162 - protein, 107 aa, Sorghum bicolor
  Clone ID: LIB3476-036-P1-K1-G8.pep
RASTSTGCCIGRRNDGSDSSEYSASSDGECEDEEDLKKRGSFIGRSTPQEHGGSKKHSLPQQQQAAPAPATLVTVDGDGELEMETLLKASAYILGATGSSIVYKAVL

SEQ ID NO: 49163 - protein, 101 aa, Sorghum bicolor
  Clone ID: LIB3476-036-P1-K1-H1.pep
ARAQPPVEAPHQVRRRRLALAGAARHRRGLDGHHHRSHPGSRTGRTTPRRAPQRAGDGAENKRCAARGARACSARPACPWRPGQSFCLVVKDPQRWFVRVC

SEQ ID NO: 49164 - protein, 141 aa, Sorghum bicolor
  Clone ID: LIB3476-037-P1-K1-A7.pep
PNQFPCPPEPEQRAQPWNCGPPAHSYPERYQYGGHDRGHHGYDRRPYFDDRGQMHHEVMDGGRFPSFFPPGPPCPDHFEAPPPNQFHCGRPLDPPPGPCSGWPMPHRRSKYPPDSRHSMEPPVSNGGGWRTHGRRDYDRYH

SEQ ID NO: 49165 - protein, 124 aa, Sorghum bicolor
  unsure (1)..(124): unsure at all Xaa locations
  Clone ID: LIB3476-037-P1-K1-B9.pep
MSMAFSCAGARLHGRTGVGGAKCRPGAAALLGRRGSSCFPATARRWSTAFPRGIRADLPPPRASADGGGATSGPAAVAVPEAXDATEQVAXAXAQPAVVLPERLDVDDGAGGNGXLPPAAGGGG

SEQ ID NO: 49166 - protein, 161 aa, Sorghum bicolor
  unsure (1)..(161): unsure at all Xaa locations
  Clone ID: LIB3476-037-P1-K1-C9.pep
AGLQNIFLMNTLYYVVQKVREXPALRELVGDDWLRRHRGQIRQYETGYLRASWTAVLSQLRRDDGASARPPAGHRAPSGPSAKSFNAAFQELYRTQTAWKVADVQLREELRIAVSERLIPAYRAFLGQGSRHPARHVKCSLEDLEDYMLDFFEGAQKFVRW

SEQ ID NO: 49167 - protein, 166 aa, Sorghum bicolor
  unsure (1)..(166): unsure at all Xaa locations
  Clone ID: LIB3476-037-P1-K1-D5.pep
DAWAYEDPDTRFPLIFHPFNDALNKDHDVMMAIITPRAIPVNFFGSGKASNLTYEFYNPSALARQLAFGQLPIALCYANVIKPREIITNNLEWIRVAQLPPNADTDVDLSAWIPALFITQAYKQWWEEWKEHLFCRLALTYRGMIDXQYKVLDNTVDGIAPLVSRS

SEQ ID NO: 49168 - protein, 166 aa, Sorghum bicolor
  unsure (1)..(166): unsure at all Xaa locations
  Clone ID: LIB3476-037-P1-K1-F5.pep
MGPLEPPPSSEPEEDGDDATAVTRSRSRSKSKSQHLTVMKAAGTVGYMDPEYYGLHHLTVKSDVYGFGVVMLESLTGRRAIFKEAEGGSPVSVVDYAVPTIVGXELAKVLDPRAPEPAPHEAEAVELVAYTAVHCVRLEGKDRPAMADIVANLETAFALCEGSAGS

SEQ ID NO: 49169 - protein, 113 aa, Sorghum bicolor
  Clone ID: LIB3476-037-P1-K1-G6.pep
THRSLKSQPSSDSTFHIFCDIFVSVFGCAFRQFWTGCDLQLVKSLTVIWHPRPGRAGSPSSLCDRRFTNGRVALWSPCGSASGTVRSRSEAPGTVTVVVVVRTPSLAGSPSIG

SEQ ID NO: 49170 - protein, 180 aa, Sorghum bicolor
  unsure (1)..(180): unsure at all Xaa locations
  Clone ID: LIB3476-037-P1-K1-H1.pep
PPPCKEEEAPPPLIEDHTAVSTGPPVKKRQRGRQQNRQPKSPKPKKPKKAAVPVEDGAPNGHAPRRRGPKKTVGMVINGIELDLANIPTPVCSCTGSPQQCYRWGAGGWQSACCTTSISMYPLPMSTKRRGARISGRKMSHGAFKKVLEKLAGEGYNLANPINLKTXWAKHGTNKFVTIR

SEQ ID NO: 49171 - protein, 156 aa, Sorghum bicolor
  unsure (1)..(156): unsure at all Xaa locations
  Clone ID: LIB3476-037-P1-K1-H12.pep
MFTVRGSRPSGQTIPKKFSDMRYSNVSWTFLLLLCFVSMADAEYMKYKDPKQPINSRIRDLIGRMTLAEKIGQMTQIERQVASANVMKKYFIGSILSGGGSVPAPQASPAIWVNMVNEFQKGALSTRLGIPLIYGIDAXHGNNNVYNATLFPHNIG

SEQ ID NO: 49172 - protein, 158 aa, Sorghum bicolor
  Clone ID: LIB3476-037-P1-K1-H3.pep
AHRPANKPAVYGEGFVETLVHTPDACANDCEEDEDGVEHMMVHMVIRRDVKIDDPVANHDCPNNDHIDGDVDGLKNEHHYIERDMKMNMHMYSDIDSVVEVTAKTTDNSKDHEECQDECDLSLELKLRSHDSIPDWMNQEAHPAAPAACAGAMLGDML

SEQ ID NO: 49173 - protein, 192 aa, Sorghum bicolor
  unsure (1)..(192): unsure at all Xaa locations
  Clone ID: LIB3476-037-P1-K1-H6.pep
TRDEGWQSSSHTSDFGWMQMAEPVMNLYTESTDGSYIETKETALVWHHQDADPGFGSSQAKEMLDHLESVLANEPVAVKSGQFIVEVKPQGVSKGLVAEKILTLMKEKGRQADFVLCIGDDRSDEDMFENIADVMKRNNVAPKTPLFACTVGQKPSKXRVYLDDTFEVVNMLSLLADASEPDPVIELEEDDL

SEQ ID NO: 49174 - protein, 55 aa, Sorghum bicolor
  Clone ID: LIB3476-038-P1-K1-A1.pep
GLDGLDLRAGSYIQRLSRRHAELGQTARAPWTVAPPNLTSRSWRQQSLLACSLVW

SEQ ID NO: 49175 - protein, 108 aa, Sorghum bicolor
  Clone ID: LIB3476-038-P1-K1-A11.pep
RSCYSHPAKTKPSYPSSSSSPKPKNPKGPRGPPYPAPEHQQPPKIPSYPSVTRSPVVGPPKGPVTRSSVTLSLVVGPPVTYPPIIGLPVTRSSVVGPPLTYPTITVLS

SEQ ID NO: 49176 - protein, 41 aa, Sorghum bicolor
  Clone ID: LIB3476-038-P1-K1-A12.pep
ACSSVANYAKSKEHECGHICMVNKDQKLEHEILFSLMDNKL

SEQ ID NO: 49177 - protein, 128 aa, Sorghum bicolor
  Clone ID: LIB3476-038-P1-K1-B1.pep
SAGVRLEDMSNQLRKRIMKKRRVKTLSFAITNDVCIEVNTYALVRPTTPGTITWLDSLSNLPLKAERSFICNDTGALLQDAQTRFQMYNDTTVKFSVRELSEVKRVASHHLRLLGFKPLDCLKDYHNL

SEQ ID NO: 49178 - protein, 93 aa, Sorghum bicolor
  Clone ID: LIB3476-038-P1-K1-B5.pep
GLLLLGPRIGLETGALAVAGGGRRVVAGSGQGAAGARAALALPRQRVHAEGIGTLGGGDGVLLAPLACHGWCRGRGVRRRAALEWIGKVGGGA

SEQ ID NO: 49179 - protein, 80 aa, Sorghum bicolor
  Clone ID: LIB3476-038-P1-K1-C1.pep
VSSSFISVCYHVARHFGIPWFEPFSFSFSLLYPILTSVLSGFVYRAFLISGSVVSTSSICMCACTFLSKAFAYVLLECST

SEQ ID NO: 49180 - protein, 131 aa, Sorghum bicolor
  Clone ID: LIB3476-038-P1-K1-C4.pep
ATGRFEFDPIDRSPPSPLVASSISRRRISSGHRAHSTSRSEGVLPGLEPLLPSPLLGRRRAETQSEIELTSSFVASPSGEAMSGVITKFAVTSMVMWMAPVAIMYGFYYQVFPGSASVPVFIAAWCTPSIW

SEQ ID NO: 49181 - protein, 116 aa, Sorghum bicolor
  unsure (1)..(116): unsure at all Xaa locations
  Clone ID: LIB3476-038-P1-K1-C9.pep
ALAEEEGLVPCCNDSPMVPNDNQWCVDALGSVLEKRVVNLTHRNTTCDTWLCLCGIRLHEIGSLRCPFVLADMTGATSNNATPTVGANDLIKSXRNAFYIGCFRSVQSLQKLKGER

SEQ ID NO: 49182 - protein, 166 aa, Sorghum bicolor
  Clone ID: LIB3476-038-P1-K1-D5.pep
GRVGSVSRWAFEQGLVCSPNNWNCMEKLLEVLIAISDEVACLSVANLILKSWPSHHRALHVKKTIECAEPVPFAPRGIDILEPKHAKLIFSNKRKSVDDEICQEIGTKKSKQSATLQLNEAKWLALLDGILSFISANNEKAGEYNCTNTVDRCQSARVVTRGLLIT

SEQ ID NO: 49183 - protein, 166 aa, Sorghum bicolor
  Clone ID: LIB3476-038-P1-K1-D7.pep
QELIARDIHDVEWKFRHIFRGQPKRHLLTTGWSVFVSAKRLVAGDSVLFIWNEKNQLLLGIRRASRPQTVMPSSVLSSDSMHIGLLAAAAHAAATNSRFTIFYNPRASPSEFVIPLSKYIKAVFHTRISVGMRFRMLFETEESSVRRYMGTITEVSDADPVRWPSF

SEQ ID NO: 49184 - protein, 146 aa, Sorghum bicolor
  Clone ID: LIB3476-038-P1-K1-D8.pep
ANRQSAARSKERKARYITELERKVQTLETEATTLSAQLTLFQRDTTGLSAENAELKIRLQAMEQQAQLRDALNDALKQEVERLKIATGEMSKSNEQFNMGMQHISYSPSFFQLLEQHTVQQHGNIQLAHHFQQPPPNVPSHQMLFH

SEQ ID NO: 49185 - protein, 142 aa, Sorghum bicolor
  unsure (1)..(142): unsure at all Xaa locations
  Clone ID: LIB3476-038-P1-K1-E2.pep
VLDDVWNNDNRXIAIEQENWQKLLAPLNKGAIGSKILLTTRSSIVAEMLQSSYIISLETLQVNDCWSLVKTSVFDETEHTINSKLENIGRKIAETLSGLPLAAKVVAGHLKQCFAYCAMFPRNWEFEAEQLILLWIAQGFVH

SEQ ID NO: 49186 - protein, 151 aa, Sorghum bicolor
  unsure (1)..(151): unsure at all Xaa locations
  Clone ID: LIB3476-038-P1-K1-E5.pep
RKHSLQTPGKEGGHDGLVFMNDTIYIDPAISDEMRKKISDAATREGAKLLEHWFIGCPATYIVCEDASVKRYVGHSDNIVTPLWILKTVKEKNLQRLVHLSSDLARHVAMVLENVQTSEENRKLXSVPSISTSSCGRPSTQEEXDEVHQER

SEQ ID NO: 49187 - protein, 53 aa, Sorghum bicolor
  Clone ID: LIB3476-038-P1-K1-F2.pep
YKELIPHKVCSNLKSMRCIIRHKRYIVLIHNQNQIVIWSSGRLEWSRRTFGTS

SEQ ID NO: 49188 - protein, 147 aa, Sorghum bicolor
  unsure (1)..(147): unsure at all Xaa locations
  Clone ID: LIB3476-038-P1-K1-F4.pep
MSNEFDYLFKLLLIGDSSVGKSCFLLRFADDSYVDSYISTIGVDFKIRTIEMEGKTIKLQIWDTAGQERFRTITSSYYRGAHGIIIVYDITDMESFNNVKQWLSEIDRYANDTVCKLLVGNXCDLAESKTVDTSVAQAYAEEIGIPF

SEQ ID NO: 49189 - protein, 173 aa, Sorghum bicolor
  Clone ID: LIB3476-038-P1-K1-G3.pep
RLKELVDFKMDGKGKKAAVMIQNLEAENSALKLELEKAKAAEEKAVQLERLVNELKSDADDARKSGSESELLADEWQKKAELLEVRLEEADQSNILKGESLNSAMEELDSTSSLLRDRESEVAALRDKVTFLEDELAKLKGDIDVSGKRANAAEKEAADLWTEVEGLRLKLRT

SEQ ID NO: 49190 - protein, 111 aa, Sorghum bicolor
  unsure (1)..(111): unsure at all Xaa locations
  Clone ID: LIB3476-038-P1-K1-G7.pep
MAHVDRPPSRAVLAVAVAAAALLLVVAAGAPRAAGQTTTTTTVVDPDSWADRGAACTVEECGMARRELGYGGYISYDAMSRGRVPCSYSGAFYYNXCRPGAPANPYFRGCS

SEQ ID NO: 49191 - protein, 142 aa, Sorghum bicolor
  Clone ID: LIB3476-038-P1-K1-H1.pep
GFELHCNKSQDGQRNTTYLFNMPVANILLLQGQVRVMSYIASMCHNRSTTTFLDLAGTPFTVSEKENVFTVVGVDTLGLMAGTRQSAIYVIGCQTEESSPKNLAAVEGCTGVGCCQVALSSNVSYQQFSFGNSTSDRNISAI

SEQ ID NO: 49192 - protein, 184 aa, Sorghum bicolor
  Clone ID: LIB3476-038-P1-K1-H10.pep
EPVAKSRWEPVAEENVANNVEISNELAKINVCSSFEPTKRTSNNWDLRKHVQCQAPLSQFSHRPTKMQRTGGDASLTENGNALSDADKEQDLMKYYTSSIAQANSPEEKKRREHRSKRFEQSQGTPSKSRSSIPDKVATDNIYTSRAMSLLFNRSNGDSAGLAVEDYDWDALTIKGTCQQIEKQ

SEQ ID NO: 49193 - protein, 41 aa, Sorghum bicolor
  Clone ID: LIB3476-038-P1-K1-H11.pep
SDSLWIKRMLSHMIILAEIACSLSDPQDGLVCPYGLEVSIE

SEQ ID NO: 49194 - protein, 157 aa, Sorghum bicolor
  Clone ID: LIB3476-038-P1-K1-H9.pep
DAWAKVMKGGWLPFAISLVLALVMFTWYDGRQRKAEYEMANKVTPERLGELLAGPDVRRVPGLCFFYSNMQEEWRWLTPVLAHYIKNMRSLHRVTVFVTLRYLLVAKVDAKSRVVVRRLGSRGVYGCTIHYCYADPLDEEEGDGLSGQVVLGVREHI

SEQ ID NO: 49195 - protein, 138 aa, Sorghum bicolor
  unsure (1)..(138): unsure at all Xaa locations
  Clone ID: LIB3476-039-P1-K1-A5.pep
RLGSISEFLSRALQSPESLSVQNAIEYLKVIGAFDQNEELTVLGKHLSMLPVEPKLGKMLIFGAIFNCLDPILTIVSGLSVRDPFLTPFDKKDLAESAKLQFSCRDYSDHLALVRAYQGWREAXRDPAGYDYCWKNFL

SEQ ID NO: 49196 - protein, 97 aa, Sorghum bicolor
  Clone ID: LIB3476-039-P1-K1-A8.pep
MMVVPYLYAEIGKRTKDLLYMVYLSDHIFILSTYTFYVVAVTASSTKNVVLIFGVIQSHIYIMNITVDVISYFESNFITSVSCDEIASSGLKSIFCF

SEQ ID NO: 49197 - protein, 46 aa, Sorghum bicolor
  unsure (1)..(46): unsure at all Xaa locations
  Clone ID: LIB3476-039-P1-K1-A9.pep
TVYSLSNDSNCLLLSRPPNNIXYSAQIHSWVAAMGSTNSFLQIYPF

SEQ ID NO: 49198 - protein, 134 aa, Sorghum bicolor
  unsure (1)..(134): unsure at all Xaa locations
  Clone ID: LIB3476-039-P1-K1-B10.pep
ISQFRFLERLLVVHGHWCYKRIAQMICYLFYKNIAFGLTIFYFEAFAGFSGQSVYDDWFMLLFNVVLTSLPVISLGVFEQDVSSEICLQFPALYQQGPKNLFFDWYRILGWMGXGLYSSLAIFFLNLCIFYDQA

SEQ ID NO: 49199 - protein, 140 aa, Sorghum bicolor
  Clone ID: LIB3476-039-P1-K1-B2.pep
RSGGATAKLPRLRYGYILWRYVVRTLRRVEARVTNRWVRRSYLEQWNTSVQLDPMLPFAFTSLDDIVSPCATADGHDISFCPICDCEVKLRSKHCMTCERCVDGFDHHCRWLNNCIGRWNYATFIRLMFFVPLMLGIEGG

SEQ ID NO: 49200 - protein, 66 aa, Sorghum bicolor
  Clone ID: LIB3476-039-P1-K1-B5.pep
NRESKASSYLQTTQQLNYQRSSIIANSTHAPIPECALLQEQIPISGSNSIQRRTSTRSDRRRVRIS

SEQ ID NO: 49201 - protein, 125 aa, Sorghum bicolor
  unsure (1)..(125): unsure at all Xaa locations
  Clone ID: LIB3476-039-P1-K1-C10.pep
FDEMCKKGLKPNATTFTTALAGFYKEERFDDVGKVLELMKKNGCGESLPVYNVRVQSLCKLGRSGEARALVDEMVKKGTKPSWVTYNHLIYGFWKEEDLEEAXRLYKEMGRKVLVGEINFYIMLI

SEQ ID NO: 49202 - protein, 111 aa, Sorghum bicolor
  Clone ID: LIB3476-039-P1-K1-C2.pep
MASSGNGSIAAGIAKRWRELHGENSWKGLMDPLDLDLRKTIISYGELAEATYDGFNTERRSPHAGACIYGYSDLLASSGVAAAGHYEVTRFIYATSGQPLPDAFLVRPLAA

SEQ ID NO: 49203 - protein, 171 aa, Sorghum bicolor
  Clone ID: LIB3476-039-P1-K1-C4.pep
ASILPRGDQTIKGPVVRLFKPFDELFADSRDFDTDALEKFIDVSGFPAVVTFDADPTNHKFLERYYSTPSAKAMLFLNFSDDRVEAFKNQIQEAAKKFSANNISFLIGDVEAADRAFQYFGLKENDVPLLFVIAQGGKYLNPTIDPDQIIPWLKEYIYGNTPYCKSEAIPK

SEQ ID NO: 49204 - protein, 158 aa, Sorghum bicolor
  Clone ID: LIB3476-039-P1-K1-C8.pep
VKQDNRRELSAKVEQLEQELSELRQALSDRQEQEQAMLQVLMRVEQEQKVTEDARICAEQDAAAQKYAAHILQEKYEEAMASLTQMENRAVMAETMLEATIQYQSIQQKAQLPSPSPSPRTLTRDASPGQGNQDSIQEFQPRMISLLAPFFLGWRDKN

SEQ ID NO: 49205 - protein, 158 aa, Sorghum bicolor
  unsure (1)..(158): unsure at all Xaa locations
  Clone ID: LIB3476-039-P1-K1-D10.pep
VIAECRKSYGLGTRQGTNLGPTLDKAQAAKIQEQEGLLRAAVNYGEGLRVPGDQRQPQSLPSHLIEVLPLGDGAQNFGDSSGSYPKNTSTFAPNNVNNQGNQASGGQLLGRPAPSPGTTGTPNFENVSTPSMPYANSXRXGTNMMNTPSPQQHLTPQQ

SEQ ID NO: 49206 - protein, 120 aa, Sorghum bicolor
  Clone ID: LIB3476-039-P1-K1-D2.pep
GWACLHFQYEYIKLEETRKELMIRVKNKKKLLQEIERQFDDLQNIKFRNQLLQRPAESANGICLPFLLVKASRKARVEIEISENSKFAGFDFNCTPFTLHDDVSILEAIRCNNYCIKRAS

SEQ ID NO: 49207 - protein, 108 aa, Sorghum bicolor
  Clone ID: LIB3476-039-P1-K1-D7.pep
LNPNLLCCLAFCFRQQENQEGTSAELVGLATGESKGENTSIRLCFLNELKTPVYHDDEIKSESNTAIKVGIFNGDKMIESGGLSNLQMEIFRLDGDFSYAFPKSWTSK

SEQ ID NO: 49208 - protein, 99 aa, Sorghum bicolor
  Clone ID: LIB3476-039-P1-K1-D9.pep
MQQGDGTEAQVTWEDQQNINRFGRLNNRLHELQDEIKLAKETNENLDDAGNELILSDEDVVRFQIGEVFAHMPRDDVETRLEQMKEDAAKKLERLEEEK

SEQ ID NO: 49209 - protein, 49 aa, Sorghum bicolor
  Clone ID: LIB3476-039-P1-K1-E12.pep
TRLEHNDPVPATAHVPSRAPALVTLAAGACRLHVHDDQLSIDETMATRH

SEQ ID NO: 49210 - protein, 102 aa, Sorghum bicolor
  unsure (1)..(102): unsure at all Xaa locations
  Clone ID: LIB3476-039-P1-K1-E3.pep
CKAVMLDEIINYVQSLQRQVEFLSMXLATVNPELGFDIEQIISKQMMLSQDRQFAFYGVDPGSSRLTAPFNQGIMQPEMMCNIFKPGDVLHGTIHDLSTMNQ

SEQ ID NO: 49211 - protein, 141 aa, Sorghum bicolor
  Clone ID: LIB3476-039-P1-K1-E5.pep
GSWLKSFSALLRAMPDVVKFIDPLPGDRGAGAAVVGVFKRSRDSAPSSIPEKCNKEVKSEEPSPCTEKRTLQAEVPPYPSDQSSRDNRKAPGFTQRPKPPFKPEGTDVTRAEDVPAPPSDAPSIDQRIDVAVDPVMQTERP

SEQ ID NO: 49212 - protein, 87 aa, Sorghum bicolor
  Clone ID: LIB3476-039-P1-K1-E9.pep
STQGIPHSLPSLRNKEEACSEGFVNMKYLVCAVPCTLDAYLLGALEHGLNALLNVPIRASKLQIRASARPPLQAENLPHGVLAPPGS

SEQ ID NO: 49213 - protein, 116 aa, Sorghum bicolor
  Clone ID: LIB3476-039-P1-K1-F11.pep
MALPGAVVRLALLLLVALPFCGAHPGPGGFPAPRHSQRPALHSDGFGLLARRSIAEAPTDINVTTNSSFVLAADRTYRKDPLNGFRKYPGGWNISEVHYFASVGYTAIPLFAIALA

SEQ ID NO: 49214 - protein, 62 aa, Sorghum bicolor
  Clone ID: LIB3476-039-P1-K1-G12.pep
MEMTDMKPEEMSHPPMDQLLGMEYCIDSNPSWGGAVLLGFQHFILCLGTAVMIPTLLVPLMG

SEQ ID NO: 49215 - protein, 107 aa, Sorghum bicolor
  Clone ID: LIB3476-039-P1-K1-G7.pep
LAGRPSWHPARSNAGSGSTEGAAKTAARPSAPWRGRGTPPRGLSPGRLLRGWSAAPPLPPPEGAGARRAAARPPPHPPPPRPRPPTAPAPPPAGPPPARRARPRRPP

SEQ ID NO: 49216 - protein, 56 aa, Sorghum bicolor
  Clone ID: LIB3476-040-P1-K1-C2.pep
MSRMCLAIPRETVITLHSEAYHEAGHLLLLVDSTTLINRCHSSMWRSWIPTEFTTV

SEQ ID NO: 49217 - protein, 105 aa, Sorghum bicolor
  Clone ID: LIB3476-040-P1-K1-D1.pep
PTRPLYCMVSGHYPFLGDTLQETYDKIANDPVQIPGDMNPQLADLLLRLLCKDPGDRITLQAAAEHPWVAGGEGPVPEFICRCGFGRRKRNDVREEVNNASDGLV

SEQ ID NO: 49218 - protein, 138 aa, Sorghum bicolor
  unsure (1)..(138): unsure at all Xaa locations
  Clone ID: LIB3476-040-P1-K1-D10.pep
LGYTKKQEERHFRGVIVLEECNLEEIEEEEVSKNSKDSKKANGQEKGPSLVFKITNRVAYKSVLKAHSAVILKAESMADKIEWIKKIKXVFQSRGGSVKGPTEDGSMRQSRSDGSLDTMARRPADPEEELRWMSQEVR

SEQ ID NO: 49219 - protein, 59 aa, Sorghum bicolor
  Clone ID: LIB3476-040-P1-K1-D4.pep
KGFSRASVHALMSEDCVTTRKSPLMCKLRLEPGWPSPHMVIFHMYPTEEPLELQHHCQH

SEQ ID NO: 49220 - protein, 58 aa, Sorghum bicolor
  Clone ID: LIB3476-040-P1-K1-D7.pep
KPITAVLFQESPTPFPSKRLRRSVPPGLPRPVCKAAPSPRVLLYEEELCEAVAQNKLL

SEQ ID NO: 49221 - protein, 72 aa, Sorghum bicolor
  Clone ID: LIB3476-040-P1-K1-E10.pep
LVQPYTVAGQKFLWTISIVRCLLVIAALYSGMLMFDFLFRTLTHVSLPCKMHLILDHLWIIVCFVLVSSMDF

SEQ ID NO: 49222 - protein, 53 aa, Sorghum bicolor
  Clone ID: LIB3476-040-P1-K1-F4.pep
GYLLQWETCLHLMPYTGTKQNHMILTVTRITNQKRNVFIIPRRHSLSESYKSE

SEQ ID NO: 49223 - protein, 68 aa, Sorghum bicolor
  Clone ID: LIB3476-040-P1-K1-G12.pep
LLSTNFIFSKKKNKRHSSNGKCYRNIAMFAISKLMISGNIYPQVEKERKYHKISGHATHSFLPLLVSS

SEQ ID NO: 49224 - protein, 103 aa, Sorghum bicolor
  Clone ID: LIB3476-040-P1-K1-H10.pep
PTSRSRRPRSGGRRRRTSSGAVAGAGAGGGETVTRRCFWAVERFLAHGGERCVREVTSDRALPSLLVSAFHTGDAATKQVAESVLRCLHRMPDYSATYESVEL

SEQ ID NO: 49225 - protein, 68 aa, Sorghum bicolor
  Clone ID: LIB3476-040-P1-K1-H5.pep
MEAQDDCKWRQIPAFGDWNLWDDMPVTQYFQAGTFFFAAPAEKDDEDLFKVPQFPAKPYSYKKCVVRV

SEQ ID NO: 49226 - protein, 122 aa, Sorghum bicolor
  Clone ID: LIB3476-040-P1-K1-H6.pep
PDTRKKNSPLFVSVSEESRRRRRCRARQGPQGLGRAARTAPRCSGHIQASQTGIRAGRRAGERSRAHYRRPRVLRSSGERTATRTYPSTPPKTHRMTCLALSAGRPLRFGLDGGALLLSCYR

SEQ ID NO: 49227 - protein, 111 aa, Sorghum bicolor
  unsure (1)..(111): unsure at all Xaa locations
  Clone ID: LIB3476-040-P1-K1-H8.pep
MEQVFYRALGLSLVGGLSTALGALCVVMNPAPXNLKVLGLLQGFAAGLMLSISFLDLAHNALNSIGFXKGSLWFFAGVLFFGXSLSKFIPEPNFSAPADPSEKKADDAGTV

SEQ ID NO: 49228 - protein, 132 aa, Sorghum bicolor
  Clone ID: LIB3476-041-P1-K1-A2.pep
AHDSSRGATASSGREGRTRRAIHGGRRRHRLFHLSPASSEAGRPSSRSSSARLFLTRPAAMAETAATTSLMIFPLIWPLRGGGGRPALLAPPVVAARPATAGMAGAGTWMVSVAISEGNWGLVGERAEPTRP

SEQ ID NO: 49229 - protein, 51 aa, Sorghum bicolor
  unsure (1)..(51): unsure at all Xaa locations
  Clone ID: LIB3476-041-P1-K1-B6.pep
ETARVRGRTXEGGCRRRSXARRXVWSGGGSPSGSGGATAKKEEFVVRRGIX

SEQ ID NO: 49230 - protein, 114 aa, Sorghum bicolor
  Clone ID: LIB3476-041-P1-K1-C4.pep
AGVVILLMLLVNLELLFSVKLTRRIKVQLDRSRLLSVRDHVRFFFCPSLIFTGNCVANGVSLDVGLVAWEIGLVVRSHLLRWFASSSGCPLHWRAVADTVHSVRPFLHRRRDGR

SEQ ID NO: 49231 - protein, 62 aa, Sorghum bicolor
  unsure (1)..(62): unsure at all Xaa locations
  Clone ID: LIB3476-041-P1-K1-C6.pep
KSAILKATQSLRKAKGXSNGNDEKTDASAADKYPLVSVPDETLTPEQFKGKKKQIFLNHNKA

SEQ ID NO: 49232 - protein, 68 aa, Sorghum bicolor
  Clone ID: LIB3476-041-P1-K1-D10.pep
STLGLSWECLIMMIKSYDYKLFSILCRATSFLYCCSNCVMIYCLLLCKCIFADLYRCLRVMQVVWCSY

SEQ ID NO: 49233 - protein, 42 aa, Sorghum bicolor
  Clone ID: LIB3476-041-P1-K1-D11.pep
SFKVTSNGSCDNLSNNIEIQSLYKRYDIYSVHIPSSLRYKHT

SEQ ID NO: 49234 - protein, 81 aa, Sorghum bicolor
  unsure (1)..(81): unsure at all Xaa locations
  Clone ID: LIB3476-041-P1-K1-E10.pep
VRLSPTAQPPYGAGLASTRCAWVRARRRRRPKQTATRTAARRVATXAPMSWPRRRRPPQQQQPCRNGASSCRSLGPSGARR

SEQ ID NO: 49235 - protein, 59 aa, Sorghum bicolor
  Clone ID: LIB3476-041-P1-K1-E4.pep
LPGLLVSTAPDSLHAGRACFTLAVDSWCPAQQWGQPYTTTHTTSPFCRGGPEERGGMTD

SEQ ID NO: 49236 - protein, 148 aa, Sorghum bicolor
  Clone ID: LIB3476-041-P1-K1-E7.pep
QFAVESPRWLAKVGRFDDAKKVVESLWEPSEVEKSMEEIKAVVVNDDSRGSWSDLLVEPHNRVALIGGSLFFLQQFAGINGVLYFSSLTFRDVGITSGALASLYVGITNFGGALVASNLMDKQGRKKLLIGSYLGMGFAMFLIVYGIS

SEQ ID NO: 49237 - protein, 97 aa, Sorghum bicolor
  Clone ID: LIB3476-041-P1-K1-F6.pep
FIQKHWSAQQLRRAEKQCWRPQRGLPEKSVAVLKAWMFENFLHPYPKDHEKDVLAARSGLSRNQVSNWFINARVRLWKPMIEEMYQDLKGSSGAGGG

SEQ ID NO: 49238 - protein, 57 aa, Sorghum bicolor
  unsure (1)..(57): unsure at all Xaa locations
  Clone ID: LIB3476-041-P1-K1-G1.pep
PTPLLPPPAXSAPPKAEPSLPIPVPSSRRRSNPSHGRADPXPLHSHPTMGASAYPAA

SEQ ID NO: 49239 - protein, 68 aa, Sorghum bicolor
  Clone ID: LIB3476-041-P1-K1-G6.pep
DAWVNPRTSDSSGPEATWKEARVKGSVMLSESARGAKILALDYFSIVLLGVERAESRESVARDVDAEG

SEQ ID NO: 49240 - protein, 46 aa, Sorghum bicolor
  Clone ID: LIB3476-042-P1-K1-A10.pep
LVVYEIFGQSYRGAITYIFITVSMWFMVGTWLFAPFLFNPSGFEQQ

SEQ ID NO: 49241 - protein, 113 aa, Sorghum bicolor
  Clone ID: LIB3476-042-P1-K1-A11.pep
MASTALVAVAVGGGLCPGLVASCSVASCSLRAGGGDSPRLGRRLVLLQRGRGAEGERKKIRNCPIFRCANEVDVVTEDDNVDGDATDDEKDLEAAADDAIDADVDTEDELDSS

SEQ ID NO: 49242 - protein, 86 aa, Sorghum bicolor
  Clone ID: LIB3476-042-P1-K1-A12.pep
MLILNQDTYFNLIHLAWSIVCFRWNLERPAIILKCILILSDARLGIVMSSLALFMALAPRIISCGNKVDTFAMAVLILTCPDVMAA

SEQ ID NO: 49243 - protein, 83 aa, Sorghum bicolor
  Clone ID: LIB3476-042-P1-K1-A9.pep
YTSEFTSSTATWSGTPSRSATGCDGLLYGTVSLTGTFFNTLRNLRREAPKEGTRQGTREVRSAFLRPCQPGADTGTQDERQAY

SEQ ID NO: 49244 - protein, 150 aa, Sorghum bicolor
  Clone ID: LIB3476-042-P1-K1-B10.pep
DRLSDWLKKNPTKEPTDCKDKLEEDYGIKLKYSKAWSGMMAALDKIHGKYEESFQLLFNWAAQIKMVSPGSIVEVEVEKIGKKYRFKRMFVALKPCIDGFIAGCRPFLGVDASSLNGKYKGQLASVTSVDGHNWLYHVAYGIFDSETEEN

SEQ ID NO: 49245 - protein, 93 aa, Sorghum bicolor
  Clone ID: LIB3476-042-P1-K1-B4.pep
EKSTLRRFSWRYIIIDEAHRIKNENSLLSKTMRIYNTNYRLLITGTPLQNNLHELWALLNFLLPEIFSSAETFDEWFQISGENDQQEVVQQLH

SEQ ID NO: 49246 - protein, 76 aa, Sorghum bicolor
  unsure (1)..(76): unsure at all Xaa locations
  Clone ID: LIB3476-042-P1-K1-B6.pep
MAXGQGAKRSILGLLFRAQQQTARPYSSSAFQTHQLSTHVPQDGVFLRRFSSEVSSSEQMNLIKQLRQRTSAPIKD

SEQ ID NO: 49247 - protein, 90 aa, Sorghum bicolor
  Clone ID: LIB3476-042-P1-K1-C6.pep
MGRKRKELLSSAPWRTGEAADDQDPARMSREGKVSVTSNPGETATMSVPRSKRQELDLTVDDFEEDEIDPELRYFFQRNSKFLKKGFSVD

SEQ ID NO: 49248 - protein, 102 aa, Sorghum bicolor
  Clone ID: LIB3476-042-P1-K1-C7.pep
DAWVQITRNLSLDGVLDFLNSKKMTDAGALDLIDDEDSDVEEGIDRQARGNLRLGLPGSMANRGRPIARTKCVKFAPTGRSFAAATTDGVLLYSSDESFIFD

SEQ ID NO: 49249 - protein, 70 aa, Sorghum bicolor
  Clone ID: LIB3476-042-P1-K1-D10.pep
PTRPQGVILSADYSEAGDGRLLLDDGSCIVDLFVLPREAEGGYWRPGTPVLNLAGYLILPYVVRNHKFHV

SEQ ID NO: 49250 - protein, 95 aa, Sorghum bicolor
  Clone ID: LIB3476-042-P1-K1-D3.pep
RTRGSNPRNTTNLLPISISGWPPLSPLRQQPPRRRRHGRAPGRRGAAHPLAAQQRPRRGLLHRRRPLLARLHALSPVALLPAGRLRGRRQRRAGG

SEQ ID NO: 49251 - protein, 92 aa, Sorghum bicolor
  Clone ID: LIB3476-042-P1-K1-E4.pep
VEEEEDERGGAGGRGPHRSKKLRLSKEQSRLLEESFRFNHTPTPKQKEALAGKLQLRPRQVEVWFQNRRARTKLKQTELECEYLKRCFGSLT

SEQ ID NO: 49252 - protein, 84 aa, Sorghum bicolor
  Clone ID: LIB3476-042-P1-K1-E6.pep
GSELTAVAFYDAPLHVVSLNIVKNFVLFGDIHKSIYFLSWKEQGSQLNLLAKDFGSLDWFATEFLIDGSTLSPVGSDSDQNLPN

SEQ ID NO: 49253 - protein, 62 aa, Sorghum bicolor
  Clone ID: LIB3476-042-P1-K1-E7.pep
FYLAEQECRLDLESQNKDLKVNLENWKGKFLDLQEVHCKAKREKDFIISNLLHSGIFFIISN

SEQ ID NO: 49254 - protein, 65 aa, Sorghum bicolor
  Clone ID: LIB3476-042-P1-K1-F11.pep
RTRVRGTQPARSGNPPVDLNRRQDAHLIVGHGQRAFILGRRRRLREPPLRRMPAVLLAAVGHHGN

SEQ ID NO: 49255 - protein, 104 aa, Sorghum bicolor
  unsure (1)..(104): unsure at all Xaa locations
  Clone ID: LIB3476-042-P1-K1-F12.pep
ATSTQYAALICAHAHRQELIHDLYKTWQDXQRGTVTSSMIRXLLISLRKATVQMPLIIIFYRDCVSEGHIYHXLHYELDAIQKACAFLXPNYQPTVTYVELQKL

SEQ ID NO: 49256 - protein, 56 aa, Sorghum bicolor
  Clone ID: LIB3476-042-P1-K1-F6.pep
TKIVCQQIQLRTLVFTTHPIYAFVTLAKLYRVFSNVQAQYMQCGVIEWNGSQFRRE

SEQ ID NO: 49257 - protein, 86 aa, Sorghum bicolor
  Clone ID: LIB3476-042-P1-K1-F9.pep
EDQMAGRSATRLKLGNAVSEGTVNNETLGYFIGRVYLFLTQLGIDKDRLRFRQHLPNEMAHYAADCWDAEIECSYGWIECVGIADR

SEQ ID NO: 49258 - protein, 122 aa, Sorghum bicolor
  Clone ID: LIB3476-042-P1-K1-G10.pep
GKQEQEISHQPWISLPSLFDLIGIGSWLLLCFGRNSIPFPLHRQPPSHPVWLDSSHPIHHHRRPSSLLGCLLGSLTLPYLTLPYLTLHDGCSNRHPLCWPWPPAPDLFRPPIPLGPAAWAPG

SEQ ID NO: 49259 - protein, 78 aa, Sorghum bicolor
  Clone ID: LIB3476-042-P1-K1-G6.pep
NTDGIHLQNSKEVSIHHTNLACGDDCVSIQTGCSDVNIHNVNCGPGHGISIGGLGRYNTKACVFNITVRDVKMFRTMT

SEQ ID NO: 49260 - protein, 50 aa, Sorghum bicolor
  Clone ID: LIB3476-042-P1-K1-H3.pep
LCIFTSRIYAINFDHEQRNSRCCGWYKIMAIHGIIILHKSRKRINIQNYM

SEQ ID NO: 49261 - protein, 80 aa, Sorghum bicolor
  unsure (1)..(80): unsure at all Xaa locations
  Clone ID: LIB3476-042-P1-K1-H5.pep
KAGNLQNIQPLTRARVPIVKLMDPETGLSCDICVNNLLAVVNTKLLRDYAQIDRKLKQLAFIGKHWAXIRRCNETYQGTL

SEQ ID NO: 49262 - protein, 152 aa, Sorghum bicolor
  unsure (1)..(152): unsure at all Xaa locations
  Clone ID: LIB3476-042-P1-K1-H9.pep
MSSSSAMPPPASPREHVERIRRERYYIGRGEQNPLAEDMHQAVNYLSQELYSKDVHFLMELVQNAEDNEYPSEVAPSLEFLITSKDITGCGASSTLLIFNNERGFSSTNIESICRVGKSTKKGNRHQGYIGEKGIGFKSGFLISKXPHIFSN

SEQ ID NO: 49263 - protein, 87 aa, Sorghum bicolor
  Clone ID: LIB3476-043-P1-K1-A5.pep
GRVGEFDDDLSCIFNDDNADKLILRIRITNDEAPKGEIQDESAEDDVFLKKIEGNMVTEIALRGIPDINQVVNKEGKGNTFYSDQRF

SEQ ID NO: 49264 - protein, 53 aa, Sorghum bicolor
  Clone ID: LIB3476-043-P1-K1-A6.pep
AYLTVVISFNNRDGFPALQDPASDLSSRNKRKLHWGYFFHYCILLLHSYVILN

SEQ ID NO: 49265 - protein, 125 aa, Sorghum bicolor
  Clone ID: LIB3476-043-P1-K1-B1.pep
MALLTAEEKKTAAEIVAALDLQRHPDGGFYLETFRDPSIALPTSGLPPRYKVDRAVSSAIYFLLPAGEIARLHRIPCAETWHYYLGEPLTVFEVHDDGQIKTTVVGPDLRQGQRPQYTVPSNIWF

SEQ ID NO: 49266 - protein, 66 aa, Sorghum bicolor
  Clone ID: LIB3476-043-P1-K1-B10.pep
VTQQKGGVSNDIGDNNKKDNSTEGTDVSRDDLTPQPKDKDNSITKPSQHEILGDPYKEASYIDDMK

SEQ ID NO: 49267 - protein, 122 aa, Sorghum bicolor
  unsure (1)..(122): unsure at all Xaa locations
  Clone ID: LIB3476-043-P1-K1-B12.pep
GFNPESAKKRFFEIYLDKYAKPNSGIGFPGALELIMECKNSGLKVAVASSADRIKVDANLAAAGLPVSLFDAIVSADAXENLKPAPDIFLAASKNLGVDTXKCIVIEDALAGVQAAKAAEMR

SEQ ID NO: 49268 - protein, 150 aa, Sorghum bicolor
  unsure (1)..(150): unsure at all Xaa locations
  Clone ID: LIB3476-043-P1-K1-B2.pep
LIDLRLLSCEGITSASMAAIAYSRLLEALQLDNCSLLTSVSLDLPHLKNISLVHLRKFADLNLRSPVLSYIKVSRCSALHRVSITSTTLQKLVLQKQESLSNLSLQCHNLIDVDLSDCESLTNAICEVFSDGGGCPMLRSXILDNXESLS

SEQ ID NO: 49269 - protein, 58 aa, Sorghum bicolor
  Clone ID: LIB3476-043-P1-K1-B3.pep
EDKETPILYGRENIIGSIKSSFGIAPYKSSGIIGDHHGLDHHPCYRGYADGHEKREEL

SEQ ID NO: 49270 - protein, 86 aa, Sorghum bicolor
  unsure (1)..(86): unsure at all Xaa locations
  Clone ID: LIB3476-043-P1-K1-B4.pep
RTRGQNLLCYELVPNGSLEAWLHGALSASWPLDWDTKDKITLGACKGIRXYFNKDQKPGEIKRNLKAFNIWLENDFNAKGSNFGWA

SEQ ID NO: 49271 - protein, 64 aa, Sorghum bicolor
  unsure (1)..(64): unsure at all Xaa locations
  Clone ID: LIB3476-043-P1-K1-B6.pep
WKEFDVTQDATNAESLQHGPTLEIRIPAEFVTSTNRQVKGAQLLXTRRYTNDSDLXGVLMHTGY

SEQ ID NO: 49272 - protein, 123 aa, Sorghum bicolor
  unsure (1)..(123): unsure at all Xaa locations
  Clone ID: LIB3476-043-P1-K1-B7.pep
GELHDGTKIAVKRMEAGVMGNKGLNEFKXEIAVLTKVRHRNLVSLLGYCLDGNERILVYEYMPQGTLSQHLVEWSENNLRSLEWKKRLSVALDVARGVEYLHSLAQQTFIHRDLKPSNFLPWR

SEQ ID NO: 49273 - protein, 114 aa, Sorghum bicolor
  unsure (1)..(114): unsure at all Xaa locations
  Clone ID: LIB3476-043-P1-K1-C10.pep
PGSCIPSAPRAPRFFSSPSRGQEHTHTRKKLLALSLARSQSRPLDSLSVQLQRPAAAASPFPFSIRXVPPQIRXGIWPSSHTTNRRKERSDGECRRKDQGWRSCADPGLSSNCV

SEQ ID NO: 49274 - protein, 132 aa, Sorghum bicolor
  unsure (1)..(132): unsure at all Xaa locations
  Clone ID: LIB3476-043-P1-K1-C12.pep
RDCVYSLLRLIRFLREKVLSPSQLIDSVKDGCWMKSTVGYRRPSDCIIKDSEWAVASCISDQPFLDVEFYGEDILSYKSELELLGVIVGFKNKYHLCIDNFKVRSSAITSESTVLXLKCIFVCGSCQDFIRK

SEQ ID NO: 49275 - protein, 61 aa, Sorghum bicolor
  Clone ID: LIB3476-043-P1-K1-C7.pep
AGRRRRRRRSISRRRPGSAYYPELVTMARGLNKHIKRLNALNHWMLNMLRTTYIFKLSYCT

SEQ ID NO: 49276 - protein, 65 aa, Sorghum bicolor
  Clone ID: LIB3476-043-P1-K1-D11.pep
RGRVGKTVLDANIYAVISPQMGKQVVAFLAAMEIMSEQFPGAFSGYKLEVMESHQATKLDISGTG

SEQ ID NO: 49277 - protein, 167 aa, Sorghum bicolor
  unsure (1)..(167): unsure at all Xaa locations
  Clone ID: LIB3476-043-P1-K1-D12.pep
LESLEALADENTCAMVIINPRTLGGGYPHMIIGQNAETARKLGIIIIADEVYDHLVFGNKPFIPMGVFADIVPVITLGSISKRWLVPGWRLGWIATCDLNXVLKEAXXDKLIENYINITNDPATFIQGAVPQIIANTKEDYFNKILNLLRNSAVLLYNKIKETRGIT

SEQ ID NO: 49278 - protein, 73 aa, Sorghum bicolor
  Clone ID: LIB3476-043-P1-K1-D5.pep
DVAMMVTSARDMNQMGAHDNNLCSSPGNSLHLIPKEHHVPSMGGDFECKMSQDDKAVIYSNGSPTIMLMNIAD

SEQ ID NO: 49279 - protein, 136 aa, Sorghum bicolor
  Clone ID: LIB3476-043-P1-K1-E12.pep
EKLTYMESAVAEANKAVQEAKAESSQLKERLLDKENALQSITQENDEFRMREADAMKKIEELSALLAEAMTKKHPEEEEKLVVVDEAHNSVREEVIRSVAENEDTEETDDQKPRLEVATADMNSNGESKHEEKDEQ

SEQ ID NO: 49280 - protein, 96 aa, Sorghum bicolor
  Clone ID: LIB3476-043-P1-K1-E2.pep
NTSRSLCETQEINTQHTRSNNNGVVQQRRGHRGEQRGDQAQRPPRHRPHRQRREHHHHRHRRGHHHHHHYAGGGEQRRHHGCRCRLWRRGRTSSSS

SEQ ID NO: 49281 - protein, 52 aa, Sorghum bicolor
  Clone ID: LIB3476-043-P1-K1-E7.pep
SRGLVGQFSAKHEGAEASIAAPYSLHFDAMELNTTERAFFKLIFLYSILILY

SEQ ID NO: 49282 - protein, 147 aa, Sorghum bicolor
  unsure (1)..(147): unsure at all Xaa locations
  Clone ID: LIB3476-043-P1-K1-F12.pep
HCLAVIDDCIKRSGLNSAAPDFVPLSIRKSNTGDATGSCFSSGANISGILEAIKSLSEVLCNNFSGEIELEEHDHCLLQSVIENLQSCLHKASKVPVMGAFDKSGGLKAXYAQNAVSKSVTGRLHGSCTADNGKALSLNLGDLVGCW

SEQ ID NO: 49283 - protein, 43 aa, Sorghum bicolor
  Clone ID: LIB3476-043-P1-K1-F5.pep
KSTLLSYDDPSSMSICQPYQIPGANSSSASVTSFFEYGADNSL

SEQ ID NO: 49284 - protein, 75 aa, Sorghum bicolor
  Clone ID: LIB3476-043-P1-K1-G1.pep
LCLLQHSEKIAVAFGLISCTSAIKPIRIFKNLRVCADCHSALKYVSKATGREIILRDSNRFHRMKDGECSCGEYW

SEQ ID NO: 49285 - protein, 62 aa, Sorghum bicolor
  Clone ID: LIB3476-043-P1-K1-G6.pep
CRSMKATLAKAYYDVCQFKKRKGKCVQITVSYIRISFAEANAKQFNLDITLGSQLKIKTGLS

SEQ ID NO: 49286 - protein, 84 aa, Sorghum bicolor
  Clone ID: LIB3476-043-P1-K1-H2.pep
TSIKLLAIIAVLSNAALMTVSNATQLSFRGCITATLAAAMPGLQSSMTEKSLRRDTYRLDNSITLVSHVTTVMAIGTMRLSTIT

SEQ ID NO: 49287 - protein, 90 aa, Sorghum bicolor
  unsure (1)..(90): unsure at all Xaa locations
  Clone ID: LIB3476-043-P1-K1-H6.pep
LARRSPPXLGFPPPPAMGALTDSRKRLSADHWXSGDHRLPYPFFSPAGLTPSFKRAKLAPFPELDPFNFTRPAISACSQIIRLLHGGAFL

SEQ ID NO: 49288 - protein, 58 aa, Sorghum bicolor
  Clone ID: LIB3476-044-P1-K1-A11.pep
ASWHLCLIEIAWNCLPRSTPAVGLAQASITLDIVNSFGFKPCMVILMNIFVAPSESPA

SEQ ID NO: 49289 - protein, 56 aa, Sorghum bicolor
  Clone ID: LIB3476-044-P1-K1-A3.pep
PDASHALSSDQVSSPDDGQIRNLGSPLIAKDASRAGRASEGSTPEVHSARVDKKMT

SEQ ID NO: 49290 - protein, 114 aa, Sorghum bicolor
  Clone ID: LIB3476-044-P1-K1-B1.pep
QELVNNPPAKETSCVFVSKGDDLEAVRGELIKGFLEIDTGGRIIGIKEMGELDEKAFEAACLAKVPPEEVGAASSQLYASWKQQLGDLSWYPFKAITSDGDHQEIENIDDDMLL

SEQ ID NO: 49291 - protein, 119 aa, Sorghum bicolor
  Clone ID: LIB3476-044-P1-K1-B7.pep
CSPEEYEQLKSEKTNLEGELAKCNEIIEETKVRLSDMEKNLEDLRSKLADSEKSNSLSETQLKCMAESYKSLESRKIELENEIEVLRSKIDALTAELSDERQSHQEGLVKYRDLEGKME

SEQ ID NO: 49292 - protein, 127 aa, Sorghum bicolor
  unsure (1)..(127): unsure at all Xaa locations
  Clone ID: LIB3476-044-P1-K1-C11.pep
AERKEHQDVKFAGAVSQLQRIFIVTPDFPVLLASCPLVQFEGSCLPSNVSDHDREGSFSIGCRVIXPPESFLTMRLXFVYGVETKEGSTFPLKNFEQQPELTAWLVGGTALQIVSVGDVTEKETVMK

SEQ ID NO: 49293 - protein, 83 aa, Sorghum bicolor
  Clone ID: LIB3476-044-P1-K1-C12.pep
PNELRFITVTSQTRNSLLKTSKWYVQRPGKCRIERLGKVILIFISHNLIYQVRHFKSRLDTQYVWSFVSGIPAKELMIYRVFC

SEQ ID NO: 49294 - protein, 46 aa, Sorghum bicolor
  Clone ID: LIB3476-044-P1-K1-C6.pep
HASDHASLLIGYVLIADCKDYFSKSLFVVGEFGGNDYNAPLFSGVF

SEQ ID NO: 49295 - protein, 43 aa, Sorghum bicolor
  Clone ID: LIB3476-044-P1-K1-D1.pep
ILSSFNCTVAELHGTSALIELFESSMTSLSLVESFESSARTRG

SEQ ID NO: 49296 - protein, 58 aa, Sorghum bicolor
  unsure (1)..(58): unsure at all Xaa locations
  Clone ID: LIB3476-044-P1-K1-D2.pep
LLYXEYIIKLNDXMKAKFMNQVFTLFNLIIIVNHYLMHQLLFPSFISYHDSIIYPKTS

SEQ ID NO: 49297 - protein, 57 aa, Sorghum bicolor
  Clone ID: LIB3476-044-P1-K1-D6.pep
MALLMEPVAEPLTESEHASVAGILAIMESVAHEFKEHGNELGQMGRQHYTEADSWYT

SEQ ID NO: 49298 - protein, 98 aa, Sorghum bicolor
  Clone ID: LIB3476-044-P1-K1-E2.pep
GRVGRSSMDRNSCSEGSSQGKKNSNISNIYGNRKGQFDYFRDKPRLLKQIGSGSEAHSAHLSNACCFQNLTADNFSSADCLNEKVLFTTDEDLVLQPP

SEQ ID NO: 49299 - protein, 99 aa, Sorghum bicolor
  unsure (1)..(99): unsure at all Xaa locations
  Clone ID: LIB3476-044-P1-K1-E5.pep
AKLQQSEAKMIEHKASMAVLGKEAAAALAAVESQQQRVTLQRLVGVVXAEKLFHLRLAAILDDVEAEMSSEKQKRESAPPIIFFHKRAEKAQYFLAEVK

SEQ ID NO: 49300 - protein, 74 aa, Sorghum bicolor
  Clone ID: LIB3476-044-P1-K1-E9.pep
MPKRSRENCGALAVAGNDDRLGSLPDDALLHVLSLLPSEDAARTCVLARRWRHLWRFTVGLRIARYDNRWSVRW

SEQ ID NO: 49301 - protein, 164 aa, Sorghum bicolor
  unsure (1)..(164): unsure at all Xaa locations
  Clone ID: LIB3476-044-P1-K1-F12.pep
YRMYRALAARYDSVTGELRKNIPSSLQSYGSFGVSESDSETQCSSSPEYDMQENMPQQKQKPGPDFLDISIGSGVSSDVSKKGSERSSSSSDSDSELDEAKEENGSIFYALSQKINELEEELQEARGKLDALEEKHAQXQSDXSTNLKVAEHEEKLHISMWIQQ

SEQ ID NO: 49302 - protein, 163 aa, Sorghum bicolor
  Clone ID: LIB3476-044-P1-K1-G12.pep
MASKQMEEIQRKLSLLEYPRANAPAQSLLFAGVERYRLLEWLFFRLLGDRSPFTQQNWQGDSLDRDEENNRIQHLAEIANFLGITPSVDTEAIQGRGSYEERVELLHLIVDLVEASCYADNPEWSVDKQLEKDVQLVDSIAEKQAQIFSEECKLFPADVQIQS

SEQ ID NO: 49303 - protein, 71 aa, Sorghum bicolor
  Clone ID: LIB3476-044-P1-K1-G7.pep
EHLLPVLACLVCVGYVGVSVEQVDVRRREADGDVGRHGDHGQHPQQSRQDVLLRAPPAHPGNHLQRSRHCM

SEQ ID NO: 49304 - protein, 141 aa, Sorghum bicolor
  Clone ID: LIB3476-044-P1-K1-H1.pep
EEIALQDEYEGSEDGNSTVHFRFIEKALPSLVPMLLETLLKQEEDQDQDDNVWNISMSGGTCLGLISRTVGDAVVPLVMPFVEANITKPDWHCREAATFAFGSILEGPSVEKLAPLVQGGLDFLLNTMNDANSQVKDTTAW

SEQ ID NO: 49305 - protein, 62 aa, Sorghum bicolor
  Clone ID: LIB3476-044-P1-K1-H2.pep
ECGHPFPSTYNSSPIASSNLSLPVSQLTNITPLWSEVNELTHPHPHTQAACFAWLVLSSTQP

SEQ ID NO: 49306 - protein, 116 aa, Sorghum bicolor
  Clone ID: LIB3476-044-P1-K1-H8.pep
HASGGTIPSSLTKLNFLSKFDVSYNNLTGDIPTGGQFSTFAPEDFDGNPTLCLRNSSCAEKDSSLGAAHSKKSKAALVGLGLGTAVGVLLFLFCAYVIGSRIVHSRMQERNSKAVT

SEQ ID NO: 49307 - protein, 52 aa, Sorghum bicolor
  Clone ID: LIB3476-044-P1-K1-H9.pep
LWLLAALETGTVAGSDELLVALDSKEELAVGGKPNVWKVHSLMVCCWVLPSV

SEQ ID NO: 49308 - protein, 101 aa, Sorghum bicolor
  Clone ID: LIB3476-045-P1-K1-A12.pep
MGRGLSAAPVSPRLVLGAAALVLLAAAALPSPAAGVNVTAVLSAFPNFADFARLLASTSVAGELSGRSSLTLLAVPNANLPQSPLAFVAGAGADIVDVLRY

SEQ ID NO: 49309 - protein, 137 aa, Sorghum bicolor
  unsure (1)..(137): unsure at all Xaa locations
  Clone ID: LIB3476-045-P1-K1-B10.pep
QLSKVRHPNLVCLFGYCDEEGDQYLVYEYCANGNLAQNLLRSDSALPWETRVKILRDCASVLRFLHTHPDGCIVHRDIKLTNILLTEDKVPKLADFGLAKMLEMEETKVFTDVRXTIGYMDPEYXTHSKLTCASDIY

SEQ ID NO: 49310 - protein, 50 aa, Sorghum bicolor
  Clone ID: LIB3476-045-P1-K1-B9.pep
LRSLVKKWQTLIEAHVDVKTTDNYMLRLVCIGFTKRRPNQVKRTCYAQAS

SEQ ID NO: 49311 - protein, 96 aa, Sorghum bicolor
  unsure (1)..(96): unsure at all Xaa locations
  Clone ID: LIB3476-045-P1-K1-C1.pep
MGYAQWELRYSIPLGLPPHRLCRLMALVAGGTRILLWSDFILYEYDLATSKLSTVCEMDRMRYQGRRTRKWKNLWSFNXVPYTESLLRIGSLLPNN

SEQ ID NO: 49312 - protein, 44 aa, Sorghum bicolor
  Clone ID: LIB3476-045-P1-K1-C3.pep
MSCCGGNCGCGSGCKCGNGCGGCKMYPNMAEQQVTTTVKTLVMG

SEQ ID NO: 49313 - protein, 167 aa, Sorghum bicolor
  unsure (1)..(167): unsure at all Xaa locations
  Clone ID: LIB3476-045-P1-K1-F1.pep
AVFVYLSTRHVHGDYVNGAHQDLRALLSFKAYNPNATALASWVGPNPCSGTWFXVRCYRGRVAXVFLDGASLSGAVAPLLGLGRIRALAVRNNSLSGTLPPLDNSTASPWLRHLLLSHNKLSGSXRILAGALLTLRAEHNGFRGGLEALPVPMLRSFNVFGNKLAGE

SEQ ID NO: 49314 - protein, 89 aa, Sorghum bicolor
  unsure (1)..(89): unsure at all Xaa locations
  Clone ID: LIB3476-045-P1-K1-F5.pep
PVNPDDEGDMVAEKRLIQRAPLVGVGAVERLNQIHDPKQTPQKXCASATKPAIAAASSSKXXPPRXKXXPMLLLLGRPPGGVAAAAIAS

SEQ ID NO: 49315 - protein, 36 aa, Sorghum bicolor
  Clone ID: LIB3476-045-P1-K1-G2.pep
KYYLNQPVDIPDKNCMINRLIKTCMITLVCIIVCNS

SEQ ID NO: 49316 - protein, 66 aa, Sorghum bicolor
  Clone ID: LIB3476-045-P1-K1-H1.pep
MATPAAEKPEDVEIREVWADNLEAEFAGIRDIVDDYPYVAMDTEFPGVVWPPLGTYKTAAEFNYPT

SEQ ID NO: 49317 - protein, 166 aa, Sorghum bicolor
  unsure (1)..(166): unsure at all Xaa locations
  Clone ID: LIB3476-045-P1-K1-H2.pep
AVSQTSGLPPKLPVKKNSKSQNSYIRKGNALIRNPATGNLHSSSLDSQNKSKPVMRRSMNFVRKVDSKDVGHSHISVERPKTPPLPLHTKSISCDVNXLEPLSQNLQQQVIETEKEDSSGQVNSGADIPSIISSHKSEALDAGKAIYVRPKVNQVVVAQGQHXCES

SEQ ID NO: 49318 - protein, 55 aa, Sorghum bicolor
  unsure (1)..(55): unsure at all Xaa locations
  Clone ID: LIB3476-046-P1-K1-A10.pep
TLSSTERVPEWNYPDTLXRPNRTRLLVADGVAKRKNLCVLIFYIYLYKENALISR

SEQ ID NO: 49319 - protein, 40 aa, Sorghum bicolor
  unsure (1)..(40): unsure at all Xaa locations
  Clone ID: LIB3476-046-P1-K1-A9.pep
DNCLSFLLESSEVKDDAAYRAPENMKSNRMLTPXSDIYAL

SEQ ID NO: 49320 - protein, 79 aa, Sorghum bicolor
  Clone ID: LIB3476-046-P1-K1-B11.pep
AAEIRDPWRKTRVWLGTYDTPVEAAMAYDRAAVALRGSKARLNFTAGRACRATPQARPFPLSHPAAPGGHFVGGLDVTH

SEQ ID NO: 49321 - protein, 35 aa, Sorghum bicolor
  unsure (1)..(35): unsure at all Xaa locations
  Clone ID: LIB3476-046-P1-K1-B4.pep
ESFLVLXRLLILRSPRAMVILSLSRLLILNVMTRA

SEQ ID NO: 49322 - protein, 115 aa, Sorghum bicolor
  Clone ID: LIB3476-046-P1-K1-C8.pep
LSIIHTDLKPENILLVSTIDPSKDPRKSGLPLVLPSARTDEPPPKVPAQSGNGGLTKNQKKKIRKKAKRAAAATSEGSSAVASADTDGSDDRGDLGTTNEGSPIQDGAKKRQHEI

SEQ ID NO: 49323 - protein, 110 aa, Sorghum bicolor
  unsure (1)..(110): unsure at all Xaa locations
  Clone ID: LIB3476-046-P1-K1-D2.pep
LLTHSGGGERRRDHAAAELQLGQHSGVAAKERRQRRGQCEREGRAENAGSRVGVDPGPAXXALLVLSNRVGSPDSVRFVWFVCLVSLLLDNDSVQSELDFVNQRNIDSWV

SEQ ID NO: 49324 - protein, 53 aa, Sorghum bicolor
  unsure (1)..(53): unsure at all Xaa locations
  Clone ID: LIB3476-046-P1-K1-D5.pep
DEGLEEDFVIIANRAEGEELEEEDTEXVEEWNGVLSDVEEEEFDFEXGEPKPK

SEQ ID NO: 49325 - protein, 75 aa, Sorghum bicolor
  Clone ID: LIB3476-046-P1-K1-D6.pep
IIRSHPSGLRSFARHAAPQSGTMAVTPLRTAEGHDGVDPDPIRRALRGVSSVLGRVACALAPAAGSLGTDCSCRR

SEQ ID NO: 49326 - protein, 84 aa, Sorghum bicolor
  unsure (1)..(84): unsure at all Xaa locations
  Clone ID: LIB3476-046-P1-K1-E11.pep
EVRLMMNPVTKKNKGFAFLRYATVEQARRAVSELKNPLVRXKQCGVAPSHDNDTLXVGNICKTWTKEHLKXKLKXYGVESXDDL

SEQ ID NO: 49327 - protein, 30 aa, Sorghum bicolor
  Clone ID: LIB3476-046-P1-K1-E2.pep
LVLATSKNYFERGIMNQSSRGKILTNLCLA

SEQ ID NO: 49328 - protein, 69 aa, Sorghum bicolor
  Clone ID: LIB3476-046-P1-K1-F2.pep
GCKALILQYLFYFSQCVLPSIILVSDDIMARNISLHVWFVGLIKFLLLNSLLHADCWCLLSYKLILHFL

SEQ ID NO: 49329 - protein, 103 aa, Sorghum bicolor
  Clone ID: LIB3476-046-P1-K1-G10.pep
HASDSALEEAKADIVGLWALNLLIKKGLLPKSLSQSMYVSFLASCFRSIRFGLEEAHGKGQALQFNWLYEKGALVLHSDGKFSVDFTKVEEAVESLSREILTI

SEQ ID NO: 49330 - protein, 93 aa, Sorghum bicolor
  Clone ID: LIB3476-046-P1-K1-G8.pep
ALASRLAQLQAKACEATRFVARHGCEYQRSLVEKNKKYVVEPPTIEKCQELSNQLFYTRLASLPGRYEAFWKELDQVKQLWKNRNDLEVEHAG

SEQ ID NO: 49331 - protein, 133 aa, Sorghum bicolor
  Clone ID: LIB3476-047-P1-K1-A10.pep
MGGQINFVSRPQVGSTFTFTAVLQRCDRSAIGDSKPVMLHPLPSSFKGLSALLVDTRPVRATVTKYHLQRLGIACDVVATIDLALGVLSGRNGSSLTSTKQPCMLLIESDSWGFKIDVSLRSRLLEMKQDGHT

SEQ ID NO: 49332 - protein, 123 aa, Sorghum bicolor
  Clone ID: LIB3476-047-P1-K1-A11.pep
DAWGLYLCLLKDCHFPQVIEMYHPLALRMFLLGTHYRSPINYTIEQLNVASDRLYYTYQTLRDCEESCQQQGSNTGNSLPPNTLNYIQKLHDEFETSMSDDLHTSVALAAISEPLKVMNDLLH

SEQ ID NO: 49333 - protein, 138 aa, Sorghum bicolor
  Clone ID: LIB3476-047-P1-K1-A12.pep
LFGCTTENKFGYIVCNPATEELVTIPASSGSCPPPSLTPLEDKTIAVCDGDIYAHTYLMFDPIVSSRFHLVQFWQDRSTCEVKKVHSYSSETRAWSDTSNKWEPGEERCGWGVLRGRGEAIIEFTRGKALVDGLLLYI

SEQ ID NO: 49334 - protein, 86 aa, Sorghum bicolor
  unsure (1)..(86): unsure at all Xaa locations
  Clone ID: LIB3476-047-P1-K1-A9.pep
SSFIFFINIFIVFYIYFMIFCFFYFVXFFNVLYFFLSLFIFYNFFIFLFLFIXLFIILFFNFILLLFFFLIFIIIFIILIFYFLFF

SEQ ID NO: 49335 - protein, 112 aa, Sorghum bicolor
  Clone ID: LIB3476-047-P1-K1-C10.pep
ALVVLAAACSRPCCLLLLLCRRRCHSGGVFLLQTETGGLLLAGQCLDLIELGFLLHGQLPLPVRWPALHAGFGGVIAYARRPRCSRLLLLLGRLAVSGGGGGGSGLVQAHLR

SEQ ID NO: 49336 - protein, 69 aa, Sorghum bicolor
  Clone ID: LIB3476-047-P1-K1-C11.pep
RKRICFRPLVYVALQIYLRERHCILRADIYYGLFDILLKLLLIYTKLSGCNPAIESMQVNMGIIKVVSM

SEQ ID NO: 49337 - protein, 94 aa, Sorghum bicolor
  Clone ID: LIB3476-047-P1-K1-C5.pep
LTPARRRRSAMIHLRKRIVSLLPRTPTRVPCPHNSPLFYPHRLLSATKCVATTTNQFAVEDYLVATCGLTRAQALKASLRISHLKDASRPDAVV

SEQ ID NO: 49338 - protein, 122 aa, Sorghum bicolor
  unsure (1)..(122): unsure at all Xaa locations
  Clone ID: LIB3476-047-P1-K1-C8.pep
HFSLLFFHLAGLSPPRSHSSQTNEKSKSTSAAGCGCVRALYWSSGAVPSMAGLGFEETELRLGLPGGNDAGDAAAARKRGFEETIDLKLKLEQPAAPHLEKGGEVXLATPSPPGGSHCRRLQ

SEQ ID NO: 49339 - protein, 78 aa, Sorghum bicolor
  unsure (1)..(78): unsure at all Xaa locations
  Clone ID: LIB3476-047-P1-K1-D11.pep
KVVYIVFYFFLFFYFSLIFFFILLFILFFLFFICFSYFXKNLLMFFLYIFFFYFFFIFFIFFFLFFYFFSFLYLFYKF

SEQ ID NO: 49340 - protein, 138 aa, Sorghum bicolor
  unsure (1)..(138): unsure at all Xaa locations
  Clone ID: LIB3476-047-P1-K1-E4.pep
GWVPNCDTLHALIREYRDARKIFLNQEHKLMLAFAPDYDHLPLIAKVEVFQHALQNTEGNDLAKVLWLKSRTSEVWLERRTNYARSLAVMSMVGYLLGLGDRHPSNLMLDRYSGKILHIDXGDCFEASMNREKFPEKV

SEQ ID NO: 49341 - protein, 121 aa, Sorghum bicolor
  Clone ID: LIB3476-047-P1-K1-E7.pep
RARTLVSLSGFRDLAQEYLPTIAVVCAHLKSLDLSYTAVTPNQILMFIGQCYNLETLWVLDSVRDEGLESVGMSCKKLQSLRVLPLNAREDADELVSEVGLTAISRGCPALRSILYFCQTM

SEQ ID NO: 49342 - protein, 59 aa, Sorghum bicolor
  unsure (1)..(59): unsure at all Xaa locations
  Clone ID: LIB3476-047-P1-K1-F1.pep
LAATPPAPXTVQGSPWRRRTARRSRTPPRAAAINTNRNSRCSISDVRVCTDDLLPAIVN

SEQ ID NO: 49343 - protein, 59 aa, Sorghum bicolor
  Clone ID: LIB3476-047-P1-K1-F11.pep
GVRPTAEAERPGSSGSGSTSFWNQIFTSTEDKTHAPARDNTANKSYAGPAPNLEHSLST

SEQ ID NO: 49344 - protein, 118 aa, Sorghum bicolor
  Clone ID: LIB3476-047-P1-K1-F7.pep
RTRGVARGIANFAKCESRAATQGNKVGKSLLIDDGSLPWIVKNANNEAAPIRRHIELALCHLAQHEVNAKDIINEGALWELVRISRDCSREDIRKLAYRTVTSSPTLQAEIRRLGIKM

SEQ ID NO: 49345 - protein, 100 aa, Sorghum bicolor
  Clone ID: LIB3476-047-P1-K1-G11.pep
VGGPKIRVAKAREAFAGVADASGYPFAVMPSAKGLVPEHHPRFIGTYWGAVSTTFCAEIVESADAYLFAGPIFNDYSSVGYSLLLKREKAIIVQPEPRGG

SEQ ID NO: 49346 - protein, 121 aa, Sorghum bicolor
  unsure (1)..(121): unsure at all Xaa locations
  Clone ID: LIB3476-047-P1-K1-G8.pep
CLEIAEIMLQVIFDRSDAARMSGMSDKAYIRSFNALQNGLGVKTTLDVRELGIQFGCVMLIPFAQKGLSLYKERFLAELPPXRRASTDFGRAEFTAAAFYLCAKRHKLKVDKLKLIDLCGT

SEQ ID NO: 49347 - protein, 52 aa, Sorghum bicolor
  Clone ID: LIB3476-047-P1-K1-H10.pep
SHLGFIFCLTCTEIFIFSSVLFCTLTCLDTSDDSHALITECTGLVYFEKLHN

SEQ ID NO: 49348 - protein, 104 aa, Sorghum bicolor
  Clone ID: LIB3476-048-P1-K1-A1.pep
REIYDQLGPEAYERQASGGDPGGPGFPQGNPFGDIFGDIFDNAYRGGQDVKVSVELSFMEAVQGCRKTITYEADTFCGTCNGSGVPPGTVPKTCKTCRGSGVIY

SEQ ID NO: 49349 - protein, 51 aa, Sorghum bicolor
  Clone ID: LIB3476-048-P1-K1-A3.pep
ITKQGQQQRVLTLSDVSVAILRYTKLLPCKLMPQTDLALPNRIKIVGLQEQ

SEQ ID NO: 49350 - protein, 66 aa, Sorghum bicolor
  Clone ID: LIB3476-048-P1-K1-A4.pep
SDLDPAVNPQALIRDQWGRLARVNMANDRNVYVSLLLTHGCRQLSRCSSGGSRVDRLRLHLRCKVF

SEQ ID NO: 49351 - protein, 101 aa, Sorghum bicolor
  Clone ID: LIB3476-048-P1-K1-A5.pep
EHLRIVDPVLQMLLDGYPDPVTSVIDSDFHCQNSMLPEGELGMDKKSLSSPITKQAPEVYTKRDAPGDGEDNFVQESGDFSVSLLMLATNTAMRENVSVMG

SEQ ID NO: 49352 - protein, 59 aa, Sorghum bicolor
  Clone ID: LIB3476-048-P1-K1-A7.pep
NALTRCSAVISNSPFILNLDCDHYINSSQALRAGICFMLGRDSDTGAFVQFPQRFEGVD

SEQ ID NO: 49353 - protein, 52 aa, Sorghum bicolor
  unsure (1)..(52): unsure at all Xaa locations
  Clone ID: LIB3476-048-P1-K1-B10.pep
LIRQAKWRFSLSFLRNISACLFSLQAITSMHWFFMYDLSYFLNFNKIIFXLS

SEQ ID NO: 49354 - protein, 55 aa, Sorghum bicolor
  Clone ID: LIB3476-048-P1-K1-B7.pep
LLSRDKESIVFYRGKDFLPPAVSLAIEKRRKLGSSTIYKPKPDIEENMPTQETLY

SEQ ID NO: 49355 - protein, 56 aa, Sorghum bicolor
  Clone ID: LIB3476-048-P1-K1-B8.pep
RGRVGKFPPNQKPSLPNPSYLRIPMANRRVLFDMTVGGAAAERIVMELYANEVPKT

SEQ ID NO: 49356 - protein, 108 aa, Sorghum bicolor
  unsure (1)..(108): unsure at all Xaa locations
  Clone ID: LIB3476-048-P1-K1-E10.pep
GQSFVPYGPPNGVHKPGVHPAGYAVPRMPVPPFPGAPHSQPYTIPTRGLHGPIGAVPPVHQPGSRNFGAPRSNTGGPIGGHLAHQQNSQQAMGGIGSXLNYTGMENPS

SEQ ID NO: 49357 - protein, 130 aa, Sorghum bicolor
  unsure (1)..(130): unsure at all Xaa locations
  Clone ID: LIB3476-048-P1-K1-E6.pep
PRVRPRVRCEMSSLEELIFGNCTNLRELPLSMAQLSNLLVLHVEGTQITAFPDHMFQNMXSLHTLKLINNMVLISLPMSLSEAKQPEVLHLSNXISLRHSIILSKQMPKSSFSTDRYTQSWTYLNYSTEM

SEQ ID NO: 49358 - protein, 91 aa, Sorghum bicolor
  Clone ID: LIB3476-048-P1-K1-E8.pep
TKYDLVYMINKEVGDAAPSSLADIKKFASAVSVDTSSVFPETHYFTVYETNLVQTLQSAGLSVYVYTLMNEFPSQPYDFFSDATAQINAYV

SEQ ID NO: 49359 - protein, 53 aa, Sorghum bicolor
  Clone ID: LIB3476-048-P1-K1-E9.pep
LMKDSGLVSLVGHYHFKTIGLGHRTRTGRQDWSAARNFQRRAHASAHASAHAS

SEQ ID NO: 49360 - protein, 123 aa, Sorghum bicolor
  unsure (1)..(123): unsure at all Xaa locations
  Clone ID: LIB3476-048-P1-K1-G11.pep
MASSDDETSRLYRIRRTVHEMLRDRGYAVSEEEINLPRDRFIDRFGNPVRRDDLASSAMKLDGSSEQIYVFXPNEAKPGVKTIRNYVEKMKHENVFXGILVVQQALSAFARSAVQEVSQKYHL

SEQ ID NO: 49361 - protein, 115 aa, Sorghum bicolor
  Clone ID: LIB3476-048-P1-K1-G12.pep
CRCHPRLLLEARCDGDAAAAARDARSRRGWRREQRQAGAAAVVGREQARLTASAVAVGRERGAGDGWRTRCLACSAATASSSRPAGHHRRPATSSGSVSSRSSGGSSSSKYVEED

SEQ ID NO: 49362 - protein, 49 aa, Sorghum bicolor
  Clone ID: LIB3476-048-P1-K1-G2.pep
MKCSFIKINLPPPSFLKENVFGELDIFLKENAGFFLNDWFPWLCILSQN

SEQ ID NO: 49363 - protein, 63 aa, Sorghum bicolor
  Clone ID: LIB3476-048-P1-K1-G8.pep
MSSPAEYYKSLPPISKAYGTLCFLTTVLVRLHIMDGGFLVLYYPRVFKKFQVWRLFTSFIFLG

SEQ ID NO: 49364 - protein, 79 aa, Sorghum bicolor
  Clone ID: LIB3476-048-P1-K1-H1.pep
MYGNIAQTKSHPINVRTHQGAWPGAVLPCTPKHTTQQRLLVDEPREERAQDDITPACEYSYHWFPAGPEPPRVRPRVRA

SEQ ID NO: 49365 - protein, 37 aa, Sorghum bicolor
  Clone ID: LIB3476-048-P1-K1-H11.pep
RCGALRVVAARPRCVYINLGYHHTIPVLGALSFWSPS

SEQ ID NO: 49366 - protein, 87 aa, Sorghum bicolor
  Clone ID: LIB3476-048-P1-K1-H4.pep
FNFFGACVALAWIIPSAVNKILWSNLQQSGNWTALALMWKTTPITIFFFVVLMPLLDPPGLLSFNWDLKNSSAIITSALFGFLLQWS

SEQ ID NO: 49367 - protein, 54 aa, Sorghum bicolor
  Clone ID: LIB3476-048-P1-K1-H9.pep
ARSEKTQMTMQHKESASEWQIDVKRMLLITSIKSCITIPRSIKHLATSALQAKF

SEQ ID NO: 49368 - protein, 73 aa, Sorghum bicolor
  unsure (1)..(73): unsure at all Xaa locations
  Clone ID: LIB3476-049-P1-K1-A10.pep
LVATIKSRLLSLCFHLTLAITLATSVSGLVHNKVIDLKLQPKPIPQPXPKTVPQPDPKAEPQPTPQTDPKTTP

SEQ ID NO: 49369 - protein, 57 aa, Sorghum bicolor
  Clone ID: LIB3476-049-P1-K1-A2.pep
DAWVRTRGRGHTQRVTDMAFFAEDVHRLASASVDGRIYVWRIDEGPDEENKPQITGK

SEQ ID NO: 49370 - protein, 137 aa, Sorghum bicolor
  unsure (1)..(137): unsure at all Xaa locations
  Clone ID: LIB3476-049-P1-K1-B4.pep
RRSPVSAGRCLSLVATTGRLPPPYARFPALHLPYLRRRRAAARRASPPVGREAEMSRGRSPEPLDFFIWTVEDVGLWLEEINLGSYRQAFEENGVNGEYLESLSMFTTEQILRFIRRCHMKWGXFITLCKEXRRIKV

SEQ ID NO: 49371 - protein, 80 aa, Sorghum bicolor
  unsure (1)..(80): unsure at all Xaa locations
  Clone ID: LIB3476-049-P1-K1-D2.pep
FEELPVQVELQRNLPPPVDGGVPRIVSXAAKYCNQLLDQPYRSVLTQVITIHRSWRKEVFNDKMLVEAMLSIIKTLEINF

SEQ ID NO: 49372 - protein, 38 aa, Sorghum bicolor
  Clone ID: LIB3476-049-P1-K1-E6.pep
LIAKHQAEGFGLTHTLHCTTYLAKNSEMASQPYPHGNY

SEQ ID NO: 49373 - protein, 61 aa, Sorghum bicolor
  Clone ID: LIB3476-049-P1-K1-E8.pep
IQLRLDPASSSTLSARGNGSITQRLNVTHNQHWPKPLSMRIPMSYKKNCEDQLEQRRINNF

SEQ ID NO: 49374 - protein, 111 aa, Sorghum bicolor
  unsure (1)..(111): unsure at all Xaa locations
  Clone ID: LIB3476-049-P1-K1-F6.pep
MGRTRGSKSAGGVRSFPSPASSSSASSSEFEFTVTLSPASKQRSAEQLCPADELFYKGQLLPLQLSPRISMVRTLLLSSASTFSASASDSTSTXNSSRDSNGSTSSSFSAD

SEQ ID NO: 49375 - protein, 139 aa, Sorghum bicolor
  Clone ID: LIB3476-049-P1-K1-G6.pep
RTRGCNLKLSFLDLSNNSLSGLPAELGEMTTLRKLLLTGNPMRTLKSSLVSGPTTTLLKYLRSRLSSDEEASRSGSTPTKDDQIAAARRLSLSSKELDLSGLGVTSVPAAAWETSDVVKLDLSKNSIEDLPNELSLCSS

SEQ ID NO: 49376 - protein, 124 aa, Sorghum bicolor
  Clone ID: LIB3476-049-P1-K1-G9.pep
LRSLDMAATTTTILLLLVADTADWRPTSPVPLVHPRPVPLESISARPAATRGPFLYQGGSRPGGTFVPCSGRPRLVRVRRAGTRCSTSSGVETGRRHLAHCARATRAPRQPLNPAASLVRLLPC

SEQ ID NO: 49377 - protein, 32 aa, Sorghum bicolor
  Clone ID: LIB3476-049-P1-K1-H4.pep
SVLMVYMVYLLNLCDELWSIWWCIGGNGWVGK

SEQ ID NO: 49378 - protein, 132 aa, Sorghum bicolor
  Clone ID: LIB3476-049-P1-K1-H7.pep
SEEGISSIDPLTSMPDPQVGLTVGPELVLVSQEKKGEEDICFIDAPTCTPDPQVGLTMDIHEQPNVSAGADQCNENCTSNITPNTASGSKYKFSGKCYERVKKGARPRNVWLRVSTQIITRVDPLELWMKDA

SEQ ID NO: 49379 - protein, 48 aa, Sorghum bicolor
  Clone ID: LIB3476-050-P1-K1-A2.pep
PGSHTPQEWPLMHMLHSLMTLLLSPVISYAHLDEMYTFLSVIVKSLLS

SEQ ID NO: 49380 - protein, 61 aa, Sorghum bicolor
  unsure (1)..(61): unsure at all Xaa locations
  Clone ID: LIB3476-050-P1-K1-A3.pep
ERQRWRXEEDAVLRAYVRQYGPREWHLVLXRMNLVLDRDTKSCLXRWKNYLRPWIKKGSLS

SEQ ID NO: 49381 - protein, 59 aa, Sorghum bicolor
  Clone ID: LIB3476-050-P1-K1-A4.pep
ISMVVLHQVPLYICLINQFELFHMLSVHSVGKSFNVIGLDLIWEFIVPMDCFKALTISN

SEQ ID NO: 49382 - protein, 62 aa, Sorghum bicolor
  Clone ID: LIB3476-050-P1-K1-A5.pep
QHMYIYLQSHITFYRKPSAICTAHNIPFQMWLAAATSYIQLYVAATYVQLYVLPIYYLRCGC

SEQ ID NO: 49383 - protein, 94 aa, Sorghum bicolor
  Clone ID: LIB3476-050-P1-K1-A6.pep
DAWVVHDLAWTTNAMFLNSVDRCNDLVASAYVTAGHTRVMLLHDSRSEDGIICCCQEVHELYIKILLNPIYLTGSRITYSYIDTKVTVLAWKYL

SEQ ID NO: 49384 - protein, 102 aa, Sorghum bicolor
  unsure (1)..(102): unsure at all Xaa locations
  Clone ID: LIB3476-050-P1-K1-B10.pep
RLRSTISWPPACLSSSLSSAIAVMNNLLTVAYELSRRDSSRDAGIDMAMHXADASDNLKDVLTNVSAIERLIALLTNLLTELEAANAESKAGSIAGSMQAIE

SEQ ID NO: 49385 - protein, 82 aa, Sorghum bicolor
  Clone ID: LIB3476-050-P1-K1-B11.pep
PTRPHYSTRPPSPRTASSRRQRPQPSSLTPAALPTVPDKRRDAATRREREWPRALHRPGRESAACVCLCCVASAMHRDRSCR

SEQ ID NO: 49386 - protein, 38 aa, Sorghum bicolor
  Clone ID: LIB3476-050-P1-K1-B5.pep
ETTLVVWRMHTREDMETTFMGTGSSQTLKYREREDHIY

SEQ ID NO: 49387 - protein, 84 aa, Sorghum bicolor
  Clone ID: LIB3476-050-P1-K1-B8.pep
FVGKDDTGRRMEIIEIPNHRYFVGAQLHPEFKSRPSKPSALSVGLIAAASGQLDRVLQDCCNGHVISAKHVLSNGSYTPTVHQN

SEQ ID NO: 49388 - protein, 108 aa, Sorghum bicolor
  Clone ID: LIB3476-050-P1-K1-C2.pep
AYGPIARARVDASAATGYVTFRSGAAAVAAIAASLDPGGGIVIGSKKVLVVQASAAPHNSIRAAESAGRSSHDATVKNVTDNSAMLSSKAASGVTYKAREIVAYDDLF

SEQ ID NO: 49389 - protein, 53 aa, Sorghum bicolor
  unsure (1)..(53): unsure at all Xaa locations
  Clone ID: LIB3476-050-P1-K1-C3.pep
TRXELDRKCHLCMNPIILVLLVVPSIILLHGSPITDPNERHEPVGDVALLGVL

SEQ ID NO: 49390 - protein, 97 aa, Sorghum bicolor
  unsure (1)..(97): unsure at all Xaa locations
  Clone ID: LIB3476-050-P1-K1-C4.pep
IDLREVDLCIWLRYRITHPVXNAYALWLLWRICEIRYALSRLMDHFPXWSRLDRVTYDDRLALTSDRQGEPYQLAPVDMYVRTADAMKEPSLVTANT

SEQ ID NO: 49391 - protein, 64 aa, Sorghum bicolor
  Clone ID: LIB3476-050-P1-K1-C7.pep
GFCHSLSPWDGRSFSICSGISSMGRPLNCFAAAMPRYTVRRVSTVFGAGRLCHSWIIRAPLRIH

SEQ ID NO: 49392 - protein, 60 aa, Sorghum bicolor
  Clone ID: LIB3476-050-P1-K1-E10.pep
IVSCAASSYTGWCRLLGSSVIDGHRPDEGARHLHQLPPQRVELLLHPRAMGLLAPAGLSY

SEQ ID NO: 49393 - protein, 66 aa, Sorghum bicolor
  Clone ID: LIB3476-050-P1-K1-E3.pep
YLIVMQLLAFKKSWFTTPLPTNCLRVIISVCPCTVGKLLFTALGEMHQSGSEASYIGILCNIDAFI

SEQ ID NO: 49394 - protein, 67 aa, Sorghum bicolor
  unsure (1)..(67): unsure at all Xaa locations
  Clone ID: LIB3476-050-P1-K1-E4.pep
MAPNAEKKPAANXPAEEEPAAEKVPAEKKPKAVKRLPAGKSSGKEGCDKKGTXKAKKSRDTYKIYIF

SEQ ID NO: 49395 - protein, 61 aa, Sorghum bicolor
  Clone ID: LIB3476-050-P1-K1-E6.pep
WSKLRQWLLVHCLMIGFPHAMLKMKTGLKKFLVMQVLMTVKHFLPRPNQMLELGMQLTRGK

SEQ ID NO: 49396 - protein, 52 aa, Sorghum bicolor
  Clone ID: LIB3476-050-P1-K1-E7.pep
SVVGIQNQINFRRSGKSPTESLTEVGESQGQGLEHTYDAMDRDSNSVFDGSS

SEQ ID NO: 49397 - protein, 61 aa, Sorghum bicolor
  Clone ID: LIB3476-050-P1-K1-F7.pep
MSDVMLQTSSVGLRTRPPPDLLADVVYEVLHLVNEPAVNIMFAVVYAHVRPGDVGVPVEDC

SEQ ID NO: 49398 - protein, 103 aa, Sorghum bicolor
  unsure (1)..(103): unsure at all Xaa locations
  Clone ID: LIB3476-050-P1-K1-G11.pep
GRVGETHDGVSKGKYTIGLGQESMALCTEVEDAISMSXTVVKSLLKNYNIDPECIGRSEVGSEXTVIDKSKSIKTWLMQTFEEXGTTDIEGVDYXTACYGGTA

SEQ ID NO: 49399 - protein, 40 aa, Sorghum bicolor
  Clone ID: LIB3476-050-P1-K1-G5.pep
ITPLCALALAPACFLLDRDLRPARQQRDREGTEGWMRREE

SEQ ID NO: 49400 - protein, 87 aa, Sorghum bicolor
  Clone ID: LIB3476-050-P1-K1-G6.pep
HVLHQHVVGLVDEQVRQAVVKSPPVHQLEVCSFAAERDFEARALLIRIGIGRVCSSGVSSGSALASCSTGISTSIGRLESRRAQKNG

SEQ ID NO: 49401 - protein, 102 aa, Sorghum bicolor
  Clone ID: LIB3476-050-P1-K1-H10.pep
GRNCPVMPITTFSSQSGDQNMLLISHLKCRALAASAAQCCHAIRAQHTRAPSRGSLMPACLPALLCSSVCRPAGSLRHPNKMHRGRRGGLSFFRSNGVQEAD

SEQ ID NO: 49402 - protein, 93 aa, Sorghum bicolor
  Clone ID: LIB3476-050-P1-K1-H3.pep
GQLPPPPPHQGTKARPGRLTASVTAAFFDACLRRCRYAKSPCVFGRNPREVLVLVSAPERSCAYLSSGLFRHPRPAKIRSVAGGKAMKGKGGA

SEQ ID NO: 49403 - protein, 70 aa, Sorghum bicolor
  Clone ID: LIB3476-050-P1-K1-H4.pep
GRASSVLGNMCAYLNPTHTSLEVIVVDADLVVGGSGGAAARVREESNALVGVRGDPIIAASYGVSHAVAT

SEQ ID NO: 49404 - protein, 90 aa, Sorghum bicolor
  unsure (1)..(90): unsure at all Xaa locations
  Clone ID: LIB3476-050-P1-K1-H6.pep
SGSAAPRGPGPTGAAPGGRLRLVGGCFLRRRSGVGLHARAGTVGAARNPSSGSGRGMLWRAVAFTGQADASWSGGAGQCGAELRGXREER

SEQ ID NO: 49405 - protein, 128 aa, Sorghum bicolor
  unsure (1)..(128): unsure at all Xaa locations
  Clone ID: LIB3476-051-P1-K1-A3.pep
DAWVIKKMCEETKARIKILDGPPGVPERAVMISAKDEPDAPLSPAVDGLLRVHKRITDSSNGESGQLQRSAGNIGPTRLLVPSSQAGSLIGKQGATIKSIQDSSKVRVRIVENVPPVALNDXRVVEIQ

SEQ ID NO: 49406 - protein, 117 aa, Sorghum bicolor
  Clone ID: LIB3476-051-P1-K1-A5.pep
KPYHNIYMSNGVSLHELSISLLKGQKMSNRQSDDLCSICSDGGQLLLCDTCPRAFHRECVSLSSAPKGTWCCRYCENRQQRESCLAYNNNAIAAGRVEGVDALEQIFTRSIRIATTP

SEQ ID NO: 49407 - protein, 118 aa, Sorghum bicolor
  Clone ID: LIB3476-051-P1-K1-A8.pep
MAPRSRASSRRPLWIIVLVAFVCAVALGAYLYTPRHYTACYLVPSEACNSRPPPEPARVYTDDEIAARAIMRDIIRARPVQSKNPKIAFIVLTPNSLPFEKLWEKFFMGHEDRYTIFV

SEQ ID NO: 49408 - protein, 139 aa, Sorghum bicolor
  Clone ID: LIB3476-051-P1-K1-A9.pep
VRARAFAKKLLNARLAIVDKRRQGHNMSEVMNLIGDVKGKVAILIDDMIDTAGTITSAAALLKQEGAEAVYACCTHAVFSPPAIERLSGGVFEEVIVTNSILLPEDKCFPQLTVLSMANLVAETIWHVHRDGSVSSIFQ

SEQ ID NO: 49409 - protein, 118 aa, Sorghum bicolor
  unsure (1)..(118): unsure at all Xaa locations
  Clone ID: LIB3476-051-P1-K1-B4.pep
MAAAFPASAALAAVAVVALLLCSCNVARAQTPVFACDASNATLASYGFCNRSASASARAADLVSRLTLAEKVGFLVDKQAALPRLGXPLYEWXSEALHGVFYVGPGTRFSSLVPVATS

SEQ ID NO: 49410 - protein, 158 aa, Sorghum bicolor
  Clone ID: LIB3476-051-P1-K1-C2.pep
KDPLERAVLDGRQLALKISANSVYGFTGATVGQLPCLEISSSVTSYGRQMIEHTKKLVEDKFTTVGGYEHNAEVIYGDTDSVMVQFGVSTVQDAMKLGREAADYISGTFTKPIKLEFEKVYFPYLLISKKRYAGLYWTNPEKFDKMDAKGIETVRRDN

SEQ ID NO: 49411 - protein, 117 aa, Sorghum bicolor
  Clone ID: LIB3476-051-P1-K1-C6.pep
MNGGRQDGFGKLHGGYQRRTPRRNSPFAGSAKTSSPGVASDSFYSTFHTTPERRKFSKEEYEAFTREETKKAMKQLLSSPDFNRLALANADRISVAPPGGSYSSSNSQQRHRFWDCL

SEQ ID NO: 49412 - protein, 114 aa, Sorghum bicolor
  unsure (1)..(114): unsure at all Xaa locations
  Clone ID: LIB3476-051-P1-K1-D12.pep
ASSSYYYYYCTNQRKMKRLHALLPTSKPVLHCIVQPKXILLICHFANQVAHGFRASNHRSSVHATCTPNFIQYFHTKETSPVINQGWEWDPNPDMLPAFWKNSCYQLLKFILSY

SEQ ID NO: 49413 - protein, 149 aa, Sorghum bicolor
  unsure (1)..(149): unsure at all Xaa locations
  Clone ID: LIB3476-051-P1-K1-D2.pep
DAWVCISKLVFLLLLCARMLLLPAGVSSAKIHGNPANDLVALINGKRAASKLPALRNSRGLGCMALQYISECMATGAACSSGNTVACQPPEAHITEVYAANCGVELPTVDVISGXLVGCHRDRDGPEDALXXVLASPTGNGNAATDHHQ

SEQ ID NO: 49414 - protein, 135 aa, Sorghum bicolor
  unsure (1)..(135): unsure at all Xaa locations
  Clone ID: LIB3476-051-P1-K1-D3.pep
SRLPSLVDFKTSTKIDALREEIRNMIEHDGSAKGIVFSQFTSFLDLIQFSLEKSGIKCVQLNGAMNITEKGRAIDTFTRDPDCRIFLMSLKAGGVALNLTVASHVFLMDPWWNPAVESQXAQDRIHRIXGQFKPI

SEQ ID NO: 49415 - protein, 103 aa, Sorghum bicolor
  unsure (1)..(103): unsure at all Xaa locations
  Clone ID: LIB3476-051-P1-K1-D8.pep
MASAVAVAVPALGSSTAPILGHHQNQKWSCGLVPGRSSSARDRDRVGGVRQRKILALVVPPPLVSASDHWGNWTFLLSTAALGIWSEKRTPVGKALSXALVSV

SEQ ID NO: 49416 - protein, 153 aa, Sorghum bicolor
  Clone ID: LIB3476-051-P1-K1-E11.pep
PRVRGRVGAGACVAARKAPPRCTASHSTTSTHHAAPQLPHFHHHHQQQQLLPPRHVLATCASDSSCNALTDPPPSQPARRRQTAPATTTMRARRRPSTATPAPAPSAASVSSPPSPYPAAFASLGPAPSPGPGPGPGPGPAPAPRAVCWAFVG

SEQ ID NO: 49417 - protein, 164 aa, Sorghum bicolor
  unsure (1)..(164): unsure at all Xaa locations
  Clone ID: LIB3476-051-P1-K1-E12.pep
MYKLTYPAPGAPDVAKRAKQLLEDAGFGPVAEDRRRGLDHGAWVPLMLMYPEANVPVCQLSVQTDRDATYHYDLGKALAPLREDGGVLIVGSGSATHNLRRILRSFAPTSHEPAXGWAAEFDAWLKESLLGGRHEHVKRYQEKGAVRRGAHPRPDHFYPLDVAL

SEQ ID NO: 49418 - protein, 156 aa, Sorghum bicolor
  unsure (1)..(156): unsure at all Xaa locations
  Clone ID: LIB3476-051-P1-K1-E5.pep
VIITRIGGFLELEIQEWQKAIYSFGGNEVKKWPVQLRRSIPEGIPPSSNGPTLQQQDMALIQDRNMPSSPNPLYSPHSKSSFMKGALGQSGNKKQILVEQTGMDTSRXPLHLVRSINLVAVSQDHSLHLTCXTDLLTRPAFGEGNQGSSGPFEYFG

SEQ ID NO: 49419 - protein, 148 aa, Sorghum bicolor
  Clone ID: LIB3476-051-P1-K1-E8.pep
PHLGASTVEAQEGVAIEIAEAVVGALRGELAATAVNAPMVPAEIMSELAPYVSLAEKLGRLAVQLVAGESGIKGVKVVYTTARGPDDLDTRLLRAMVTKGLVEPVSSTFVNLVNADYAAKQRGLRITEERGRARQPGSGGTGWSPSRF

SEQ ID NO: 49420 - protein, 60 aa, Sorghum bicolor
  Clone ID: LIB3476-051-P1-K1-F1.pep
SHCPSIHCPASYNILTETNLMFLNLITLQPVRVIPAGSITNRLANNSSSNMGTDRLADGT

SEQ ID NO: 49421 - protein, 152 aa, Sorghum bicolor
  Clone ID: LIB3476-051-P1-K1-F12.pep
RTRGRTRGRTRGARDLKTGKFVALKKVRFLNVDPESVRFMAREILILRKLNHPNIIKLQGIITSSFSQSLYLVFEYMEHDLVGLAATTGLKFTEPQVKCLFQQLLSGLDHCHSNGVLHRDLKSSNLLMDNNGVLKIADFGLATSIDPDNQQP

SEQ ID NO: 49422 - protein, 139 aa, Sorghum bicolor
  Clone ID: LIB3476-051-P1-K1-F3.pep
GSGVGVGCASGRDESACSTPFVSAPSSPARDPSFSAAGCFYSAPASPARGGPGTADEYEYGCELGFDFDFDFSSRCPSPAAAAMSSADELFHNGQIRPMRLASFLLRPQALPPLDGDVPPPHSRPRRAGACGGRGGQRG

SEQ ID NO: 49423 - protein, 119 aa, Sorghum bicolor
  Clone ID: LIB3476-051-P1-K1-F8.pep
PRPAPSPSPPPSPSPAAGAPASPAARRRRPRPPTPRRRPWSLPAPASPSSARRRPRGRRPAQRPSRRRCWPRCRARPRAPCGPGRRPSCSLPRRRSPWMGFGAERDRGRGEGGRGGDEW

SEQ ID NO: 49424 - protein, 101 aa, Sorghum bicolor
  Clone ID: LIB3476-051-P1-K1-G3.pep
MKIQKANAGILTNFEVLDFLQTRGAKVDPMGCLGAVAASECKVYEYLLKTPACNQTRESIYEFVKRSEGFKLAEADKLNVINWRPSSAADAYAMIEKCGKR

SEQ ID NO: 49425 - protein, 153 aa, Sorghum bicolor
  unsure (1)..(153): unsure at all Xaa locations
  Clone ID: LIB3476-051-P1-K1-G5.pep
GELPQGIKFLTNLRHLELSSMDNWNMCMPCGIGELTNLQTMHVIKVGSDSGSCGIADLVNLNKLKGELCISGIENITSAQITPEASMKSKVELRKLIFHWCCVDSMFSDDASSVLDSLQPHSDLEEXAIRGFCGVRFPLWLGNEYMFSLSILE

SEQ ID NO: 49426 - protein, 64 aa, Sorghum bicolor
  Clone ID: LIB3476-051-P1-K1-H11.pep
RRSTTVAAAHERLYAAPNRAQAEEMRRRTFLPYRQGLLGCLGFSSRGYGALHGLTKTLNPVFSR

SEQ ID NO: 49427 - protein, 171 aa, Sorghum bicolor
  Clone ID: LIB3476-051-P1-K1-H4.pep
RDHFTLPASDFVLCPVLDILVKIDTCASDCGHRAFGHVDSQTSGVSKSFHDLPLGAWLLAVACLPAAACVLASCKLQYTSAPCLLGCSPRVQSLLAWASAVRPVAAAAYRRRAGLPAAASPVRCRPAAARCRWDPVRRVAGIPSAVLLAAQLSPSPPAAATPRRAPACRKT

SEQ ID NO: 49428 - protein, 187 aa, Sorghum bicolor
  unsure (1)..(187): unsure at all Xaa locations
  Clone ID: LIB3476-051-P1-K1-H5.pep
IGPEGDLLETTEKQCNRLALKGPLVSIDEMEAIKKMNYRGWRSKVLDITYPKKSGRKGLEEALDRICXEAREAISKGYTILVLSDRGFSSDRVATSSLLAVGAVHQHLVANHERTRIGLLVESAEPREVHHFCTLVGXGADAICPYLAIEAIWCLQNDGKIPPNGDGQRYSKEELVKKXFYASNYGM

SEQ ID NO: 49429 - protein, 181 aa, Sorghum bicolor
  Clone ID: LIB3476-051-P1-K1-H6.pep
RAVMATCDHGAVAKIKRVVMDRDTYPRKWGLGPVALKKKKMIAEGLLDKHGKPNEKTPAEWLRNVEVVLPTGGDVSIASIAAAPEPEKVKVEQDAVIHEEVKEKKKKRQKDENNDDDASVPAKKIKVEEAAEAVEGEKSEKKKKKKKDKGESESADAVEVKEAEKADVADEKGSEKKKKRR

SEQ ID NO: 49430 - protein, 73 aa, Sorghum bicolor
  Clone ID: LIB3476-052-P1-K1-A5.pep
LCLFFSNICLGSFAPQFSSKKSCTTGLLFLSWFMIRFFLLIVVLLEFFPFWFSVLIYSYAFNCFAMKFLSLLT

SEQ ID NO: 49431 - protein, 89 aa, Sorghum bicolor
  unsure (1)..(89): unsure at all Xaa locations
  Clone ID: LIB3476-052-P1-K1-B10.pep
MAANLWTSLILIQXLDPDDVDLVPAADLERCITPEEIRLIKSHMSFHIXCRLAQHVKVRHLGSRTNFISVVEPILFNLIYVVFLLLVFS

SEQ ID NO: 49432 - protein, 54 aa, Sorghum bicolor
  Clone ID: LIB3476-052-P1-K1-B12.pep
KIQHWVHQCGSRCSPPLLSLIYCRPPPQQPLYTSVAKACWMVPVHIFVDDRVCT

SEQ ID NO: 49433 - protein, 100 aa, Sorghum bicolor
  Clone ID: LIB3476-052-P1-K1-B3.pep
MPASASSAGAGAASPSGSASASASDPTPSWWESVSQARSRILALSSILPAAVSHDVAALADADRPARALLRSPAAYAGLSDALRAGGGADDPGCHWLYDT

SEQ ID NO: 49434 - protein, 161 aa, Sorghum bicolor
  Clone ID: LIB3476-052-P1-K1-B7.pep
IQSSVELLCEEREKKFRRREEDRVRQREILEQMAYGKTPMNKAVDMQKLKGLTAIGFEKYLAAEALRINENDADKALDLLTNPEQNCILQSKIQAKRSRASRGFSAGSSSSKAAVARAAPAINNSQTSVNDVPHPADGDAPPHPADGGAPHPADGRNAPHM

SEQ ID NO: 49435 - protein, 46 aa, Sorghum bicolor
  Clone ID: LIB3476-052-P1-K1-C1.pep
FMMGTAEHRYSKTASSANPNVLMMLFLGYSTVRCFCLYNVTPFHTC

SEQ ID NO: 49436 - protein, 151 aa, Sorghum bicolor
  Clone ID: LIB3476-052-P1-K1-C12.pep
RASERVSRSVQPRHRRHEAQPPEPEPGEDVAVLLVHPYTILGGVQGLLRGMAEGVARRGYTAVTFDMRGAGRSTGRASLTGSTEVGDVVAVCRWVAENIKPRGILLVGSLAGAPIAGSAGDKVDEVIGYVSIGYPFGLMASVLFGRHYDAI

SEQ ID NO: 49437 - protein, 120 aa, Sorghum bicolor
  unsure (1)..(120): unsure at all Xaa locations
  Clone ID: LIB3476-052-P1-K1-C9.pep
PLVIHVGRFGREKNLDFLKRVMERLPGARIAFVGDGPYRAELEKMFMGMPAVFTGMLQGEELSQAYASADVFAMPSESETLGQVVLESMASGVPVVAARAGGIPDIIPNDKDGXTSFLFT

SEQ ID NO: 49438 - protein, 129 aa, Sorghum bicolor
  Clone ID: LIB3476-052-P1-K1-D10.pep
HAVATGREQVGERQRHQAKRAPPSSDAMRAGGDLVWVDPLVLPEVVRDPFIGAWAHHRSGGARNNMGSHLEGGASASHGPGDGGSTSTRHELPELVSRVASGGGGGRAEIQGAGLLYALPSPTWGVQFQ

SEQ ID NO: 49439 - protein, 68 aa, Sorghum bicolor
  Clone ID: LIB3476-052-P1-K1-D12.pep
IVMSVPMFKKQNSLSTPVHKTNPFDSDSDSERPSRAQSVPVRHTNQFCQELEDYAITKAPETTHKVND

SEQ ID NO: 49440 - protein, 68 aa, Sorghum bicolor
  Clone ID: LIB3476-052-P1-K1-D8.pep
PCLAFVISTVQHSLGYSSSSFTAISGGSSSLVLWQCPMYGLYIGLSSVCLSSCCCIICSSGRLVLISL

SEQ ID NO: 49441 - protein, 110 aa, Sorghum bicolor
  unsure (1)..(110): unsure at all Xaa locations
  Clone ID: LIB3476-052-P1-K1-D9.pep
ATPNRSLALLLPLSATSSILNMSLNIGLLNEVSDTAIDALLLDQDLLTDAVIEAMIYAILSQVKDRTKGEPGWHKVWTDYSADXLVLNAYLKLLSRLLEARLTALSIHLI

SEQ ID NO: 49442 - protein, 76 aa, Sorghum bicolor
  Clone ID: LIB3476-052-P1-K1-E4.pep
MASSMKFLCILGLILLIGTVVDGAGECGRSSPDIDAFKLAPCAGASHDAHFALPGGCSTQINRFTHYPKCLCAILL

SEQ ID NO: 49443 - protein, 141 aa, Sorghum bicolor
  Clone ID: LIB3476-052-P1-K1-E6.pep
MGGAAAKKKEPAPAPRVRTPSPTALMMKFPLKSTLPSVASLKARFARFGPLDVDGIRVYWKSHMCRVIYRFKADAEAALRYAKANAMFGQVDTQYHLREVESWAAVAAPEAPPQQQQQQRSELRLMETASFMPGSSGNGAP

SEQ ID NO: 49444 - protein, 50 aa, Sorghum bicolor
  Clone ID: LIB3476-052-P1-K1-F10.pep
SGVGPADCSELYLSERLCISRQPWPATHETLSVKALMNQSLSLITETYYS

SEQ ID NO: 49445 - protein, 59 aa, Sorghum bicolor
  Clone ID: LIB3476-052-P1-K1-G11.pep
RKYDRSAHASSAVASANADATFPSHSHTLLAPGGAAPPAEGSGAIVMGWGAAGPGRLWV

SEQ ID NO: 49446 - protein, 144 aa, Sorghum bicolor
  unsure (1)..(144): unsure at all Xaa locations
  Clone ID: LIB3476-052-P1-K1-G2.pep
ACGRQLVRVLDLGELAGGDELLEXARAGALRKLRRGAWSIVLCPSTELVQIGVLGWTPRPSLLSDVXSPSEISFSAVRAAWSRRWFYLHWGASGPSIALGPDFALERAGLPTGCPPRACLGWPPSSHTALRSTQPLSGSPLECE

SEQ ID NO: 49447 - protein, 170 aa, Sorghum bicolor
  Clone ID: LIB3476-052-P1-K1-H10.pep
RLQRHKMGVEDFELLTIIGRGAFGEVRLCREKSSKNVYAMKKLKKSEMLRRGQVEHVKAERNLLAEVDSAYIVKLYYSFQDEEFLYLIMEYLPGGDMMTLLMRKDTLTEDEARFYIAETVLAIESIHKHNYIHRDIKPDNLLLDRIGHLKLSDFGLCKPFDSNNFSFLNE

SEQ ID NO: 49448 - protein, 146 aa, Sorghum bicolor
  Clone ID: LIB3476-052-P1-K1-H2.pep
PRVRPRVRSCLKKLSGYSDRQDEIPNDNALSVSERLQCCIVAFKVWRSNLEALNVDLQDFFVQLYNLILEYRPDRDHGEVLADALKTLLWEGKQQDMLRAAAFIKRLATFALSFGSAEAIAALVTLKHLLQINSKCRNMLENDSGG

SEQ ID NO: 49449 - protein, 61 aa, Sorghum bicolor
  unsure (1)..(61): unsure at all Xaa locations
  Clone ID: LIB3476-052-P1-K1-H4.pep
RKVASDLPMLEESLQRLAKSDPMVLCTRGESGEHIIAGAAVHHLEICLXDLQDDFLGGAEN

SEQ ID NO: 49450 - protein, 146 aa, Sorghum bicolor
  Clone ID: LIB3476-053-P1-K1-A9.pep
EIQVWKDVDGVLTCDPNIHPKAKPVPYLTFDEAAELAYFGAQVLHPQSMRPAREGDVPVRVKNSYNRRAPGTLITKARDMSKTVLTSIVLKSNITMLDIVSTRMLGQYGFLAKVFSIFEDSGMSVDCVATSEVSISLTLDPSKLWS

SEQ ID NO: 49451 - protein, 125 aa, Sorghum bicolor
  Clone ID: LIB3476-053-P1-K1-B1.pep
RCPFCDQAEDSINHLLVECVFAREFWFFMLRQVGLQILSPQPTDNSFLDWWERADNATTNLVRQGVNSLIILGAWTLWNHRNRCIFDGSAPSVAGALVVAGEERRMWSTAGARGLSLLTAHLPGD

SEQ ID NO: 49452 - protein, 78 aa, Sorghum bicolor
  Clone ID: LIB3476-053-P1-K1-B11.pep
QQDENGDFSVSISAIEDSLVSDAPGDHFCESLCPFRTREGCRWPDAPCAQLGSQFVGLKANFDAFDRLSIQDCYFGPE

SEQ ID NO: 49453 - protein, 180 aa, Sorghum bicolor
  unsure (1)..(180): unsure at all Xaa locations
  Clone ID: LIB3476-053-P1-K1-B6.pep
XFKDLEGVVAYMHGWDRDGHPVCYNAYGVFKDRDMYERVFGDGDRLSRFLRWRVQVMERGVRALTLRPGGVNAIIQVTDLKDMPKRELRAASNQILSLFQDNYPEMVARKVFINVPWYFSVLFSMISPFLTERTKSKFVIAREGNVAETLYKFIRPELVPGQYGGLSRAGDLENGPPKPA

SEQ ID NO: 49454 - protein, 120 aa, Sorghum bicolor
  Clone ID: LIB3476-053-P1-K1-C12.pep
MRQSLGYDAYPAGTISTSNGTEVYGTGLKNAAGEYNCFLNVIIQSLWHIRRFRDEFLKTSSLHKHVEDPCAVCALYGIFIDLSKAAKGQGEAVAPTSLRIALSKSYPNSKFFHEGQMNDA

SEQ ID NO: 49455 - protein, 178 aa, Sorghum bicolor
  Clone ID: LIB3476-053-P1-K1-C7.pep
ASLRTPSKLKINSRTSSWPRRNLDSGLAKVAALEILERWTVDRSELLIGHRFASGAYSRLFHGIYKELPVAVKFIRQPDDGEDDELSAKLEKQFTSEVTILARLQHRNVIKLVGACNCPPVFCVITEFLSWGSLRAFLRKLERKTLPLEKVVSIALDIARGLEYIHLKGIVHRDIKPE

SEQ ID NO: 49456 - protein, 44 aa, Sorghum bicolor
  Clone ID: LIB3476-053-P1-K1-D1.pep
GVYENLISVLGPNIFCWLCPVLNTVGNGLRYRTSYDIPISTPPM

SEQ ID NO: 49457 - protein, 173 aa, Sorghum bicolor
  Clone ID: LIB3476-053-P1-K1-D11.pep
WLQVSTTLIDGLIQPAFVKWIEEEQALENGQINEKLMKVISSKLKEDNKILRRFNRFGKSELYLDMLFFLRFGSARSDSYYDVKFLAEHGERILEDLVISLADVIASVYLELMSVDGDMSTEVVSSSLVLCSLSTRELQKLRNEVAIKLGLHQYFKSVVSMYEDRFELYVLCS

SEQ ID NO: 49458 - protein, 144 aa, Sorghum bicolor
  Clone ID: LIB3476-053-P1-K1-D2.pep
RTRGGYYKGCDDDKRKQRPLTPAAQAEQEHRKRVLRELNSLISGAAAAPDEAVEEEVTDTEWFFLVSMTQSFLNGSGLPGQALFAGQPTWIASGLSSAPCERARQAYNFGLRTMVCFPVGTGVLELGSNDVVFQTAESMAKIRS

SEQ ID NO: 49459 - protein, 137 aa, Sorghum bicolor
  Clone ID: LIB3476-053-P1-K1-E11.pep
QAQAMEADKEFYSRIRIPDEDDSCSQKQTCRSSASQGADSKPASERQSRGVEHIKQGLVNFIASLLMPLYRGKKIDREGYKSIMRKSVNKIIDTCSEGEKSMTTLEFLDAKRKIKIESFVNKMVDKHLHVVSKSAKP

SEQ ID NO: 49460 - protein, 178 aa, Sorghum bicolor
  Clone ID: LIB3476-053-P1-K1-E12.pep
ALSGAIPDELRGLKQLQELQISGNNLTGALPGWLAGLPALRVLSAYENALSGPIPPGLGLSSELQVLILTLNRLNGTIPDAIGRCRGLSNVRIGDNLLSGAIPASVGDATSLTYFEANTNDLSGGIPTQFARCANLTLLNLAYNRLAGEVPDVLGELRSLQELIVSSNGLGGEFPRSI

SEQ ID NO: 49461 - protein, 175 aa, Sorghum bicolor
  unsure (1)..(175): unsure at all Xaa locations
  Clone ID: LIB3476-053-P1-K1-E9.pep
VMAQSDPPSTGAFHPDVAPQLQQILAFLSRTGAPFMINPYPWFAYQSDPRPETLAFCLFQPNAGRVDGGSKIRYTNMFDAQLDAVKSALVRAGYGSVDIVVAETGWPTKGDAGEPGATAENARAYVSNLVAHLRSGAGTPLMPGKSVETYLFALYXRTSXPGPTSERSFGLYHTD

SEQ ID NO: 49462 - protein, 161 aa, Sorghum bicolor
  Clone ID: LIB3476-053-P1-K1-F11.pep
EGFIHKVDKGGSDVELLEDARIVAPQGIQWHVFAAFGTLKGGRADWLIEKCTELGASSVTPLLTERCHTIAENRVDRLQRLVLAAVKQCQRIHEMSLKPPIQISHLLPVVSQSKLAFLASAEAPPLLSVLPKSSTEQSGLLIVGPEGDFTEEEVHSLKAAG

SEQ ID NO: 49463 - protein, 175 aa, Sorghum bicolor
  unsure (1)..(175): unsure at all Xaa locations
  Clone ID: LIB3476-053-P1-K1-F5.pep
KVAKEHKKPWLWWDYVTDFAIRCPMKEKKYTKECAEGVIKSLGLDHKAIDKCIGDPDADEENPVLKAEQDAQIGKGSRGDVTILPTLVINNRQYRGKLDKGAVLKALCAGFKETTEPAVCLSEDIQTNECLENNGGCWQDKAANITACKDXXPWRVCXXSVKGVNLVGWYTHXKL

SEQ ID NO: 49464 - protein, 172 aa, Sorghum bicolor
  Clone ID: LIB3476-053-P1-K1-F9.pep
YRGTMPGGECVAVKRIVSAEGGGFQAEVETLGRIRHRHIVRLLAFCSGPEAKLLVYEYMVNGSLGEALHRRNDGDGSGVLAWASRLRVATEAAKGLCYLHHDCSPPILHRDVKSNNILLDARMEAHVADFGLAKFLVGGNDATECMSAVAGSYGYIAPEYAYTLKVDEKSDV

SEQ ID NO: 49465 - protein, 43 aa, Sorghum bicolor
  Clone ID: LIB3476-053-P1-K1-G3.pep
IFVNKSVSELFLLLNEDSYNIEQSISDIIYLPSEMFGEEISVT

SEQ ID NO: 49466 - protein, 149 aa, Sorghum bicolor
  Clone ID: LIB3476-053-P1-K1-G8.pep
CSYSCHCGGDGNGRHRTEDIPSGVATRARQDAGLRERMRGLPFRLLRMGFRQRERRGVRALQVRLGGGVVCVGLRGRRAVAVRGGRRLEVVEREHDAAGEELVGGEQRRGRVRAHHPELELGRRGVGRRGPPGVALRYRGRRKRPHGVR

SEQ ID NO: 49467 - protein, 131 aa, Sorghum bicolor
  Clone ID: LIB3476-053-P1-K1-H12.pep
SRNPLCSLHSWSLTSSYPEPSSRSILMVSGAASNNVDSDVERSVTNWEETEGTREDGELPVVIPAENEPNGSTILHPEVSPEIRSHSRGLSLISKSATPSKLSISQSFGRNEDDLDLLMYSDNELEDQPCI

SEQ ID NO: 49468 - protein, 179 aa, Sorghum bicolor
  Clone ID: LIB3476-053-P1-K1-H2.pep
ERLPKAPPNHRISTPRLPPSLSELPSIARYAPPIVAMIDGQPMEVEAPVLAPQQAVSPPAATLSKKTLASTPKSRAARRKTLCDITNLSKREPADVPVPDESACPAPASAGGVVEFAQLVKKNEELVRLLAERDKIIQLKRGRDSEAATCQLGTCPDQFPYVGRVNLGKNNLLALQHEP

SEQ ID NO: 49469 - protein, 84 aa, Sorghum bicolor
  Clone ID: LIB3476-053-P1-K1-H6.pep
MSCCGGNCGCGSGCKCGSGCRGCMMYPDMVEQQVTTTGKTVVMGVAPSFKGHAEGRFEAADDARADNEGCKSRPNCSCNHCTCK

SEQ ID NO: 49470 - protein, 157 aa, Sorghum bicolor
  Clone ID: LIB3476-053-P1-K1-H8.pep
MADAARLFLLVAVTAALAGRSDAAWCVCRTDLADTALQKTLDYACGGGADCKPILQNGACFAPDTVKAHCSYAVNSFYQRNNQNPQACVFSGTATLSNNDPSGNGCTYPATPSAAATSSPGVYSPPTMGPSALNDNSGAAGVLPTAAGLATRLVILA

SEQ ID NO: 49471 - protein, 140 aa, Sorghum bicolor
  unsure (1)..(140): unsure at all Xaa locations
  Clone ID: LIB3476-054-P1-K1-A12.pep
PRVRGRVGSHNHLSGGVPLELGRLPATVTLDLRFNNLSGEIPQSGSLASQGPTAFLNNPGLCGFPLQVPCRAAPPSSASSSXSLPPPXSSGGGAGGARQPIKTSLIELISVADPVADVLILRKPVSQNVTQLELCGKNAV

SEQ ID NO: 49472 - protein, 177 aa, Sorghum bicolor
  Clone ID: LIB3476-054-P1-K1-A4.pep
EKLSKVHQEKKEQEETTKNAEAHRQRIGSLDEFLATKEVSQNSGNSTEEETSEVVDPSVDSSTEHKENTPECSDHTSTENFQTSPQATESGGAGEIQSTQTVRKGVSQLRAKKTRDPVADPSVDSSTENKENTPEHSANTSTENSQTSAPLTGSEGGDEENQSTQSVRKGASRSRAK

SEQ ID NO: 49473 - protein, 139 aa, Sorghum bicolor
  Clone ID: LIB3476-054-P1-K1-B10.pep
PTRSPESFKLDYVSIGNQECWMLYYRGNYQKFYSAIKSAYPDINIISSCDRPTISPSNPADLYDVHVYTSLTNMFSKTSMFDNTPRGAPKAIVSEYAVTGNDAGKGTLVAALAEAAFLIGLERDSDVVEMASCAPLFVM

SEQ ID NO: 49474 - protein, 171 aa, Sorghum bicolor
  unsure (1)..(171): unsure at all Xaa locations
  Clone ID: LIB3476-054-P1-K1-B3.pep
TNVRHVSHVTFDRFHGFLGLPSEFEDEMPCRVPSASASVFGVSAESMQCTYDGKGNSVPTILLLMQERLYAQEGLKAEGIFRINPENDQEEHVRDQLNKGVVPEDIDVHCLASLIKAWFRELPGSVLDGLSPEQVLQCNSEXEFLDLXSXLRPTQAALLNWAVELMSDVSK

SEQ ID NO: 49475 - protein, 74 aa, Sorghum bicolor
  Clone ID: LIB3476-054-P1-K1-B6.pep
NHVKVMERLKMGNRQTKMHYRASHENAKMQNSVTSLDRICLHGNNKAMSFMKTMSLHWDFLWWNFSEMTTSDAW

SEQ ID NO: 49476 - protein, 147 aa, Sorghum bicolor
  Clone ID: LIB3476-054-P1-K1-C12.pep
ANRGVQGSLTGISIGVVTPMDKVWRSLQAFGDIAFAYSYSLILIEIQDTIRAPPPSESTVMKRATVVSRAVTTLFYMLCGCMGYAAFGDGAPGNLLTGFGFYEPFWLLDVANAAIVVHLVGAYQVYCQPLFAFVEKWAAARWPDSAF

SEQ ID NO: 49477 - protein, 184 aa, Sorghum bicolor
  Clone ID: LIB3476-054-P1-K1-C7.pep
HASAHASGSVGASGGPGCRKHVAKVTEYGAVGDGRTLNTEAFAKAVADLSRRARDGGAALVVPPGKWLTGPFNLTSCFTLYLDEGAEILASQDMNHWPLIAPLPSYGRGRDEPGPRYINFIGGSNLTDVIITGKNGTINGQGQVWWDKFHAKELKSTRGHLLELLHSDNIIISNVTFVDAPYWN

SEQ ID NO: 49478 - protein, 143 aa, Sorghum bicolor
  Clone ID: LIB3476-054-P1-K1-C8.pep
ADSVNANGTLNSESKCAMDQELKNAILKIQDFVKLLDQEVSKFQGQSSDYDGLCEKTRQFSALVDKVLSNGDVLNDIVMALSVILSETSQIKFTMLRDNSNEAESNNLDCVDKVTLLENKVQPEPVKDNVSGLLPLVPHSSSD

SEQ ID NO: 49479 - protein, 102 aa, Sorghum bicolor
  Clone ID: LIB3476-054-P1-K1-D1.pep
TCLPASSLYALSPHHPLLGLPNQHKLLQMPLVQEQAAANNHGVMLYSDHHHHGGGLLYPLLLPGIPFCPFSAAADAATCDKTTTTGGFAALDAGEAGTSVAK

SEQ ID NO: 49480 - protein, 169 aa, Sorghum bicolor
  unsure (1)..(169): unsure at all Xaa locations
  Clone ID: LIB3476-054-P1-K1-D11.pep
GRVGSPFVLRELDQPVDTLKHVGISGPMVENIETRLKEDILSEIKQLGGRLLLHKEEFNAATNQCSVVGYWEHIDLEDVMTPAEVYSTLRDKGYCIDYKRIPLTREREALAADVDAIQSLIEESARYYLFISHTGXWCVAYAMAITCLGLGADAKFVMEETAETHFVST

SEQ ID NO: 49481 - protein, 139 aa, Sorghum bicolor
  unsure (1)..(139): unsure at all Xaa locations
  Clone ID: LIB3476-054-P1-K1-D6.pep
MVALLRPLSAAAFLRVPAAPLTGSAVAASAVGGRRWRSVRANAGGGWLSGLLGGKGGGASTAMAVTPGTVKAGDPVLHEPAQEVAPXDVRSEKVQGIIDRMVDVMRKAPGVGLAAPQIGVPLRIXXLEDTQEYISYAPK

SEQ ID NO: 49482 - protein, 114 aa, Sorghum bicolor
  Clone ID: LIB3476-054-P1-K1-E8.pep
TQPLLSLSAALSLQDISNRSHMLMTEALIPTPTAVPSSHWHLQGDLGERPWCRWRGSAARPRARCRGSIPTDLHSARLVLLSGRSMFCEHWVQQIHRLHASTYILDVIVLAHAS

SEQ ID NO: 49483 - protein, 182 aa, Sorghum bicolor
  Clone ID: LIB3476-054-P1-K1-F10.pep
PRVRPRVRPRVRENLVTWARPLLSHKEGLEKLIDPSLDGKFNFDNVAKVASIASMCVHTDPSQRPFMGEVVQALKLIYNDPDEACDDSYSPRNSSDQDGDYEGDLVFESGSWGFEASGCLDYRNSLPFVTMDYSSGRIEGPHDPRAALSAGPHVQSPVLQNRSGPLRMKKKLASFYRSRGSI

SEQ ID NO: 49484 - protein, 170 aa, Sorghum bicolor
  Clone ID: LIB3476-054-P1-K1-F6.pep
HLVYDLLLKFIGSSSLDTKVGKKYFDHTFIVKLLELFDSEDPRERDCLKTILHRIYGKFMVHRPFIRKAVTNIFYHFVFETDRHNGIAELLEVFGSVISGFALPLKEEHKIFLWRVLIPLHKPKSVGLYLQQLTYCVTQFVEKEPKLASSVILGLLRYWPITNSQKEVCF

SEQ ID NO: 49485 - protein, 122 aa, Sorghum bicolor
  unsure (1)..(122): unsure at all Xaa locations
  Clone ID: LIB3476-054-P1-K1-G12.pep
SCRFPAPGKASKMGNLDTSLFPQINKTVQQQSEVDEKLASILYEALLTLRRQIMEECSEGCHAYHIFKTDTLKEMSXRVPRTKEELLDINGIGKTKLKKYGDRVXATIEDFLSKHPNPRRNI

SEQ ID NO: 49486 - protein, 77 aa, Sorghum bicolor
  unsure (1)..(77): unsure at all Xaa locations
  Clone ID: LIB3476-054-P1-K1-G5.pep
LVASKPSLVRHGKALVLAHHREVSDASCVLTVLGELILTLLFAFAGVGXPMASRKLAGSSGDTVVGLTAVALAHTLV

SEQ ID NO: 49487 - protein, 146 aa, Sorghum bicolor
  Clone ID: LIB3476-054-P1-K1-H3.pep
PTRPGALTPKESTPREGKEVENSFAEGGLPSKLKPKMALDVNEILLVKKKSVLGKDGPKEKKQGARGDTLVCGACGQVGHMRTNKLCPKYGEDPEMSEMDANSVKPNPTDINHLQAKIPKRLITKVSSEVTETEGPEGIEKTNLSQ

SEQ ID NO: 49488 - protein, 59 aa, Sorghum bicolor
  Clone ID: LIB3476-054-P1-K1-H9.pep
HACDDAGYHSASIKDGQKHGTKHYIVQDTILLTTLMLMLIIANVNATPHSTTMTCFMSL

SEQ ID NO: 49489 - protein, 145 aa, Sorghum bicolor
  Clone ID: LIB3476-055-P1-K1-A11.pep
VLVKNTFQQHFAHSFPHHGLCNNPHNSRLRSLKLAACYIPPLKGFHALTSLVLQDLPESTPTAAYEAIFTLCPQLQALHLKSCTLNQGVVAVHAPKSQIKQLIMEHCWFGLIKLYTLPMLESMAVLQSNVSYELSSFPYLTHLNI

SEQ ID NO: 49490 - protein, 136 aa, Sorghum bicolor
  unsure (1)..(136): unsure at all Xaa locations
  Clone ID: LIB3476-055-P1-K1-A5.pep
RGFYKGNGASVLRIVPYAALHYMTYEQYRCWILNNFAPSIGTGPVVDLLAGSAAGGTAVLCTYPLDLARTKLAYQVSNVGQPGNAFGNSGQQQTYNGIKDVFKTVYKEGGARSLYRGVGPTLXGILPYAGLKFYIY

SEQ ID NO: 49491 - protein, 140 aa, Sorghum bicolor
  unsure (1)..(140): unsure at all Xaa locations
  Clone ID: LIB3476-055-P1-K1-B10.pep
MDPAPQTHPILSYVLSRIPTLVKSNKGSTTFEFDIEQPSPVHTPYPRTVPMFPFAGEFELVXRMPGLRHPFVLRAMTRAGFDVFAARAALQVLGPRPDHELVDSYRAIVVAAEAGDARIPEGDAEACPAXVRLEQTHDAY

SEQ ID NO: 49492 - protein, 143 aa, Sorghum bicolor
  unsure (1)..(143): unsure at all Xaa locations
  Clone ID: LIB3476-055-P1-K1-C5.pep
VLDRELELVLIVGPGVLGRIVAEMXXQGYTGGKVCGRSGRTDHHSELTDIGIIPSLKRSVAGPKFPNVIFCAPPYRSEDYAGDLRIAASNWNGEGSFLFTSSTAVYDCSDNGFCDRGPHVYWLSKGTXDVRPDHILNLIHXED

SEQ ID NO: 49493 - protein, 85 aa, Sorghum bicolor
  Clone ID: LIB3476-055-P1-K1-C8.pep
MASAGNSGSGDDDSGGKLLADRYQKGEVLGEGTYGVVFKAIDTKTGNTVAVKRIRIGKDKKEGVNFTALREIKLLKELKDPNIIE

SEQ ID NO: 49494 - protein, 153 aa, Sorghum bicolor
  Clone ID: LIB3476-055-P1-K1-C9.pep
DAWAHARTKGSTRVRLHRELAALLEEELSRRGTSVIPAGEQFGKWKGLRESTDREIVWPPMVIVMNTFLEKDDDDKWKGMGNQELLDYFGEYAATKARHAYGPSGHRGMSVLIFESSAVGYMEAERLHRHFVNQGKDRNAWQLNKVRFVPGGK

SEQ ID NO: 49495 - protein, 144 aa, Sorghum bicolor
  Clone ID: LIB3476-055-P1-K1-D3.pep
PTRPRRRRKGVPILVPGLCLPKALQPFLPIFQQGLISGSAETKEQAAEGLGELIDVTSEKTLKEVVVPITGPLIRILGDRFPWQVKSAILSTLTIIIMKGGIALKPFLPQLQTTFMKCLQDNNRSLLTRAAAALGKASALSTTG

SEQ ID NO: 49496 - protein, 162 aa, Sorghum bicolor
  Clone ID: LIB3476-055-P1-K1-D9.pep
PTRPDVSNYFSIYGPVHDVRIPYQQKRMFGFVTFVYPETVKLILAKGNPHFICDARVLVKPYKEKGKVPDKYRKQQQGDFSGCTTPPGGLDARDPFDLHQLGARMLQHSNSANELLLRRKLEEQQQAAELQQAIELQSRRLMGLQLLDLKARAATTAAAASP

SEQ ID NO: 49497 - protein, 185 aa, Sorghum bicolor
  unsure (1)..(185): unsure at all Xaa locations
  Clone ID: LIB3476-055-P1-K1-E1.pep
DLDSKRRKMESAGIDAALMGKPNREPRVVVQTVSEVDILDDGYRWRKYGQKVVKGNPNPRSYYKCTHTGCPVRKHVERASHDPKSVITTYEGKHNHEVPASRNASHEMSTAPMKPVVHPINSNMPGLGGMMRACDARAFTNQYSQAAESDTISLDLGXGISPNHSDATNQMQPSVPEPYQYQMQH

SEQ ID NO: 49498 - protein, 71 aa, Sorghum bicolor
  Clone ID: LIB3476-055-P1-K1-E11.pep
DPARAVPPASRPASRTRLTELRWLKGPAPTYLNGTDTDIVHSDIVSTSAYKIFAKTELNVKCYYHQILGTS

SEQ ID NO: 49499 - protein, 139 aa, Sorghum bicolor
  unsure (1)..(139): unsure at all Xaa locations
  Clone ID: LIB3476-055-P1-K1-F1.pep
EITXNIVNDNIXSQYMHKILPTGNYLWTFKKQFAIQVALSCFMSYMLQIGGRAPNKILFAKNTXKIFQTDFHPAYDPNGMIEFNELVPFRLTRNLQAFFSNXGVEGLIMSAMCSAAQSVVSPKQSQHIWHHFAMFFRDE

SEQ ID NO: 49500 - protein, 136 aa, Sorghum bicolor
  unsure (1)..(136): unsure at all Xaa locations
  Clone ID: LIB3476-055-P1-K1-F4.pep
KKKIFFWXLLLRDRLSTTXILNGEILFLDDYHCVFCTSMPTEESVTHLFLDCPFAQACWATLGLIVPHLQDPFLTVVMFKAQLHCPFALEILITMSWSIWSIRNDLIFRGIQPSVQRCKAIFRKEFALVILRAKAA

SEQ ID NO: 49501 - protein, 155 aa, Sorghum bicolor
  Clone ID: LIB3476-055-P1-K1-G3.pep
RRNTKEEIDWSYIQFVDNQEILDLIEKKPGGIIALLDETCMLRNSTHEIFAEKLYQKFKENPHFSRPKFSRSDFTIHHYAGNVTYQTDLFLDKNIDYAVNEHQVLLHASRCSFVSNLFPPSEESAKSTKFTSIGSSFKQQLQSLLETLSATEPHY

SEQ ID NO: 49502 - protein, 132 aa, Sorghum bicolor
  unsure (1)..(132): unsure at all Xaa locations
  Clone ID: LIB3476-055-P1-K1-H4.pep
PRVRAFGVNLQRASTRAAGSHGLFEIRCSDNMLVTQVIGPGEEASPDSHETFKHDSSFCIQMHSVEETQSFSVSMETKGDIKSDFVFFQFAVHYSDIYQTEITRVITMRLQTVDGXSAYLSVCSXDVRSYHW

SEQ ID NO: 49503 - protein, 95 aa, Sorghum bicolor
  Clone ID: LIB3476-055-P1-K1-H8.pep
SCVSLAFTTAVIPLARTVPLIPSYMIPVSARAPEPVRIPPLLARLIMWQTVWTVMKASLVLFSRLQPLAQLGPCTSLGCYTCQSCRRIQQHTVRV

SEQ ID NO: 49504 - protein, 51 aa, Sorghum bicolor
  Clone ID: LIB3476-056-P1-K1-A1.pep
NNGSQGLGEETAMAEAAECSVIHPPWRSSTHGRRSCFLRSRVTRGYKQEHD

SEQ ID NO: 49505 - protein, 54 aa, Sorghum bicolor
  Clone ID: LIB3476-056-P1-K1-B5.pep
RIRCHSEFLDFGCHPTRPCIILNSARNTLICQGTRPNISHCISAENGQRPSNKA

SEQ ID NO: 49506 - protein, 115 aa, Sorghum bicolor
  unsure (1)..(115): unsure at all Xaa locations
  Clone ID: LIB3476-056-P1-K1-C12.pep
MLAGGKRRYGFDDGDARLDRPRNVAVDDRDDVYVGHESNHAGRKGPPCGYTTTATGRLSXXPGENDGLAQNATLLRYDEPCYVPKISAMLVARRRNPMALPIYLEAENCAHEKHI

SEQ ID NO: 49507 - protein, 121 aa, Sorghum bicolor
  Clone ID: LIB3476-056-P1-K1-C9.pep
LPDDCCAAAAAAAALGQVLRLSLVSSPATSTHQGMKMSASALKDLNVSQSANLENGKDNSVKSCISKPVLNGNSCAKKEESSLSACPDAVTNGNVAGNADVEYIDSENLVDLPDVDAALST

SEQ ID NO: 49508 - protein, 72 aa, Sorghum bicolor
  Clone ID: LIB3476-056-P1-K1-D12.pep
EPSDEGSLGPPNRPPVQVTGEPEVELDGIRPGADGLPVPPPGPHVDNQGYTHGCGSRGPARVAAYPVPYACA

SEQ ID NO: 49509 - protein, 43 aa, Sorghum bicolor
  unsure (1)..(43): unsure at all Xaa locations
  Clone ID: LIB3476-056-P1-K1-D3.pep
GASTTTPRLVTWWXCSVPITSTTPFCTITTVTFPSKHRIASVT

SEQ ID NO: 49510 - protein, 129 aa, Sorghum bicolor
  Clone ID: LIB3476-056-P1-K1-D4.pep
PTRTTKCTTNSASFAPCLPRCLARRLSAAPCGSAGRNTRMQTLQAPSQAQRMRQRMLVKAVDIAAELATVWTVVTEGSKEHLAAHLDATLHSALGYRSCQRSAVTRVQKLVAPLGAKLRQKVQPGRHLQ

SEQ ID NO: 49511 - protein, 80 aa, Sorghum bicolor
  unsure (1)..(80): unsure at all Xaa locations
  Clone ID: LIB3476-056-P1-K1-D8.pep
IADTKENTDISKCSDSCGNVALEYIYDEDLCVLQFSMLTRRXTCDHDSRRGASAREVDAELVLQRATGEVEAGIRQVPPD

SEQ ID NO: 49512 - protein, 128 aa, Sorghum bicolor
  Clone ID: LIB3476-056-P1-K1-D9.pep
AEIAFADAIKAFQEVFDHTNVILINCNLGHGRRALAEECVSRIDEFQKHDLPEGTYMQSFKSAKSEYFQAINYYTAAKRQLKYVNTEVDKVLYHEVYTQYAHTYLRLGMLLARESFLTDSYEGGLVDD

SEQ ID NO: 49513 - protein, 71 aa, Sorghum bicolor
  Clone ID: LIB3476-056-P1-K1-E2.pep
ADRDEDEKESHAELLSLPPHGSEVYVGGISSDVSSDDLRKLCESIGEVVEVRMPGKSGKLDAFVNFRTKEL

SEQ ID NO: 49514 - protein, 67 aa, Sorghum bicolor
  Clone ID: LIB3476-056-P1-K1-F11.pep
QLIRQVEQDVETVIHVLQPGPIGIVEHKFTDAEILEARGTVKRAVDNWRRNWTLERNLGSTTFDKWK

SEQ ID NO: 49515 - protein, 107 aa, Sorghum bicolor
  Clone ID: LIB3476-056-P1-K1-F7.pep
KIAQFAEKNPDVLLLQVNYETHKCMCYGLDVHVLPILTFYKGSEGRVSSFSCTSATIKKFKDALAKHGADRCSLCPALGVDVSELMALSANRDLQFTYDKPGLIAAC

SEQ ID NO: 49516 - protein, 127 aa, Sorghum bicolor
  Clone ID: LIB3476-056-P1-K1-F8.pep
PTRPQFWVLDKDGLITKARKDLDSAVARFARGFGPDEVPDLHEGASLVEVVKKVKPHVLLGLSGVGGIFNEEVLKAMKESDSPRPAVFAMSNPTTKAECTPDDVFKHVGENAIFASGSPFNNVSLGN

SEQ ID NO: 49517 - protein, 116 aa, Sorghum bicolor
  unsure (1)..(116): unsure at all Xaa locations
  Clone ID: LIB3476-056-P1-K1-F9.pep
HASGLKNLRPTAKWDVYAFGMVLLELLSGRVYSEVELCQWHAXLVAAEEHGRVLRMADPTLRGEADGREDALLACFKIAFACCAMAPGKRPXMRDAVMVLERTTAGAASGSAAAVP

SEQ ID NO: 49518 - protein, 142 aa, Sorghum bicolor
  unsure (1)..(142): unsure at all Xaa locations
  Clone ID: LIB3476-056-P1-K1-G1.pep
VDSVVEACSNPSIIRSLFSATLPDSIEALARTIMHDAIRVIVGRKNSASSLIKQKLIFAGTERGXVLALRQSFQESLNPXVLIFVQSKERAKELYXELAXDDVRVDAIHADLNEQQRQDAXDNLRAGKTWVLIATEVIARGM

SEQ ID NO: 49519 - protein, 110 aa, Sorghum bicolor
  unsure (1)..(110): unsure at all Xaa locations
  Clone ID: LIB3476-056-P1-K1-G5.pep
DESDGKDELDELDEEDSDEDDPKFQQDTACEYRKLITIQAGKPKGHLRDALKVDPEKVRRXSLSETQLAKATTSHGAEVIRFTQNNILRVYPKGTRVNSSNYDPMNAWTH

SEQ ID NO: 49520 - protein, 65 aa, Sorghum bicolor
  unsure (1)..(65): unsure at all Xaa locations
  Clone ID: LIB3476-056-P1-K1-H2.pep
DDNGGACGFKGVNLPPFSAMTSCGNEPLFKDGKGCGSCYQIRAXGQPCWLRRAGEVILTAMNYYP

SEQ ID NO: 49521 - protein, 55 aa, Sorghum bicolor
  unsure (1)..(55): unsure at all Xaa locations
  Clone ID: LIB3476-056-P1-K1-H3.pep
FFCLEDRALLCRSCDVAVHTXNAFVSAHRRFLLTGVQVGRTGWTTFRSRAEGALP

SEQ ID NO: 49522 - protein, 153 aa, Sorghum bicolor
  unsure (1)..(153): unsure at all Xaa locations
  Clone ID: LIB3476-057-P1-K1-A10.pep
PRVRPRVRIHAKSGETEKAIETFKKVTRIDPKDHQAFVELGELLVESDWAAAMEYLKTARNLLKKAGEAVPVELLNGIGLLHFEKGEFEMAEQSFKEALGDGLWVSVMDGKVGSSMVNWSVQNKDQSFFHQLEEEGXPLEYIQLKYHTVNYAR

SEQ ID NO: 49523 - protein, 135 aa, Sorghum bicolor
  Clone ID: LIB3476-057-P1-K1-B11.pep
VGDRQCGKKVTKSDSGNWLCDKCNQEFPECDYRYLLQLNIQDHTGTTSATAFQEVGQELLGCSARELNMFKENEDPRYTAVLIHCLYQNYLLRLKVKEEQYGDERRVKNTVVKVERVDPSAESKFLLDSISRFIV

SEQ ID NO: 49524 - protein, 58 aa, Sorghum bicolor
  Clone ID: LIB3476-057-P1-K1-B2.pep
EVTDDVGQCWALVAVRIEGRLDGGGLPRAPRTGHVHDTSPVQLSEPSTTTYCPALSSL

SEQ ID NO: 49525 - protein, 102 aa, Sorghum bicolor
  unsure (1)..(102): unsure at all Xaa locations
  Clone ID: LIB3476-057-P1-K1-B7.pep
LTVVIASQLTESSRLKLDDICRKAHIDHXVADSSYGLTGLVRDSVMEHCVIQSTPDHLLDDVGLHNAWTDLKPFQESIDIYDENPGGHTHTPYIDLLERLAQ

SEQ ID NO: 49526 - protein, 138 aa, Sorghum bicolor
  Clone ID: LIB3476-057-P1-K1-B9.pep
DKKITDLVTKQQQMDAERDHAKSELEQFKVDIARAMKQKSSLEKALGKKEKSLDNIRNQIEQVQSSIAMKNDEMGTELIDQLTSEERDLLSRLNPEITDLKERFLMCKNSRIEIETRKEELETNLSTNLIQRQKELEA

SEQ ID NO: 49527 - protein, 161 aa, Sorghum bicolor
  Clone ID: LIB3476-057-P1-K1-D11.pep
MNEVLFKSLPGDTPDLEMLASSHLLSQRKSDLIVKERLGVRKTRLRLKEQILTMKFKAYRHLWKEDVRLLSAKKQRSKSNKRIDQSNRTSQIGSQRQRSSNRSRLAMPAGNLSTFSTPEMSDVARKLFSEFQIKRCRNYLKMPALIIDEKEKECSRFLSKN

SEQ ID NO: 49528 - protein, 69 aa, Sorghum bicolor
  Clone ID: LIB3476-057-P1-K1-D2.pep
SKPTPRNLPKEIPSVFQKLVPTKLEYPHPPFGPPLLEHQPLRYFMNPAVFEFLRQCLAMESRTCRRTRA

SEQ ID NO: 49529 - protein, 105 aa, Sorghum bicolor
  Clone ID: LIB3476-057-P1-K1-D3.pep
SHSFLQLGLNVAYESFHDLLSSPGLSLMATHLISQAKYKDPCTPRGFTHIAGSVKLPVSVLEPKVEYRPFAHAVGNFSECRSAALTLLAKRKGGCTYHNVALSGI

SEQ ID NO: 49530 - protein, 141 aa, Sorghum bicolor
  Clone ID: LIB3476-057-P1-K1-E5.pep
MIQAFLRGRRVADALHMFDDMLAQGVLPNTGMITSFINPLCTFGPPHAALMIYKKSRKAGCVISLKAYKLLLERLAKFGKSGIVLDIWEEMQECGYQPDKVIYEFIVNGLCNVGKVDAAVFVVEESLRKWLLSLGRVVAAN

SEQ ID NO: 49531 - protein, 159 aa, Sorghum bicolor
  unsure (1)..(159): unsure at all Xaa locations
  Clone ID: LIB3476-057-P1-K1-F8.pep
LNEESDIILKRPGIKARLHNLMIQLRKNCNHPDLLEAQVDSIGLYPPVEKILEQCGKFQLFDRLLNYLIEQKHKVLVFSQWTKVLDIIEYYLDSKGHDVCRIDGSVKXEERRRQIAEFNDLNSSMRIFLLSTRAGGLGINLTSADTCILYDXDWNPQMD

SEQ ID NO: 49532 - protein, 96 aa, Sorghum bicolor
  Clone ID: LIB3476-057-P1-K1-G10.pep
SASGSGTAGQESATALPCLRLRRRRRLPLRWRRRRAAGGGVGGGEAETEVADEVEDEDDAAAAVSSGSESELHISVARGRRVWCRRLDTDERKEGA

SEQ ID NO: 49533 - protein, 104 aa, Sorghum bicolor
  Clone ID: LIB3476-057-P1-K1-G2.pep
YPVGMLLDVLAKHRDKYHDLLLADCRRQVAEALAADKFDQMLMRKEYEYSMNVLAFGIQSSDITPAFPYVAPFSCTVPDICRIVRSFIEDSVSFMAHGGGGIPM

SEQ ID NO: 49534 - protein, 107 aa, Sorghum bicolor
  Clone ID: LIB3476-057-P1-K1-G6.pep
HASDYLRLVPLITLVDNARIRDRLEYIERDQCEYSFDEEDKKVQDALLNPDPCTNPTIVLKKTLSCSYPNLPFNEALRKESEKLQVELSRSQSNMDLGSCEVIQHLN

SEQ ID NO: 49535 - protein, 79 aa, Sorghum bicolor
  Clone ID: LIB3476-057-P1-K1-H1.pep
KPVKDLEAAFQDPDLEANPMLFLNQIVLQEFQNRHHEIESISIKLKVDKGDHEICCFEIEPVKGKWFPTLRTLVSKLND

SEQ ID NO: 49536 - protein, 93 aa, Sorghum bicolor
  Clone ID: LIB3476-057-P1-K1-H3.pep
PRVRTNSSACKLKLGDFEGALLDADYALRETEDNAKAFFRHGQVRMALNHIDASVESFKQALELEPNDGGIKRELAAAKKKISDRRDREKKGF

SEQ ID NO: 49537 - protein, 117 aa, Sorghum bicolor
  Clone ID: LIB3476-058-P1-K1-A5.pep
LVAALKKIEPEDPSEPTHDPEVLTPEEHFYFLKMGQKCKNYVPVGRRGIYQGVILNMHLHWKKHQTLQVIVKTFTPEEVKEIATELARLSGGIVLDIQDGNTIIMYRGKNYAQAPPE

SEQ ID NO: 49538 - protein, 153 aa, Sorghum bicolor
  unsure (1)..(153): unsure at all Xaa locations
  Clone ID: LIB3476-058-P1-K1-A9.pep
FLFSLLQKSGYEVYLLEAPYKDPTGCAARNVHGFTLDEIKKMAADWEEAPPLYLQLDIHSLFHDDNLRGHSIQEVDMDTEDVDDANDTTSIIAETSQKAVQDPPYEGFSKPGEKWNSEVEDDRDGLKELGQSKWSKDFDDDXRKSENTEENTH

SEQ ID NO: 49539 - protein, 64 aa, Sorghum bicolor
  Clone ID: LIB3476-058-P1-K1-B11.pep
KSFILKGRGNKFWIFKRAGPKFNIKFYFLYIFNFFLYTFLNIFIFIYIIILFLYFFIFFFFFFF

SEQ ID NO: 49540 - protein, 80 aa, Sorghum bicolor
  Clone ID: LIB3476-058-P1-K1-B12.pep
AISTEGSKAPNIINGSTLSSDFRGNLVPTFSATKRKNFKQHKNQKPQPSAPIDNEHILGVEGTLNSLLDVDGGISKRKDA

SEQ ID NO: 49541 - protein, 36 aa, Sorghum bicolor
  Clone ID: LIB3476-058-P1-K1-B2.pep
CDSSRVYAKRLSAGPCSPVSCHQFSVASWCITPASA

SEQ ID NO: 49542 - protein, 113 aa, Sorghum bicolor
  Clone ID: LIB3476-058-P1-K1-B4.pep
MGSSVSQAGAPPPPPPTYASTPPPFAPAAADAAFATPPPKPHEEEATEEKVDYLNLPCPVPYEEIQREAFMALKPDLFEGMRFDFTKMITPCFALSHSVYNGSTEIPAQGKRC

SEQ ID NO: 49543 - protein, 164 aa, Sorghum bicolor
  Clone ID: LIB3476-058-P1-K1-B8.pep
RTCAGSPASKETDLYSDWSESENNHAPLATDSEGTYQSRDVPAEDSAVYHVPNLPHHSDSGSSPSEHYGVGSGSTHSEPEEVVPLTATSKQNSVKGLCVSNKMQSPNGECDVTEYTDDTLDAHDDAEHPNASNDNNDFVTNLITKSFNINIAMRIGRAWNYVNG

SEQ ID NO: 49544 - protein, 95 aa, Sorghum bicolor
  Clone ID: LIB3476-058-P1-K1-C10.pep
SPAGSAGPPACRPWSRFGRREYSGPAKMNHNARGPGASCRPPVATPRNARRRKGPGAGALAIGPCPRWPLAPEARLWVVRLVPPKPKPRPEPRVR

SEQ ID NO: 49545 - protein, 163 aa, Sorghum bicolor
  unsure (1)..(163): unsure at all Xaa locations
  Clone ID: LIB3476-058-P1-K1-C2.pep
AAATTDGVLLYSVDESFIFDPTDLDIDVTPEKVEEALAENQQQRALILSLRLNEDSLIKKCIFAVDPSDVRAICSAIPYKYLQRLIDAFAGLLESCPHLEFILLWSQELCKVHGHYIQQNSRTLLPSLKSLQKSITRLHQDLADTXSSNEYLLKYLCTGGTKK

SEQ ID NO: 49546 - protein, 112 aa, Sorghum bicolor
  Clone ID: LIB3476-058-P1-K1-C7.pep
MAQVWKHFIPSHPQSLSISGSPPSTDPQIATSNRIHPLRHPFTMESPKRERVFPQGSPRRSPKAMRPGAARGADENTSPKHLVAVGAASSQRKKVLGERNDGGVGVMKGATA

SEQ ID NO: 49547 - protein, 84 aa, Sorghum bicolor
  Clone ID: LIB3476-058-P1-K1-C8.pep
KLCMRSHQHPYLSHETKSHTSTTRNQKLSSLTLKAHCSTFTNSELIAFCLIGSKQNTASMSTFHLSTPPSTLPWSCRMAYLSLQ

SEQ ID NO: 49548 - protein, 46 aa, Sorghum bicolor
  Clone ID: LIB3476-058-P1-K1-D4.pep
ISMKYDCRSISFQRYSPQRASTSTVFVPPTFSLIFRARSARLCLLF

SEQ ID NO: 49549 - protein, 139 aa, Sorghum bicolor
  Clone ID: LIB3476-058-P1-K1-D7.pep
MASRSQTISSPALLLGFLALLLPLQFTDASSGQTTIYVVYMGRKMHDDPSVVMASHHAALTSILGSKDEALNSIVYSYKHGFSGFAAKLTEAQAEALRKYPGVVRVRPNTYHELHTTRSWDFLGMSYGQQASSSSSSSS

SEQ ID NO: 49550 - protein, 113 aa, Sorghum bicolor
  unsure (1)..(113): unsure at all Xaa locations
  Clone ID: LIB3476-058-P1-K1-E11.pep
LSLXACPGPVLRLRGAACRGLRGXPPRACGCGAXPPSPXAXRSPCPRRSAAAAAAPPASPPPCRCRXFRRVRGRCWLLVPGAFARRCFLCXGXAAAXGGXVGXGXXXXGRRVG

SEQ ID NO: 49551 - protein, 74 aa, Sorghum bicolor
  Clone ID: LIB3476-058-P1-K1-E2.pep
RTRGFILSLPVWLAVWVRSSVACSQSYAHSERRPAMRPWLRVVHHEGDYGDSACDAVLHALRDTVVRIQARLHA

SEQ ID NO: 49552 - protein, 73 aa, Sorghum bicolor
  Clone ID: LIB3476-058-P1-K1-E8.pep
VWRTTYLHPLADHAAVVEWFKASALRPFLAPLSDSEKTAFLQDYQARITQAYPALADGTVLLPFPRLFIIATR

SEQ ID NO: 49553 - protein, 51 aa, Sorghum bicolor
  Clone ID: LIB3476-058-P1-K1-F10.pep
MKAEKAAVAPAGACGDEWRCRKHPAARSGGGVCPYCLRDRLLRLCHNCAHV

SEQ ID NO: 49554 - protein, 59 aa, Sorghum bicolor
  unsure (1)..(59): unsure at all Xaa locations
  Clone ID: LIB3476-058-P1-K1-F9.pep
LXVCCIIYLGLGPHLARALGRRTSALPLGPALLGTYTELRKQEAYTNDNKLNDMDLALT

SEQ ID NO: 49555 - protein, 142 aa, Sorghum bicolor
  unsure (1)..(142): unsure at all Xaa locations
  Clone ID: LIB3476-058-P1-K1-G11.pep
HTTSSSSLCLAREFDFLSDSRAITQDLVNGEALSKKHRAQLFLSQACGGGNAWRSPARTRAGAAXRGSLPSSPLPDPWPHGEGGSGVDAGASPTARREPGTGKGGARVLAGHAARGSLSFLRTRGRTRGRTRGRTRGSGRVG

SEQ ID NO: 49556 - protein, 148 aa, Sorghum bicolor
  unsure (1)..(148): unsure at all Xaa locations
  Clone ID: LIB3476-058-P1-K1-G2.pep
AIVLLAVGTTTSQVKGCGDAPCDSLFSAPLQGYMLGILSACLSALAGVYTEYLMKKNNDSLYWQNVQLYTFGVMFNMGWLIYGDFKARFELXPWWQRLXNGYSITTWMVVFNLGSTGLLVSWLMKYSDNIIQVYSTSMAMLLTMVYLY

SEQ ID NO: 49557 - protein, 73 aa, Sorghum bicolor
  unsure (1)..(73): unsure at all Xaa locations
  Clone ID: LIB3476-058-P1-K1-G6.pep
MPPPQPAASDPPPVPPPPQEEPPLPPVPHPPPPLPMLSVHPPLLPPPPPLQPPPPLSSLPKLXRPRHRPRPRV

SEQ ID NO: 49558 - protein, 60 aa, Sorghum bicolor
  Clone ID: LIB3476-058-P1-K1-H11.pep
MAGPKFGSFKAEKGDSAAAAGAAVQRKDPYEVLGVGRNATEQEIKSAFRRMALKYHPDKN

SEQ ID NO: 49559 - protein, 60 aa, Sorghum bicolor
  Clone ID: LIB3476-058-P1-K1-H9.pep
IDQQFQLDMQLEDIWLWTTLLKLTHQTQALACFTTVNSLLQVPPYIMMLMPWTYKSAWAD

SEQ ID NO: 49560 - protein, 91 aa, Sorghum bicolor
  Clone ID: LIB3476-059-P1-K1-A5.pep
ARRLCQRGPPAPNVGTKNSRAPVERRVSNAGTVLGSQRHRGTGQVVERQRGGRRRRRGRRESKEEAEEQGLGRAASSHDGLVGFLAFGRVG

SEQ ID NO: 49561 - protein, 37 aa, Sorghum bicolor
  unsure (1)..(37): unsure at all Xaa locations
  Clone ID: LIB3476-059-P1-K1-A7.pep
PTKLIAQQSIKAGCEFVYKKIKMASKTXKQILFMVTT

SEQ ID NO: 49562 - protein, 56 aa, Sorghum bicolor
  Clone ID: LIB3476-059-P1-K1-B1.pep
AELSLPVCKICDFRVWAFIILIRYARIVTILALHIQFFKHGQYSAWLFSSHIYIWW

SEQ ID NO: 49563 - protein, 47 aa, Sorghum bicolor
  Clone ID: LIB3476-059-P1-K1-B10.pep
PTRPAEYCNMRQANAVIRALGNENIIRESYSSGVDVLLYCEILLDYR

SEQ ID NO: 49564 - protein, 42 aa, Sorghum bicolor
  Clone ID: LIB3476-059-P1-K1-B11.pep
VLQSSQSDPPKTLLIYSSSDNCLGISWFLQIEGTNAQVAPCF

SEQ ID NO: 49565 - protein, 155 aa, Sorghum bicolor
  unsure (1)..(155): unsure at all Xaa locations
  Clone ID: LIB3476-059-P1-K1-B2.pep
XEMYPLQEYVKRAKAFAEDFAQEQKDEGEVQGGGIIHVLFVNLWRFYQRRKEEYGTMTREERRRKYLEQMKRLEEQGAVSKLFVDLSSPYPRRLSILKRLWRLSERRAYGSVREGLASAFLLLYTSLKTSGFPVHRXLEPELMTDLSKNLCGLLI

SEQ ID NO: 49566 - protein, 66 aa, Sorghum bicolor
  Clone ID: LIB3476-059-P1-K1-C2.pep
FLVCNAGVIFRQKNHSVTKVSKQKMICSHSNRIENYVKNIPTLMIYLSLNRPMEMKIKRLRLFVAN

SEQ ID NO: 49567 - protein, 69 aa, Sorghum bicolor
  Clone ID: LIB3476-059-P1-K1-C6.pep
EDELFQYQVVLLVILTSSRRLELAVISTGLRWQWRCLNSCDTLLCDEDKSYFLRHCCAARASKVGAVLM

SEQ ID NO: 49568 - protein, 148 aa, Sorghum bicolor
  Clone ID: LIB3476-059-P1-K1-C8.pep
KSLKRCSALTKNQTLFNLFQVFQRILKAYAAKLYARLPKGGTGIVAAATGTDGQIRTSDRDERMICYIVNTAEYCHQTSGELAENVAKMINPQFADKVDMSEVQDEFSAVITKALMTLVHGLETKFDAEMVAMTRVPWATLESVGDQS

SEQ ID NO: 49569 - protein, 132 aa, Sorghum bicolor
  unsure (1)..(132): unsure at all Xaa locations
  Clone ID: LIB3476-059-P1-K1-E12.pep
RRXASAPAVSGGGQREPSSDAASSASRSCRRKEAGSSRWPLLPPPCPPXPPPRRRWFLARRTAAQWDSGFHSDRCMGLGSRRRRSRGGKIAALRWRSGSTSGVRHGVGKPPRFPCEMGRFWTNECRKTAVSG

SEQ ID NO: 49570 - protein, 93 aa, Sorghum bicolor
  unsure (1)..(93): unsure at all Xaa locations
  Clone ID: LIB3476-059-P1-K1-E2.pep
ACRRCADDDWGGCCWGTCGRRPPPNRSRPRPRRCCRSRRRRRCRRRRRRRPRRRRRSPSXPAGTGPPDAARRRGGRRTRLRRPRAPAPGGRVG

SEQ ID NO: 49571 - protein, 127 aa, Sorghum bicolor
  unsure (1)..(127): unsure at all Xaa locations
  Clone ID: LIB3476-059-P1-K1-E6.pep
RARESETELRSKIDGLKGKLRSYEAQRKEEEKVLFAIDNLDTSTAPMHKPKNYGKATDLLKSEEDRMKLWCELQKAREQLSMVQKEIKNMNKCDYIDCEXAVLEAEIEDSCLSILETDIEKLAVTTR

SEQ ID NO: 49572 - protein, 86 aa, Sorghum bicolor
  unsure (1)..(86): unsure at all Xaa locations
  Clone ID: LIB3476-059-P1-K1-F10.pep
MDPAPAPPPPFAVHLVTGGGSSPELSLLLRSLAASRVVALDAEWKPRRRGSPAAAAPAALGDGSTSLALEASXSAAKFPTVTLLQV

SEQ ID NO: 49573 - protein, 54 aa, Sorghum bicolor
  Clone ID: LIB3476-059-P1-K1-F12.pep
VRISLSLHRRHLTCQYPLQPTDSWHFLAARETQLFTFLVGRTLTSPLFPHKRGS

SEQ ID NO: 49574 - protein, 73 aa, Sorghum bicolor
  Clone ID: LIB3476-059-P1-K1-F2.pep
CRRRACSPAAPCRSRTRSTARSSSSPPRRVAPLTPRPPPPSQPPPPKPSRSHAALPFPRDASTRECELGLWSS

SEQ ID NO: 49575 - protein, 100 aa, Sorghum bicolor
  Clone ID: LIB3476-059-P1-K1-F6.pep
LPSLRNPYHWVQWSMIDPYSILLLIYHHLRLHVRSWRSRAEHQRRRLVEVERECLRPRPELQRRGRLRRGDDVLRHCDEGRHRRRNRHGLVVQPAGREVE

SEQ ID NO: 49576 - protein, 75 aa, Sorghum bicolor
  unsure (1)..(75): unsure at all Xaa locations
  Clone ID: LIB3476-059-P1-K1-G2.pep
SLLLPLSVSESPNTNIAGTSVXAAAAPAPPPPLLPPXKPGPIGNVPFHGGNTCAAAPPRAESSXRVGGRVGGRVG

SEQ ID NO: 49577 - protein, 175 aa, Sorghum bicolor
  unsure (1)..(175): unsure at all Xaa locations
  Clone ID: LIB3476-059-P1-K1-G4.pep
EEGGLFRRRIVVQELFNREFIEAVLQEWCKTMSNLPAGLRQACEMGLVSSAQMVRYLSIFARPTNTRSFSRALPGWLSRGLVGRTLADPSFPHKMALEFMATFSSSIWWEMNIRKERFEQEWDLVIVNALTASCCNLMVLGLLAXVPSXGSTSRFDFQNAXEKLXNNIXEKSYPX

SEQ ID NO: 49578 - protein, 161 aa, Sorghum bicolor
  Clone ID: LIB3476-059-P1-K1-G6.pep
RDSFRREGFNLNGQTEDNVENRTARSTTSVGGTQNQESQPESAALGLHNASLLAENMHSTRQIVVEQAGALLSQLSAQLGDLENVTDPATRRDIQNSAVRVGSLLQNLGSLLLELGRTTMLLRINPSSSEAVVNSGTSSYISPSGPNPLMVQPVPFPGRSV

SEQ ID NO: 49579 - protein, 121 aa, Sorghum bicolor
  unsure (1)..(121): unsure at all Xaa locations
  Clone ID: LIB3476-059-P1-K1-H9.pep
DTWGEHTVYNEGXVHQLYRPLLRFGLDFGARRWLAMLHNQRECAGXCSCAQLHADEMTRDXITHEGKRSMLQLARGMTENCCGVVSAXRAHELSKLDCSGWNIREEVLVMCRKNLCEPWEP

SEQ ID NO: 49580 - protein, 36 aa, Sorghum bicolor
  Clone ID: LIB3476-060-P1-K1-A1.pep
HKLRRITGGYTDNNSDITYNNTQTSVGAALMALYTH

SEQ ID NO: 49581 - protein, 92 aa, Sorghum bicolor
  unsure (1)..(92): unsure at all Xaa locations
  Clone ID: LIB3476-060-P1-K1-A4.pep
LRDAAATYEAADIIATXGTNGEPPDLVAFLKEHWSQSAFAEGVTTGEMHFVNVMRVLRRGASPICLEDLPSEMVLGITYLPLYRECVSAGGQ

SEQ ID NO: 49582 - protein, 103 aa, Sorghum bicolor
  unsure (1)..(103): unsure at all Xaa locations
  Clone ID: LIB3476-060-P1-K1-B1.pep
HNHTPVQESPVHMRLFASASPPRLLLSPSISNLDYSIAPFDYSELAHGRNGEQQPHGGDGDSGRRAPGGAGADDAQWRGGQVSAAQQHHRRGLRVLRRLXQQY

SEQ ID NO: 49583 - protein, 72 aa, Sorghum bicolor
  Clone ID: LIB3476-060-P1-K1-B12.pep
RTRGVKVISPESVAVTVTPAKLTFKKAGQKLRYHVTFASKAGQSHAKPDFGWISWVNDEHVVRSPVAYTWKM

SEQ ID NO: 49584 - protein, 35 aa, Sorghum bicolor
  Clone ID: LIB3476-060-P1-K1-C2.pep
SLVALESPCLLAARGVGVGAGKWGKWRRLGTVRVG

SEQ ID NO: 49585 - protein, 132 aa, Sorghum bicolor
  Clone ID: LIB3476-060-P1-K1-C7.pep
MQATEHAVLKKHDQPFVFTVCADHCINLLLENIAKLDHVKDVLTKAREITMFLYGHALPMELMKKFFYFDSEIISNSNLRSVAKFLTLETLVSQRENLMEMFSSPNWASSDLACTSLSMHICEVVKQIVHFG

SEQ ID NO: 49586 - protein, 144 aa, Sorghum bicolor
  Clone ID: LIB3476-060-P1-K1-C9.pep
QLLLRAVSSCGLHLHALRLHSLLPDPSHLTFPFAIKVASRLPNPLTAGVQLHARSLKLPCHSNPHVLTSLLNLYAKCGRLLDAQKAFDEMPHPGTVSWTALITAYMDAGRAQEAVGVARRAFASGMRPDSFTAVRVLTACARVT

SEQ ID NO: 49587 - protein, 141 aa, Sorghum bicolor
  Clone ID: LIB3476-060-P1-K1-F12.pep
GRVGDSNVKSSHIPKGSHHLHSGEKNNYNTDGSPMQPGKHPVDPKTSALDKGVSSMHENTKSTNSLQDRNGSTHCPPDGNPPLGLPSGKEKSYLKSNKQDSQKPKPQVVCSPQKESKLDSHSTPLKPNGSKMTPQSRQYNA

SEQ ID NO: 49588 - protein, 109 aa, Sorghum bicolor
  Clone ID: LIB3476-060-P1-K1-F8.pep
RGVRKKNDGPSGVTIGIVRKDLIGAAHSITPVMLDFKTHADNAALYNTAPCYDIYICGLVFEDLLAQGGLAEVDKKNTHKAGVLYDTIDASGGYYICPVHKAARSHMNV

SEQ ID NO: 49589 - protein, 122 aa, Sorghum bicolor
  Clone ID: LIB3476-060-P1-K1-G5.pep
MARAPPPPPLHRLPALLAALCLAVAVCFSGVVENAAAATLAADRTGRKMVGVHELRMGDFSIKVTNWGATLMSVILPDSKGNLGDVVLGYDTVAEYVNGSAYFRGLIGRVANRIAGARFVLD

SEQ ID NO: 49590 - protein, 126 aa, Sorghum bicolor
  Clone ID: LIB3476-060-P1-K1-H10.pep
PSTTARYPEGKSSLESAMVGFLTLLSGSLHQGNWARVATLGLDGQPPGDWPCEELDGCMHQRLGVVPGHVAAQGAHRCLENVPWLGVEGRGREGAAALVCAAAQLHMPAPEGVSSLYSASSRRGTP

SEQ ID NO: 49591 - protein, 85 aa, Sorghum bicolor
  Clone ID: LIB3476-060-P1-K1-H12.pep
KGKRLPKYFCSRLINAQTVGLIEFKLLHDNSDKLRFNIVLETVSEIVTCSDSRISVYSVQKVGRHKIARHHLCTIYQSQTIRFCV

SEQ ID NO: 49592 - protein, 42 aa, Sorghum bicolor
  Clone ID: LIB3476-061-P1-K1-A9.pep
EKQERGRGDNKESISGHSDDRGRGLHRRAAGCLLRGLMQGDA

SEQ ID NO: 49593 - protein, 170 aa, Sorghum bicolor
  Clone ID: LIB3476-061-P1-K1-B10.pep
FSMMERFADAEAIYLELKASASVLDMIAYSVIVRMYIKAQRLEDACSILAEMEKQKEIIPDKYLFLDMLRTYQKCGLLEKLADTYYWIRKSQVECDEAMYNCIINCCGRAIPVDELSRIFDEMIQQGHLANTVTLNVLLDIYGKAGLFNRAEKVFIMARKQGLVDIISYN

SEQ ID NO: 49594 - protein, 153 aa, Sorghum bicolor
  unsure (1)..(153): unsure at all Xaa locations
  Clone ID: LIB3476-061-P1-K1-B4.pep
NMTPEAALDHARSVRPRVLLAPAQWQAVKMFSKLNGRCLSIQSSNPTCSVLSYEESSELLSTQSSRCLSIQSSTEDSIASDEESSEASFVDPEVDGYAATEFDSEHFILPRCRSMLSRPTSPTGCSDAVFVTXEDLEGYETYADDGKGRGECK

SEQ ID NO: 49595 - protein, 54 aa, Sorghum bicolor
  Clone ID: LIB3476-061-P1-K1-B5.pep
VILEITLDWYIIFRHDEICTRACATTLLYMGHALLFVVHKMLLDRAYKLTDQIH

SEQ ID NO: 49596 - protein, 149 aa, Sorghum bicolor
  unsure (1)..(149): unsure at all Xaa locations
  Clone ID: LIB3476-061-P1-K1-B8.pep
ADPTSALLFPFHLGPHSVPLPVTTKGPNPLGTSEEVIRRLIDRPIRRRCRHVQQDHQEGEPQGRARGQRGVRRAPRSALVVLRERRRLQIGGSLAPYQQPLFPRTVPSTHLSTXSYIPFFDLGTNHFFLIFFYFLFLLYFFFCVVYLVF

SEQ ID NO: 49597 - protein, 51 aa, Sorghum bicolor
  Clone ID: LIB3476-061-P1-K1-C6.pep
GVLETFVISKRKLLVVVYCRRRRVRIDRRSQELVGEVGINSGWIGPSLCGC

SEQ ID NO: 49598 - protein, 173 aa, Sorghum bicolor
  Clone ID: LIB3476-061-P1-K1-C7.pep
GKSIDEKKTKPRKSMEFHNIKISQVELVVTYEGSRLAINDLRLLMDTFHKAEFTGTWRRLFSRVKKHIIWGVLKSVTGMQGKKFSNHRETLEGSIPENDLNLSDSDVGHHGRHDQLTASWLKRPGEGAGDGFVTSIRGLFNTQRRKAKAFVIRTMRGEGHNNDEYQDEWSESD

SEQ ID NO: 49599 - protein, 110 aa, Sorghum bicolor
  unsure (1)..(110): unsure at all Xaa locations
  Clone ID: LIB3476-061-P1-K1-D12.pep
YFRHATGQLYAISKDLATYISINKHILHKYINEDVSLGIWVHGLDVGHIDDRRLLWGTPADCEMEAXAGXICAASFDWRCSGICNSEGEDLXKVHNKCAEGEKALWNATF

SEQ ID NO: 49600 - protein, 147 aa, Sorghum bicolor
  unsure (1)..(147): unsure at all Xaa locations
  Clone ID: LIB3476-061-P1-K1-E1.pep
KVIWTVKEHVGGGDSPYITLYYHSFDGERGFPGDLDVYVTYRLSSPYVLSVRMNATAESRATPVNLAHHAYWNLGGHGSGPILGETVQLFASRYTPVDAATLIPTGALAPVAGTPYDFRAPAPXGRAPAAGPAARSRRLRHQLRRGS

SEQ ID NO: 49601 - protein, 171 aa, Sorghum bicolor
  unsure (1)..(171): unsure at all Xaa locations
  Clone ID: LIB3476-061-P1-K1-E11.pep
PTRPIITDGAIEHIAKLGTNLQYLSLXDTGITSQALCILAGTVPNLTSLSLANTKIDDSALAYIGMIPLLRTIDLSQTSIKGFTHMSAFEHLKYLESLNLEDTPLSAEVIPPLASLAALKYLYLKSDFLSDPALHALSAASNLIHLGFCGNILSSSGLLQFVPPTTLCVLD

SEQ ID NO: 49602 - protein, 115 aa, Sorghum bicolor
  Clone ID: LIB3476-061-P1-K1-E7.pep
TAVCKPLTEPLIVEDTAKDYAIAFKIIITFICNTLCNTYKTYGKAKFAPILPHISYHEAYSVVEHVEEYVEGYTAVHTLLPQFLHHCSYSCNYTNKHNYMSDSMPLVMRRDMTTN

SEQ ID NO: 49603 - protein, 50 aa, Sorghum bicolor
  unsure (1)..(50): unsure at all Xaa locations
  Clone ID: LIB3476-061-P1-K1-F2.pep
SSRAGPWRGDMXGSCGNCRRGAARMMSRIGGWVLGVWNLGVVRVRSLYMS

SEQ ID NO: 49604 - protein, 127 aa, Sorghum bicolor
  unsure (1)..(127): unsure at all Xaa locations
  Clone ID: LIB3476-061-P1-K1-F5.pep
FSHKQLCCLGNVLSVFLYXLGEASIELCTGLQHLTELLAPPPKACTAAAKRMMGKPRHGTPLRLPTKQKNRRKPHRIVRPLLVFLLASSHGAGTCAEDPTLQLSSNHQCREATVGNRGARTRGRTRG

SEQ ID NO: 49605 - protein, 51 aa, Sorghum bicolor
  Clone ID: LIB3476-061-P1-K1-G5.pep
FAHRHFKPTHKARTSKTSSIRTDHSNSLHGSTECTVRTSVTDIPCRVAKEK

SEQ ID NO: 49606 - protein, 104 aa, Sorghum bicolor
  Clone ID: LIB3476-061-P1-K1-H8.pep
SAGITHATSYTGCRRTPCRHRRGEWRRPPDPPHNTLYILLHFLLEHSHTVPAIHAHAARVHIQAHSTTDGGTELCGGSRGRSTGWIGIVINTGVSIHVMCLSTP

SEQ ID NO: 49607 - protein, 40 aa, Sorghum bicolor
  Clone ID: LIB3478-001-P1-K1-B7.pep
LKARVISYLPRRPHPSANKTPLRAGPAPATARPWLPYSAR

SEQ ID NO: 49608 - protein, 64 aa, Sorghum bicolor
  Clone ID: LIB3478-001-P1-K1-C11.pep
FISRFAVHHINVNFSCRKHGANRADVHSSSTSSRLDAIRNVYGASVVRDLIEIEVSDEDAGDAV

SEQ ID NO: 49609 - protein, 46 aa, Sorghum bicolor
  Clone ID: LIB3478-001-P1-K1-D12.pep
AQSKREREAKLNRRLKEAEEMDESKRTTEQLQRQTILEAPQESEDE

SEQ ID NO: 49610 - protein, 89 aa, Sorghum bicolor
  unsure (1)..(89): unsure at all Xaa locations
  Clone ID: LIB3478-001-P1-K1-D4.pep
DEACVRPERSDYXRLVWACTVEEHYAIGKELYQRIREGGDGGEINLSVLNHLIWLMGKAKKWWAALEIXXDLVDKRPKPDNLAHEPIMS

SEQ ID NO: 49611 - protein, 158 aa, Sorghum bicolor
  unsure (1)..(158): unsure at all Xaa locations
  Clone ID: LIB3478-001-P1-K1-D9.pep
LHQKSSSDTNALPAFSIPRSPNSCYGCSTTLVTQCLELLQVLSKHEYCRKQLVSAGTLSELFENNIHHGPKTARTLARAVLSSFSESDEDAVHELNNSIQKKVMYCLEHHRSMDIAQSTREELLLLSETRALVDEFCEARIRVTFQLXFSSIKVEQTI

SEQ ID NO: 49612 - protein, 102 aa, Sorghum bicolor
  unsure (1)..(102): unsure at all Xaa locations
  Clone ID: LIB3478-001-P1-K1-G10.pep
PVKIADPFDYGAGFVNPSKADDPGLIYDIDPSDYLRFFSCVGGLGVNNNCTTPKSAVADLNLPSIVIPNLKASETVMRTVTNVGQPDALYKAFXQAASGVEM

SEQ ID NO: 49613 - protein, 37 aa, Sorghum bicolor
  Clone ID: LIB3478-001-P1-K1-G11.pep
SDTSYIGPYECHRPQLLARRQHSSCSNDDNRPGGHLY

SEQ ID NO: 49614 - protein, 130 aa, Sorghum bicolor
  Clone ID: LIB3478-002-P1-K1-B10.pep
QLQELRRNVFGDTNAQGLFNYFKKMQSENSSFFFSTQVDSKNCVSNAVWVDARARMAYTYFGDAVYFDTTYSQNENMLPFAAFTGVNHHGDTVVFGCALILDRTESSYSWIFETWLTAMDDRLPFSFTTD

SEQ ID NO: 49615 - protein, 52 aa, Sorghum bicolor
  Clone ID: LIB3478-002-P1-K1-B2.pep
FRVGFDGDMASNGGTGPVGSADWDCRRRHGRGYTVSVAQRIPCGAFGNPRVR

SEQ ID NO: 49616 - protein, 95 aa, Sorghum bicolor
  Clone ID: LIB3478-002-P1-K1-D6.pep
IKLTYMLTYESATELLYMNLEEEEELRMLQEAASIRAQWRHSQGSIDTAMIEPRIKVSNPDDPEPNINLYVEDQANPAMQLVSEMMILCGQAMAV

SEQ ID NO: 49617 - protein, 146 aa, Sorghum bicolor
  Clone ID: LIB3478-002-P1-K1-E11.pep
GRVGDCTEEFDAIHSDKAKALLDTYRIGELITTGTGYSSDNSVHGGSAVLSNLAPIREAVRAPAPVALSNPREKIHCRLVGKKELSRDVRLFRFALPSSDQVLGLPIGKHIFVCATIDGKLCMRAYTPTSMVDRSALRPLVRLLKT

SEQ ID NO: 49618 - protein, 43 aa, Sorghum bicolor
  Clone ID: LIB3478-002-P1-K1-E5.pep
VLDCERPAFFIAQEERGSAYYQVTVHTRLRGSICSSSSYIHST

SEQ ID NO: 49619 - protein, 126 aa, Sorghum bicolor
  Clone ID: LIB3478-002-P1-K1-E9.pep
PNLQTLDLSWNIGLEELPESIGSLHNLKILILFQCWSLSRLPDSISNLVMLESLNLVGCEQLTKLPDGIISISNLKHLRNDQCSALERLPHGFGQWTKLETLSLLTVGDKNSNIAELEYLNVLTGQ

SEQ ID NO: 49620 - protein, 136 aa, Sorghum bicolor
  Clone ID: LIB3478-002-P1-K1-F10.pep
MTRLDKKHSKQLFLKEACPVEYSEYMGPDLAAILKKCDGQPLALTTVGQFMGKKSWPTGHDCEDVCNQERFYHLQSGDDTLDRMHKVLIHDYTSLPSHALKACFLYFAMFPSDHPVRAKRLKRQWLAEGFLQPTNL

SEQ ID NO: 49621 - protein, 105 aa, Sorghum bicolor
  Clone ID: LIB3478-002-P1-K1-F2.pep
GGTNHHLTVDQPATGVPAATANPAQWPRRRWASCVSSCEPRAPAGFAARPWAWRRASSAPRPSRRRPTAPPARPTRGHHRTGRVAATRCSCSTTARRATPACRTP

SEQ ID NO: 49622 - protein, 125 aa, Sorghum bicolor
  Clone ID: LIB3478-002-P1-K1-F9.pep
PTRPVTDELCVLKATAELLKSQLNEEKAALAATQQVEAMASTTIQSLKMDIKLSQQELEAVHVKSKECRDRMDKVLQDASQEVDEAKIIATKAREELRKTKEEVEQAKAALSTMEFKLEAVLRDI

SEQ ID NO: 49623 - protein, 55 aa, Sorghum bicolor
  unsure (1)..(55): unsure at all Xaa locations
  Clone ID: LIB3478-003-P1-K1-A5.pep
CVSLCLYSFDLSTDGWSIMTLILVIISPLICVMLMFVFHLYIQHSIYIXNDGIFQ

SEQ ID NO: 49624 - protein, 100 aa, Sorghum bicolor
  unsure (1)..(100): unsure at all Xaa locations
  Clone ID: LIB3478-003-P1-K1-A6.pep
FCSLYGSCHNQLHQLAHRTLSMSAVCSLLLILLLVWKLPPDTAAHRQACNLLLPPWSLVRIRGECICMFDADLTILDIGSMDEGDXYVKFQLRNKVDGFN

SEQ ID NO: 49625 - protein, 100 aa, Sorghum bicolor
  unsure (1)..(100): unsure at all Xaa locations
  Clone ID: LIB3478-003-P1-K1-A8.pep
QETVDITCGIKCAHPCIIDVLILLILNVTDKTILIYQSKGERHDGXKSAVASPHXEADGNKWRKDGSILICSCCWTDRNTDRARQRTLNQQLNSDDFTVA

SEQ ID NO: 49626 - protein, 160 aa, Sorghum bicolor
  unsure (1)..(160): unsure at all Xaa locations
  Clone ID: LIB3478-003-P1-K1-B9.pep
FYWYTDAVVGPGFSEGYIGLIYSIGSVGSLIGVLLYQSALKDYPFRSMLLWGQVLSSLAGMLDLVLVTRLNLKIGMPDYFFAVADNAVSQMVGRLQWLPLLVLCSKLCPPGTEGTFYALLMSLQNAGLLMSAWWGXLLLHMLNVTRMEFSNLWIIVLIRN

SEQ ID NO: 49627 - protein, 41 aa, Sorghum bicolor
  Clone ID: LIB3478-003-P1-K1-C10.pep
FAVLGRSNVGKSSLINALTRRKEAALTSKKPGKTQTINHFW

SEQ ID NO: 49628 - protein, 180 aa, Sorghum bicolor
  Clone ID: LIB3478-003-P1-K1-C2.pep
TFKQLQSERGESILTFAVDMTLKSTKALVQPSNMPDGLDFWRSKLLWASRVLPMPLVGLLVITGLCLPVENQDGFPELEALSRLDFGAALKIFLAKQLTSEFTAVPTPVEEKSVIIGERNRVATEKIKEAINCGYKRIRVLYGGGHMPDLGRRLREELNMVPSDVQWVTAWSIRMPEIDN

SEQ ID NO: 49629 - protein, 135 aa, Sorghum bicolor
  unsure (1)..(135): unsure at all Xaa locations
  Clone ID: LIB3478-003-P1-K1-D12.pep
TFIPGDDDNVYSTELRELLSRRSVSNLLHSAFRENLDRLIRSYVERQGRGPLPWDLEGTTPAPPSPDQNQEQQRDDEDQELQNTVNRPPLVIPPPPMPPRQPLWHSELHRNNWIRQNIHXSSSDIEWEAINDLRA

SEQ ID NO: 49630 - protein, 67 aa, Sorghum bicolor
  Clone ID: LIB3478-003-P1-K1-D5.pep
FVYSVRSIYYTCVLHTAASRRNIPMATGLPFVHWMMAGNVASRELSSEIGGWRCPWNLMIAITPFHG

SEQ ID NO: 49631 - protein, 161 aa, Sorghum bicolor
  Clone ID: LIB3478-003-P1-K1-D8.pep
ELPSASESHFLDLISATAALRPAFADALAQLQPRPDLLVHDGFLPWAKDAADGLGVPRLVSHGMGAFSCYATLSVLIQKPHARVSSPWEPFEVDGLPGLQLTTADLSPPFDDPEPAGRHWDFICESGVAMNSSRGTILNSFHELESLYIDKMNQLENSPAM

SEQ ID NO: 49632 - protein, 161 aa, Sorghum bicolor
  Clone ID: LIB3478-003-P1-K1-F3.pep
SVWYAAAFPFRADPIDVDFVSTEGISRLSHRSLDGLVAYLCHQCPDLSHDDALWHLALSLAALHGASASARGAVPIGRTGLEAVPFQVAAQAARHPTPSALTSFVTSVLPPVERDVLSLLAAGRRRLSSHDILRLSAMLQPLPLPDALPQQPCSRELTIRI

SEQ ID NO: 49633 - protein, 43 aa, Sorghum bicolor
  Clone ID: LIB3478-003-P1-K1-F6.pep
VGGPERRSPGGLYYLSYLDRDMLLGRSVGGGGVFVFTKAQPLT

SEQ ID NO: 49634 - protein, 78 aa, Sorghum bicolor
  Clone ID: LIB3478-003-P1-K1-F7.pep
STNCILCCIFCLYSTRMFCLLKDTKFEWYVSFFLESIIFMHNSFVIDMTNYLILNFDDPGPYGASRYSDHTLPEVLKL

SEQ ID NO: 49635 - protein, 129 aa, Sorghum bicolor
  Clone ID: LIB3478-003-P1-K1-G3.pep
VEPLLFNYQVDLVFFGHVHNYERTCAVYQGDCKGMPTKDKNGIDVYDNSNYTAPVHVIAGAGGFTLDSFPNNGEAWSLSRVSEFGYGKVHATRTDMLGQFVNSSSMEVRDQFKIVKGASVNKTPSLILQ

SEQ ID NO: 49636 - protein, 123 aa, Sorghum bicolor
  Clone ID: LIB3478-003-P1-K1-G6.pep
GSCPPCPCCAARYPQAGSVLGLGVASSLACMRGAFERCARGCRRRRRPPARRAGASVIASCSRPPPHPPFRPAVRLPRGAGSERARGRRQNPSGERQRRIAGMRGNRGESSGSVVAGRTPDAW

SEQ ID NO: 49637 - protein, 52 aa, Sorghum bicolor
  Clone ID: LIB3478-003-P1-K1-G7.pep
LVKPLPPVMAYSVSRNINFFFRIFTQFWDEEGIANAQKSLGLGNDDGSRRMR

SEQ ID NO: 49638 - protein, 61 aa, Sorghum bicolor
  Clone ID: LIB3478-003-P1-K1-H1.pep
TIIGYAVALSGVVLYNYLKMKDVKANQLPADNSSDRATKDKKSVSIFRPDNSMDNNDGTVV

SEQ ID NO: 49639 - protein, 123 aa, Sorghum bicolor
  Clone ID: LIB3478-004-P1-K1-B11.pep
HHCMHADSHVQIKWVRKKTDGNTSTDPMSYLPTGAAPKNRDEHRNSARINGQELSDRAYRPPTRTLARPQIPGYCHCDSNLRINLDKFDKKLEYIVISNNKKSNYSTLSAKQWRRQNFKLGYC

SEQ ID NO: 49640 - protein, 91 aa, Sorghum bicolor
  Clone ID: LIB3478-004-P1-K1-B12.pep
YACSSSVRLPRASYAQHISLSQNTEHRSVSPERSIDSRSGSRSAVVVVVIVVAVGLCHPSPRAAAPIPWRGVNGARRGGNAAALDELEVAS

SEQ ID NO: 49641 - protein, 38 aa, Sorghum bicolor
  Clone ID: LIB3478-004-P1-K1-D5.pep
SYRCTQTVWTLSLSEVTETESHLTKLLSILGGYIITSL

SEQ ID NO: 49642 - protein, 77 aa, Sorghum bicolor
  Clone ID: LIB3478-004-P1-K1-D6.pep
QDILDLQSARPPLACGYYSQIRTIDRGIVHRTRDTLPCGALLSREHGGPNQAHASGRCMASCTAGTQPSVFVHACVS

SEQ ID NO: 49643 - protein, 168 aa, Sorghum bicolor
  unsure (1)..(168): unsure at all Xaa locations
  Clone ID: LIB3478-004-P1-K1-E1.pep
LSWMGEGQADKQRQRSLMLKQLLTEILLRDGGIQLLLGPNGMGEEGELKKYMMDWRSRQQFLLEAAHRCQEAGLYDKAVEIHKRVGAFAMALQTINKCLSDAVCAMARSMLDGESHAAALIHSGNEILETARYSSEASTQEKDLISEQQTVLRQXEAILHIYRLARAG

SEQ ID NO: 49644 - protein, 124 aa, Sorghum bicolor
  Clone ID: LIB3478-004-P1-K1-F3.pep
RNEVCVYANKRGGELTRVLQNNPFDRRPNYSRQESRRETRFSGSLFPLCSKCSSYLAPSPAASSSSLTPPSATMDVSSSSSWAPAPIREALAAFPTTASKEKLQSCSRKHSWSWPSHRSLNATN

SEQ ID NO: 49645 - protein, 52 aa, Sorghum bicolor
  Clone ID: LIB3478-004-P1-K1-G4.pep
VDPPELITPAKIFVIERLHPMIDQRVRDLLEFRIYSDITEEVKVAWKIQRTM

SEQ ID NO: 49646 - protein, 40 aa, Sorghum bicolor
  Clone ID: LIB3478-004-P1-K1-G7.pep
SHPFFIHHARHSIPFSTTHASSSSWGDRYSTPSSQTTFMK

SEQ ID NO: 49647 - protein, 64 aa, Sorghum bicolor
  Clone ID: LIB3478-005-P1-K1-A10.pep
PLDFISYNFYGCKTLFGVPGIISLYEFRSSHCNLNKIKILSLFFYVAGIQIPSKIITQCGQRSG

SEQ ID NO: 49648 - protein, 67 aa, Sorghum bicolor
  Clone ID: LIB3478-005-P1-K1-B1.pep
QGLARHLRRDARRLAAMADPYLPVTISAYQGRRMKRSAAYYEVNAYLSDTSARGVRQLRAEGSKDAN

SEQ ID NO: 49649 - protein, 99 aa, Sorghum bicolor
  Clone ID: LIB3478-005-P1-K1-B12.pep
ARRSCCWFPTLCWSCCLHYLSRLCRDLRGCWWRGEIRPKLVLGRGPTRAVGSYSLMRAEPHAARIWEHTWMPPPLHCPCCLKPMRGVMRGSWRERDDAC

SEQ ID NO: 49650 - protein, 92 aa, Sorghum bicolor
  Clone ID: LIB3478-005-P1-K1-B9.pep
MSRLAHRSGWLVGSTGRILNGVSRTEDWKAAANSSALFLTAAAQNLLCLKLAEEIGVNIGNYWFTWFKVASVPALLGILVTPYLIYKIFPPE

SEQ ID NO: 49651 - protein, 59 aa, Sorghum bicolor
  Clone ID: LIB3478-005-P1-K1-C8.pep
VSVATSVPRARAGPRPVACRAEPRRIRCSTHGAARAARAEAPPVARRGQQPVMLFSLPP

SEQ ID NO: 49652 - protein, 60 aa, Sorghum bicolor
  Clone ID: LIB3478-005-P1-K1-E10.pep
YTSIYSVQECSLISAPHKGWALRVAIFVRNEQGIKCSASCMLRSAAYHVFTNEEMGIQTV

SEQ ID NO: 49653 - protein, 87 aa, Sorghum bicolor
  Clone ID: LIB3478-005-P1-K1-E5.pep
MSASRSSSPNSMSKWSPKENKMFEQALAYYGEGTPNRWDKVSSAMGGIKSAEEVRCHYEDLDYDVKMIESGHVPYPQYKTQGFWTRG

SEQ ID NO: 49654 - protein, 153 aa, Sorghum bicolor
  unsure (1)..(153): unsure at all Xaa locations
  Clone ID: LIB3478-005-P1-K1-E8.pep
RIYIVLEFVMGGELHDIIATSGRLKEEEARRYFQQLINAVDYCHSRGVYHRDLKLENLLLDVAGNLRIQXFRVKGLXNQGKMVDWCVPTCGPPTYVLQKVMVNKGYNGALADLGSCGVILFVLLAGCLPFEDDNIASLYKKISEAQFTCPSWF

SEQ ID NO: 49655 - protein, 52 aa, Sorghum bicolor
  unsure (1)..(52): unsure at all Xaa locations
  Clone ID: LIB3478-005-P1-K1-F1.pep
GDQRQLKACSITITSWHMQILFSQDATLMYIFYHLGGKLGPXWIMHPKNLRF

SEQ ID NO: 49656 - protein, 62 aa, Sorghum bicolor
  Clone ID: LIB3478-005-P1-K1-G1.pep
RRTTRATPAVPDFTPSTSPRLLGAPPPPRFRVSDENLNNLTKIYRTGFFEFYHLSSPSKGTC

SEQ ID NO: 49657 - protein, 109 aa, Sorghum bicolor
  Clone ID: LIB3478-005-P1-K1-G6.pep
WWSSNPPFPSCPSVPAPQLHAQSAAASSSGSRHRLSSSAAAAIAVSVRLGYTRSTFESTLAKKLKVQPQAIKNCSATAAAVATHNAASLAWPPTTNSRRGRRRRLRTGG

SEQ ID NO: 49658 - protein, 97 aa, Sorghum bicolor
  Clone ID: LIB3478-005-P1-K1-H12.pep
INVSAAPPGRWGHTLSCLNGSWLVVFGGCGRQGLLNDVFMLDLDAKQPTWREIPGVAPPVPRSWHSSCTLDGTKLVVSGGCADSSVLLSDTYLLDVT

SEQ ID NO: 49659 - protein, 134 aa, Sorghum bicolor
  Clone ID: LIB3478-006-P1-K1-B12.pep
DLETQLNELKNMESVASEQHGRIEKLTDELSRKDQEIEGLVQALDEEEKELEILENKSLQLEQMLQEKEFSLKTSEVSRTKALAKLTTTVDKFDELHSLSENLLAEVENLQSQLQERDSEISFLRQEVTRSTNE

SEQ ID NO: 49660 - protein, 66 aa, Sorghum bicolor
  Clone ID: LIB3478-006-P1-K1-B4.pep
KKKKKKKKKKKKKKINKKWAAAKKKTKLTTAGRPQHSFSFLRPLSISLPVVFQPSLLRKPSEYPTY

SEQ ID NO: 49661 - protein, 50 aa, Sorghum bicolor
  Clone ID: LIB3478-006-P1-K1-C2.pep
ATRPARSCVCASATGGPMSVWRSVCQTTDATMTPYMHIYIRLVSSLLGTE

SEQ ID NO: 49662 - protein, 63 aa, Sorghum bicolor
  Clone ID: LIB3478-006-P1-K1-C3.pep
VPCWPYFPQPILNRVKILIVDIGICCSGAVVPRCYYLKSNLYTCSSYTFKQSRLQQTYQVRCA

SEQ ID NO: 49663 - protein, 106 aa, Sorghum bicolor
  Clone ID: LIB3478-006-P1-K1-C5.pep
QIEVSKLEENSVVAWSPAVVAKTIWKNNLLVDYTVSKCYGTALSEEIVDVKHVRPCPPQASEISFCINDEVEAFQGDCWWLGVITKVHPEFKYTFKSAHLGTEVEV

SEQ ID NO: 49664 - protein, 119 aa, Sorghum bicolor
  Clone ID: LIB3478-006-P1-K1-C9.pep
IGSVCTRMHELTKNNHLRKMVCQNAWGRDVTVRLEMSTKMVGWGRLARELTTLEAASWRKFTVGGRVEPSRCNFSACAVGNRLVLFGGEGVNMQPMDDTFVLNLEAARPEWRRVKVSAF

SEQ ID NO: 49665 - protein, 123 aa, Sorghum bicolor
  Clone ID: LIB3478-006-P1-K1-D5.pep
LILPAYDIVNIIGSGLRTIGYWSNYSGLSIVSPETLYKKPFNVSANQELHSAIWPGETVTKPRGWVFPNNGNELRIGVPDRVSYRQFVSVDNQTETVGGFCIDVFAAAINLLQYPVTYRFIPF

SEQ ID NO: 49666 - protein, 49 aa, Sorghum bicolor
  Clone ID: LIB3478-006-P1-K1-D7.pep
IGLGPSFVNRVRGEQINRDWPGWLFNIAVEAIGGWSPWRADSFKKIGKA

SEQ ID NO: 49667 - protein, 97 aa, Sorghum bicolor
  Clone ID: LIB3478-006-P1-K1-D9.pep
TLRYSVRRHMRNDTQLAYWTIRGQRFLRSSLRATTPSLHDKTSSIQVRRRYVLAYPSSTAPISSSIVHRRPRATTTNSVTIFISITDDVVYFYSRKQ

SEQ ID NO: 49668 - protein, 106 aa, Sorghum bicolor
  Clone ID: LIB3478-006-P1-K1-E3.pep
IICACLLDLTVVVQSAVAINEVTGLWDKELADTINRICEGNRNADVGTDTADTQVTKSNCLTDEPIQSHDRLAPQDGNQVDEGSIPQSLQNDGSSVLTSDNILLSS

SEQ ID NO: 49669 - protein, 119 aa, Sorghum bicolor
  Clone ID: LIB3478-006-P1-K1-E4.pep
FTTTIDFDFNTISSRIRELAFLNPELTITLTKEEGHTVQHNEYCYAGGLVEYVKWLNTDKKPLHDLIAFRKELDGITVDVSLQWSSDSYSDTVLGYANSIRTIDGGTHIDGLKASLTRT

SEQ ID NO: 49670 - protein, 61 aa, Sorghum bicolor
  Clone ID: LIB3478-006-P1-K1-E9.pep
NGKSILKFSFFFFTLRELCTLLNSISPFTMLLCSYFHNKFSPVIPYLFNLLFHPNFCLVAF

SEQ ID NO: 49671 - protein, 113 aa, Sorghum bicolor
  Clone ID: LIB3478-006-P1-K1-G1.pep
CTHPYLLLHPLLPPRRSSTAVYTTEICRYLSTLGTTVNELGLGMGMELAQNITYHTTSNMPSNLLPDMVKHKLMNLLLILAILLAIVLMTVRYGALYGPFCFRGACGGTYGKD

SEQ ID NO: 49672 - protein, 63 aa, Sorghum bicolor
  Clone ID: LIB3478-007-P1-K1-A4.pep
SLSHVIRNLQYLMHQALGHHSEHVNQCNIHGAVIHLQPWQEHPQFSSLELHGSRYQSLGRTRR

SEQ ID NO: 49673 - protein, 115 aa, Sorghum bicolor
  unsure (1)..(115): unsure at all Xaa locations
  Clone ID: LIB3478-007-P1-K1-A5.pep
GKFGPGSAAWQSFRSPVVSQKDDMVCIHIRRGGVDSGQCHSKWLSTITGFPDVISMSFVPITSLLTGVRXSGFLNHAVNLYLRYKPPIEELQQFLEFQVPRLWAPEFGELPAVSP

SEQ ID NO: 49674 - protein, 42 aa, Sorghum bicolor
  Clone ID: LIB3478-007-P1-K1-B12.pep
QNILPWRHTSVLLGHSQWSFINIKYADGTVLMKREMIRVSWK

SEQ ID NO: 49675 - protein, 142 aa, Sorghum bicolor
  Clone ID: LIB3478-007-P1-K1-B2.pep
NYTISHGEETQHDENKANGSNSCIYSINARLKKFSDWLLDIIAMGDLDAFFPAATREYAPFVDEMWKDPAIQATFKRKEELHFLPDVAEHFLSRAIEVSSNEYEPSEKDVIYAEGVTQGNGLAFIEFTLDDRSPMSEPYIDN

SEQ ID NO: 49676 - protein, 94 aa, Sorghum bicolor
  Clone ID: LIB3478-007-P1-K1-B4.pep
DPRVRNTDYQNEQGHGPQEENGHIQDGDQNNEENGGCNDIENQATTISMPRPNTNSDELRDCPQNNKAIALTCFGSQVTHRGGVTNIGDQVAQV

SEQ ID NO: 49677 - protein, 73 aa, Sorghum bicolor
  unsure (1)..(73): unsure at all Xaa locations
  Clone ID: LIB3478-007-P1-K1-B5.pep
ILFRQLSTSLQYSNNILXSFHTCIISSFKIRYYILIQTNVELLCISISNVQIILGFLSKRFANSTKGGSRQQI

SEQ ID NO: 49678 - protein, 100 aa, Sorghum bicolor
  unsure (1)..(100): unsure at all Xaa locations
  Clone ID: LIB3478-007-P1-K1-B6.pep
IVSGALRLVKQLAPKIVIAIDHDAERLGFPPXQHFLNXIKCGTFLLDSLDAAXVDADSAGTIVTCLIQPIIDDTKLDRIKVDKPTAWRSALAGAGFAPVS

SEQ ID NO: 49679 - protein, 157 aa, Sorghum bicolor
  Clone ID: LIB3478-007-P1-K1-C7.pep
RERKIISTACTLPRSHVAEKLFQPLASGQVPSSLLAHTLVPRGEPVHLRLRFCFPFYFFSSENPSGHSLLPAGETLEPSRSTDMWASSALRRRRDAALGWWRWTRVGAPTGPKRRSSVRRCRRSTRRGGGSGGGASCVEDLRVAGREPGELARALDH

SEQ ID NO: 49680 - protein, 53 aa, Sorghum bicolor
  Clone ID: LIB3478-007-P1-K1-C8.pep
SLKQDDLLSSTRTYRVCYIHTSLLEVYILSYYTIIQKISYCFHLFVNYLKNSI

SEQ ID NO: 49681 - protein, 146 aa, Sorghum bicolor
  Clone ID: LIB3478-007-P1-K1-D6.pep
TCSFGFASTLEDGTVPSQAMRNLEVEANEVSSVYRDQYYEGGISSDYIWEDEDNGFIACFLIKKDGHGKRGYMQIGSWDAIHVIQAGPEEEGAAHYCLNSTVMLSLTTDSKQSRTFNLSGSIRRQMSMTLAVADGHLVDMGKMIEE

SEQ ID NO: 49682 - protein, 135 aa, Sorghum bicolor
  Clone ID: LIB3478-007-P1-K1-D9.pep
GMYLGSVTGLGFSPLLISRFGWPSVFYAFGSLGTVWFALWQSKAHSSPDDDPEISKAEKRHILGGSPLKEPVTSIPWRLILSKAPVWALIISHFCHNWGTFILLTWMPTYYNQVLKFNLTESGLLCVLPWLTMGC

SEQ ID NO: 49683 - protein, 77 aa, Sorghum bicolor
  Clone ID: LIB3478-007-P1-K1-E4.pep
GVPLPWFPHYGGDKDRECRIMARIRLYLVPSELLDRAVLWALGFISFSLMGSCPAGLISYKGRLGLWKCNWTPSPEL

SEQ ID NO: 49684 - protein, 143 aa, Sorghum bicolor
  unsure (1)..(143): unsure at all Xaa locations
  Clone ID: LIB3478-007-P1-K1-F11.pep
HALRVKTLDITSAILAAKSAVFSKLFSNGMKESDQRHAPLRTTDSEETALMELLSFMYSGKLTATEPTLVLDILMAADKAEVVSCMRYCMQLLTHLPMTTESALVYLDLSCSISMAAAVXPLTDAATDALAVKHKDLTKVQDE

SEQ ID NO: 49685 - protein, 150 aa, Sorghum bicolor
  unsure (1)..(150): unsure at all Xaa locations
  Clone ID: LIB3478-007-P1-K1-F4.pep
AKAAAYYDELNRKGEGARRFKQGLGFSSTSSDAAAFPSKPTASSFLSGFVRAGAAPAAAQLPNLSKQPPPHSRPPSSPRRRSSSPPPSRPRIRSRSRSRSPSRSSRRRSRSGXRSRERMRRSRSRERDRMASRRRSXSRASRRFSPERRS

SEQ ID NO: 49686 - protein, 54 aa, Sorghum bicolor
  Clone ID: LIB3478-007-P1-K1-F5.pep
KKKKKKKKKKKKKKKKGGGKKKKKKKKKKKKKKKKKKKKKKNKQKKKKKRGGPF

SEQ ID NO: 49687 - protein, 90 aa, Sorghum bicolor
  Clone ID: LIB3478-007-P1-K1-F7.pep
KLMTLGLPSESSMPPHYCISIYRSIIFFASSTKCHRFYQDLSLGRCFPPDFPPSIQLMGLPCSCVCRLWADRRGLLLLEICTDPIFYSAS

SEQ ID NO: 49688 - protein, 67 aa, Sorghum bicolor
  Clone ID: LIB3478-007-P1-K1-G2.pep
KKKKKKKKKKTKKKKKKKKKKKKKKKKKKKKPKKKNKTKKKKKKRAIVLQGGAPFSGSQLSLPFLET

SEQ ID NO: 49689 - protein, 111 aa, Sorghum bicolor
  unsure (1)..(111): unsure at all Xaa locations
  Clone ID: LIB3478-007-P1-K1-G8.pep
DRPNPSTGEWYPAPFDSSAVDNMRRLLEHAGVPGHIYPLSLLCYEVMPPPQQVEKEIGEQRVISFHGVGLSVTEEIKYGDITAHTKNADEGRELFTNTXYNSVVNQYDVLK

SEQ ID NO: 49690 - protein, 108 aa, Sorghum bicolor
  Clone ID: LIB3478-007-P1-K1-H7.pep
HIAEYGVGCKISVESDIYSYGIILLEIIKFCTTLQIETDDMFKDGVNVRNFVESSLPLNIHNILEPNLTGYHEGEDGGQEMVEIQHCAMQLANLGLKCSEMSPKDRPK

SEQ ID NO: 49691 - protein, 124 aa, Sorghum bicolor
  unsure (1)..(124): unsure at all Xaa locations
  Clone ID: LIB3478-007-P1-K1-H9.pep
HASGFLEPTSTVLARPVLDAHGWDHDCGYDGVSVEETLAILSRFPANVAVQVTKDKKEFSIHLDSSIAAKHGENASSLAGFDIQTVGRQLAYILRGETKIKNIKKNKTTGGFSXVTFLGDIVAT

SEQ ID NO: 49692 - protein, 39 aa, Sorghum bicolor
  Clone ID: LIB3478-008-P1-K1-A6.pep
MARRGRVELRRIEDKASRQVRFSKRRAGLFKKAFELALL

SEQ ID NO: 49693 - protein, 64 aa, Sorghum bicolor
  Clone ID: LIB3478-008-P1-K1-A8.pep
DEQGAVEIVQSFGAQWYGHMTRVFISIRFSMSGVRSKMIQLSAWHVSLCARFIGINSSDNFQVA

SEQ ID NO: 49694 - protein, 140 aa, Sorghum bicolor
  Clone ID: LIB3478-008-P1-K1-B8.pep
PTRPNLSPREGDWICQNPNCGNLNFARRTHCNNCNKFRYSSHEAYEPRRSPPFRGYPSSPRGPPRIGPPGDRAPAREMTRYRSPPHGWGASDPRAYAARSPPERAGRFTDPSPKERMGFRGERDPRDRVKFEWSGTDDYI

SEQ ID NO: 49695 - protein, 61 aa, Sorghum bicolor
  Clone ID: LIB3478-008-P1-K1-B9.pep
QHKALALLRPAAVAVLMISTRAVEAPSTLTLARKPLGLHDTFLDGFQSAFMNNTTVAAARI

SEQ ID NO: 49696 - protein, 109 aa, Sorghum bicolor
  Clone ID: LIB3478-008-P1-K1-C10.pep
HASEKTGQPLEAGAAHAAAGNHGTHGTHNTHNTHGTTGTTGGLTGNDHTTDSHGVTGSHGTHGTHGTHGTGAGLGEPVGTTGTHHTTGTHGTTGGLTGNNHHSATGNAT

SEQ ID NO: 49697 - protein, 131 aa, Sorghum bicolor
  Clone ID: LIB3478-008-P1-K1-C12.pep
AAREAEILMLAADAPHVVRLHAVIPSSAAGAGAGEAPAALALELMPGGSLSGLLRRLGRPMGERPIAAVARQALLGLAALHALRVVHRDLKPSNLLVGAGGEVKIADFGAGKVLRRRLDPCAFYVGTAGYM

SEQ ID NO: 49698 - protein, 112 aa, Sorghum bicolor
  Clone ID: LIB3478-008-P1-K1-D1.pep
QELCPEKRMLYYPYLPKVIGSDFLERRLRDIHSNRKDGAACHVFGHTHFCWDSVVDEIRYVQAPLAYPRERKRRMNSEGWLPFCVYRDGFNPEIYPALWSDYYNKNKREPEN

SEQ ID NO: 49699 - protein, 106 aa, Sorghum bicolor
  Clone ID: LIB3478-008-P1-K1-D6.pep
MWPSWVKTRSSDPAAASTSTALVPAAGASPRLSIPNPSLKDLRSLLAPDSAAAALPSAVSPSPRVFHRIRVAASALRVLRTLQHSPSPPAAGKELAPGGGPGGLYF

SEQ ID NO: 49700 - protein, 54 aa, Sorghum bicolor
  Clone ID: LIB3478-008-P1-K1-D8.pep
HMIQNDLVHGWGLDFALRKCVEVFRAIVMHNTSPPHFFDNPRISHTVHAFPLTG

SEQ ID NO: 49701 - protein, 60 aa, Sorghum bicolor
  Clone ID: LIB3478-008-P1-K1-E1.pep
SSIMAIVQLISSIISHFVHRIRDVFGRCVILSRLMERAEAQAVVIGNRYIFRPRMSDRFT

SEQ ID NO: 49702 - protein, 105 aa, Sorghum bicolor
  Clone ID: LIB3478-008-P1-K1-E9.pep
AAAGLRPLSLAVSARPLYRQEHVLSTVAVAAAAGRNDRSTSPAPPSATADGARPVEVAAAPAENARRARIGVYFATWWALNVIFNIYNKKVLNAFPYPWLTSTLS

SEQ ID NO: 49703 - protein, 131 aa, Sorghum bicolor
  Clone ID: LIB3478-008-P1-K1-H11.pep
MTYAPSSAVWWASYGSSQRIIWSALGHLHDKEEAPSQLKLVGVQASGGVFAGAVTSFVTTPIDTIKTRLQVMDNENKPKAREVVKRLIAEDGWKGLYRGLGPRFFSSSAWGTSMIVCYEYLKRLCAKVEEV

SEQ ID NO: 49704 - protein, 86 aa, Sorghum bicolor
  Clone ID: LIB3478-008-P1-K1-H2.pep
GVIRKYGGKAHTSGLHRDINVCANFLSSRRVQKTREQTGGRAGPGTGRPPPPIGRPPSYGSQSGSTSWIMLHRPKGLRKTMRLRSV

SEQ ID NO: 49705 - protein, 77 aa, Sorghum bicolor
  unsure (1)..(77): unsure at all Xaa locations
  Clone ID: LIB3478-008-P1-K1-H9.pep
YLFSNQACVWHHIYSGSHGTLFCSHEKSAEFCFLLQRFFISSAFAHGLMFCSMLDSRIRSCKXDSNSEQCQDSSCRI

SEQ ID NO: 49706 - protein, 60 aa, Sorghum bicolor
  Clone ID: LIB3478-009-P1-K1-A10.pep
KLAIHLQYLCSLPQIIQLEDDPYNHQIPEYDRKYYEPIGPWKRFSHVCAAPVESDDLSIV

SEQ ID NO: 49707 - protein, 142 aa, Sorghum bicolor
  unsure (1)..(142): unsure at all Xaa locations
  Clone ID: LIB3478-009-P1-K1-A8.pep
TFPFSPPVTTETELELTESTPPSTEETEETEPTDEETETELTVPTTPLSTEETEVTEPTTEETEVSIPPGEPTTDETEETEGTEETEETEETEVTFPFSPPATTETEXELTESTPPSTEETEETEPTDEETETELTVPLLLI

SEQ ID NO: 49708 - protein, 81 aa, Sorghum bicolor
  Clone ID: LIB3478-009-P1-K1-B4.pep
QQLLDILELTHQSVSRFLELDSYSLMLSEMQENLSLVSYSSRISSQIWSEMQTDFLPNFILCNTTQRFVRSIKRTHHSSHR

SEQ ID NO: 49709 - protein, 81 aa, Sorghum bicolor
  Clone ID: LIB3478-009-P1-K1-C11.pep
QLTWDASSEFYISSIKLMIQAGYILLLCITKMTNKVSKTQGSAYDFHTTVAIVGAVRSAFLPVASCTLSALNSTDAWADAW

SEQ ID NO: 49710 - protein, 82 aa, Sorghum bicolor
  Clone ID: LIB3478-009-P1-K1-C4.pep
DSEDDSGEEAQAKPSDKAIYNKEAILEKLEDIAWPKNVDWMHKLTIEHDQGEKVDVNDDLARELAFYTQALDGTRQAFEKLQ

SEQ ID NO: 49711 - protein, 49 aa, Sorghum bicolor
  Clone ID: LIB3478-009-P1-K1-C5.pep
VKHCHCFRHPKAQRVAHKAQYVDGGEVPKVIACLPARLQATLDTDALSL

SEQ ID NO: 49712 - protein, 119 aa, Sorghum bicolor
  Clone ID: LIB3478-009-P1-K1-D11.pep
SPPGVEMQQRMKQPADHFSFAPFRKTFDQDAGISGDHVPSNQLGRSEPHHAGHGQLPHRPMLSTTTGVPATSVLISMPSNPVSTIVPPVMHDAWVVLDHDQLHVPAMLMDHHDKFESEH

SEQ ID NO: 49713 - protein, 54 aa, Sorghum bicolor
  Clone ID: LIB3478-009-P1-K1-D12.pep
ITKPCSLGYSVYAALDFFTDSRHIKTDILKVDLASKLDMQETSRKACAFSFVNY

SEQ ID NO: 49714 - protein, 107 aa, Sorghum bicolor
  Clone ID: LIB3478-009-P1-K1-F8.pep
LLKKAYGEEGGDDIDYDRRLLTSSDESVSEGSGNGSANGMVSEFGDDNFVIGNWELKEIISRDGHMKLSSQVFFASIDQRSERASGESACTALVAVIADWFQANQNM

SEQ ID NO: 49715 - protein, 39 aa, Sorghum bicolor
  Clone ID: LIB3478-009-P1-K1-G3.pep
CAEQCAYSNASTVRHPLWHEMQKGRQRGPVRVPVRGPRH

SEQ ID NO: 49716 - protein, 126 aa, Sorghum bicolor
  Clone ID: LIB3478-009-P1-K1-G5.pep
MKTLSFDVGIVMIFGGGRLDERRKAELRKNYSIVEKGYNSFPNSLPGTLYYKAMQARRRLQGVLSDIMRERRKRGEPGTDLLGCLMQSQGDDGAPLLSDEQVADNIIGVLFAAQDTTASVLTWIVK

SEQ ID NO: 49717 - protein, 72 aa, Sorghum bicolor
  unsure (1)..(72): unsure at all Xaa locations
  Clone ID: LIB3478-009-P1-K1-H5.pep
MDTPSPSPTSSAGHDEYRTVWSAPPKKPAGRTKFRETRHPVYRGVRRRGTLWRCVCEVRXPGGRGSRLWLGT

SEQ ID NO: 49718 - protein, 110 aa, Sorghum bicolor
  unsure (1)..(110): unsure at all Xaa locations
  Clone ID: LIB3478-010-P1-K1-B8.pep
RPLEALNVFYSMQNQLSSYPDMAAYHCIAVTLGQAGLVKELFDVIDCMRSPPKKKFKLSPLQNWDPRLEPDLIVYNAVLNACVQQKQWEGAXWVLQQLKEKNIRPTNSTY

SEQ ID NO: 49719 - protein, 105 aa, Sorghum bicolor
  Clone ID: LIB3478-010-P1-K1-C8.pep
PRVRDKLHVQLKRPRIVPGEEVDEKSKKFRHMLRSVVVDGSDIVVSAKKASERSLARLEAREAAAKAKAKREEERVQELKKIRGEKWLPSVARQMKEEKAELRRQ

SEQ ID NO: 49720 - protein, 107 aa, Sorghum bicolor
  unsure (1)..(107): unsure at all Xaa locations
  Clone ID: LIB3478-010-P1-K1-E3.pep
ECLEWVIHCDVKPENILLDQTFEPKITDFGLAKLLNRGGSTQNVSHVRGTLGYIAPEWVSSLPITAKVDVYXYWVVLLELVTGTRVLELVESPDEVHNMLRKLVRML

SEQ ID NO: 49721 - protein, 67 aa, Sorghum bicolor
  unsure (1)..(67): unsure at all Xaa locations
  Clone ID: LIB3478-010-P1-K1-E5.pep
CHSLLLTKLLLIHWGQKPFSSQNSRCRTCVCSNASLNHICRXSSVFLPQIQASHRIFTVGLGSPLSK

SEQ ID NO: 49722 - protein, 61 aa, Sorghum bicolor
  Clone ID: LIB3478-010-P1-K1-F3.pep
KFMGANRTKHKKLFLISLAQYQVNAKILDLLVFKYMNTAMIWKSKPLTRLTYNHIPRMKGN

SEQ ID NO: 49723 - protein, 41 aa, Sorghum bicolor
  Clone ID: LIB3478-010-P1-K1-F4.pep
ANRHCHLHAIITKRPSMLQCILTELQLRIIELDTGVGSLEY

SEQ ID NO: 49724 - protein, 132 aa, Sorghum bicolor
  unsure (1)..(132): unsure at all Xaa locations
  Clone ID: LIB3478-010-P1-K1-F6.pep
GHHGLISDETLESGLKICPGSSFIHIEPECQKIWDKAVEEQGNIDGYSIYTPPCDKGTPYARRRLRRSRRPLMLPAYDPCTAFYSTKYLNLPEVQTAMHANVSGIIDYPWVLCSDPLYYNWTDTPAXMLPIY

SEQ ID NO: 49725 - protein, 109 aa, Sorghum bicolor
  Clone ID: LIB3478-010-P1-K1-F9.pep
MADAAREIGSLPVANVQALAETCNNGGHVQVPQRYLTKDPGSEEVVAADDSSHAIPVIDLQKLLESQSSEEECAKLASACLNWGFFQLINHGVPDKVIGNLKNDIAEFL

SEQ ID NO: 49726 - protein, 87 aa, Sorghum bicolor
  Clone ID: LIB3478-010-P1-K1-G6.pep
MSGSRNSSRNVNIDSNWSKKENKLFEEALACYGEGTPDRWHKVARAMGGIKTADEVRRHYEILNDDVTLIESGGVPFPNYNTQGAWN

SEQ ID NO: 49727 - protein, 45 aa, Sorghum bicolor
  Clone ID: LIB3478-011-P1-K1-A4.pep
DKRARRMIGWCDVCKVEGETGPSTMAVTGLQIRAEVEHHHAGALR

SEQ ID NO: 49728 - protein, 87 aa, Sorghum bicolor
  Clone ID: LIB3478-011-P1-K1-A8.pep
IQVVLNANSQIVPAYEIAAGSMGLDMDPDAVTSFNASMDTCHTVIWNGTMNDLQFDTYYVRTDARAKKSAQLSTNGVTAIIEGGDSV

SEQ ID NO: 49729 - protein, 137 aa, Sorghum bicolor
  unsure (1)..(137): unsure at all Xaa locations
  Clone ID: LIB3478-011-P1-K1-A9.pep
LTDVLNRKNKTHRKCMVQCPVPELIAARAGQHPSDVPERRLLDPHRPDAGAPAELGRVGAVLLVDVXEQGAPLRGGDGTDGGPVAASNPPPAPPRGDGGVSGNDGVVRGRRVVDGSSTAAKGHERPRVRPRVRPRVR

SEQ ID NO: 49730 - protein, 67 aa, Sorghum bicolor
  Clone ID: LIB3478-011-P1-K1-B10.pep
ATSVNLKFQQCPGYVLLNGEKVKAKFRRYLCQWNKQGPSVEAMDEEKKHYSVCYSVIVVLDPQVQVQ

SEQ ID NO: 49731 - protein, 96 aa, Sorghum bicolor
  Clone ID: LIB3478-011-P1-K1-B11.pep
AKGTPQHPHCGMAMPNCSPPPGGGFLLLRWAGGGLGWFWNESEEEGLWAHLAAAQSPTPLPLRSSFPPSDLVPAVLVIDSLDPVLSPNPDMPDEVW

SEQ ID NO: 49732 - protein, 72 aa, Sorghum bicolor
  Clone ID: LIB3478-011-P1-K1-B7.pep
SIHARAALSYYFLTATILWYILIHPTSHVLPSHLGSPSDPISVHQCVPKNRHVVRASVRGAPPDKTDDAIRH

SEQ ID NO: 49733 - protein, 132 aa, Sorghum bicolor
  unsure (1)..(132): unsure at all Xaa locations
  Clone ID: LIB3478-011-P1-K1-C10.pep
EHEETFTDDDEAVDIDPEERADLAPEIPAPPEIKQDDEENEEEGGLSKSGKELKKLLGRAAGLNESDADEDEDDDDQEDESSPVLAPKQKDQVKDEPVDNSPAKPAPLGHARGTPXASKSKQKKKIGVDDAK

SEQ ID NO: 49734 - protein, 149 aa, Sorghum bicolor
  Clone ID: LIB3478-011-P1-K1-D2.pep
NMMAFVKILKKFEKITGKQVLSVYLKVVETGYFNSSDEALKLMDEVEDIFVRHFAGDNRRKAMKYLRPAQRMDSHAATFFTGLTAGCFAALFVGYCVMAHMAGMYYYYSTPAPRPRSPRARGVTAGGGFGDSVSVYMETAYPVLSMFAL

SEQ ID NO: 49735 - protein, 36 aa, Sorghum bicolor
  Clone ID: LIB3478-011-P1-K1-D4.pep
SMLKYKRVYQCMIVGPILLHINLSDRRYNLSSVYLA

SEQ ID NO: 49736 - protein, 77 aa, Sorghum bicolor
  Clone ID: LIB3478-011-P1-K1-E12.pep
QPHSVMVDTFSQKTSGRLSVCLHWPLLIMVSLVSERVRNPYTWMTKRCAHIPRVLGKHMDDDPSIDALLPCMLSTGI

SEQ ID NO: 49737 - protein, 51 aa, Sorghum bicolor
  Clone ID: LIB3478-011-P1-K1-E3.pep
DFLFLLQINKLFCFTHIAIEFNLPTRIQNKQRKISIQCILEEKDPILTNHT

SEQ ID NO: 49738 - protein, 52 aa, Sorghum bicolor
  Clone ID: LIB3478-011-P1-K1-E8.pep
STVMSESSEGVVVGAVVMLLIAIHRSTVDGVSSRNRRVSHHKQDRKSECLIV

SEQ ID NO: 49739 - protein, 51 aa, Sorghum bicolor
  Clone ID: LIB3478-011-P1-K1-E9.pep
VAPDYHYIKDVAILLTRHTEESATNGSKGEGCAYDGEICAIQMEGIAVQRA

SEQ ID NO: 49740 - protein, 136 aa, Sorghum bicolor
  Clone ID: LIB3478-011-P1-K1-F10.pep
MVGGHEVGPYRQCSYTQGVMNGVNVLCGVGILSTPYAVKQGGWLGLVILAVLGALAWYTGILLRRCLDSKDGLETYPDIGHAAFGTAGRIIISIILYMELYACCVEYLILESDNLSKLFPDAHLTIGGLTLDSHVL

SEQ ID NO: 49741 - protein, 133 aa, Sorghum bicolor
  unsure (1)..(133): unsure at all Xaa locations
  Clone ID: LIB3478-011-P1-K1-F5.pep
SLGSSCCCCCCAVXVVVVVXVVGSVLFSGGGVGNLGSISTHTETQRHAYKLHQLPSSRQPKANQIRLPCSRLLLPLPLPCPEEGEDQVRQRGMGRDGDRGGGGRGDERRGEGTDGGRRENRRREKGGIRKSRE

SEQ ID NO: 49742 - protein, 150 aa, Sorghum bicolor
  Clone ID: LIB3478-011-P1-K1-F8.pep
PTRPLPPPRRLPLISNLVVDDKNRRRGASADSSAPSRGMASAMATSSARARRNSFTHATAAMTPTPLLMPLTLLQLASLLGTSSVAIPPGSSAPVPSSSAAGDADEHLHCCPHSGLGSSTASVARHRPKVPPLSTASIFFQLTDMRIDLT

SEQ ID NO: 49743 - protein, 36 aa, Sorghum bicolor
  Clone ID: LIB3478-011-P1-K1-G3.pep
THIPTLELPFSTFLVSMALHTLLRTKQVLLNEVIHK

SEQ ID NO: 49744 - protein, 105 aa, Sorghum bicolor
  unsure (1)..(105): unsure at all Xaa locations
  Clone ID: LIB3478-011-P1-K1-G7.pep
TVIATEENSSMPIKEARTAKYLIADTHGTDYRKINIGGRPTKMTLDCCVTTXLRAMXLYXFDETQTMFQLYVXMDNKAAYKLAMSDDMNNFQKLKVMYNEWPFFR

SEQ ID NO: 49745 - protein, 98 aa, Sorghum bicolor
  Clone ID: LIB3478-011-P1-K1-H10.pep
LYQHPALSSVPRPLSRTPAAFFLCQRCTQGLQIRSFNFILHSPSLVCSLCSQSFLLTLSHFLLCQRSTQGLQIPSFNFILDSLSLVCSLCSQSFKLTL

SEQ ID NO: 49746 - protein, 36 aa, Sorghum bicolor
  Clone ID: LIB3478-011-P1-K1-H6.pep
TLARLREPYVLDGLASELGFHEPSAPCWSTRICCWR

SEQ ID NO: 49747 - protein, 104 aa, Sorghum bicolor
  Clone ID: LIB3478-011-P1-K1-H8.pep
VTDARELEKIRQRECDIMKERIEKILKAGANVVLTTKGIDDMSSKYFAEAGAIAVRRVRTEDMCHVAKATGAAMVSTFADMEGEETFDASFLGHADEVVEHKNR

SEQ ID NO: 49748 - protein, 103 aa, Sorghum bicolor
  unsure (1)..(103): unsure at all Xaa locations
  Clone ID: LIB3478-012-P1-K1-A12.pep
PTRPTPQVEQGQQIFPKTPHRRRDREHLRPSPHHGGRHHRGGGGGYGRRDGGGGGYGGGGGGYGGGRGGYXGGGGGYGGGGGGYSGGSRGGGGYGNSDGNWRN

SEQ ID NO: 49749 - protein, 118 aa, Sorghum bicolor
  unsure (1)..(118): unsure at all Xaa locations
  Clone ID: LIB3478-012-P1-K1-A7.pep
KKLEYVKVPEIYWEYTTPQVLTMEYVPGIKINRIKQFDKXGVDRKXLGRYAVESYLEQILSHGLCHADPHPGNIAGDDVNGGRLIFYDFGMMGSISQNIRGGLLEVFYGXYEKDPDEV

SEQ ID NO: 49750 - protein, 86 aa, Sorghum bicolor
  unsure (1)..(86): unsure at all Xaa locations
  Clone ID: LIB3478-012-P1-K1-C5.pep
CCIYFGHETCRHFSFNELNYQAKKMMLIFASSTSVFPSAVNELSYLHTFFFEISVSIEILASLXSVFLAMQLLGYSKNSNRELRNH

SEQ ID NO: 49751 - protein, 66 aa, Sorghum bicolor
  Clone ID: LIB3478-012-P1-K1-E5.pep
LNSKITCSTHLEKLNFFASSSEDYSLQSCDPMRGATRFLCECNQNQGINMQWLEDGTLLKFDEPDA

SEQ ID NO: 49752 - protein, 143 aa, Sorghum bicolor
  unsure (1)..(143): unsure at all Xaa locations
  Clone ID: LIB3478-012-P1-K1-E9.pep
ENQDIPMSETNSVCEAQEDTEHQPSEKDAPVAWEEDENNVGWMPAVSRSTHRRYLRRKARRDALKESGESFETSSVAPSVDDDKDLSENSGLEHGLTSTDSIPEKISASSDGLEHQVEDDTEIAGGHXHSDQQAYGDDTDVCT

SEQ ID NO: 49753 - protein, 85 aa, Sorghum bicolor
  Clone ID: LIB3478-012-P1-K1-F4.pep
TLDKFSNSLVYDDCSTHPSFSESYYSSVDPSISFDTQDLGAALKGFIATISKPKAAYRGWRTLSYVLGWIFYTKRIVAKRKKHGK

SEQ ID NO: 49754 - protein, 71 aa, Sorghum bicolor
  Clone ID: LIB3478-012-P1-K1-H11.pep
VKMFDVAVDVLQVQICKMDLFLKENDWIFGFGTPHHSLAFFLAESISQHLFNSLIFLQGIGARDQLIPFLK

SEQ ID NO: 49755 - protein, 45 aa, Sorghum bicolor
  Clone ID: LIB3478-012-P1-K1-H5.pep
IKYWCHRFGQLKLSTAIVNVGGAKILLKLVCEHSLSRGTMGAVTS

SEQ ID NO: 49756 - protein, 145 aa, Sorghum bicolor
  unsure (1)..(145): unsure at all Xaa locations
  Clone ID: LIB3478-012-P1-K1-H8.pep
MVAVIMSASHNPGGPDNDWCIKFNYSSGQPASETITDQIYGNTLSISEIKTAGIPDTDLSSVGVVSYGDLTIEVIDSVSDYLELMENVFDLQLIXDLLFPPDFRFIFNAMHAVTGAYARPIFVEKLGADPDCILXNGVPSGDFGN

SEQ ID NO: 49757 - protein, 74 aa, Sorghum bicolor
  unsure (1)..(74): unsure at all Xaa locations
  Clone ID: LIB3478-012-P1-K1-H9.pep
MATKDPAATGGEPAIGIPYHPAPGAQGHYYYAPXPNPYAAGMPPPNAIYAGAPKGVPLQQTMFRDTPAPFHCQA

SEQ ID NO: 49758 - protein, 152 aa, Sorghum bicolor
  unsure (1)..(152): unsure at all Xaa locations
  Clone ID: LIB3478-013-P1-K1-B4.pep
MDSSATGFRGRIEWAAPALKDLLPDLSRDEQLRLENGGQADGRRHKHKGRQRIIKQDEQLMSMALRTEGERDALLIRRVQHALCHYNARHKGGEFDAVKPLMEARVGFRDQVWXHLNFWARSRSTNKIKRFFAXVHYKPSSDTKYPRATTPI

SEQ ID NO: 49759 - protein, 104 aa, Sorghum bicolor
  Clone ID: LIB3478-013-P1-K1-B9.pep
MDFQVKNLLSVSADDEVPIKSVTIRKIPRVLEDMPLYDILNEFQKGHSHMAVVIRKNNSSYPPAEQAANDGGTFEVSVAIDDKNSEKVVKNLPSPLLRWKSYPN

SEQ ID NO: 49760 - protein, 185 aa, Sorghum bicolor
  unsure (1)..(185): unsure at all Xaa locations
  Clone ID: LIB3478-013-P1-K1-C5.pep
RLRSAATALPRRRAGGAAAPFPRIAHYGLLPPRHRRRRRGSVRAVPPEQSSLPAAAAVYGSAGDVKAALYGALEGANRGIFGMTSAKRSEIHALVELLESSNPTPEPTAKLQDKVDGCWKLIYSTISILGKKRTKLGLRDFISLGDFLQIXDVKEEKGVNVIEXSARAMKILSXKXTIEASYSVL

SEQ ID NO: 49761 - protein, 64 aa, Sorghum bicolor
  Clone ID: LIB3478-013-P1-K1-E12.pep
SLTARASSVWSQPASTARTERGSSSKIDTTTVRHQITMTLATIPCAPITCTSNARMKTTMYLFL

SEQ ID NO: 49762 - protein, 173 aa, Sorghum bicolor
  Clone ID: LIB3478-013-P1-K1-G11.pep
LSASYLFLILNLICILPLLLVLQIWVQPECPKLLSPVLQNLQFLNLEELPEGCDIAWTRFFLEAAPNLKEVCITVWDHWCDMETDKVEREEQGYCDKRNVEWESSAPDGFRHYNLTKLTIYGFQPNENFMGYTRHVMEAAVNLEEISLYDRKVLQCCEDLDPKIEGAPSRYPQ

SEQ ID NO: 49763 - protein, 90 aa, Sorghum bicolor
  Clone ID: LIB3478-013-P1-K1-G9.pep
EHLAYNLLQESRAVLAKNSCVLLWRTNGKKPPTRRQNHCDLPHRAAAIDVKCTLIGQVLWDMWLLSKVHGDMMKRVCIQFQLFGSTVWTP

SEQ ID NO: 49764 - protein, 118 aa, Sorghum bicolor
  Clone ID: LIB3478-013-P1-K1-H10.pep
MAFAGCAASFCTAASLKRPPRIQGHANQVCAARRRRADIQSDTYVLMEPGMDEEFVSREELEERLKRWLENWPGDALPPDLARFDTVDAAVSYLVRSVCVLEIDGEVGSVEWYQVELE

SEQ ID NO: 49765 - protein, 47 aa, Sorghum bicolor
  Clone ID: LIB3478-013-P1-K1-H7.pep
GIYQFFILEELKCLFLRPNQLQNALLKCHIMTILYDNLLSRKLSAYK

SEQ ID NO: 49766 - protein, 51 aa, Sorghum bicolor
  Clone ID: LIB3478-014-P1-K1-A12.pep
WKGWANSLYISALPLTWTSDGHQASPPQMWNKSEQQSFYGNQDLTVRKKTT

SEQ ID NO: 49767 - protein, 60 aa, Sorghum bicolor
  Clone ID: LIB3478-014-P1-K1-B5.pep
GQQTQITENFCLPPASRLLPTKRLSYSVPLVSRQWCVAGTWQSQQQHMQMKFIIVWISTR

SEQ ID NO: 49768 - protein, 77 aa, Sorghum bicolor
  Clone ID: LIB3478-014-P1-K1-B7.pep
NRHTDDAHHHTYGMDMKHEVKIAKYGARILAHQTRALHPSIDYDNAYGANRKKTGLNKTKSLHIGQNHSLRVPTCPR

SEQ ID NO: 49769 - protein, 45 aa, Sorghum bicolor
  Clone ID: LIB3478-014-P1-K1-C11.pep
KWTHRPSGPRYRPTQPCTRRGRPHPWRRLSPSCIRPSVLACKATE

SEQ ID NO: 49770 - protein, 53 aa, Sorghum bicolor
  Clone ID: LIB3478-014-P1-K1-D12.pep
RLKSLRLLPRFRLQHPNEHRKSEFCFVLSSLLDQANCIACISKNRISTVRAVK

SEQ ID NO: 49771 - protein, 134 aa, Sorghum bicolor
  Clone ID: LIB3478-014-P1-K1-D3.pep
RLVSSSTSRPNPPAPPPPYPPSPWPQPPPPIIIATPSSTSPDLRTSASLSPLSSLAEPRASGWVPPVSARGRGQAQYLHRHRFLKPWKRRRRRRSVGCRMRRRASVTRRRMSKSGRAATARRAGRTWARTPART

SEQ ID NO: 49772 - protein, 160 aa, Sorghum bicolor
  unsure (1)..(160): unsure at all Xaa locations
  Clone ID: LIB3478-014-P1-K1-D4.pep
PTRPKGPCVVLGYTGGGFRFGXFSPEGYRSTDDYYDTLDAFLFYWPDELAAPAEAATETSPLPPPVVLPKVGGSGAALFDYSRGGPHVGADGLLIGPPLTAVMGVFTGPDSSAGVGDLRSARSRLGLSYARRPDGKESLFGDEGRAQVAEVLVFCNPRIA

SEQ ID NO: 49773 - protein, 157 aa, Sorghum bicolor
  Clone ID: LIB3478-014-P1-K1-D9.pep
AVRCRLDDVDYLEYPLQIPKDDLLPHPLPRPSHDEESKLILLVQVTAFACGGFVVGFRFSHAVADGLGAAKFMAAVGELARGAEQVSVPPVWARDAIPDPPGALVGSLPDPTGAKRLEYLAIDISADYIDHFKSQFAAATGGGRCSSLRVLRHERAP

SEQ ID NO: 49774 - protein, 71 aa, Sorghum bicolor
  Clone ID: LIB3478-014-P1-K1-E11.pep
FIAMLGVNELLRCDMNVSSSQSLQLCGTLESKLAFVYAVTWFTKKICVGIKHLSYDHIVDVFSFGIVLWSC

SEQ ID NO: 49775 - protein, 91 aa, Sorghum bicolor
  Clone ID: LIB3478-014-P1-K1-E4.pep
ELSCVLARVIFTTRRELVDRQIAIARKKEKKENCVWQGLVELWLSCCQKDSDTDRVKEKGKPCIWAGNLFQFICASQSKFCYVIILPFSVL

SEQ ID NO: 49776 - protein, 127 aa, Sorghum bicolor
  Clone ID: LIB3478-014-P1-K1-E7.pep
PHILSSFCRMNLSNNSYRVIKCPTVSQMAGVGVLSLGKSERGVYSGVPWNDGWPRFQVWFLNESSEQMEWILKSNISLQAVLQNFPLLSNHNIIYGSWAVTSNKSINEHVERAGAQEEFEWDSDDVF

SEQ ID NO: 49777 - protein, 105 aa, Sorghum bicolor
  Clone ID: LIB3478-014-P1-K1-F10.pep
TRPDMIFICCVVSGSVQPFGQVPAFQDGDLHLWGTYATHMILYLLVSLCKYDSIVVFTPAIIYIYIYMHHKNGMFFLPESRAICKYVARKNKAAELLREGNLQES

SEQ ID NO: 49778 - protein, 44 aa, Sorghum bicolor
  Clone ID: LIB3478-014-P1-K1-F3.pep
VLIASAALSTLPIRVSHDHTSRTLGRKYSPPIIIWTAMITIEST

SEQ ID NO: 49779 - protein, 119 aa, Sorghum bicolor
  Clone ID: LIB3478-014-P1-K1-G3.pep
MCPGSVEAAGAAVKSVCVMDAAGPLGHALVDRLLRRGYTVHAATYAVCGDGGDDEEEEEATTAALLSHLSSSCGVDAYRQRLELFRADPFDYHAIADAVRGCAGVLCMFNTPDDHAQCD

SEQ ID NO: 49780 - protein, 101 aa, Sorghum bicolor
  unsure (1)..(101): unsure at all Xaa locations
  Clone ID: LIB3478-014-P1-K1-H1.pep
MEGKEEDARLGAIMFXQRQAIGTVEHGAVDDXDYREPPPAPLVEPGVLKLCSLYHAGIGELVATLLYVYITMLNRMGVCKCNIKCATVLMQSISWCFGRMI

SEQ ID NO: 49781 - protein, 125 aa, Sorghum bicolor
  unsure (1)..(125): unsure at all Xaa locations
  Clone ID: LIB3478-014-P1-K1-H2.pep
THMHTDADHAEAHAKDGAMNAASYDARIDAAMVNDDMNTDNINMDINTGCNANCTTNCVDAIDDDIHDIEGMMATVHTTTDAMTTSDRTVDRDXSNDWTGSLNIIFNITGSSNAAGKAVADVNAE

SEQ ID NO: 49782 - protein, 58 aa, Sorghum bicolor
  Clone ID: LIB3478-014-P1-K1-H3.pep
SHKSVHYRKYFRTETFPVSSIIEMISYKLWISQNKVIIQLSAENISEPKQKLLVVLDR

SEQ ID NO: 49783 - protein, 57 aa, Sorghum bicolor
  Clone ID: LIB3478-015-P1-K1-B2.pep
LKWGSPNRKGRPCRFGLPSRLGKPRLQLKGLFRLWRPPRLRQSQRGRRSYRGRPSLL

SEQ ID NO: 49784 - protein, 88 aa, Sorghum bicolor
  unsure (1)..(88): unsure at all Xaa locations
  Clone ID: LIB3478-015-P1-K1-C1.pep
GRLSGSIARVGVGGGGGLEXGGEPHRDGQWPWPLPAWAGSRWGAREFLLSSAADELLTAGTGASRGGRGRDLRFAPVVKFWEQSETQT

SEQ ID NO: 49785 - protein, 114 aa, Sorghum bicolor
  Clone ID: LIB3478-015-P1-K1-C2.pep
ALNARGAGVPRRDQQRGRGQELRAQRQQPSPARRIRRRGGGVASRSRASGRRRRGGRGGGGGRGAAGRDGERSAAGPREQRRRGFWLDATRDDREEMGGAMAAGWWRGFGPTRP

SEQ ID NO: 49786 - protein, 111 aa, Sorghum bicolor
  unsure (1)..(111): unsure at all Xaa locations
  Clone ID: LIB3478-015-P1-K1-C4.pep
HASGALYWTIPGEIYPVEVRSAGQGAAVALNLGLNFLQAQFFLAMLCCFKYGTFLFYASWLVVMTAFAVAFVPETKGVPLESMAHVFARHWYWXRFVKDHQKFAKSHLVKI

SEQ ID NO: 49787 - protein, 130 aa, Sorghum bicolor
  Clone ID: LIB3478-015-P1-K1-C7.pep
KNVRFSRRRLSPPELDRPPSPPAKKMHLWPSLRIRDSFKHGYLQKLELNLGHMKRAQRQRQGRQGEGQEDQDGEPGGSGKAPLLEDRSPSRSVLAGALELAWDAVLLLTCCCCCFCCGACSDEEDHPTAR

SEQ ID NO: 49788 - protein, 158 aa, Sorghum bicolor
  Clone ID: LIB3478-015-P1-K1-E12.pep
RFKGEQTPPAHIGASRDYNVDMVPKFMMANGALVRVLIHTGVTKYMSFKAVDGSYVFNKGKIHKVPSNDMEALKSPLMGLFEKRRAGKFFLYVQDYKEDDRSTHKGYDLTKLTTKELISKYGLDDNTIDFIGHAVALHKDDSYLTEPAIDTCKADEAL

SEQ ID NO: 49789 - protein, 79 aa, Sorghum bicolor
  Clone ID: LIB3478-015-P1-K1-F11.pep
TKPHQRQLQLHRSIVIQQLPLRNGHWRRGWHYPPAPAPYHLHVSNSASYSQLPFPIHSKPPNVALLLRSNLPFYLNPPA

SEQ ID NO: 49790 - protein, 117 aa, Sorghum bicolor
  Clone ID: LIB3478-015-P1-K1-H4.pep
HKVSKVLDHSEFEQVNRAIFDKCEKIINQCLVDAKLVPEDINDVILVGGCSKIPRIRSLVLGLCKKEISYKNIDALEAAVSGAALEGAIASGVNDPSGSLDLLTIQATSMNLGIRAN

SEQ ID NO: 49791 - protein, 85 aa, Sorghum bicolor
  Clone ID: LIB3478-016-P1-K1-A5.pep
TLTAIWMFHCQMTSCSMAACSCCRLYTSMIGQQRRTPCYWMRSDTYATAPTTQRACYRFRASWASRRHSWWLMLHARSESAVYAQ

SEQ ID NO: 49792 - protein, 71 aa, Sorghum bicolor
  Clone ID: LIB3478-016-P1-K1-A6.pep
RAARLNIIHSSSGAAKAVGMVRPAVIGMLTAMHCRLPTEDVSVADLTVRIAYAASYVDIMTALLAACEGPL

SEQ ID NO: 49793 - protein, 133 aa, Sorghum bicolor
  unsure (1)..(133): unsure at all Xaa locations
  Clone ID: LIB3478-016-P1-K1-A9.pep
PRVRREAHVFSTHDGYSLDVFVADGWPIEDTDGLHIALEASILRNEGSWSGSSHSSAAERTLPFQVKGGEWEIDKRLLKMGGMIASGSXGDLYHGTYLGEDVAVKVLRAEHLNKNVWNEFTQDVYILRRGHHT

SEQ ID NO: 49794 - protein, 124 aa, Sorghum bicolor
  Clone ID: LIB3478-016-P1-K1-B4.pep
MSDGIGIANLPNQRHKIISQRGAHLTIMVVGPSGSGKTTFINTLFASEICTPRNYRNRSIKQMDKTTEIEILKAELEEKQFSIKLTVIDTPGFGDYVNNRDSWTPIIDFIDDQHESYMRQEQQP

SEQ ID NO: 49795 - protein, 55 aa, Sorghum bicolor
  Clone ID: LIB3478-016-P1-K1-B5.pep
PLIKARLLAAAGLPGDSSIQLIIFASHIEKQKGSDILIAFIPKLSGKNAQIVILG

SEQ ID NO: 49796 - protein, 56 aa, Sorghum bicolor
  Clone ID: LIB3478-016-P1-K1-B7.pep
SDLIGHQFTPRVSSCVKLTVDTECLTAPRSVKRNTLIIILCAAPRRSTEAHAFNIF

SEQ ID NO: 49797 - protein, 144 aa, Sorghum bicolor
  unsure (1)..(144): unsure at all Xaa locations
  Clone ID: LIB3478-016-P1-K1-B9.pep
PTTTSSPSPPPPTASSPVREPTPPPPRRRLLPPSPLPXGPEPFAPPPTTRCAPPPPPPPPLPPPARQQAPPPPKXNPSPRRRSSTPGSSWPASSTPPRRPSPPRPPPAXPPAPSPDPSPRHRRQLLRFQGKPLFVLPVRGCALH

SEQ ID NO: 49798 - protein, 127 aa, Sorghum bicolor
  Clone ID: LIB3478-016-P1-K1-C2.pep
FGSDCPSNKCHLTGECIIDTPQKLKAKLEMAEALGEIETATKLLEDDSSDQDDPLYARYKQLHCDLAPLEADSDEYSMIKTYLRNTHGKTHSGYTADIAQIFNVSRHGETERFQKFASTRNRMLLRH

SEQ ID NO: 49799 - protein, 123 aa, Sorghum bicolor
  unsure (1)..(123): unsure at all Xaa locations
  Clone ID: LIB3478-016-P1-K1-C5.pep
LSIHFVTDMHGEEGGSAIIAMADTNRTDIXSAAVLRPERYDRQAYGDVPDVQSRTEILKMHGISTKDESEDHLDVLAMRTPGFSGADLADLLDEASILPGRPGRSALYXEENDDSIDRIVTTY

SEQ ID NO: 49800 - protein, 57 aa, Sorghum bicolor
  Clone ID: LIB3478-016-P1-K1-C6.pep
LLLSAPYHVSSTLLMSVSSDASDAVLGYWSGFSCVWTRSCQSSRCTFWSRTSNTRLS

SEQ ID NO: 49801 - protein, 64 aa, Sorghum bicolor
  Clone ID: LIB3478-016-P1-K1-D10.pep
TNGSQHEASRDNYIVRSYICLPCECFRTTSDCYKVNIRSHTILLLDTYLPTTSNATTEPSKLAT

SEQ ID NO: 49802 - protein, 50 aa, Sorghum bicolor
  Clone ID: LIB3478-016-P1-K1-D6.pep
SASGRPFALWFLMNASHVKITMIIKSHMPNYALIYMFTSIGSIYAVPRVL

SEQ ID NO: 49803 - protein, 138 aa, Sorghum bicolor
  unsure (1)..(138): unsure at all Xaa locations
  Clone ID: LIB3478-016-P1-K1-E10.pep
MGSQTMASQAGGGGGGVGGSGGAGAAQRGQMQSLARQGSLYNLTLDEVQSHLGEPLHSMNLEELLKSVFPDGLDPDGGTTSQYEQSSGLYRQGSITMPPELSKRTVDEVWKGIQDAPKRNVGXGGRRMRERQPTLVEM

SEQ ID NO: 49804 - protein, 57 aa, Sorghum bicolor
  unsure (1)..(57): unsure at all Xaa locations
  Clone ID: LIB3478-016-P1-K1-F6.pep
TNAAGTTADRRADXNCLKNDVSGIRGVNAADAVSVPYKCGVGVTYTMSSCTDCSRES

SEQ ID NO: 49805 - protein, 152 aa, Sorghum bicolor
  Clone ID: LIB3478-016-P1-K1-G10.pep
IATASVPRSQSALFQTDCTRDPDGSGDAEILGSRCTSDDGLCSLIDEKLDYLSGGEMHRSKPSLDVHCAPSSPNVYRASNIDDRGSVCCSDTAAEGQRATESTDETFVRDGILVCHEYCGGKYICGDHSLDPVGTFCAHSGDVYHHTVIAVS

SEQ ID NO: 49806 - protein, 51 aa, Sorghum bicolor
  Clone ID: LIB3478-016-P1-K1-G2.pep
LQDEVASEHLEQESNHLPVAVPAEYPGAPCERNSPDARDDELSIERATRQY

SEQ ID NO: 49807 - protein, 118 aa, Sorghum bicolor
  unsure (1)..(118): unsure at all Xaa locations
  Clone ID: LIB3478-016-P1-K1-G5.pep
PRVRECLMTAQTXSINKGLQHRRYKNRELGIMRSMDHWIVVSLMHCLLYTSSRDERVLNLVMERVPESLYRAMKHHSNVHHRMPLINVTXYTYQISRGXAYIHTRPGVGHTGRPPREL

SEQ ID NO: 49808 - protein, 116 aa, Sorghum bicolor
  Clone ID: LIB3478-016-P1-K1-G6.pep
MLTSTAVDLIRALAEEYPNDLNDRVMSDAEKSEVAEKTDLYDKLCKVFDKYIKLVIIEDTANRIGLAKLVRYERSKDDGDLAYVDEYISRVKPGQIASSTSREASKNTLEKSPFLE

SEQ ID NO: 49809 - protein, 113 aa, Sorghum bicolor
  unsure (1)..(113): unsure at all Xaa locations
  Clone ID: LIB3478-016-P1-K1-G7.pep
PEEKSVPMETDAKVEPSKRIVKKTSSPVHDLVYGALAAVDLLKAVEKEYEMALQDRVMADTKEMKDAEXAYVYDMRYKLYDKYSDLVTPEEKDRLIAHLQDVKDWTYEDGEDL

SEQ ID NO: 49810 - protein, 108 aa, Sorghum bicolor
  Clone ID: LIB3478-016-P1-K1-H10.pep
SEDNEENGQPMDEDYEEHVPDYSVGYSSRSRHHGTMSMMDHETDEEDDDAEGDENVEEDDADQAVDDADVEMDEDDEIGDDGEDGNLGGEMNADEDPDATSYSSDYSE

SEQ ID NO: 49811 - protein, 97 aa, Sorghum bicolor
  Clone ID: LIB3478-016-P1-K1-H7.pep
GVHGCMYALRQSEHKAEGALLSACYSHHSDRLSSIMHASIDQDSLFRQQSLHVWHRSPSNHDCVSLVNVEGHGLASHSLSSGYASPPIDSKNRSQSV

SEQ ID NO: 49812 - protein, 79 aa, Sorghum bicolor
  Clone ID: LIB3478-016-P1-K1-H9.pep
VISSEARNTRNISPVMLLQKKKHFTSKTTATKLLVTKMRAKKRLLQSMTSSRQKFHWIREKQCTYIKASRSMPGGSRYN

SEQ ID NO: 49813 - protein, 113 aa, Sorghum bicolor
  Clone ID: LIB3478-017-P1-K1-A2.pep
PGAAALHIEYTADDAEAWHALWKAAITVRADTNPEDVDGMHALSVILTYRGGMTYDAAVVSRRWGKYCVSKCSDIPVNDADKTAAIGDHVLSEGKTLSLNGSTAEPILVKHAF

SEQ ID NO: 49814 - protein, 55 aa, Sorghum bicolor
  unsure (1)..(55): unsure at all Xaa locations
  Clone ID: LIB3478-017-P1-K1-A6.pep
GRVGASPTCLAKILRIYQDTIKHVKRGKEPNMHXLETETLPFGRNITRLYDLKGS

SEQ ID NO: 49815 - protein, 39 aa, Sorghum bicolor
  Clone ID: LIB3478-017-P1-K1-B4.pep
SQLFSFIYLTLPCMIIRFECRVLSGLIITPIGKSYTIGS

SEQ ID NO: 49816 - protein, 112 aa, Sorghum bicolor
  unsure (1)..(112): unsure at all Xaa locations
  Clone ID: LIB3478-017-P1-K1-B5.pep
VCWAAQQEVPTDAALSLAFCRHGRHKCAACNIRDERGATVSKRTAWPGERLVSQWPSTPTRRASSRLRLDRALRLMLSXRRHTRXSPRVRQVALTSVKLPTPETRAASYHVF

SEQ ID NO: 49817 - protein, 149 aa, Sorghum bicolor
  unsure (1)..(149): unsure at all Xaa locations
  Clone ID: LIB3478-017-P1-K1-B7.pep
ASLLCRSARYPLCLRRSLRRTAAPAEMSAPSAEPPPPRTVICVGDVHGYFTKLESLWSNLEAVLPADAFVTALVIFLGDYNDRGPDTRRVLXLLLALPTRHPAQSHVFLCGNHDLAFAAFVGALTSPPDSFTFLATWDECIYYEEHEGV

SEQ ID NO: 49818 - protein, 136 aa, Sorghum bicolor
  Clone ID: LIB3478-017-P1-K1-C1.pep
KDAQSESPENYGFAAIDEDPKFSLSKRYNTLYRNLYKIAAKASESVEAYAFLESQYEQLVEQVEVLLQAKLHDKSSLSTVLKGNQPNLLNSEVSSSEHRRATGKKIKNIEVRRQQQSPLDPNKKKKGRQGLLEPEE

SEQ ID NO: 49819 - protein, 141 aa, Sorghum bicolor
  Clone ID: LIB3478-017-P1-K1-D11.pep
SCTPIYKYEYTCTVWLLLLEPSMDAGTTLLEYSICFLFRFNDVLAPFTISSLFRTSNYLVRYLMAATGFVLYCTVQSVPQSAVVRYCGRCHACAHQISVRCRVAQRKSGLAPRTYCSHASQVCGLSLPKFTTEKPLINSCP

SEQ ID NO: 49820 - protein, 114 aa, Sorghum bicolor
  unsure (1)..(114): unsure at all Xaa locations
  Clone ID: LIB3478-017-P1-K1-D4.pep
EPSPTATYLAWPASTPACRRPRGARTSKGTTTTTTTRAASSGMSRHHRQYKYIRSHSSLARHILNELQHVRMQGPCSIILVSRIIDRIQFTXLLGTYSDTRCSFXGYGHFNSYI

SEQ ID NO: 49821 - protein, 74 aa, Sorghum bicolor
  Clone ID: LIB3478-017-P1-K1-D9.pep
GNRLTALSDSISKCRSLVELDVSYNGRTDLPTNIGYELVNLPKLWIHMNKWRSLPSSVCEMTSLYLLDAHSNEL

SEQ ID NO: 49822 - protein, 140 aa, Sorghum bicolor
  Clone ID: LIB3478-017-P1-K1-E10.pep
VVLNFLGNFCYLFLSSTLLGVFSGLLSAYIIKKLYIGRHSTDREVALMMLMAYLSYMLAELLDLSGILTVFFCGIVMSHYTWHNVTESSRVTTKHAFATLSFIAETFLFLYVGMDALDIEKWEFASDIPGKSNGIRLDFV

SEQ ID NO: 49823 - protein, 77 aa, Sorghum bicolor
  unsure (1)..(77): unsure at all Xaa locations
  Clone ID: LIB3478-017-P1-K1-E11.pep
YIRSHTTNSRLALIMLMAYLSYMFTELLDLSGILTIFFCGIVITHYTWHNVTYNSILTTKHALCXLMSFIAETYLFL

SEQ ID NO: 49824 - protein, 121 aa, Sorghum bicolor
  Clone ID: LIB3478-017-P1-K1-E3.pep
GNEHENCNDNDSERSSITSNSCAGDDDRDEILPDESSSCNCEGKTVSEATTSETNVDPVGSSERATVSNERKPFINKLQWFLRFGRPSTEGNAEKGIAQASNDKHDAVIPCPSPADVSSDN

SEQ ID NO: 49825 - protein, 81 aa, Sorghum bicolor
  Clone ID: LIB3478-017-P1-K1-F3.pep
VLKWFQKIKNVIHRNAYFTSNFQVLGLDICADTIVGNNMLRGISGGQKKRVTKMLVTPGRALFMDEISTGLDSSTTFQIVN

SEQ ID NO: 49826 - protein, 110 aa, Sorghum bicolor
  unsure (1)..(110): unsure at all Xaa locations
  Clone ID: LIB3478-017-P1-K1-F5.pep
GIGVVIYQKPASNSCYAERKTNEPPLCXERDGSRFPWYAPLDSCLFXTTITSTDERYSWPVSWPERLXCRYASVPDDSASNEKLKLIKVLEQLVQKYISDSTNCQHRMND

SEQ ID NO: 49827 - protein, 65 aa, Sorghum bicolor
  unsure (1)..(65): unsure at all Xaa locations
  Clone ID: LIB3478-017-P1-K1-F7.pep
RERSFTELCLVGVGALGACQPSCPSLCLQTIIQQLLLPXYGKAKICGLLSRARLDVKGLPDSHRL

SEQ ID NO: 49828 - protein, 74 aa, Sorghum bicolor
  Clone ID: LIB3478-017-P1-K1-G5.pep
VKTVMDLALCKMVNTGETRLLSAGIDGYVKSFDFGKLKMTHSLRSPQPLLSVASSPCGSVVVAGVCEREDYMEI

SEQ ID NO: 49829 - protein, 132 aa, Sorghum bicolor
  Clone ID: LIB3478-017-P1-K1-H11.pep
ALLSRGGGGPLGSHGRPSGGGSHPGGACPRTRRPPKAGETTTQPWRWRLLQTRRGRKIHFYSRYYLLLPGSRTASLLTAVPPSTTVSTTHRTLRPLTPTAAGTAASPLPTPDTADLDHSDGDLGLLMDYDVW

SEQ ID NO: 49830 - protein, 60 aa, Sorghum bicolor
  Clone ID: LIB3478-017-P1-K1-H2.pep
RNALVSPRTDCPEKLPDVTKSLLPSGPKEDSSLSEFQVELIQLASQLNGDHVLNTYPDIG

SEQ ID NO: 49831 - protein, 113 aa, Sorghum bicolor
  Clone ID: LIB3478-018-P1-K1-B10.pep
IFSSVCVMKAHQNCTNAFNARRALEKQPVMDLKLSLTVGPSESVVTDVDLNMATQDNTVLLQSCNVASVPSVDEGSTSARRKSGGKLLTYLVPVGCNEFHSPIPLHPAIQLPK

SEQ ID NO: 49832 - protein, 131 aa, Sorghum bicolor
  unsure (1)..(131): unsure at all Xaa locations
  Clone ID: LIB3478-018-P1-K1-B11.pep
EKVMTANPDCATLEXTILDALHIMHDGKFLHIPVIDKDGQIAACLDVLQLTHATIQLVEGGNGTVNDVANSVMQRFWDSALALEPPDEEFDSRSEVSLLLQSEAGDGKSSVYPPVIGNIFSFKLHDRKSRV

SEQ ID NO: 49833 - protein, 78 aa, Sorghum bicolor
  Clone ID: LIB3478-018-P1-K1-B7.pep
APRRPGTATPSCGRDRAGQRAARAHRLSGSYIPSLPPPPPLAGSRRPGGRPLEADASLLAARRGVTGAARQRRLLEIL

SEQ ID NO: 49834 - protein, 57 aa, Sorghum bicolor
  Clone ID: LIB3478-018-P1-K1-C10.pep
GRVGAQWTAAGRPWSAQGARVRPVRCLVLAVAHEVPAALNRSKVCLLHSHPVAVPEP

SEQ ID NO: 49835 - protein, 48 aa, Sorghum bicolor
  Clone ID: LIB3478-018-P1-K1-C7.pep
AYKYYIYYILYIIIMSKGNLLTNYTPFSSWFAFDFTSFGITPSSSICY

SEQ ID NO: 49836 - protein, 130 aa, Sorghum bicolor
  Clone ID: LIB3478-018-P1-K1-D9.pep
PRVRSTWAAPVIGQMISSAVHAMGSFAVHTPTSTLKIANLATGECLHLKKPTKSLKDDHFSFYRFGFHPVTKEYKVIHFCQEIGPFTEDRFNVIQVYTLGDEKRKDIVTSEALSCDWVKKSGVVMVDGTM

SEQ ID NO: 49837 - protein, 107 aa, Sorghum bicolor
  Clone ID: LIB3478-018-P1-K1-E1.pep
LPPKNPSLASLVGRSQSVALAPARAEAEQAGGFQRRRRRYSTTLTPRRGGKNHQELGGLQLLLPGDDALRRPRKTGGASERFRSPAPRGFRGWWQAAPASSSGADRE

SEQ ID NO: 49838 - protein, 82 aa, Sorghum bicolor
  Clone ID: LIB3478-018-P1-K1-E12.pep
LVVVHKYLHHIIKRQVCYCYALLCIQLKTSINNDVREGSTSTGIEQWRVTKWSAISTHGSAIVHHIIYLSSVIAYELFCYML

SEQ ID NO: 49839 - protein, 134 aa, Sorghum bicolor
  unsure (1)..(134): unsure at all Xaa locations
  Clone ID: LIB3478-018-P1-K1-G10.pep
ARAIDHHGRWSPESLLVPPLVLLLVAAAGVLLLPQRGSAEEEWKVSLELYYESLCPYCSRFIVNHLAGIFEGGLIDAVHLRIIPYGNAWVWSNSEIXSSXHGTYQCLHNTGEVCANYTXXXXSGHCSFIYCVRD

SEQ ID NO: 49840 - protein, 60 aa, Sorghum bicolor
  Clone ID: LIB3478-018-P1-K1-G11.pep
TSNSSPCRLLTPVHPACAVGRAHARRAAPACSSCRSTAPWRRTVRRHSSTTMTLCNPTAP

SEQ ID NO: 49841 - protein, 42 aa, Sorghum bicolor
  unsure (1)..(42): unsure at all Xaa locations
  Clone ID: LIB3478-018-P1-K1-G12.pep
ARANHHHGRWYSESPVLVPSLVIMLGGGADMLLLPQHXSLKE

SEQ ID NO: 49842 - protein, 97 aa, Sorghum bicolor
  unsure (1)..(97): unsure at all Xaa locations
  Clone ID: LIB3478-018-P1-K1-G4.pep
EEQVIEGLDITVVNMXKGEVALVRVPPEHAFGSVETKQDLAIVPPNSTVFYEVELVSFEKERESWDLKTNTEKIEAAAKKKDEGNVWFKIGKYAKAS

SEQ ID NO: 49843 - protein, 136 aa, Sorghum bicolor
  Clone ID: LIB3478-018-P1-K1-G8.pep
GSLKHQPLLILCLLKLPLVTTLTQETSASIFGNPIKKQILLFAIASESSKFLPIFKEAAKPFKGKLLFVFVERDNEEVGEPVAVYFGITGQETTVLAYTGNEYAKKFFLDGEVSLVGIEDFAEGFLEDKLTPFYKS

SEQ ID NO: 49844 - protein, 163 aa, Sorghum bicolor
  unsure (1)..(163): unsure at all Xaa locations
  Clone ID: LIB3478-018-P1-K1-H3.pep
IIVAIRGTQENSVQNXKDLIWKQLDLSYPGMPNAKVHSGFFSSYNNTILRLAITSAVNKARKSYGDINVIVTGHSMGGAMASFCALDLAMKLXSDSVQLMTFGQPRVGNAAFASCFGKYVPNTIRVTHGHDIVPHLPPYFFFLXHLTYHHFPREVWSRILMAT

SEQ ID NO: 49845 - protein, 92 aa, Sorghum bicolor
  unsure (1)..(92): unsure at all Xaa locations
  Clone ID: LIB3478-019-P1-K1-A2.pep
MTDAKPFDASSITXLQLMFRALVYQGSTDPNIXEGAWELPFSSIRAYINEPITPRIVHVSSAGVTRPERPGLDLSEQPPAVRLNKELGSILT

SEQ ID NO: 49846 - protein, 140 aa, Sorghum bicolor
  Clone ID: LIB3478-019-P1-K1-C9.pep
VLGKLSNSNVMVPLAYVLTEDNAYLLYEHVHKGTVFDFLHGAKSDILDWPSRYSIALGVAQGLTFLHGCTQPVLLLDLSTRTIHLKTVNEPQIGDIELYKIIDPSKSTGSLSTIAGTVGYIPPEYAYTYRLTMAGNVYSF

SEQ ID NO: 49847 - protein, 43 aa, Sorghum bicolor
  Clone ID: LIB3478-019-P1-K1-D9.pep
VNCYCFASLSLSQPPLTLLPMSQRLLFGRKKIHNKKVPWMQGK

SEQ ID NO: 49848 - protein, 106 aa, Sorghum bicolor
  Clone ID: LIB3478-019-P1-K1-E2.pep
SAFPFPLHLRSARGNLTTPRHIACERAPNRRRPSHPQLSRPRGAIRCVLHRCPAAGGKGGGGAQARGDARGEAAVAGLRRGRGGGGAHSQSPAVGGAAAGLGPALV

SEQ ID NO: 49849 - protein, 65 aa, Sorghum bicolor
  Clone ID: LIB3478-019-P1-K1-F12.pep
MPVFVNFVSLKRPPLFFFFFFFFFFFFFFFFFFFFFLFFFFFFFFFFFFCKVKLQFFFLVVSYCL

SEQ ID NO: 49850 - protein, 96 aa, Sorghum bicolor
  Clone ID: LIB3478-020-P1-K1-A4.pep
AAATVGSEEEAARVSWMAQGTPGGGQRAARRRATPHAEAAAAPPALGEEQRERWNRRERTTHVPAQGLRCGHGARRQPPREDDGVAEVQRSRPGSG

SEQ ID NO: 49851 - protein, 93 aa, Sorghum bicolor
  Clone ID: LIB3478-020-P1-K1-A6.pep
EKVFAHRIQSNYSKLTYDGVDLMGERLAEEVRQIVQRRRNLRKISFVAHSLGGLVTRYALGKFYEPAMDETSSCDNDKPSDEQNVPGGGKIAG

SEQ ID NO: 49852 - protein, 78 aa, Sorghum bicolor
  Clone ID: LIB3478-020-P1-K1-A7.pep
PFVCTHVPPFEGVRKNFSTSSSSVVGGCCRVSSTTGRAYGPDAASGSSNTLLEERFVLGDALEYAYAILYIECEANQN

SEQ ID NO: 49853 - protein, 84 aa, Sorghum bicolor
  Clone ID: LIB3478-020-P1-K1-B9.pep
FARLADRYGPIFSIRLGSKLGVVVSSPSLAREVLREQDLVFSGRDVPDAARSIFYGGGQNIVWNPVGPTWRLLRRVCVREMLNP

SEQ ID NO: 49854 - protein, 55 aa, Sorghum bicolor
  Clone ID: LIB3478-020-P1-K1-C2.pep
PRVRQDLLLLDVSPLSLGLETAGGVMTVLMPKNTTIPTKKEQVFSTYSDNQPGVL

SEQ ID NO: 49855 - protein, 69 aa, Sorghum bicolor
  unsure (1)..(69): unsure at all Xaa locations
  Clone ID: LIB3478-020-P1-K1-C7.pep
LAEEYPDEYMITGNTYEXKSEVEEKKSQYAKFWNEFGKSIKLSIIVDATNRYRLAKLIRFESSKSDGKL

SEQ ID NO: 49856 - protein, 71 aa, Sorghum bicolor
  unsure (1)..(71): unsure at all Xaa locations
  Clone ID: LIB3478-020-P1-K1-C8.pep
DSWAFPGVAGFRFQTTPRPGESISPGGPAPPPKGWCPLSFYMSCVLEPEHSKEKGCYSIVIGTXXVSPVIV

SEQ ID NO: 49857 - protein, 54 aa, Sorghum bicolor
  Clone ID: LIB3478-020-P1-K1-D2.pep
GRHLVRRSQLNHVGSLVRGNVTYYPVLICGYEVHGIPTSIVFIVTLVGNSNPIL

SEQ ID NO: 49858 - protein, 46 aa, Sorghum bicolor
  Clone ID: LIB3478-020-P1-K1-D7.pep
NRLDFDGMNSDRAKAELGFRKQNGTGGCNRRARALVSFIGCSAGCC

SEQ ID NO: 49859 - protein, 163 aa, Sorghum bicolor
  Clone ID: LIB3478-020-P1-K1-F11.pep
SSGRKLFSRLTHGFDMVVIDEAAQASEVGVLPPLALGAARCVLVGDPQQLPATVISKAAGTLLYSRSLFERFQQAGCPTILLSVQYRMHPQIREFPSKYFYQGRLTDSESVVQLPDEAYYRDALMAPYIFYDMSHGRESHRGGSSSYQNIHEAQFALRLYEHL

SEQ ID NO: 49860 - protein, 81 aa, Sorghum bicolor
  Clone ID: LIB3478-020-P1-K1-F8.pep
PCTIFMRVLMVLCCRGRGSFGAAAPAEVGARAGGTVRRASCRRPWRRMRSAGSPGPHGGREPGVGGGVGWRWRWRPRPRVR

SEQ ID NO: 49861 - protein, 60 aa, Sorghum bicolor
  Clone ID: LIB3478-020-P1-K1-G12.pep
SKSIVMISNRLILRGEQTLNRCILKKQLFFLMPVQIYVAKTNGLTPLHRISHYMFSIKTE

SEQ ID NO: 49862 - protein, 50 aa, Sorghum bicolor
  Clone ID: LIB3478-020-P1-K1-H5.pep
RLIMNGFCSIECSPCVCFCLAPSHLYSSCIGLLLNPLSSPWSDPAPVSRP

SEQ ID NO: 49863 - protein, 111 aa, Sorghum bicolor
  Clone ID: LIB3478-020-P1-K1-H7.pep
LADSTSLLRATTTGRTATYTSSPTLRTCTLLWRPRGWPPRTGSSLALLGPGARASAGSLPSTTTTHLTAADGRVNVPSQRALLVRAGQQTEDGKPADAATASKALGLWDAL

SEQ ID NO: 49864 - protein, 70 aa, Sorghum bicolor
  Clone ID: LIB3478-021-P1-K1-A11.pep
QCQIIQDSVLVLIVVRHGSIIILGLIEIRRTVLPCILERHDVDELRVGLLEQPLVARPDVHDGVWLGASA

SEQ ID NO: 49865 - protein, 122 aa, Sorghum bicolor
  unsure (1)..(122): unsure at all Xaa locations
  Clone ID: LIB3478-021-P1-K1-A6.pep
VEWMPPKGGITEGQMLKFMGANIHLSPTQAKILLEDETTGFAYLNLQEACPPLYSIIGLREHIKKRPPLATSEKVQQFVRARXRESMIAGFYHERYEDPLLMPMRRRTXHAGLVVKGEEGAL

SEQ ID NO: 49866 - protein, 52 aa, Sorghum bicolor
  Clone ID: LIB3478-021-P1-K1-B6.pep
LAQQKQQCKDRLQQPTLTGHSFVPVHCIRELATSELQLQVYLVWLPSYWLDT

SEQ ID NO: 49867 - protein, 75 aa, Sorghum bicolor
  Clone ID: LIB3478-021-P1-K1-C6.pep
LSDVLGAQLDAKGTGENAVRALAEATLKVDINGFRRIGRNFLRSWHKREDYTVDVVRVNDTTCVKDADDFLKDDF

SEQ ID NO: 49868 - protein, 129 aa, Sorghum bicolor
  Clone ID: LIB3478-021-P1-K1-D7.pep
MQGNGGSSRNCVSTIPAASSQLDLPSIFGTFLSLLPSNLQQQVQQQAQASGLGAVILDLARLDPNSQMDALRHWMAVKPQAASPGPWRSAPRRRSAPRRSGPARRRALTSLQVDHFLPFASWTEKGSVE

SEQ ID NO: 49869 - protein, 64 aa, Sorghum bicolor
  unsure (1)..(64): unsure at all Xaa locations
  Clone ID: LIB3478-021-P1-K1-E3.pep
LRYTQQLASTDSDDDAXDDDDMAGLGKNGTGGAGDHGSAYDITGAPQRLESISLVTADIDSILS

SEQ ID NO: 49870 - protein, 119 aa, Sorghum bicolor
  unsure (1)..(119): unsure at all Xaa locations
  Clone ID: LIB3478-021-P1-K1-E6.pep
DAWDXEKLGSKSFAVYSIAETDADNTAWIVKRTYRNFERHHRQLKEIPNYSLHHPPKSSFSSSVDKHLVHHLCILLDIYIYNLLSIANIAEQHEVYDLLSAYXKNYSARKITSVIKTSA

SEQ ID NO: 49871 - protein, 64 aa, Sorghum bicolor
  Clone ID: LIB3478-021-P1-K1-F2.pep
KKANKSENLNSHNIKLKRAQKNDHARLPLLQPGGGGPCSRAGATACCGSGGTCLCARVGGAVHR

SEQ ID NO: 49872 - protein, 57 aa, Sorghum bicolor
  unsure (1)..(57): unsure at all Xaa locations
  Clone ID: LIB3478-021-P1-K1-F6.pep
VVCHPWIHDXGVGSDRPLDPANLSCMKQSSAMNKSKKMALRVIPESLLQEEFVGFKD

SEQ ID NO: 49873 - protein, 130 aa, Sorghum bicolor
  Clone ID: LIB3478-021-P1-K1-G3.pep
RYLLKAKNSGSQKWADMCKLEAMPSQSFIFLQLYELKDDFIQAEIRKPCYQSVCSHSTGWFSKPMIKTLTVQVSIRLLSLLHNEEAKNLSRNAHELIERSKKQEALSRSEWSKEDNDAGEVPATQTGTED

SEQ ID NO: 49874 - protein, 43 aa, Sorghum bicolor
  Clone ID: LIB3478-021-P1-K1-G9.pep
LRLLVIDVGLQLVEHGLSSGGRRPPCPWRVGGGWPVWFSNLKE

SEQ ID NO: 49875 - protein, 59 aa, Sorghum bicolor
  Clone ID: LIB3478-021-P1-K1-H10.pep
RILAQRVHWQGRRHHLFLEQLREHRTASHYTRTRRTMYWTLNYDHTRGPHYFTERDLIQ

SEQ ID NO: 49876 - protein, 75 aa, Sorghum bicolor
  Clone ID: LIB3478-021-P1-K1-H6.pep
HLTTPYKARSGSMRSTIASAVAAAGHGVLPVSSSAVMARSPSRKRSIIRSSISAIIVPSRINKEKNKVGRSRSRT

SEQ ID NO: 49877 - protein, 78 aa, Sorghum bicolor
  Clone ID: LIB3478-022-P1-K1-A10.pep
ELFSQICVGSVALSQLHPPQVSVYSKESQCQFIAGDFNSIGFPFNDQRASCVIVLQTSIAYEQFLAVVHRRVATGNSG

SEQ ID NO: 49878 - protein, 79 aa, Sorghum bicolor
  Clone ID: LIB3478-022-P1-K1-B9.pep
ARASKEPHTLRSSIAMRTRKKGEWGRSVIAPRTVGVGAERTTYAWTETRTRPSETRGRSKTHQQMLWARARTSGSAYAC

SEQ ID NO: 49879 - protein, 92 aa, Sorghum bicolor
  unsure (1)..(92): unsure at all Xaa locations
  Clone ID: LIB3478-022-P1-K1-C3.pep
NKQKXFTAADYNGCGHSFSCKHLCSGLDARSCCLFCYSNRMHSVTLELPFEVTLMRHTAMASGSTVNQKVRLRPYLVVAVLLLLAADDPSAP

SEQ ID NO: 49880 - protein, 57 aa, Sorghum bicolor
  Clone ID: LIB3478-022-P1-K1-D11.pep
MQRLFNHHLNGSGTPVDMALDYFIYDYEFTEPTRVTSLLNTQSTPTNADFVEDNYFF

SEQ ID NO: 49881 - protein, 92 aa, Sorghum bicolor
  unsure (1)..(92): unsure at all Xaa locations
  Clone ID: LIB3478-022-P1-K1-D3.pep
RCKYRRYIYTTFYLKGSARSTSGRNICPGIRAIEDMXSHVIATREEARWHYLGPLVFEGPARSTITSYNCRPLNITGKKWICPSGFVWVSLK

SEQ ID NO: 49882 - protein, 80 aa, Sorghum bicolor
  Clone ID: LIB3478-022-P1-K1-E3.pep
FLLGSVVMIMEDADAPHHLLLLRCFMSQGVVHKQPLLFSGAMIGAAVFLGTLPAPGSSSKEDGRHRAMGAAASSDGRAKY

SEQ ID NO: 49883 - protein, 47 aa, Sorghum bicolor
  Clone ID: LIB3478-022-P1-K1-F10.pep
DAPPGDHVVRPSGTDPCPHPEALGASGWRNKGGCRRKGASSVRDREI

SEQ ID NO: 49884 - protein, 46 aa, Sorghum bicolor
  Clone ID: LIB3478-022-P1-K1-G5.pep
DALGLIFRNLPLQEMLTVVPRVCKSWGRVVARPYCWHGIHIYEWSQ

SEQ ID NO: 49885 - protein, 65 aa, Sorghum bicolor
  Clone ID: LIB3478-022-P1-K1-G9.pep
ISNSFSFVSSFISNFKYFFLNNSGLLLKEQLTVLAYPQITLLLGPKLWFFYCATRVASEQKCKYF

SEQ ID NO: 49886 - protein, 46 aa, Sorghum bicolor
  Clone ID: LIB3478-022-P1-K1-H4.pep
KDQTLAHSTKSLLAMPTIHRFHGPLKLTTMSTKKGNATTFSHPTHN

SEQ ID NO: 49887 - protein, 100 aa, Sorghum bicolor
  Clone ID: LIB3478-022-P1-K1-H9.pep
HHITPRWLNHVGHNLVLDSDILLLHVEERKYATVGLDHWQKASYVPTSSDSMLARFMNCFKQFSKNQIGRATPHIDQLSPTPTKDQLMERYWSHAAQCTS

SEQ ID NO: 49888 - protein, 85 aa, Sorghum bicolor
  Clone ID: LIB3478-023-P1-K1-A1.pep
ITQSVAAPGLVQVCFDCLGNLNHLEGRCSHILMGLALCSGSIRDLVHRLLLHVVVQLLVKRCDRTSSALLHLESHCMNLVVVVCP

SEQ ID NO: 49889 - protein, 68 aa, Sorghum bicolor
  Clone ID: LIB3478-023-P1-K1-A6.pep
RVEVEFLAGMIRQSSGFLLLTGQLDLCLASLQFIYIVGVVSCSGPACAALQSSALILPFIDGLCIETD

SEQ ID NO: 49890 - protein, 150 aa, Sorghum bicolor
  Clone ID: LIB3478-023-P1-K1-B3.pep
DVGNNNYLQGATVGRANSPYNGVDFPGSVPTGRFSNGYNIADYVAKNMGFACSPPPYLSMVQSSSGPLVQTALTSGINYASGGAGILDSTNAGSTIPLSKEVKYFGATKAKMVAAVGPNTANPAISQSIFLIGMGNNDPYVFAASERARN

SEQ ID NO: 49891 - protein, 49 aa, Sorghum bicolor
  Clone ID: LIB3478-023-P1-K1-B5.pep
METAAAPTTAPHVLVVPFPAQGHTLPLLDFAGLLATRGLRLTVVTSPAN

SEQ ID NO: 49892 - protein, 109 aa, Sorghum bicolor
  Clone ID: LIB3478-023-P1-K1-C1.pep
MADPRLYPTGSGSDDRRDAAYPGSERRLYNPYQDLNLPYRQLYDLPTSPEFLFQEEAVAQRRSWGENLTYYTGVGYLGGAVAGAAMGLCDAASLAEAGEPAMSRANGVL

SEQ ID NO: 49893 - protein, 175 aa, Sorghum bicolor
  Clone ID: LIB3478-023-P1-K1-D2.pep
MAATAAATAAAATTSTPSTPLLRRAAAAPTTSHHYQLRCSTKPSQFVLRHRAARVAPARALLPDRVTPFSFDADGDDHPREECGVFGVIGDPDASSLCYLGLQKLQHRGEEGAGIVASDADGKLNSVTDLGLCRDVFRDPARLAKLPGNAAIGHVRYSTAGASFRRNVQPFLAAY

SEQ ID NO: 49894 - protein, 42 aa, Sorghum bicolor
  Clone ID: LIB3478-023-P1-K1-D4.pep
FILNNSPCIQTCPNVMCYTSIYMQYSGLPKKRKHQHPDTRLS

SEQ ID NO: 49895 - protein, 74 aa, Sorghum bicolor
  Clone ID: LIB3478-023-P1-K1-F4.pep
LKNYLLKAHYKYRGDKLLEQQQLQHARTHARGHCTERDQTATASRCTRSAVKKRNTKQHMGKMCRQVQGPTQDN

SEQ ID NO: 49896 - protein, 151 aa, Sorghum bicolor
  unsure (1)..(151): unsure at all Xaa locations
  Clone ID: LIB3478-023-P1-K1-G3.pep
MVITAGAVCAVKLKLLAAWPSPXVNHVHVALHLKGLEYQNVQEDLTNKSDQLLPCNRAHTKEPGLLHGYTTVSELLVITENLDNAFAEARQAFLAADSYEHSVGLFWAGYVDSKLYXMMVKAILEATEEERAAATADALAAMETLKGAFAE

SEQ ID NO: 49897 - protein, 95 aa, Sorghum bicolor
  Clone ID: LIB3478-023-P1-K1-H4.pep
LPSVPGFLLLSLVLFGLKQRTQGKLAAPIGLRSGIMTASYLIQSSGVLTPKPETPFWMISTCRLHPFDGVIGLSICSLLVIFFFPQKPVQKDTSV

SEQ ID NO: 49898 - protein, 143 aa, Sorghum bicolor
  Clone ID: LIB3478-024-P1-K1-A12.pep
RGQQYHRPHDYMNKTFRALGRVMSAKSPFTIDVTSDIRCPFCLLGVKQLKNAIGIYNSKHASTPIQPEIKILPYQLDPTVGLEPKDKAQVIRQKFGDRAEGLSEMMRGKIVAAGYPEPKKDATTSSSHLGQRLQAYTLSKFPE

SEQ ID NO: 49899 - protein, 72 aa, Sorghum bicolor
  unsure (1)..(72): unsure at all Xaa locations
  Clone ID: LIB3478-024-P1-K1-B12.pep
ASTKPGAGAREETGYSPVGSNGGGRRLAPRRRRRMGRGVDRQAWXIAIRASCRVCVSCVRSVFGASVFSVAN

SEQ ID NO: 49900 - protein, 35 aa, Sorghum bicolor
  Clone ID: LIB3478-024-P1-K1-C4.pep
PLKRARTCFGLNNEVSVYERTKNGPRVFVSDWSGG

SEQ ID NO: 49901 - protein, 77 aa, Sorghum bicolor
  Clone ID: LIB3478-024-P1-K1-D1.pep
LPSQDHEEKHQLLQESGLLNHVALVPITSIEPKWHIVLYTDDEADSALQSPDDTAYWARSNSTEYELGCESDHNMNH

SEQ ID NO: 49902 - protein, 36 aa, Sorghum bicolor
  Clone ID: LIB3478-024-P1-K1-D12.pep
ADATRNLYQQCSNALATDAPALIVSRAGLTLTNMTL

SEQ ID NO: 49903 - protein, 61 aa, Sorghum bicolor
  Clone ID: LIB3478-024-P1-K1-E4.pep
EDLAVCFDSARRRSSRLAGGYRGDARCRGGRRPRRCAGRARWGESSGPVVAIAWRRDRARK

SEQ ID NO: 49904 - protein, 46 aa, Sorghum bicolor
  unsure (1)..(46): unsure at all Xaa locations
  Clone ID: LIB3478-024-P1-K1-H12.pep
HYDFLPIAILWPYLEKKKLGKYMLNISTLHLLCYIAXTFQKYVSAI

SEQ ID NO: 49905 - protein, 100 aa, Sorghum bicolor
  Clone ID: LIB3478-026-P1-K1-A2.pep
DTACCTHGYQAIFGNKHLQFRLLATSHLNLKWLAVGLYSIFSNKLQKYLAYLACSAYGSSTNEATVIIVILPRKKDALIEVTTLFLVHALSIVRVDGRVA

SEQ ID NO: 49906 - protein, 78 aa, Sorghum bicolor
  unsure (1)..(78): unsure at all Xaa locations
  Clone ID: LIB3478-026-P1-K1-B6.pep
MAALVKIGTWGAGDHGSAYDITVAPRRVESISVRHGMIVDCISFSYRDRDGKLHTAGPWGGTXGLKEETITLGPDEFV

SEQ ID NO: 49907 - protein, 57 aa, Sorghum bicolor
  Clone ID: LIB3478-026-P1-K1-D5.pep
TLQAHNIYLSDFFHHSSIIFLSLLNNYFQNIFLLIYSHNFNLVISYLYLMFHSFVLF

SEQ ID NO: 49908 - protein, 102 aa, Sorghum bicolor
  Clone ID: LIB3478-026-P1-K1-D7.pep
SHQCRVNHDNSSRCGDINLTLYEVEDSFRVGFLHSTHPHFNSFELYCSLHYALRKDLWHSIRESKASTALSLSVVDLTAPTSVDRLMSNGVAPPPRPASRCV

SEQ ID NO: 49909 - protein, 167 aa, Sorghum bicolor
  unsure (1)..(167): unsure at all Xaa locations
  Clone ID: LIB3478-026-P1-K1-E1.pep
EFYDRTYDRVTPRAERRLERFKSRNFFKVTTTDDPVIRRLAENDTATVFATDTILAALMCAPRSVQSWDIVIQRVGNKLFFDKRDGSQLDLLTVNETAQEPLPEAKEDINSAHSLAVEATYVNQNFSQQVLLRNGEKVTFDEPNPFATEGEEAASVAYRYRXWKXDD

SEQ ID NO: 49910 - protein, 82 aa, Sorghum bicolor
  Clone ID: LIB3478-026-P1-K1-E9.pep
KYEKVGTIKDNVEKKQSEMIEKDGEKKNRKHKKTLINDKVVEKNNMEVVNCMSESKSIERNNKFFRTDKEKNKAGLCEATRY

SEQ ID NO: 49911 - protein, 148 aa, Sorghum bicolor
  Clone ID: LIB3478-026-P1-K1-F1.pep
ADTGNSAKSDLSEVTRQWFKPYGYCHGFLRDPTGRFFNSLVHSDFIAEILGRYEAPLTYKRTNVGYPHKFGGNFAVGGAGVSEVPRQAPTLARQIDDFQMMLDHDRSVPVMQLRQSVALVAICGNDYRPRGANTSSDGADITGFVGNV

SEQ ID NO: 49912 - protein, 135 aa, Sorghum bicolor
  Clone ID: LIB3478-026-P1-K1-F12.pep
QVYKARLKYSGKLVAVKVQRPGIEDAIGLDFYLLRGLGFLINKYIDIVTSDVVALMDEFARRVFQELNYVQEGQNARRFKKLYADKQDVLVPDIFWDYTSAKVLTMEWIEGVKLNQQAVIESQGIEGSWIWSTIG

SEQ ID NO: 49913 - protein, 48 aa, Sorghum bicolor
  unsure (1)..(48): unsure at all Xaa locations
  Clone ID: LIB3478-026-P1-K1-F4.pep
AGSHLLHXSPLKFKHIMSCHLCCGYVGHLGPIPIPEWSQHFHPYITCI

SEQ ID NO: 49914 - protein, 54 aa, Sorghum bicolor
  unsure (1)..(54): unsure at all Xaa locations
  Clone ID: LIB3478-026-P1-K1-G1.pep
ASANNLLHSNARPLPRARAIRRLSQTEPPTRFPPXRHQPRAMEDDARHLQGPTP

SEQ ID NO: 49915 - protein, 59 aa, Sorghum bicolor
  Clone ID: LIB3478-026-P1-K1-G10.pep
NWLIGRMNSFGDLIVLVVLRDYPFSLLRVSDHGECGRSGVGGGLKGGAELGIIAYAFAA

SEQ ID NO: 49916 - protein, 161 aa, Sorghum bicolor
  Clone ID: LIB3478-026-P1-K1-G3.pep
RWLVWSLRYPEFGYRQGMHELLAPLLYVLHGDVQHFRQVRDLHEELLGDDFDGQTFPDRSKLNRSDRKNNVEGRTAKFRSLSDLDPDTRDLFLINDAYGAEGELGIILSEKFMEHDAYSMFENLMNGAQGVVAITDFYSLSPAPKSSTGLTPCREALFAIY

SEQ ID NO: 49917 - protein, 88 aa, Sorghum bicolor
  Clone ID: LIB3478-026-P1-K1-H4.pep
VAKKSLQRGSVHLRQRRRKLEQRTGGFGLSKRRPSSLSGSGRPSIGDDRVGSYVARRRREPGGRSAGGGSARKKGRRGGLRALRRWFH

SEQ ID NO: 49918 - protein, 42 aa, Sorghum bicolor
  Clone ID: LIB3478-027-P1-K1-A5.pep
RTRGCSLCCMETDQIEGVSGCRFFQLIGHDGNMHIWSPRGSV

SEQ ID NO: 49919 - protein, 98 aa, Sorghum bicolor
  Clone ID: LIB3478-027-P1-K1-B11.pep
QHCCQELSTGKTSTFMFTYDPRFGSRIHLAAPLRSDLMQVFVQIVRHRVQRVAPRVFLQAPNVFPSVVASVVPLRAFVDVKDVVQHVSYQPIYERFYV

SEQ ID NO: 49920 - protein, 80 aa, Sorghum bicolor
  Clone ID: LIB3478-027-P1-K1-B4.pep
QVHETEGSGFEHLNITHEFTMQAENYPDYSDGVNTERDGYFSRRQIYQHVQLWLENVGWLALELHMIQYVLLKLEEEHEY

SEQ ID NO: 49921 - protein, 97 aa, Sorghum bicolor
  Clone ID: LIB3478-027-P1-K1-B5.pep
PILLRNTHRDVVRALTQSILRGTEPLRDASAYEAEQPWEGAVRRREPGLSRAQAARVRAPRWSTTRRDASFGRGRRDANAWVPRANYAMRGVGCRPP

SEQ ID NO: 49922 - protein, 53 aa, Sorghum bicolor
  unsure (1)..(53): unsure at all Xaa locations
  Clone ID: LIB3478-027-P1-K1-C1.pep
RXKDRLTGCDCVDCVGFPCRASTRRKKEAAVAVEESIECYVDEXLYXESFIFF

SEQ ID NO: 49923 - protein, 76 aa, Sorghum bicolor
  Clone ID: LIB3478-027-P1-K1-D11.pep
ANLHFSLSRSGIIALDRAEAVIEITEWVEVAKKILTLESNTTNQNSSSEVRAANSTTNSQENMSSGSYTNSNTFAD

SEQ ID NO: 49924 - protein, 33 aa, Sorghum bicolor
  Clone ID: LIB3478-027-P1-K1-D2.pep
LMRIRHRMMVIYSRISTSNCSFLLRPVMSCGIM

SEQ ID NO: 49925 - protein, 102 aa, Sorghum bicolor
  unsure (1)..(102): unsure at all Xaa locations
  Clone ID: LIB3478-027-P1-K1-H8.pep
ATISAPHMHATCLELLKDHLQPGMHALDVGSGSGYLTAXFAMMVGPKGRAVGIEHIPELVASSIENVQRSAAAPLLRDGSLSFHVTDGRLGFSDAAPYDAIH

SEQ ID NO: 49926 - protein, 84 aa, Sorghum bicolor
  Clone ID: LIB3478-028-P1-K1-A3.pep
DWPDAYTNASVHPKLVEYSAVFHQRHGDDKDPTTEPLDPELLISVGGGKHHGSYWMGNNAINPTTTSTLREILKFNFSSLLRHS

SEQ ID NO: 49927 - protein, 69 aa, Sorghum bicolor
  Clone ID: LIB3478-028-P1-K1-A4.pep
VASVVTISINRIVSLSRFIWASPVARVKMLKCCIPAKSFSVVIVCMILIQSRYGSMKLSWCRSVGPCRQ

SEQ ID NO: 49928 - protein, 66 aa, Sorghum bicolor
  unsure (1)..(66): unsure at all Xaa locations
  Clone ID: LIB3478-028-P1-K1-A6.pep
RGSFRIPNESGHXSHRRLTVTAYRLTRTRGGPGNGTKPRWRASSRARASRNNGSSRAFPFPRCLYR

SEQ ID NO: 49929 - protein, 54 aa, Sorghum bicolor
  Clone ID: LIB3478-028-P1-K1-B1.pep
RSLFAPFIYIWQAVTLSTTTSSTTHLATYHCKHGRLRFGISFVIRMLVGTSVSH

SEQ ID NO: 49930 - protein, 87 aa, Sorghum bicolor
  Clone ID: LIB3478-028-P1-K1-B10.pep
SHQSTLPAPRAMATTTNHRRIVALLLVAARLLAQAAACPYWPTPTPSPSSSSAKVKPPPSSTPCPSPPYSPSTPTGKCPVNTLKLLA

SEQ ID NO: 49931 - protein, 60 aa, Sorghum bicolor
  Clone ID: LIB3478-028-P1-K1-C11.pep
SLIKTDMATDEEHLKLVELDAHERLSNYEYHRYRRAHHRWLTPQSTRGPHGQASPKSPRQ

SEQ ID NO: 49932 - protein, 98 aa, Sorghum bicolor
  unsure (1)..(98): unsure at all Xaa locations
  Clone ID: LIB3478-028-P1-K1-C5.pep
PCGLCFINACHHMHTALITSAWLSIYINMPRVGRPIRACDARAMTNXHSKAAERHTISLDLCVGMNPNHSDATYQMQSSAAEPMQDQMQHMASVYGSM

SEQ ID NO: 49933 - protein, 58 aa, Sorghum bicolor
  unsure (1)..(58): unsure at all Xaa locations
  Clone ID: LIB3478-028-P1-K1-C6.pep
GEGPPPPPAKRGLLRYNSPLAQVSLLGLICFCXPRMFNALSGLGGGWQVDSSTVDNSN

SEQ ID NO: 49934 - protein, 82 aa, Sorghum bicolor
  Clone ID: LIB3478-028-P1-K1-D7.pep
ADYPVALVETQPSRLSFHKFNQCCHRPLRQKLRSERRAVGGYGVMQRGRHEPPQSSEDCPPRDEGPLGGHGHAREGTAAYSS

SEQ ID NO: 49935 - protein, 32 aa, Sorghum bicolor
  Clone ID: LIB3478-028-P1-K1-E8.pep
DEPRKRSRPLYAMTPTTCKLQTHLTSLSISLW

SEQ ID NO: 49936 - protein, 151 aa, Sorghum bicolor
  Clone ID: LIB3478-028-P1-K1-F3.pep
AKEIGKASFKYAWVLDKLKAERERGITIDVGLWKFETTKYYFTIIDAPGHRDFIKNMITGTSQADCAILVIASPTGEFEAGIDKNGQTREHALLAYTLGVKQLIVLVNKMDEKVTNYFEARFNEIRTEVHSFIKKIGSTPGGFLLPISGWN

SEQ ID NO: 49937 - protein, 79 aa, Sorghum bicolor
  Clone ID: LIB3478-028-P1-K1-F4.pep
PPRPRGQGQASADHPASGARRRPGVVARRRAASARASTPAKPSPPTPNTPAVRAFGRPPPGRARAPREDARPSRAAVCA

SEQ ID NO: 49938 - protein, 77 aa, Sorghum bicolor
  unsure (1)..(77): unsure at all Xaa locations
  Clone ID: LIB3478-028-P1-K1-F8.pep
VRGGTFGLCSGPTHLFMLSQPADTINECMRVTYHGKVIEFMFLXENLGFQPLHAITVASLDHSLHPSVSPKPQRRKL

SEQ ID NO: 49939 - protein, 45 aa, Sorghum bicolor
  Clone ID: LIB3478-028-P1-K1-G10.pep
LRLYYILVLRLGHMMHSLLALATLDDQYLTSIIHLTNDHLYSHIT

SEQ ID NO: 49940 - protein, 58 aa, Sorghum bicolor
  Clone ID: LIB3478-028-P1-K1-G11.pep
RAKFEIAQRCRAKAPEGVESWDHLLLVVLSRRVLMPAVVDVAVVRCSISTHTGTQARL

SEQ ID NO: 49941 - protein, 115 aa, Sorghum bicolor
  unsure (1)..(115): unsure at all Xaa locations
  Clone ID: LIB3478-028-P1-K1-H11.pep
HNTQRLTTHSDEEAPGCCEXKTPMNHNAVYKVKXHAPIIDNPNYKGIWKPHEIPNPXYYELDKPHSDPIDGIGIEIWTMQDCILLDNILIADDENDATYILEKTLKPKCHVKMKK

SEQ ID NO: 49942 - protein, 45 aa, Sorghum bicolor
  Clone ID: LIB3478-028-P1-K1-H6.pep
VTVYHGKIYNGKLSTLEKNYMRPTAINEGFYVKRHYFKRLWHLNI

SEQ ID NO: 49943 - protein, 110 aa, Sorghum bicolor
  Clone ID: LIB3478-029-P1-K1-B4.pep
TTPRPLASICFCSPLLRSRSPLLLLLDLSPSGRQPQRYELQRDHGPPPATHLVLYKYIDIWEKRESIQLTPLDPDCYIWRWTPNGAYYASSAYCLFFLSMSSLLGPKEPW

SEQ ID NO: 49944 - protein, 113 aa, Sorghum bicolor
  Clone ID: LIB3478-029-P1-K1-B7.pep
AHVRAKLDDILKADVHAHVILDFINAAHAHLHAREHMNANRTYQNIPLNMDFVPHIEKACTIDMASYGVARKQASVQVNTTQITTHPGTLAALLANNMTSHMTRHMVVAYRPS

SEQ ID NO: 49945 - protein, 91 aa, Sorghum bicolor
  unsure (1)..(91): unsure at all Xaa locations
  Clone ID: LIB3478-029-P1-K1-C10.pep
DSMHIVLLAVAAHAAATNSRFTIIYDPTAWPSELVIPLSKYIKAAFHTRISGGMRFMMXTETEESSVRMYMETITEVSDADPVRRPSSYWR

SEQ ID NO: 49946 - protein, 75 aa, Sorghum bicolor
  Clone ID: LIB3478-029-P1-K1-C3.pep
CHFGLQIKFWKRYSWKETPFYARDIPVHLMFGLSEEPNQTRVLCEVKKVHLELEIILVHKATAPRARLDLQLFLE

SEQ ID NO: 49947 - protein, 99 aa, Sorghum bicolor
  unsure (1)..(99): unsure at all Xaa locations
  Clone ID: LIB3478-029-P1-K1-C5.pep
MAAASMIKAPVGQNPRLACHAPARGGGVVRCSLQGAVVGGRADWQSSCAVLSSKVAALGTHSINGHVAPAPAPEPSQNXAVLXLVPVTSITGGAITKAN

SEQ ID NO: 49948 - protein, 47 aa, Sorghum bicolor
  Clone ID: LIB3478-029-P1-K1-D10.pep
VSRRDGVQLPGQVSGSRPRHYASSPYQRWQQPAGGWQRLWRLKWSWR

SEQ ID NO: 49949 - protein, 65 aa, Sorghum bicolor
  Clone ID: LIB3478-029-P1-K1-D11.pep
EKINTNHMKKNSMMDNFQKKNIYLILDLKLVASSYFCNLEKQSPPNKQIPRIKSCADDVAQLVLP

SEQ ID NO: 49950 - protein, 76 aa, Sorghum bicolor
  Clone ID: LIB3478-029-P1-K1-D9.pep
LHFVNGDKLLIQHRDNNLYSYELLGMNFKIEFSKMVKLLGLRPWGDDDLQLYTCVKSLVRLDLYANAAVAYPKMRA

SEQ ID NO: 49951 - protein, 168 aa, Sorghum bicolor
  Clone ID: LIB3478-029-P1-K1-E12.pep
MDNGSKVHILLSFGQHGRELITSEVALHLLYILTEKPKIAGVDLSSFEKLLENLVIKVVPMENLNGRKRVEEGDICDRRNGRGVDLNRNWSVDWGKKEKDYDPYEENPGMAPFSEPEAQIMRELSRSFKPHIWVNVHSGMEALFMPYDHKNTTPNGALAHLMRAGLEN

SEQ ID NO: 49952 - protein, 69 aa, Sorghum bicolor
  unsure (1)..(69): unsure at all Xaa locations
  Clone ID: LIB3478-029-P1-K1-E6.pep
LPGLRFLCXPLRSSGCSPGSCLXASGPPWXRGPVRRPXXLVRRLSRSCVCFVSRGAWLAPWWVGGPPRA

SEQ ID NO: 49953 - protein, 59 aa, Sorghum bicolor
  Clone ID: LIB3478-029-P1-K1-F8.pep
HQAKPLSVVNEPPMSKASHNLVPKDMGNGSTQPSKTQLALKKRQTGSTPLAKLEKLENN

SEQ ID NO: 49954 - protein, 162 aa, Sorghum bicolor
  Clone ID: LIB3478-029-P1-K1-F9.pep
IIVQPERVGIGHGPAFGCVLMKDFLDALATRLKKNTAAYENFRRIYVPPGEPLASEPGEPLRVNILFKHIQAMLSGNTAVIAETGDSWFNCQKLKLPEGCGYEFQMQYGSIGCAVGATLGYAQAAKDKRVIACIGDGSFQVTAHEVATMLPWEQNTIIFSVK

SEQ ID NO: 49955 - protein, 170 aa, Sorghum bicolor
  unsure (1)..(170): unsure at all Xaa locations
  Clone ID: LIB3478-029-P1-K1-G11.pep
IIQSLISASLLQTSSSLSSKVKMHHVIRHMGIWLVNKTGQKFLVQAGMALDSAPPAEEWKEATRISIMSNDIKELLFSPECEILTTLLIQNNPNLNKLSSGFFKFMPSLKVLDLSHTAITSLPECETLVALQHLNWSHTRIXILPERLWLLKELRHLDLSVTAELEDSLE

SEQ ID NO: 49956 - protein, 128 aa, Sorghum bicolor
  Clone ID: LIB3478-030-P1-K1-A6.pep
GYRKDEIENCVKNATKFIENKQQPDGSWFGTWGICFIYGTLFAVKGLVAAGKTYKNSYSIRKACNFLLSKQLSSGGWGETYLSSETGIYAEASSPHAVSTAWAMLALLYAGQVERDPTPLYHAAKELI

SEQ ID NO: 49957 - protein, 122 aa, Sorghum bicolor
  Clone ID: LIB3478-030-P1-K1-B10.pep
ENIASRGILLNDFFLCPLIRHLCKHKKALEAHQLFNKFKGLGVSLKTGSYNSLIRGLVDENLIDIAEDLFTEMKRLGCGPDEFTYNLILDAMGKSMRIEEMLRVQAEMHRKGYESTYVTYNT

SEQ ID NO: 49958 - protein, 117 aa, Sorghum bicolor
  Clone ID: LIB3478-030-P1-K1-B5.pep
THSLAFGHTSVATAHRHGNRSLVTLHSGSVKICVPVTTRQPPYSSVKVGSGSFALLLRDDRKSIFGEACTTGQDSGTPTDVDVIGAVFGVAGVAARLTVRGSTCVGYTSVTSSMPSS

SEQ ID NO: 49959 - protein, 86 aa, Sorghum bicolor
  Clone ID: LIB3478-030-P1-K1-B8.pep
DGKQLMPFLNFSQLFHRLPSDFPRILIAGSTATCVTKLLIPRAPMDGRLNASQEPFQALRRRPARRFPRSLHDARDRHRLPPHLIA

SEQ ID NO: 49960 - protein, 91 aa, Sorghum bicolor
  Clone ID: LIB3478-030-P1-K1-C8.pep
LVLDRDGRPFFFFLFKTSIGSHARRKWLIWVYIQRLEKHHRFNTCLAPKNALLRSYCVQIYLFLFILIRRGWHAMNRLHPTQTSRSINTKS

SEQ ID NO: 49961 - protein, 58 aa, Sorghum bicolor
  unsure (1)..(58): unsure at all Xaa locations
  Clone ID: LIB3478-030-P1-K1-D3.pep
EVSCMVDAIDAPAVGQLKEFEGQKLVFCTNVGLELDXTEDVKTRNEALYEKFEGCAKS

SEQ ID NO: 49962 - protein, 101 aa, Sorghum bicolor
  Clone ID: LIB3478-030-P1-K1-F8.pep
GELNTFIVYNERKRVTSSAKRKLKSEDRSLHQTPEGSLLDIMRNAHDLLSSCSIDIPMVKDNSEYLHSGPPFLIFLHPALSPFWDIIRQKFVGGSISKGSE

SEQ ID NO: 49963 - protein, 109 aa, Sorghum bicolor
  Clone ID: LIB3478-030-P1-K1-G11.pep
PEVFNQFMWSLGVPEDDVEFHDVYGLDDDALDMVPQPVLAVVLCFPDPPQDASYPSEQLLFSGEKETQDQVYFIKQIKSLGNACGTIALLHAVGNASSEVNLVGNSCLD

SEQ ID NO: 49964 - protein, 59 aa, Sorghum bicolor
  Clone ID: LIB3478-030-P1-K1-G12.pep
IGGAQLISDSVGLTPAARLHEGGSHLLDRLYFHAHMVQVPCMSFLVLFMCVSCEHVLDN

SEQ ID NO: 49965 - protein, 113 aa, Sorghum bicolor
  unsure (1)..(113): unsure at all Xaa locations
  Clone ID: LIB3478-030-P1-K1-G2.pep
XHLPRRGLYQALAIAAMCLQEKAKNRPPIREVAAALSYLASQTYDRNNTAPRRNRAGASTSRVLDDQIGQDTTLANQQGAQMSMHGQTNHVMPEVKETSWSXRXHRGGRGRVL

SEQ ID NO: 49966 - protein, 105 aa, Sorghum bicolor
  unsure (1)..(105): unsure at all Xaa locations
  Clone ID: LIB3478-030-P1-K1-G5.pep
ENFEKAKDTGNISATYNTGHNHFESSLFARADLIRLKSSTLNANSGHDTSPISLVQLDSILNARDSTLFLPVHLSKQHQTXYGYDRKNILHSLCPTMXSKHRQWM

SEQ ID NO: 49967 - protein, 149 aa, Sorghum bicolor
  Clone ID: LIB3478-030-P1-K1-H11.pep
HSRSPSGSRSRSPHDWAPRNRSKIMANVGSTLRRHSRSPPNHMAKGRIVRMASPQRQPGYDDRAMRYSPLSRNNTYSQHASTWVEGRNGSAVDISDDHNKRYSRRSPPLRITSRNDRFDVMDSQGRPRSGEFYRPTQGRLLYGYDRENK

SEQ ID NO: 49968 - protein, 87 aa, Sorghum bicolor
  Clone ID: LIB3478-030-P1-K1-H2.pep
LRQAWAAGDGKGEEEEAEEDVVVAEVRRKVDEDAHVMMGRDVFVLWVRAGFDAAFAMGIVLVLDRITGDDVDGDLGEELLEAVTSSA

SEQ ID NO: 49969 - protein, 123 aa, Sorghum bicolor
  Clone ID: LIB3478-030-P1-K1-H7.pep
AKLLCVPLVMSYHTHVPIYIPRYTFSWLVKPMWLIIKFLHRAADLTLVPSVAIGRDLQAAHVTAANKIRLWNKGVDSESFHPRFRDMEMRSRLTNGEPEKPLIFYVGRLGVEKKLDFLKESWP

SEQ ID NO: 49970 - protein, 71 aa, Sorghum bicolor
  Clone ID: LIB3478-031-P1-K1-A10.pep
QWTNVVLGLHQEMAAARVVSFLARKLDAGEAHHRGAPHDDRLALMNGRLLADQFTLHYMFCVARRHTVTRL

SEQ ID NO: 49971 - protein, 79 aa, Sorghum bicolor
  Clone ID: LIB3478-031-P1-K1-A7.pep
MVAEGKRWRFAMVCSSNMNRSMEAHSQLGRAGLDVESYGTGTHVKLPGPSLHEPNVYDFGTPYGAIYDDLRRKDPDLYK

SEQ ID NO: 49972 - protein, 63 aa, Sorghum bicolor
  Clone ID: LIB3478-031-P1-K1-B1.pep
STHAFDYEELIERVELERLERVSSYEYHGDDAPIIHDSHLKELEALNDNHDVKHHDNEWEDYI

SEQ ID NO: 49973 - protein, 121 aa, Sorghum bicolor
  Clone ID: LIB3478-031-P1-K1-B12.pep
EVTEDLTCLKLSSSETDDHRNKVYLCELTDLAYGLVRMTKQSSHGNAMVPLAKLVDKLAAYYGLIANELPQITLLTNKVSSKYKLARVYLDYYTTRLSTNVILVVDMAELVSSYTIHGHKV

SEQ ID NO: 49974 - protein, 140 aa, Sorghum bicolor
  Clone ID: LIB3478-031-P1-K1-B2.pep
LFAFVEKWAQQRWPKSSYITGEVDVPLSLAGAAGRCYKLNLFRLTWRTAFVVATTVVSMLLPFFNDVVGLLGALGFWPLTVYFPVEMYIVQKKVPRWSTLWVCLQLLSLGCLIITVASAAGSVAGIISDLKVYKPFVTTY

SEQ ID NO: 49975 - protein, 154 aa, Sorghum bicolor
  Clone ID: LIB3478-031-P1-K1-B8.pep
EYYDYRKSIYGDVTHRALLVDAVGTLVVPAQPTAQVYKSIGEKYGVKYSEDEILMRYRRAYEKPWGGSRLRYVDDGRPFWQHIVTSSTGCSDAQYFEELYQYFMTEKAWKFCDPDAENVFKALRKAGVKTAAVCNFDTRLRPLMQGLKCDHCVD

SEQ ID NO: 49976 - protein, 158 aa, Sorghum bicolor
  Clone ID: LIB3478-031-P1-K1-C4.pep
GRTEVEQLHKIFKLCGSPSGDYWSKLEVPQTGMFKPSRQYRVCIAETFKDFPQSAVVLLDNLLALQPDARGTAAEALRSDFFRKKPLACSPSSLPKCPPSKEYDVRLGREEARRKRKAAESVSGFRSVETEDGNSFASEITKVAMIRPESAVVRNEVL

SEQ ID NO: 49977 - protein, 73 aa, Sorghum bicolor
  Clone ID: LIB3478-031-P1-K1-D10.pep
SGRWRPRASAPGIPRRRLWGGARARSTPAVIASSDTNRTPRRSCLTRSHLRTAYSTGQSYALLWNYMKTITNT

SEQ ID NO: 49978 - protein, 104 aa, Sorghum bicolor
  Clone ID: LIB3478-031-P1-K1-D4.pep
PQFNGAAHVYEHFVRPMIVNQQVVNIWYIPKKDESGRPDDVISAAQRYIEQNGSKAFENLVNKFKSSNPKRSILEEVEVERRARIQRESEAREVNPFFNPEYQY

SEQ ID NO: 49979 - protein, 156 aa, Sorghum bicolor
  Clone ID: LIB3478-031-P1-K1-E1.pep
MSPRLPGRSPSPCRGSRGAASPSRGRSGEVSPNGHMVQAPANAPSIISFAAEVRRAKKGENRIEEAHRLRLLDNRHLQWRCINARTDATLLVQSFTAEKTLHSAWKEISRLRDIVSTRRSRLQLQKQKLKLFAILRGQMSYLEDWSHIEKHHSSAL

SEQ ID NO: 49980 - protein, 137 aa, Sorghum bicolor
  Clone ID: LIB3478-031-P1-K1-E11.pep
GKTRWPSGATYEGEYSGGYVFGEGTYTGPDKIIYKGRWKLNRKHGLGHQTYPNGDIFEGSWIQGEIVGHGKYTWANGDTYVGNMKSGKMSGKGTLTWKNGDSYEGNWMDGMMHGYGIYTWNECGYFIGTWTRGLYDW

SEQ ID NO: 49981 - protein, 123 aa, Sorghum bicolor
  unsure (1)..(123): unsure at all Xaa locations
  Clone ID: LIB3478-031-P1-K1-F10.pep
LPSVMNQVTEGVSEFKPTPPENREFCKNAYSVPNTLLVKFSVDAIDDTDIVEDVLRPRIDSIGGQIKKVILSGTHLTPCIQDVKWQVGSEYTPADAIAQGLKSLALSETXVLSRTIADWFTSL

SEQ ID NO: 49982 - protein, 111 aa, Sorghum bicolor
  unsure (1)..(111): unsure at all Xaa locations
  Clone ID: LIB3478-031-P1-K1-G6.pep
ENVARNSWIVMLSTDVRKMSASLLKCADLSTGCTPYDVLSKSIASGVDVDSMIXCVGHKGAARSTALLLMTGHRRRLDGSSXSHKHLGMTHAELLLLLKLDLYMASLAYMM

SEQ ID NO: 49983 - protein, 38 aa, Sorghum bicolor
  Clone ID: LIB3478-031-P1-K1-G7.pep
SRQSIFIPTYMPLLMKNVHRHGHHQYLQICRVTQRKCK

SEQ ID NO: 49984 - protein, 54 aa, Sorghum bicolor
  Clone ID: LIB3478-031-P1-K1-H7.pep
PHSLHDGDPYPRTVKEREGVQSDRHVWLGRIHARGGMSPDTLLAEHVHQTANAL

SEQ ID NO: 49985 - protein, 126 aa, Sorghum bicolor
  Clone ID: LIB3478-032-P1-K1-A5.pep
VRPPISDTRERRIYNSLVGAGTYMFRIDDERVIDATRAGSIAHLINHSCEPNCYSRAITILGDEHIIIFAKRDIDPWEELTYDYRFFSSDQRLPCYCGFPKCRGVVNDVEAEEHAAKIRVKEVNLF

SEQ ID NO: 49986 - protein, 122 aa, Sorghum bicolor
  unsure (1)..(122): unsure at all Xaa locations
  Clone ID: LIB3478-032-P1-K1-A6.pep
TVDDYDEYCHYVAGLVGYGLSRLFYATGTEDLAXSLSNSMGLFLQKTNIIRDYLEDINEIPRSRMFWPREIWSKYADKLEDFKYEENSEKAVQCLNDLVTNALIHAEECLQYMSALKGYAIF

SEQ ID NO: 49987 - protein, 148 aa, Sorghum bicolor
  unsure (1)..(148): unsure at all Xaa locations
  Clone ID: LIB3478-032-P1-K1-C10.pep
MEEGSKFVPLNAEDPMCGPXALLLIGFEKGETVTIQAFLKELEGEFLKVIHCTEEMTKQTLWDAMHTEQPDLEAVKIARSLPRICIFSGLTGEEMMMFINGLPETGLESPAFAALVPNSAEKGLGQVIEEIMGDHEMLHERIPNKKNL

SEQ ID NO: 49988 - protein, 171 aa, Sorghum bicolor
  unsure (1)..(171): unsure at all Xaa locations
  Clone ID: LIB3478-032-P1-K1-C12.pep
SPHTETIARGRSKARVTDYKXLTTHPEYETNDTDNLSAFQVTTQVMVRSDEAGAAVPAESSTGTWTTVGTDGLTSHDRYKXRCYDIEIVPGDPDLYIWDVAYPLDLFEEGSATNMLTCTEGNVSGSKALRALRMEDLRNPPAYVKTFQGANHRVQVVRDKLYQVCRPLLGC

SEQ ID NO: 49989 - protein, 64 aa, Sorghum bicolor
  Clone ID: LIB3478-032-P1-K1-C9.pep
MMGALQVQRKSNNGDRAAAGAAADELFPDPGYVEVDPTGRYGKYDEILGKGFSKTVYRAFDEHR

SEQ ID NO: 49990 - protein, 172 aa, Sorghum bicolor
  Clone ID: LIB3478-032-P1-K1-D12.pep
RILVYEYMPNGSLDSFIFGARTSRLHLDWPTRFQIIKGIAEGMLYLHKLCGLHIIHGDLKPSNILLDTNMKPKISDFGLSRTYNPGVDEEFADRIVGSIGFTAPECQERRVFSVKSDVYGFGALLLEIISGHRCFSLASGESGDDHGFLNKKGVKLWRASGLIKFVDSPPGD

SEQ ID NO: 49991 - protein, 61 aa, Sorghum bicolor
  Clone ID: LIB3478-032-P1-K1-D7.pep
PPLFFYPYIDTHRLKHIYEHHTTPDHRCRGRLYCIDCSSSLTSTNSKLHLLHKHQRLPTLT

SEQ ID NO: 49992 - protein, 68 aa, Sorghum bicolor
  Clone ID: LIB3478-032-P1-K1-E10.pep
TYNALLDVQVSNTGDSWLTLQNIVLRPKLIWKVSKEYRHKAHWVIKPHVIFQMLYDCLYHHPLYNVPQ

SEQ ID NO: 49993 - protein, 182 aa, Sorghum bicolor
  Clone ID: LIB3478-032-P1-K1-E12.pep
TKNIQSFVSSFFYFYGYSYFKRLYLEKSGAKSIGTSANLLVAAAAGACTVIVTQPLDTAASRMQTSAFGKSKGLRETLSEGTWMEAFDGLGISIILTCNPSIQYTVFDQLKQRIIQRQRRKNAGSAEDNSRVALSAFSAFLLGAVSKSIATVLTYPLIRCKVMIQAADPDEDDDNESERPSK

SEQ ID NO: 49994 - protein, 108 aa, Sorghum bicolor
  Clone ID: LIB3478-032-P1-K1-E7.pep
EMEFLTLDGGNNEAWTWTETMEDSVFTLGSGDDDEAWTETREDPPRPLLRWQTGVTLKGFIFWRVDTAQYCQSSAGILLRLTLELEGFNIIPLPGSMRVCDDFMLDAL

SEQ ID NO: 49995 - protein, 60 aa, Sorghum bicolor
  Clone ID: LIB3478-032-P1-K1-E8.pep
ALCTEYPKIMQQGFAYLPGGVCVSSMGRAVSYEQAVAWKVLSDDDTPHCLAFMFVNWSFV

SEQ ID NO: 49996 - protein, 56 aa, Sorghum bicolor
  Clone ID: LIB3478-032-P1-K1-F1.pep
SIHGYKDENGPEISRTELTRFLYLIRSNSYFLVRLYRFRFRILDVLYFKCKSRKWF

SEQ ID NO: 49997 - protein, 142 aa, Sorghum bicolor
  Clone ID: LIB3478-032-P1-K1-F2.pep
NMAMDENNQINAAAHNTEGPAKTGRKVTINHQLRKRRAKGKHIDIKFPKEFAKVCGEHASLFKSEITVLVRTIPLQVKKWRDMDKVHAGTTAAVWRKLKQKFPELSEEDKDCAMRQVESQYNNRRYRLLQAYRNNKPRPQHV

SEQ ID NO: 49998 - protein, 73 aa, Sorghum bicolor
  Clone ID: LIB3478-032-P1-K1-F3.pep
CAPSALRAPPSRAQATAVPQDAVHYNEEPYAGPATKIKTRQARIEWTWTDRRSGCLTEEGQGQGLVPYSSTRP

SEQ ID NO: 49999 - protein, 125 aa, Sorghum bicolor
  Clone ID: LIB3478-032-P1-K1-G4.pep
LLLLLYPLRRPPVAKSVVSSGCSCPWNGLLPHMYLFLKKSPHQSSRLPFLLSKDNMPACLSGIPMAIKKPLSPVPANMNVSIPVRRNPYVLDTLENQDFVEYLPGPAKSGERSLILVIVIVVVLL

SEQ ID NO: 50000 - protein, 47 aa, Sorghum bicolor
  Clone ID: LIB3478-032-P1-K1-H11.pep
GACIHCAITAEYRYAFVKEYLLRQYLRSEAPETEYGQMNMWRTPSTT

SEQ ID NO: 50001 - protein, 146 aa, Sorghum bicolor
  Clone ID: LIB3478-032-P1-K1-H5.pep
SATGHRPPPRLSDSGAADLTRAVDSGSPARTPPPDAPPRTGAATGCSSPRAPPAPLPAELFSSAPSFSFCTAWVHKPKKHWGHGHMDMVVLFSMHNSHLSPLRSAKNFSRLFMHNSFYLDENLKRFRLDFHMGLIRFWFFSREDFL

SEQ ID NO: 50002 - protein, 61 aa, Sorghum bicolor
  unsure (1)..(61): unsure at all Xaa locations
  Clone ID: LIB3478-032-P1-K1-H9.pep
ERASATWYVPGHTLLMLATDAGRAGLDLRAXDDPVRPTLLPGRHLPGETNSSHDTKPRSDS

SEQ ID NO: 50003 - protein, 155 aa, Sorghum bicolor
  unsure (1)..(155): unsure at all Xaa locations
  Clone ID: LIB3478-033-P1-K1-A2.pep
ALATGQDEXGMLEFIASSSIAQILSKHGRITSYLQKFHPDEDGPFGITAQCLETFIKSCAGYSVITYILGVGDRHLDNLLLTDDGRLFHVDFAFILGRDPKPFPPPMKLCKEMVEAMGGAESQYYTRFKSYCCEAYNILRKFSSLILNLFKLMER

SEQ ID NO: 50004 - protein, 106 aa, Sorghum bicolor
  Clone ID: LIB3478-033-P1-K1-A4.pep
MVSPRGTGKASQGRRRRELVLIEDPKSRLVTFSKRKSGLLKKASELSLLCGARVAAVVFSATGKPSAVGAPSVERVISRFAPLPSGEGDDDREREVMEVTARRAKE

SEQ ID NO: 50005 - protein, 112 aa, Sorghum bicolor
  Clone ID: LIB3478-033-P1-K1-B2.pep
DERLEQVVELVEKLAKLDSMLGMLGFSLGVLTHVLTHTLSQAIIEAAIQMVNQGVEIMPDIMGTLDESPHEVNHIKHAVKQTVDNAVDTVGYTIGSIIETMMAILMADLVAD

SEQ ID NO: 50006 - protein, 51 aa, Sorghum bicolor
  Clone ID: LIB3478-033-P1-K1-C11.pep
HASLDPTSKTSCMQLPSVLHQDNLRGNRVRMRICEAAGHQSSAIPGRLTNC

SEQ ID NO: 50007 - protein, 122 aa, Sorghum bicolor
  unsure (1)..(122): unsure at all Xaa locations
  Clone ID: LIB3478-033-P1-K1-C9.pep
LPEWYKFTLFNELYFLVAGGTVWTDGQPPAIDEKNSPGSIQQKSSKRGTKDTKQGSVKDNHVNLTVEQVPHGGQMTNSDDHSVSXAAVHGSQMQEQVNGLKSEEPIPYLISKDGPEHVGKFL

SEQ ID NO: 50008 - protein, 124 aa, Sorghum bicolor
  Clone ID: LIB3478-033-P1-K1-D1.pep
LLDHLLAVEPGNRGTAASALDSEFFTTKPYACDPSSLPKYPPSKEYDAKLRDEEARRQRAAAKGQEAEAGRRKQLPAPDGNNGLQHRRVQVNPKSSSYKFTPKEDAVSGFPIDPPARAADNGYP

SEQ ID NO: 50009 - protein, 45 aa, Sorghum bicolor
  Clone ID: LIB3478-033-P1-K1-D2.pep
AVIGTQHPADLCMWYCVGMSSSATISVATLSAVSASASNGVLATV

SEQ ID NO: 50010 - protein, 73 aa, Sorghum bicolor
  Clone ID: LIB3478-033-P1-K1-D6.pep
KYLSPLYGGPAGYLTGESPRFYPWNSSLLSANPKTCAKNSKLKVFHSRWAMLVTLGCVFPDLVDHGCDTKANP

SEQ ID NO: 50011 - protein, 54 aa, Sorghum bicolor
  Clone ID: LIB3478-033-P1-K1-D9.pep
EITYHLFRPAAAYKRRVQVCDRHVQPLSPQLCPIVHGVSPPAPSVMGTYSSVSR

SEQ ID NO: 50012 - protein, 60 aa, Sorghum bicolor
  Clone ID: LIB3478-033-P1-K1-E4.pep
GNGGVQRLLDAKVIREVMYPEWLANVVLVPKKNGKMRMCIDFTDLNKACGQKTSTIILFS

SEQ ID NO: 50013 - protein, 157 aa, Sorghum bicolor
  unsure (1)..(157): unsure at all Xaa locations
  Clone ID: LIB3478-033-P1-K1-F10.pep
LAYLFGMFVPWRILAVLGILPCSILIPGLFFVPESPRWLAKMGKMEDFEYSLQVLRGFQTDITAEVNEIKRSVASSRRRTTAIRFADIKQKRYSVPLAIGIGLLVLQQLSGVNGILFYAGSIFKAAGITNSNLATFGLGAVQVIATXVTTWLTDKAG

SEQ ID NO: 50014 - protein, 76 aa, Sorghum bicolor
  Clone ID: LIB3478-033-P1-K1-F4.pep
MSCSCGSSCNCGSSCKCGKKYPDLEEKSTAAHATVVLSVAPEKKAAAKFEAAAEFGAETSHGCSCSDSCKCNLCTC

SEQ ID NO: 50015 - protein, 123 aa, Sorghum bicolor
  Clone ID: LIB3478-033-P1-K1-G7.pep
QSKKYFARMTTKVGFCRVRVPFSSFRPVNPQDPPLDPFLVHTLTIRFEPKRQRPGDGSQNASDPRNFELKLEYIKALPTGQETDFILVSCSGSGIESNRREQVLKAKKAGEDALAGSGLGYTI

SEQ ID NO: 50016 - protein, 80 aa, Sorghum bicolor
  Clone ID: LIB3478-033-P1-K1-H7.pep
PDLSSRAASSPSAAAASSPFSTATRPPPPASSSASLHRLGSASTLGGGGVNHCELIPLRSLLSVILASISTYGCVAIVCV

SEQ ID NO: 50017 - protein, 52 aa, Sorghum bicolor
  Clone ID: LIB3478-034-P1-K1-B11.pep
NRWEVYFPSTLNSYALQPQLLSTVKFSDMKGGSERDLLAEDCHCHPMSHPTR

SEQ ID NO: 50018 - protein, 55 aa, Sorghum bicolor
  unsure (1)..(55): unsure at all Xaa locations
  Clone ID: LIB3478-034-P1-K1-C2.pep
RVSNHLTTLQVMLPNITDGGSLSNILEQCMYCAMGLGLVGXDFRGLLPPILEMRI

SEQ ID NO: 50019 - protein, 115 aa, Sorghum bicolor
  unsure (1)..(115): unsure at all Xaa locations
  Clone ID: LIB3478-034-P1-K1-G4.pep
GESVRCLMRRPEYMSTRVSVALGRLGRLASXDVVSGVASRXSLTTSRKTDMSVPPGRAVLGGVKAPSHTGPSAAARGEAAGVSGTASXSESRRSRSSAAFAMVGDEVCVETARHR

SEQ ID NO: 50020 - protein, 59 aa, Sorghum bicolor
  Clone ID: LIB3478-035-P1-K1-A12.pep
LADPLWAPARTTTARRGLARGGIGERRLAPRNDGVLSSAAGAVAQVDASAMTGGFGVVS

SEQ ID NO: 50021 - protein, 163 aa, Sorghum bicolor
  unsure (1)..(163): unsure at all Xaa locations
  Clone ID: LIB3478-035-P1-K1-C11.pep
NGEVSIKEKILDEGDRILSVNGLVKSHVLNGLCTAVYNDNAMNIKYRYKDDEISFVPSISLPSNTLSFAFKRQLTPLDKLSYWYNFDTNYWSAIYKHKANKHLKWKAGYESDNRLGWASLWVGDAGGSTKEVPFKAKVRLTLKVPQDNMRNSTXVFHVKKRWD

SEQ ID NO: 50022 - protein, 97 aa, Sorghum bicolor
  unsure (1)..(97): unsure at all Xaa locations
  Clone ID: LIB3478-035-P1-K1-D3.pep
PRGARVPEGAQRPAGGQHYDDVVSSRAVDLRLLAVAVQTKSVCVYGVPGVLLRATVRANPIPTCIYICRAVFVPYMHIRTLRQCKTEDQVIEPLXRX

SEQ ID NO: 50023 - protein, 122 aa, Sorghum bicolor
  unsure (1)..(122): unsure at all Xaa locations
  Clone ID: LIB3478-035-P1-K1-D4.pep
MQSIQRGRDPGVMIYMLPQGPGRSKAKSYHGWGTQNESFWCCYGTXIESFSKLGDSIYFEEKGQKPALYIVQFIPSTFNWRTTGLTVTQKLMPLXQWDQYLQVSFSISAKDRRAVCDIEREN

SEQ ID NO: 50024 - protein, 133 aa, Sorghum bicolor
  unsure (1)..(133): unsure at all Xaa locations
  Clone ID: LIB3478-035-P1-K1-D5.pep
SLVPNKAQGPVSDDNLRDMAYLRAVVKESLRLHPPTPILTAHFTMASCSVDGFAVPAGVGVLVNSWAIATDARFWEDPEAFAPERFVLDGGSAAGIDFRGXDFRLLPFGSGRRMCPGMNFGVASVEAMLANLV

SEQ ID NO: 50025 - protein, 151 aa, Sorghum bicolor
  Clone ID: LIB3478-035-P1-K1-D9.pep
GFPPLDSLSRDRFPFSWPWPTSGSRSCSNDRPASGNAAAGAKGSSSAPAPAASAALPSLARTVLKFLMWAVFLTWAAGIFLYPTKPVQAVFTKWVRLSKESMFGIAGGIFLAFSAPILIIALLAYVYISFFPSERVVEKKKLRSLSFKPLT

SEQ ID NO: 50026 - protein, 132 aa, Sorghum bicolor
  unsure (1)..(132): unsure at all Xaa locations
  Clone ID: LIB3478-035-P1-K1-E2.pep
GFFFEAVRREYYHPIRVNFFFAPWIACXMLVIGVPPVVAREPLPQWLWYALMAPVLTLELKIYGQWMSGGQRRLSKVANPSNHLSVVGNFVGALLGASMGLKEGPGFFFSVGLAHYTVLVVTLYQRLPTKRD

SEQ ID NO: 50027 - protein, 78 aa, Sorghum bicolor
  Clone ID: LIB3478-035-P1-K1-E4.pep
ASMDADDGGELSQSILQLILSIIFIRYNIVTFGICANLFLSSPDLHLFSSTGPQFKRVKVCNPVSCWMHASKVVIKEV

SEQ ID NO: 50028 - protein, 96 aa, Sorghum bicolor
  unsure (1)..(96): unsure at all Xaa locations
  Clone ID: LIB3478-035-P1-K1-E5.pep
VSGVIQYAHAVVKDPSRGGNIMXLVSADPYAPHSERSATDNHDMTCHTVSDLEVVDRVTEYXIELELTEFXKDLTWSVNYPVERYPGTQGPYYCAD

SEQ ID NO: 50029 - protein, 143 aa, Sorghum bicolor
  unsure (1)..(143): unsure at all Xaa locations
  Clone ID: LIB3478-035-P1-K1-F10.pep
IDYLKQLQAQVQVMSRMSSMMMPMGMAMPQLHQMSVMAQMAQMAQMAQTMAQGMMNMGSLAQPGYAGLTPPMMHPPPPFVPMSWADPAAAATTSGAGAGPGPAAAXPPPSPSIPGGGGAAVPDAFSAFLACQAQQSGQQQQPG

SEQ ID NO: 50030 - protein, 34 aa, Sorghum bicolor
  Clone ID: LIB3478-035-P1-K1-G5.pep
ISHGTVHEWHRSFILNKYTCTLKDSHHTTYTQSH

SEQ ID NO: 50031 - protein, 39 aa, Sorghum bicolor
  Clone ID: LIB3478-035-P1-K1-G6.pep
CALTLCGGISNQSGLISLPIQSLFHPRSIISYNNPPLQT

SEQ ID NO: 50032 - protein, 68 aa, Sorghum bicolor
  Clone ID: LIB3478-035-P1-K1-G7.pep
YDYACKVDLKLQLTHPMIDLLLCLCYCHWYSYLTTYHKFNQQYPMLHSMVYNLVYDRMPGIMRHALDH

SEQ ID NO: 50033 - protein, 88 aa, Sorghum bicolor
  Clone ID: LIB3478-035-P1-K1-H10.pep
HPSLQVLSSSTLQLWRSGSLVSTQLMPLSCSAIGGHSPSLSAFILVHHGSSLVCQMLGIIGPLDDIHNTRYAMVSLYWMHYFRISQPP

SEQ ID NO: 50034 - protein, 61 aa, Sorghum bicolor
  Clone ID: LIB3478-035-P1-K1-H2.pep
RECGIRQTLPVVPLFERLADLQAAPAFVEKLFSTDWYITTLRAILWIFSWTQTRFHLPVWL

SEQ ID NO: 50035 - protein, 118 aa, Sorghum bicolor
  Clone ID: LIB3478-035-P1-K1-H4.pep
VRNGKNTLSWKDVWLYEKPPCVLLPDLFKFCEQQNILVNQVRDDLQSISFTRWLMDALLTDWQTVLDDMRKLNFTSEEDLVSWKSGTLGRFSVKSVYNAMTANYSGPYHRKVWKGKVP

SEQ ID NO: 50036 - protein, 95 aa, Sorghum bicolor
  unsure (1)..(95): unsure at all Xaa locations
  Clone ID: LIB3478-035-P1-K1-H6.pep
LYAMAYGTVPVVHAVGGLRDTVAPFDPFNDTGLGWTFDRAEANRMIDALHHCLNTYRNFKESWRGLXERGMAQDLSWDHAAVLYEDVLVKAKYQW

SEQ ID NO: 50037 - protein, 135 aa, Sorghum bicolor
  Clone ID: LIB3478-035-P1-K1-H7.pep
EFIVSVLVVIGWILVTGTFILCGVFLLLHNVVSDTCVAMEEWVAHPTEHTALDEVIPCVEPATANESLYRSRQVTFELVNVVNQVITNVSNRNFPPQLTPFYYNQSGPLMPLLCNPFTPNLRDRNCTPREVTLYN

SEQ ID NO: 50038 - protein, 59 aa, Sorghum bicolor
  Clone ID: LIB3478-035-P1-K1-H9.pep
GGSLLYLAMNHCTVCIRCPVRSTHDEILCDSALIHHEAFELFKITSLHYVCMCSICLSA

SEQ ID NO: 50039 - protein, 124 aa, Sorghum bicolor
  Clone ID: LIB3478-036-P1-K1-A11.pep
PLPSPASRPAAAVAVPSPCGLLRRGHRSSRPGAGPGGHQDGHRGRRLLAARATDQVPRRAQEARRAQEEGRDVVRVRQRRDAPARAAAGAPVGARRARRVRLDRVQRAVQRRAGRGGARRSAAM

SEQ ID NO: 50040 - protein, 113 aa, Sorghum bicolor
  Clone ID: LIB3478-036-P1-K1-C10.pep
MHMQGLILESKRILTEGNDLRKDPPTSCIAGPACEDMCHCQATVMDTSDSTYAASVIVANIHLWTDYRFKSSKACCTTNVLDPNINRNESICLDILTVHTSLALTSHKDLLYI

SEQ ID NO: 50041 - protein, 79 aa, Sorghum bicolor
  Clone ID: LIB3478-036-P1-K1-C5.pep
VLVKSVPSCGWVSWRQLHEPVLKRMRSQDDALCPVKHERPAVVVAVPFIAISSPLALCSSCPVASRRSRQCCLGRPLAI

SEQ ID NO: 50042 - protein, 45 aa, Sorghum bicolor
  Clone ID: LIB3478-036-P1-K1-C8.pep
LSTRTIYPLILSARITDMTIQTNVLTKRRVTIQLAHISQRTTYQT

SEQ ID NO: 50043 - protein, 161 aa, Sorghum bicolor
  unsure (1)..(161): unsure at all Xaa locations
  Clone ID: LIB3478-036-P1-K1-D10.pep
ADMAAKLASELMPSDVAKALWGTTKSSSKINKEVQELLRLTLSKARVKLTENTIFNRIIMDTNSTDPFNGLYVGAFSPYGPEIVQLRRKFGHWNSTDDVEFFEYVEAVKLTGDLSVPAGQITFRAKIGKGKRLENRXAYPEEFGVVLVIXGQGRIAQPGFK

SEQ ID NO: 50044 - protein, 101 aa, Sorghum bicolor
  Clone ID: LIB3478-036-P1-K1-D2.pep
VLGNLSYLKKVLHMYPDCSLVRNQLGSLLLWSGDWMASHKAIRVTTLLSHGHASSMGLRSPHHVQACAMVSCYATCPNYAKFSFATCEHQYLSGPDAIHHL

SEQ ID NO: 50045 - protein, 64 aa, Sorghum bicolor
  Clone ID: LIB3478-036-P1-K1-E2.pep
LKLVHNQVEDLMFELSMWRCNDELRARAEEVQSPPASKKVTKFSIEFWKQIPPNEPYRVILVAV

SEQ ID NO: 50046 - protein, 63 aa, Sorghum bicolor
  unsure (1)..(63): unsure at all Xaa locations
  Clone ID: LIB3478-036-P1-K1-E4.pep
ELIHHWFIYYTSPSPYSEVFGLQRFLQCELMHVRXAMLATLCALSVEWLTGVTXHDAGKVDLL

SEQ ID NO: 50047 - protein, 108 aa, Sorghum bicolor
  unsure (1)..(108): unsure at all Xaa locations
  Clone ID: LIB3478-036-P1-K1-F11.pep
IEGRPRTWTLYLSVHDQLYIWFEDDYALLQAIGGECYTPSNKLHSICLIRHEHMSLCGASHANPNDTDTSLSLAPAQISKRYATITCTNKDLYLTDHGSXHRTWITDN

SEQ ID NO: 50048 - protein, 38 aa, Sorghum bicolor
  Clone ID: LIB3478-036-P1-K1-F3.pep
MTDPHHLCGGTSASINNLILVFHMYQFIPGCIIQCSAL

SEQ ID NO: 50049 - protein, 70 aa, Sorghum bicolor
  Clone ID: LIB3478-036-P1-K1-G12.pep
LLYRGSKRGGSAHAHSIIYPVPPGLKGLELMGEQNTLPMALLGKLSSITMLKLVSCKDTTGDGCDPFITF

SEQ ID NO: 50050 - protein, 98 aa, Sorghum bicolor
  unsure (1)..(98): unsure at all Xaa locations
  Clone ID: LIB3478-036-P1-K1-G9.pep
SHXYFMQWHXTEIHXRHISWGTLSKLHXXYGXXISRXIQLXRMTXMDXXIFLLTXXVIXXSTLYXXYCXXWKMQTXMKSXXIEXCKXIHXXVLXXMSA

SEQ ID NO: 50051 - protein, 44 aa, Sorghum bicolor
  Clone ID: LIB3478-036-P1-K1-H5.pep
RTGTDGVMLVVVCVLEKMQASARRSVIHAQSYVLGVQRVMIVLL

SEQ ID NO: 50052 - protein, 48 aa, Sorghum bicolor
  Clone ID: LIB3478-036-P1-K1-H8.pep
SGNRALVTSFDKHSIRRFRSSFMINALAPLSVKFMLMHYVSDGSLFRS

SEQ ID NO: 50053 - protein, 93 aa, Sorghum bicolor
  unsure (1)..(93): unsure at all Xaa locations
  Clone ID: LIB3478-037-P1-K1-A11.pep
YPPMCAPLRIYTIPRHTEIQIHYTQXARTDPLVHRHQMVKTESMSLRPSTYTAAACIYGLGARTCTCTVLAVGEASPYRAVRTTSTCWYYCST

SEQ ID NO: 50054 - protein, 69 aa, Sorghum bicolor
  unsure (1)..(69): unsure at all Xaa locations
  Clone ID: LIB3478-037-P1-K1-A12.pep
AGKVYRLELSKGRGTLAVKELWKRDDTRGVXAYIRTLXKILHLYILKLNACLTGALXXLVYEYVVKGNL

SEQ ID NO: 50055 - protein, 119 aa, Sorghum bicolor
  unsure (1)..(119): unsure at all Xaa locations
  Clone ID: LIB3478-037-P1-K1-A3.pep
HYVAKDVRALLGDDAVYEAVDAEAFPEYNKARLVYFELPDRSGDIIILTYGEIDKNNYLDPRTAQVATIDHLKQTCTKLRPAEDEELPSAYIEEFRCALDVELSKYVVEAXPKGRCAIY

SEQ ID NO: 50056 - protein, 128 aa, Sorghum bicolor
  Clone ID: LIB3478-037-P1-K1-A4.pep
PRVRITQASKLTLSSRAFYSSNLGPFAKKVTELFGFDMVLPMNTGAEAVETAIKLARKWGYEKKKIPEGRAKVLSVEGNFHGRTIGIISMSTDEESRRGFGPFLENVCPQWGETLIRYNYVEDLERGL

SEQ ID NO: 50057 - protein, 93 aa, Sorghum bicolor
  unsure (1)..(93): unsure at all Xaa locations
  Clone ID: LIB3478-037-P1-K1-A5.pep
ATPSEGSNFYPNALRAVVLTSAVSQSLHELAVKVVAANMVRTDTLLSGTHLLCAVGRYXEACSQLQDAVCWNDAATLAACHLHGSDYARILYR

SEQ ID NO: 50058 - protein, 66 aa, Sorghum bicolor
  Clone ID: LIB3478-037-P1-K1-A8.pep
PSSTSHMTALRSLDARLNCLRALPDGLENLGGLETLNVSQNFQYLRELPYGIGLLVSLRELDVSYN

SEQ ID NO: 50059 - protein, 69 aa, Sorghum bicolor
  unsure (1)..(69): unsure at all Xaa locations
  Clone ID: LIB3478-037-P1-K1-C10.pep
ATAPSCTASPPTSSTHAVXGTITRYTYCGYTSGCVEHATLTNLHHXTRYHYAVCVGVYDTLRAGWFTTP

SEQ ID NO: 50060 - protein, 70 aa, Sorghum bicolor
  Clone ID: LIB3478-037-P1-K1-C11.pep
LMDFRLEKYDKVTKFSVTVSTNAQSKETSQTGEKKTYCQQELLVSSEPIKLSINRNLANIYEVQDTNSRR

SEQ ID NO: 50061 - protein, 64 aa, Sorghum bicolor
  Clone ID: LIB3478-037-P1-K1-C6.pep
PKEYGIHSVFWVVLVLGAAEIGKMLLFYCLSTSRVSFVVLVSQCLVFIRLLWVLDYNIGMLTLF

SEQ ID NO: 50062 - protein, 57 aa, Sorghum bicolor
  Clone ID: LIB3478-037-P1-K1-D4.pep
MMHDLFSVPSCFSAGEKLPDVPASAAATRSWQSAATLVYRAGIAGQDRLVTVTWCKN

SEQ ID NO: 50063 - protein, 74 aa, Sorghum bicolor
  Clone ID: LIB3478-037-P1-K1-E12.pep
LTNLAQRSPGVFFSVPSPSLLVWCGVWGRSICIPVCEMKAAAAIWRGSWLPQQLARAAIRQGSITREMARAGVA

SEQ ID NO: 50064 - protein, 89 aa, Sorghum bicolor
  unsure (1)..(89): unsure at all Xaa locations
  Clone ID: LIB3478-037-P1-K1-E5.pep
PVASYVHLRTLYSCVRPLRCGVRFXAYHRYGPXLYMIQPSGVLYKHSPAPLRKRRQADQTQIEKYILXQLTSRVGILVAPHILYRDPHQ

SEQ ID NO: 50065 - protein, 65 aa, Sorghum bicolor
  unsure (1)..(65): unsure at all Xaa locations
  Clone ID: LIB3478-037-P1-K1-E7.pep
WVLSKAETVLLLITWITIDGIMVAQEKXVVACCLCPSCLIQQSEQVVGPYISMDPQSDELNLDPA

SEQ ID NO: 50066 - protein, 126 aa, Sorghum bicolor
  Clone ID: LIB3478-037-P1-K1-G1.pep
FGASRSVPFDQTHITTLIQGTIGYLDPEYFQSSQLTEKSDVYSFGVVLAELLTRQKPISAARPEESCNLAMHLVVLFNEGRLLQEIEPHIVAEAGEDQCYAVAELSVRGLNVEGEERPTNGGGGCW

SEQ ID NO: 50067 - protein, 83 aa, Sorghum bicolor
  unsure (1)..(83): unsure at all Xaa locations
  Clone ID: LIB3478-037-P1-K1-G2.pep
WGASRSAPFDQTHITTVIQXTTGCLDPEXWQSSQRSGKSDFYSFIVHLTELLTRQKLISAARPEESCNLAMHRXALFNEGRPL

SEQ ID NO: 50068 - protein, 67 aa, Sorghum bicolor
  Clone ID: LIB3478-038-P1-K1-A10.pep
RSILASKCGVAALFIASVPLQSNALQSSAAYLASTLWITRLIRIELMSAMFSFLHMYSKILGLKPSV

SEQ ID NO: 50069 - protein, 105 aa, Sorghum bicolor
  unsure (1)..(105): unsure at all Xaa locations
  Clone ID: LIB3478-038-P1-K1-B10.pep
MYILSRLIDLQVASHPNIYVLDTPGVLSPRFANDGSGPRLAXTGAMKDSLLEEYDIVQFLLAIVNSGKEYRKWEKLNKARDTFSCGNTITFRGHNNEGQYASNHT

SEQ ID NO: 50070 - protein, 142 aa, Sorghum bicolor
  Clone ID: LIB3478-038-P1-K1-B9.pep
MAAGLALPVPAAYSPLARVSSPAHTAHRICCAIPSSSSPRTVKYPPLRAATVLSGNRRGTGRGASVVCAVQGQDANATIQVPDVTKSTWQSLVIESELPVLGEFWASWGGPCKMIDPGVGELSKDYQGKLRCYKLNTDENPH

SEQ ID NO: 50071 - protein, 51 aa, Sorghum bicolor
  Clone ID: LIB3478-038-P1-K1-C2.pep
AGLGSGIFHGSCLHSFSKKKWLISSRNGWGRRSNLDAQIYLSRLLFKRSSL

SEQ ID NO: 50072 - protein, 40 aa, Sorghum bicolor
  Clone ID: LIB3478-038-P1-K1-C4.pep
SISVLQNIVLYSNARCDLSPAMPLLVFGFRCVPRESARVR

SEQ ID NO: 50073 - protein, 138 aa, Sorghum bicolor
  Clone ID: LIB3478-038-P1-K1-D5.pep
FEHLMQPSTGSPAFRGAQPTSSSSSPFYLGGAEDGHQSQPSHSSLLHGNKQVYHGLMQLPEQHQPGSNNGLLNLGFFSGGSGGQDAPLVFPDQFNGAMGRNLPRDCRKHRNSGAHTGSRAIFSRNLMGNQMASSAGFF

SEQ ID NO: 50074 - protein, 135 aa, Sorghum bicolor
  Clone ID: LIB3478-038-P1-K1-D9.pep
YILTNAPVNDTEMTTEGYYLARCRAEKSLVDRWQIVTLPAPDCTIQDMDIFHDNLVLYLQKNGTPLFCSINMPIDVDVQEPKELDDLNPWFFPIPSELCSIVAGSNNDFMSSTYRLVVSSPVVQLLLIYVKRDFV

SEQ ID NO: 50075 - protein, 124 aa, Sorghum bicolor
  unsure (1)..(124): unsure at all Xaa locations
  Clone ID: LIB3478-038-P1-K1-E1.pep
GTDRPKYLGPLCEHTRTYLTGKFPRHYRWNTTRLSXDTKTFSQNRELEVIHLRWAMLGAHWEQLPRILTKDGVHVLQXSGSRPYTQMFSDGRLDYLGRPXLVHAQRMLYILACHVLLNGFDYGY

SEQ ID NO: 50076 - protein, 49 aa, Sorghum bicolor
  Clone ID: LIB3478-038-P1-K1-E4.pep
LASNRCTRSKISFAILQLTTCYMASAIFRSTTVVLQLLVCENPVVLNLI

SEQ ID NO: 50077 - protein, 98 aa, Sorghum bicolor
  Clone ID: LIB3478-038-P1-K1-E5.pep
MAKALLSSSLLPALPRAAGGSASRPLLLPPLRLRRGGRRAAYGCTVRAGLHGLDSIGGHDLQAKLERDEAAIYKLDDTCNRTINQQKDEPYNNNRNEY

SEQ ID NO: 50078 - protein, 112 aa, Sorghum bicolor
  Clone ID: LIB3478-038-P1-K1-E7.pep
EISVMLEASRAQYSTSNDLSVKMLNPVALLRSASSRSSSSRFLLAPSSSIDDLYDNETSSCYSEESCSTMSGSHHSTLDRLYTWEKKLYKEVKAGERLRIDYEKRLTHLRNQ

SEQ ID NO: 50079 - protein, 156 aa, Sorghum bicolor
  Clone ID: LIB3478-038-P1-K1-F1.pep
SLHLGRNDSYKDMVVEKNLRGVLRSEVDRSVSRDSIIIVDSLNNIKGYRYELWCLARASGVRYCVLFCDTEVDHCREWNSNRQEKGEPAYDSNIFEDLVRRFEKPDRRNRWDSPLFELVPSRDEIVETAPVIAEAVSYLTKKVDSKTRDVKVLQPT

SEQ ID NO: 50080 - protein, 99 aa, Sorghum bicolor
  Clone ID: LIB3478-038-P1-K1-F11.pep
IMAGIFADGPEIVSDGCREVIGSLCMAKESTDLACVGRIYHVDCQVTAYNYTASGSLYTSCRQWIESGRCKRTINRCWHTEAFHSHCDERNHWHALCRL

SEQ ID NO: 50081 - protein, 142 aa, Sorghum bicolor
  Clone ID: LIB3478-038-P1-K1-F3.pep
GRVGRLADPSDVEEADKLRSALQSWGLFKVTGHGIPVALLDGVRDAGLEFFHLPAEEKLRHANRDDAGEFQPEGYGIDRVDTDEQVLDWCDRLYLTVQPEEARRARFWPANPPSLAGLLHEYALGKQHVARPVIMGMGRLLG

SEQ ID NO: 50082 - protein, 152 aa, Sorghum bicolor
  Clone ID: LIB3478-038-P1-K1-F7.pep
LFLAQFRDDKTHSIYIVDLSGNVVKRIAGAAGGPYHRLQCTRLDRACLTTDWNRCHVLNPATGAVQALPESPAAEHVNRVNLRDPYTFFALGRVSSTGDYKVLRMFNRLGFAKGGHQLFEVFTINGGDAHARWRGQQSPGLFVDECNGVVVD

SEQ ID NO: 50083 - protein, 138 aa, Sorghum bicolor
  Clone ID: LIB3478-038-P1-K1-G1.pep
AGAMLGDSFLHQLPHAFGGGHSHSHDHEGHDHAHEHAHAHSLEDLSVGLSILFGIVLFFIVEKIVRYVEDNSQNGTHSMGHGHHHHNHKRHDSSDKAKLNHQKSDTDGKDIDHTEEEPLVDGATGKISDGHESKATIR

SEQ ID NO: 50084 - protein, 97 aa, Sorghum bicolor
  Clone ID: LIB3478-038-P1-K1-G10.pep
ISQCSPALGKQPSRFLMAAHTPPGFEPSVRTVMCCWPFRLQIRRVLDHLPVWHLCAIKCPCTSDIAPPPLHNMRPIFPPRGVSQSGQLHAESLACLP

SEQ ID NO: 50085 - protein, 153 aa, Sorghum bicolor
  Clone ID: LIB3478-038-P1-K1-G12.pep
DAWGSQVFVEMREHERRVWSVDFSIVDPTKLVSGSDDGSVKLWDMNQAGSIGTIRTRANVCSVQFQPDTSRSIAIGSADHKIYCYDLRNIRAPYCTLVGHTKTVSYVKYLDASTIVSASTDNSLKLWDLSMSRGRIIDSPIQTFTGHTNTKNF

SEQ ID NO: 50086 - protein, 97 aa, Sorghum bicolor
  Clone ID: LIB3478-038-P1-K1-G2.pep
KNVLLCVSQRSISICCTDTDIMPLELASGSCWLWGHPSNIRCWCRFLASEGLSGSGRRHRSNRCVSCLSTSRVSGSEYVIVGGPDIDIPDAVSTWIA

SEQ ID NO: 50087 - protein, 76 aa, Sorghum bicolor
  Clone ID: LIB3478-038-P1-K1-G5.pep
LQLSTCSSSITSGARPQWHSPCRWPAPHPASCPGPRECTAIGGCGEVPCPSLTPDLRRRYSGPDRPGAAGCSSHRP

SEQ ID NO: 50088 - protein, 77 aa, Sorghum bicolor
  Clone ID: LIB3478-038-P1-K1-H2.pep
PRSSFVGCRIKRTPFEGASAARAIGTTRFWILALSAKDLSRATACRLVSRLCHVEPQLGELLGLLCPRPPVAAPRRF

SEQ ID NO: 50089 - protein, 131 aa, Sorghum bicolor
  unsure (1)..(131): unsure at all Xaa locations
  Clone ID: LIB3478-038-P1-K1-H4.pep
MMASHKEFIAVDTLTQLQILIXALNADDRANAEKLKSILXASSYSNMHICDVCPYKVIDYNADSNNVFEQHXRTDEEIRYCFDGRGYSDARDQNDQGIPLAANKGGMIALPAGMYHPFTLDTVDYLKAMPL

SEQ ID NO: 50090 - protein, 49 aa, Sorghum bicolor
  Clone ID: LIB3478-039-P1-K1-A11.pep
LNVSKLDSDWGINGKTLRSLLLRNPKVLGYNIDCRGDCMAQCTRCWVRF

SEQ ID NO: 50091 - protein, 62 aa, Sorghum bicolor
  Clone ID: LIB3478-039-P1-K1-A7.pep
TIKNGRLAQSVFGLAFIILCDVVMSLVCYTATSHSNCAVCPLGGKKKQTSKKKKKKDGRSRS

SEQ ID NO: 50092 - protein, 91 aa, Sorghum bicolor
  Clone ID: LIB3478-039-P1-K1-A8.pep
PPPGASTDKTNNGAEHTHHLLVPRAGLLDGADMPAGWVLGGWHQQQLGRGSPAQEEPDAGDYDNYSLLDEGSWSPIAGEVQRDRDLDLRGS

SEQ ID NO: 50093 - protein, 52 aa, Sorghum bicolor
  Clone ID: LIB3478-039-P1-K1-A9.pep
LFAFTFLYLSLFWQKPLEIYSYIMFTNYGLLEHKAECITSLSIPLLSTTWMH

SEQ ID NO: 50094 - protein, 165 aa, Sorghum bicolor
  unsure (1)..(165): unsure at all Xaa locations
  Clone ID: LIB3478-039-P1-K1-B1.pep
SLPNPAIVRTNMTTRMDKSICSWWDGPGISEVMDRIELSLRDRKGTRRMPMIDKYKDMGTRXMGKIESDTIREGDRLLLMPNTFHVKDRHLNSDESKIHRAGPAENVRVKLCELEEEDAMAGXRLSRSANAAGAARQYIDALQILEXVDNAILTDSYKAVIHIHS

SEQ ID NO: 50095 - protein, 175 aa, Sorghum bicolor
  Clone ID: LIB3478-039-P1-K1-B10.pep
TSPLYSAAVKDHLDVVNAILDTDDSCIRIVRKNGKTSLHTAARIGYHRIVKALIERDPGIVPIKDRKGQTALHMAVKGKNTDVVEELLMADVSILNVRDKKGNTALHIATRKWRPQMVQLLLSYDETLEVNAINSQNETAMDLADKVPYGESKTEIIEWLTEAGAKNARNVGKID

SEQ ID NO: 50096 - protein, 106 aa, Sorghum bicolor
  Clone ID: LIB3478-039-P1-K1-B2.pep
RMVRSSHDIRMSARIGVLWYATEIPKESSTFRDVDTEGVCRAIMQYNPLLNPRSYHFNRDLYGRCLPESWQDRYLCLFRFRGNIRRLQSGGSGSHSDGAGQYRRYS

SEQ ID NO: 50097 - protein, 72 aa, Sorghum bicolor
  Clone ID: LIB3478-039-P1-K1-B4.pep
LVPSTIERFGIDTTCTFIGLRSLHEPIVEFQDLRRPAVVRRRWLTCWTTGTDYLFKSALIGDFSDCEGHICL

SEQ ID NO: 50098 - protein, 109 aa, Sorghum bicolor
  unsure (1)..(109): unsure at all Xaa locations
  Clone ID: LIB3478-039-P1-K1-B7.pep
RALPTPAIARTNRTTRTTKSTSTSWRCERGHSNYSHVWNLLPATANEQLRHHDSLIVDRLLHILQDXLHDPSPIKYGHKCYEVPNNYHGKKDTFKLGEIRAQLTGLAPN

SEQ ID NO: 50099 - protein, 125 aa, Sorghum bicolor
  Clone ID: LIB3478-039-P1-K1-C11.pep
CYFFFFFLGSVFYFIVPGGIPPCLKGFRASLLSSNPRNLLFLQNNLTPPPSFWGFFTLSKSQKNTSPHPLGDPLVHQHRSCYPRAQFSLLIIRLEDRTITLLFFLPNNKPSVPRVVGGHQQKEVL

SEQ ID NO: 50100 - protein, 72 aa, Sorghum bicolor
  unsure (1)..(72): unsure at all Xaa locations
  Clone ID: LIB3478-039-P1-K1-C6.pep
MPDFSIFRGDVCSDDLTIIELXEACTATFGRQTTVKDKRWMKRPLTMGLTNSYDVASSRCVRKDYKVAGTDA

SEQ ID NO: 50101 - protein, 171 aa, Sorghum bicolor
  Clone ID: LIB3478-039-P1-K1-C9.pep
RYLWKKQIHKLLYGGKKTSIQEVLCLDKEGSHLEICDQDFFKLEISKIKETTLQWLAKAEKVACDSGELALDLVYGLIAEGENLSVHFEKELKLLRDRCVLYCICRKPYDNKAMIACDQCDEWYHFDCINLLGPPPETFFCPACHPNNEESVLLARSEHDEDRSSTGARAH

SEQ ID NO: 50102 - protein, 57 aa, Sorghum bicolor
  Clone ID: LIB3478-039-P1-K1-D8.pep
FSPHHDHYYPGAERRPDMPSVPMSVLINRHPLFRLRWHTLDLRLREPMGDSLWEDRG

SEQ ID NO: 50103 - protein, 73 aa, Sorghum bicolor
  Clone ID: LIB3478-039-P1-K1-F11.pep
MALEWVVLGYAAGAEAIMLLLLTLPDLDCLLRRMICVVRSALKPMMWAALLCLCLLMDIYWKCQTRPTCDDEH

SEQ ID NO: 50104 - protein, 62 aa, Sorghum bicolor
  Clone ID: LIB3478-039-P1-K1-F12.pep
QLREPCDSFLTLMSTAPRFIPLELHSPLIRSSSPSRLGVGLSPLWKCLLWHDSCHRPGWMSV

SEQ ID NO: 50105 - protein, 100 aa, Sorghum bicolor
  unsure (1)..(100): unsure at all Xaa locations
  Clone ID: LIB3478-039-P1-K1-G2.pep
CWQRVGSADGLINVKDYEGDPVLTIPDAKALLHDISSSAVDNPXHALQRALAYMLNNPKVTAKATDELDRVYRRQRLVLETDIAKLYYVNAFIPEAVRLH

SEQ ID NO: 50106 - protein, 141 aa, Sorghum bicolor
  Clone ID: LIB3478-039-P1-K1-H10.pep
HASGPSHGWEAGICLPKVLGDVIESIAGAIYIDTKNDKKVVWRKMKRLLEPLATRDTLEIDPVKELHEFCDPKTCSIKYTVAREDRVTFVAREIQTKGTTYKATLTGLTKRDAKKLAAKSVLKDMKAANSTQHFANGISCT

SEQ ID NO: 50107 - protein, 44 aa, Sorghum bicolor
  Clone ID: LIB3478-039-P1-K1-H11.pep
LEVHQNKLNDLQLALAAAVAEKEEASEEIHSLRKTLDRMIGRKA

SEQ ID NO: 50108 - protein, 35 aa, Sorghum bicolor
  Clone ID: LIB3478-039-P1-K1-H2.pep
ACIKYYQAFSTKLSYERTYVSSLDTTLAALRTSPG

SEQ ID NO: 50109 - protein, 143 aa, Sorghum bicolor
  unsure (1)..(143): unsure at all Xaa locations
  Clone ID: LIB3478-039-P1-K1-H8.pep
NQSSQRPNDVWVTVSDIALVTLPTSAPAALRPAPALAAKKPPTECATSEAYAHHHNXGCHHSGCSNTSKTSHIDESEDFFMAKPANFGSGHTQVLKRARNGHYPSAATARFMDWTEMGHSKGGNHRAFDSMFTSNQDRQPEID

SEQ ID NO: 50110 - protein, 56 aa, Sorghum bicolor
  Clone ID: LIB3478-040-P1-K1-A9.pep
RVRHGWISLFIVWTIEITSYVNYETHCTSMRSIDPANTLKEKTLLEQAHARYTPML

SEQ ID NO: 50111 - protein, 62 aa, Sorghum bicolor
  Clone ID: LIB3478-040-P1-K1-B2.pep
TDKASMLDEVIDYLKQLQAQVQVMSRMSSMMMPMGMAMPQLHQMSVMAQMAQMAQMAQHGQA

SEQ ID NO: 50112 - protein, 71 aa, Sorghum bicolor
  unsure (1)..(71): unsure at all Xaa locations
  Clone ID: LIB3478-040-P1-K1-B7.pep
MAHYWSSLLMVISCTAIDDSQIKEGSFGEGRITMRKSSDNPNVVELCSPXYGPDRLKDLGPLCCEPSSYAY

SEQ ID NO: 50113 - protein, 63 aa, Sorghum bicolor
  Clone ID: LIB3478-040-P1-K1-C9.pep
SMSSRKRFTRTHTHFHYWRYGMHLRHRTPGFYVKHEGVKKDIHAKVQMELIIDTGEHYIFTYY

SEQ ID NO: 50114 - protein, 88 aa, Sorghum bicolor
  Clone ID: LIB3478-040-P1-K1-D12.pep
SQTPSASYCISNMIVPILHAKKLPYKYFVSPLHVKKSFRKCPIIVSAIHNNVWLFLYDIDIHYDNLGKEPCCCIKRIVVICVDETVKN

SEQ ID NO: 50115 - protein, 86 aa, Sorghum bicolor
  unsure (1)..(86): unsure at all Xaa locations
  Clone ID: LIB3478-040-P1-K1-D6.pep
HRPIRLVDDANVGTAKHFEYMFYVDFQAWVAEPRAQNALAEVQEYTSFLRVLGSYPMDMTPMTXAGSSTTISSSDGPSSSSSSSSS

SEQ ID NO: 50116 - protein, 138 aa, Sorghum bicolor
  Clone ID: LIB3478-040-P1-K1-E10.pep
VGDNRAHAASARVPHLTALLVDFRQARPVAGTDRCDLPRADVHCTALLERHTLRSKGAYGDPDDIDTRYIMWLNYLLQNEISHLRCLTLILEADMETHIVYLMTVVLKYELKPPGLNIKVNVETIHESVELVPVHILT

SEQ ID NO: 50117 - protein, 75 aa, Sorghum bicolor
  Clone ID: LIB3478-040-P1-K1-E5.pep
SLLREARVTMRKTAAKANPDDAYGSPWYGPDRVLYLGPLFGEPPSYLTGEVRGDYRWDTARVSGDPETFAKNREL

SEQ ID NO: 50118 - protein, 113 aa, Sorghum bicolor
  Clone ID: LIB3478-040-P1-K1-E9.pep
AENGETLADHPKKEEGDLQKDTGTIVQHCDALACDRESVCSSCEEPRYGLNGEPSDLSSESYSGLTPTLNTGGKLPMVSEDPVNNLEPNMTDGVTSDSTYRELNPEVSTRNEM

SEQ ID NO: 50119 - protein, 57 aa, Sorghum bicolor
  Clone ID: LIB3478-040-P1-K1-F2.pep
ILDTFLGTEAYFGFQKQNRATMRLFSGAGSDSRVPKNVLDAPATHEASHDQRLVLLP

SEQ ID NO: 50120 - protein, 74 aa, Sorghum bicolor
  unsure (1)..(74): unsure at all Xaa locations
  Clone ID: LIB3478-040-P1-K1-F6.pep
GYKPGDLSCLKLEASTSGKMAAPPLGLACEGRRGLHHTGGGAFRFPPPTSRPWSPPFKEMERGGEDGGGGXRKA

SEQ ID NO: 50121 - protein, 63 aa, Sorghum bicolor
  Clone ID: LIB3478-040-P1-K1-G12.pep
PTSEIRTSLTFCTHHLMCASTHTRLAMRHQYLEGRRRRDEMNVPVAGREDEKRRQERHVRPPS

SEQ ID NO: 50122 - protein, 42 aa, Sorghum bicolor
  Clone ID: LIB3478-040-P1-K1-H4.pep
NKSHICHFYYCYNPTLSFILHVLSSMFKQVFAFNLLKIISLF

SEQ ID NO: 50123 - protein, 63 aa, Sorghum bicolor
  unsure (1)..(63): unsure at all Xaa locations
  Clone ID: LIB3478-041-P1-K1-A5.pep
ADGNFVAPFDVDDIDIYSGESYSVLLTTDQRASSSSYWISVSVRGXPPKTPAALAILNYTNSK

SEQ ID NO: 50124 - protein, 87 aa, Sorghum bicolor
  Clone ID: LIB3478-041-P1-K1-B6.pep
FSTSSPSSHRKQAGRQPAMAMASSSGLRSCSAVGVPTSWPVAGGSAAASAHATLGGTIRSDAAAAALRLRLVTCAGEYVGRHRHGRR

SEQ ID NO: 50125 - protein, 70 aa, Sorghum bicolor
  Clone ID: LIB3478-041-P1-K1-B7.pep
TGQTQDKYMMLQVPRRRISTSISYTIPCSSVVEKKKKNVMLTAWTGCCWARSAAAGSSSGTAPPSYCTPP

SEQ ID NO: 50126 - protein, 73 aa, Sorghum bicolor
  Clone ID: LIB3478-041-P1-K1-C1.pep
MQLYHHPYSLDSQKVRMALEEKGIDYTSYHVNPLTGKNMNVDFFRMNPSAKLPVFQNGAHVIYRAIDIIQDID

SEQ ID NO: 50127 - protein, 38 aa, Sorghum bicolor
  unsure (1)..(38): unsure at all Xaa locations
  Clone ID: LIB3478-041-P1-K1-C12.pep
AYTFLYWLPFYISHTAIGGQYLSDSEAGVLSTLFXRGW

SEQ ID NO: 50128 - protein, 73 aa, Sorghum bicolor
  Clone ID: LIB3478-041-P1-K1-C2.pep
VSAQHTFIFEDSPSGIRAGVAAGMPVVGLVTRNPENSLLEAGAALLIKDYEDPKLWAALDEIDREEAKLKASA

SEQ ID NO: 50129 - protein, 49 aa, Sorghum bicolor
  Clone ID: LIB3478-041-P1-K1-D1.pep
AVVLMNDDTFNLFAVNSFLIVLLTKALFVSVWHGLLCFSLQLESRDCGF

SEQ ID NO: 50130 - protein, 62 aa, Sorghum bicolor
  unsure (1)..(62): unsure at all Xaa locations
  Clone ID: LIB3478-041-P1-K1-E5.pep
LVVVTXTVIMKAPIASKNPIFFSEHDFIITATSFYYPREKESLLVRGYNGPSSKDKTIVEGG

SEQ ID NO: 50131 - protein, 84 aa, Sorghum bicolor
  unsure (1)..(84): unsure at all Xaa locations
  Clone ID: LIB3478-041-P1-K1-F11.pep
NSPNILVYNLKRLYFIVPLXSTKKLSYRVALPLKLKLTNTSYHMYSXYSFLTELNHVXSXPNHSHYISLAITINHSLFFDDQNL

SEQ ID NO: 50132 - protein, 100 aa, Sorghum bicolor
  unsure (1)..(100): unsure at all Xaa locations
  Clone ID: LIB3478-041-P1-K1-F7.pep
VLCTDCYINHINGKLQVMVXYSDSAKDDRRVSMVWHVDVALDEICNVDNKYRVHLTLVHXRRRILGPCCGPTHLCIMSQAADTSNRSIRMTVHIEVIELM

SEQ ID NO: 50133 - protein, 60 aa, Sorghum bicolor
  Clone ID: LIB3478-041-P1-K1-F8.pep
VLVIDEYVVFRLILFSTSSLVGTSLEVEQAESSIPVEKEKFTILLCLIFQNQFCSPFWKT

SEQ ID NO: 50134 - protein, 71 aa, Sorghum bicolor
  Clone ID: LIB3478-042-P1-K1-A1.pep
TAIVNDALKLMTSYSDYDSGTGCVYIENSSGLYDKEYAQQTMDRTYEVQELHGNLTKEMHANGQDNIYILA

SEQ ID NO: 50135 - protein, 64 aa, Sorghum bicolor
  Clone ID: LIB3478-042-P1-K1-B11.pep
IINRLRTHEMGLLCISIHVHHKYTRVFQWDKQKSVIHMTTSIYPQLLKLNMSGFCMILLLALVI

SEQ ID NO: 50136 - protein, 49 aa, Sorghum bicolor
  Clone ID: LIB3478-042-P1-K1-B7.pep
PIPIAFAEILGQNALPSSSTLFPVSNREFPLPYIGLMFPSVTSPVQSWA

SEQ ID NO: 50137 - protein, 65 aa, Sorghum bicolor
  unsure (1)..(65): unsure at all Xaa locations
  Clone ID: LIB3478-042-P1-K1-B8.pep
MTGLHSPSSSALLARPVLHSLLALASDVVYVILALPPPXXSTRPERGAELPRRWVVKALLASAER

SEQ ID NO: 50138 - protein, 82 aa, Sorghum bicolor
  unsure (1)..(82): unsure at all Xaa locations
  Clone ID: LIB3478-042-P1-K1-C8.pep
LVPAFRXAPFPWLFAPCRVXFWXXXCLSVVCVXCFLFSVACGLLGARVPCVGSPPRFSSPLVLVCFYIVWLRGFFFFFFFFX

SEQ ID NO: 50139 - protein, 41 aa, Sorghum bicolor
  Clone ID: LIB3478-042-P1-K1-D9.pep
VFITDIIYFTFVIFYLFFFFLNEKNYQLQSFITFRDIQLSF

SEQ ID NO: 50140 - protein, 94 aa, Sorghum bicolor
  Clone ID: LIB3478-042-P1-K1-E11.pep
LLRSALFNPRGQHVEGVPELADEESTVEAQEDVPEDEEMQDPPPSQPAQLANARLGWTTVLWFPESDPKAFFHEHLVLTLNHYYPDLQATLEYC

SEQ ID NO: 50141 - protein, 83 aa, Sorghum bicolor
  Clone ID: LIB3478-042-P1-K1-E2.pep
ASLYLFYLLWSLKKVGSLILFFPWYSLLFCSLLAFISHWPFIDILLFGFLHRFSPHKHEISSWHDLRAFIKNLVVILPKILTC

SEQ ID NO: 50142 - protein, 50 aa, Sorghum bicolor
  Clone ID: LIB3478-042-P1-K1-E3.pep
KTLCFFWYLYASFVLSAFKGSRCISSDQANSVQQLRQLFSLNVIFYQKMD

SEQ ID NO: 50143 - protein, 87 aa, Sorghum bicolor
  unsure (1)..(87): unsure at all Xaa locations
  Clone ID: LIB3478-042-P1-K1-E4.pep
RGKKRGEKKERDREREGGGGHHPIRRLVLTGSVSIWAAPYAXXGRDQRVVISSIFXSARELLAFTMVDKNDGSEGLKFNTLNLIQTT

SEQ ID NO: 50144 - protein, 70 aa, Sorghum bicolor
  Clone ID: LIB3478-042-P1-K1-F3.pep
YYISSYLFRDIKSSNILLMNNCRAKVADCGCAKLAPTDASHISTQVKGTAGYLDPEYLRTYQLNEKSDVY

SEQ ID NO: 50145 - protein, 87 aa, Sorghum bicolor
  Clone ID: LIB3478-042-P1-K1-F6.pep
CEVYNLGTGQGTSKGAMVAAFEKVSEKKIPLKIAVLIPGHTHIDSAITDNADNDLKWEAKYKIKDMCKDLCNCASNNPYRYACSHDN

SEQ ID NO: 50146 - protein, 125 aa, Sorghum bicolor
  unsure (1)..(125): unsure at all Xaa locations
  Clone ID: LIB3478-042-P1-K1-F8.pep
HLGHAKTHFEEALSVRDRTIEATKLVLRCARNKSAPGKMTRETIMKYSTRVSYQMDVVKALNSIDGPQWKTSLFGNPTDPETLRRRCIVXETLAEKHIDLAFRMLHEXDLPAVDIYAGVAASLAE

SEQ ID NO: 50147 - protein, 90 aa, Sorghum bicolor
  unsure (1)..(90): unsure at all Xaa locations
  Clone ID: LIB3478-042-P1-K1-G4.pep
HARLIADFRPGGEXSALLDMQPMKLFREESAGLYAAEVVIGLESMHLLGIIYXDLKPDNILLQEDGHNCLTDCDLSFLTYSKPDVIKHST

SEQ ID NO: 50148 - protein, 122 aa, Sorghum bicolor
  Clone ID: LIB3478-042-P1-K1-G8.pep
KFLDLAYNKFSGSIPSWIGEISSDLSFVRVRSNMFSGGIPIQITRMKGLQYLDLACNNFTGNIPLSLGNLEAMAHTPNNNSALFSVTNTGFCGVFLYRPVRTDSLLVVTKGQQLEFASGIAY

SEQ ID NO: 50149 - protein, 129 aa, Sorghum bicolor
  unsure (1)..(129): unsure at all Xaa locations
  Clone ID: LIB3478-043-P1-K1-A1.pep
RGSSXGWRSALFVVGVEIAGSFAYFGISANLITYLTGPLGQSNASAAASVNAWSGTACLMPLLGAFLADAYLXRYRSVIIACTLYVLGYGMLTLXATVPVLRPSHVPCREEDDGDGGVSWSWSSAHSCH

SEQ ID NO: 50150 - protein, 141 aa, Sorghum bicolor
  unsure (1)..(141): unsure at all Xaa locations
  Clone ID: LIB3478-043-P1-K1-A8.pep
INFGCPQRIARRGNYGAFLMDNLPLVKSXVQNLAANLHVPVSVKIRVFPRLEDTLAYAKMLEEAGASLVAVHGRTRDEKDGKKFRADWDAIKAVKDALRVPVLANGNXRHMEDVKNXLEHXCADGVLSAETLLENPHFLLV

SEQ ID NO: 50151 - protein, 56 aa, Sorghum bicolor
  Clone ID: LIB3478-043-P1-K1-C11.pep
MGIRRQHGAATIVLGIILELVLFRLATSQSFIGVNYGTIADNLPPPASTASLLMST

SEQ ID NO: 50152 - protein, 72 aa, Sorghum bicolor
  Clone ID: LIB3478-043-P1-K1-C6.pep
SWHIQTNLHLKLQDHRNFNYCNFCTSMPQRAKVGTSCVHSPCACKIMEQREKQKKRNSKYSFYYIIFRPTRP

SEQ ID NO: 50153 - protein, 136 aa, Sorghum bicolor
  unsure (1)..(136): unsure at all Xaa locations
  Clone ID: LIB3478-043-P1-K1-C7.pep
AVLGAQLVAKVTGENTVRTPAKANLKVEIKGFIHIGRNFLRSWHRRXDCPLDFLVENDSGSDRNAFNLLKYDLMLDTLKADVKIDDNTTINVNGKPISMVFSMDPIKLPWAELWIDIGIDGTIVFIDGPGDGKHIQ

SEQ ID NO: 50154 - protein, 96 aa, Sorghum bicolor
  Clone ID: LIB3478-043-P1-K1-C8.pep
MHKMAQQRAGAVYGLGGPGARDAAPAGEAQRARVLPIETLLLAAHVMLRVDTMTAMLRDQQSNDVGTVIYFYLEGCKHLWYLNGLCRCYLLECALY

SEQ ID NO: 50155 - protein, 112 aa, Sorghum bicolor
  Clone ID: LIB3478-043-P1-K1-D10.pep
VGVHSCASYIARDQPVLGLHLLHIESSLFLFSCRLCWLLDVIGQGSIDVVHCRQIFLGVGDSAGTDLGRLLILEILGHVHHLCTPERWLSWRMTSWSARRASEVGLEAVEVA

SEQ ID NO: 50156 - protein, 150 aa, Sorghum bicolor
  unsure (1)..(150): unsure at all Xaa locations
  Clone ID: LIB3478-043-P1-K1-D11.pep
LAFGAAFAVFLTLEMIRIWEIYPLGHVVHQFMNAFTDHRDSEILIVSHFSLLLGCALPKWMSSGLNDRPLAPFAGILSLGIGDTMASMIGYKYGVLRWSKTGKKTIEGTAAGITSVLAACSILVSLLASSGYILSQKWLSLLIAVTXSGL

SEQ ID NO: 50157 - protein, 93 aa, Sorghum bicolor
  Clone ID: LIB3478-043-P1-K1-F1.pep
RARSIAPTPTNKHSADGCLYDLDAIYTNAVRQGTRTDSRRSLHLLLAHTLHHRQVEQDRQALRDWRRPDRRQRCLTEECKGQGRTPHSQQAPN

SEQ ID NO: 50158 - protein, 68 aa, Sorghum bicolor
  Clone ID: LIB3478-043-P1-K1-F10.pep
RRSTDLIPTTAYAASRPPILVHPPYVRAPTMATTEMATTTASLLVLLGHSTRASDGRFRSTTTTHIAA

SEQ ID NO: 50159 - protein, 65 aa, Sorghum bicolor
  Clone ID: LIB3478-043-P1-K1-F11.pep
MATTEALFTGINHTQICRWRATLGKPMQGHGLGMDRERAQSITCQAASMIIAGRVPNMAKQTLMN

SEQ ID NO: 50160 - protein, 115 aa, Sorghum bicolor
  unsure (1)..(115): unsure at all Xaa locations
  Clone ID: LIB3478-043-P1-K1-F5.pep
LQSRSVFVKNLNFKTTDESLKQHFSAKLRSGSLKSATVKKHVKKGKTVSMGFGFVEFDSVETATXVCKDLQGTVLDGHALILQLCHGKKDGQAAKKNGKDKSSTKLLVRNVAFEA

SEQ ID NO: 50161 - protein, 50 aa, Sorghum bicolor
  Clone ID: LIB3478-043-P1-K1-F9.pep
GRRMNNQRWVPIDLILAVNRMRAFTVLVERRLHIICCPGIYMYWKGREIM

SEQ ID NO: 50162 - protein, 94 aa, Sorghum bicolor
  Clone ID: LIB3478-043-P1-K1-G4.pep
SILPSMSRASLNCIYDSIGVQRISKAVTENDAFTLDNYHFRTVDPSKVIKVGLLKIILSFLADPALDIPAEKRHRMVSCLLNVTVQESDEPITV

SEQ ID NO: 50163 - protein, 137 aa, Sorghum bicolor
  Clone ID: LIB3478-043-P1-K1-G7.pep
MAMARDGLLPSFFSDVNKQTQVPVKSTIVTGIFAAALAFAMDVSQLAGMVSVGTLLAFTIVAVSILILRYVPPDEVPLPPSMQESFHLNQECDEETDRGLLGVGNCNLSQTKNVIVVVESVKDPLIDKRLHKGKMDE

SEQ ID NO: 50164 - protein, 64 aa, Sorghum bicolor
  Clone ID: LIB3478-043-P1-K1-G8.pep
GGEGRGGECTFFQHHLLLLPQLLESNGGGGTLLYVGHCLHQVHPYPQGALIFLHLLVHHFRQHS

SEQ ID NO: 50165 - protein, 142 aa, Sorghum bicolor
  Clone ID: LIB3478-043-P1-K1-H1.pep
ATRNAKQVTMHAALGTKPAGAVRCGTARMPDPMLVPTISATAPATLPLFSPRDGDAGAGAPGPGRSADLPMALAIRARHSWPGVVTRALAHGTGAAAPCTQVAAAEASRHTDAYCRAAERGAADLWAPRPAGDGPFHRRGIS

SEQ ID NO: 50166 - protein, 116 aa, Sorghum bicolor
  Clone ID: LIB3478-043-P1-K1-H8.pep
SLVRSLPAKSSKKLNKELFDKPCDGPRAEIVMHSAGTDASASNCIYEGKTIIESTNGGATRADAALEDTDDQIDEHSDESLDHYRADDLDNELYSLEDWYEGSYQKPSITLESGIG

SEQ ID NO: 50167 - protein, 74 aa, Sorghum bicolor
  unsure (1)..(74): unsure at all Xaa locations
  Clone ID: LIB3478-044-P1-K1-A11.pep
IRKNMKRSVLFSETSVAATEDGRRFSAKQKRVKIIVXSHNHIKRHRACSFSHIGRLSLIITLSCEEDCAESGSP

SEQ ID NO: 50168 - protein, 112 aa, Sorghum bicolor
  Clone ID: LIB3478-044-P1-K1-A6.pep
IHLLFSRVHGQLCQLPELQARVDQGNLIEQMCRQMIKAQEHEVLSRVVDIADVNMSADSPCVYRSPAYVPLASSLISSSVALAAALVCKPSSAYMVSFSPSLSSPFGSTRAL

SEQ ID NO: 50169 - protein, 44 aa, Sorghum bicolor
  unsure (1)..(44): unsure at all Xaa locations
  Clone ID: LIB3478-044-P1-K1-B9.pep
RQRLRADLKLGRLKDLVSRYADHTXAALDDLLYKLLRIEPSIRV

SEQ ID NO: 50170 - protein, 53 aa, Sorghum bicolor
  unsure (1)..(53): unsure at all Xaa locations
  Clone ID: LIB3478-044-P1-K1-C11.pep
PRQIILXIHIYIKYYNSRVGITIHTHQLQIHIQSLKNIYNNTFSLTTLISLSI

SEQ ID NO: 50171 - protein, 66 aa, Sorghum bicolor
  Clone ID: LIB3478-044-P1-K1-C5.pep
VFSKCYTKVIRRPMVQMIALQLPRFRDPLLELILPRRLAPDSSSQCILVKAMSCDCIFIPCCSRAR

SEQ ID NO: 50172 - protein, 159 aa, Sorghum bicolor
  unsure (1)..(159): unsure at all Xaa locations
  Clone ID: LIB3478-044-P1-K1-C7.pep
PRVRIPVTNILSRFCKGSGFASSKNGESWSSATFQVLLRETCIHEQELFFSFLNRLFNTLSWTMTEFSMSIREMHDKNQVADLQQRKCSVIFDISCCLARILEFCTREIPCAFLMGPDMXLRXLAELVXFILNHIISAADASSLHDTERQGASRETNRL

SEQ ID NO: 50173 - protein, 125 aa, Sorghum bicolor
  Clone ID: LIB3478-044-P1-K1-C8.pep
GNLGDQSSWPVHKVRPVPCAGAAAAATFIIAGEASAERRARALEPPNSSWLEPRSIRSSTFASLHVIESGRKSRAGGNGEGRSVVLLRAGRGLGLRWSPADTFPGGRRWFERHRGAYSSASSVSK

SEQ ID NO: 50174 - protein, 116 aa, Sorghum bicolor
  unsure (1)..(116): unsure at all Xaa locations
  Clone ID: LIB3478-044-P1-K1-D4.pep
AAIDANVSSPPLLSKKDSCDYDRVYSNLATGTPPRTPLHPLAESYWEKQWRNLHNGGTVSNDGTTPKESDKGLSYKRSLKQSLSQKLGLSRTESDPSPVKIVSVKSDTXNSVRRCL

SEQ ID NO: 50175 - protein, 51 aa, Sorghum bicolor
  Clone ID: LIB3478-044-P1-K1-E10.pep
AEDAHSDSTHVLSTASGTHITCGLFLSRSAWHTCPRAVTLRTDCVIYLKVS

SEQ ID NO: 50176 - protein, 110 aa, Sorghum bicolor
  Clone ID: LIB3478-044-P1-K1-E12.pep
GSARSLYLISQLSGPLIAGWHSIVPAAGEWAPTRSRRLQSALSLSQDKKLAKNERYTIRKRGKRERRSEAPPARGNINGSVHRKLIRLLSIVPFSCRTGPVYYSPTANHA

SEQ ID NO: 50177 - protein, 101 aa, Sorghum bicolor
  Clone ID: LIB3478-044-P1-K1-G11.pep
PYFAKRLLTDPNPYLRDALIELLFKDGGWRWNRLENLLVQGRQDREFAAKDALQPVLKLLLGPDGEELRVLVVKEAVRVTEAITIGTLIDSYNAASAFLRP

SEQ ID NO: 50178 - protein, 51 aa, Sorghum bicolor
  Clone ID: LIB3478-045-P1-K1-A3.pep
DDSSDSVVDDDDHISKFEKEVEETFQRALGGGVNRDNLILEINGLRLAYSL

SEQ ID NO: 50179 - protein, 85 aa, Sorghum bicolor
  unsure (1)..(85): unsure at all Xaa locations
  Clone ID: LIB3478-045-P1-K1-D12.pep
LQLGNSXQRKGEKQXAHXYSEDITEKQAKMGLVWRVHSNDKSXFKLLYYELRENGRLSLALQEDSVKAGEDTAARMDILGXPENR

SEQ ID NO: 50180 - protein, 64 aa, Sorghum bicolor
  unsure (1)..(64): unsure at all Xaa locations
  Clone ID: LIB3478-045-P1-K1-H12.pep
AAXCVGEICKNGGASALKYYGDIXSSLHNLFGNLESDDAVREYAAGVIXRMIMVHXKSIPLNQV

SEQ ID NO: 50181 - protein, 63 aa, Sorghum bicolor
  Clone ID: LIB3478-045-P1-K1-H7.pep
VGMILANTEESGEELIADSHLVPATMVGQKFGDKIRYYVQTDPSPTATIMLRGTGIGKSPSAP

SEQ ID NO: 50182 - protein, 143 aa, Sorghum bicolor
  unsure (1)..(143): unsure at all Xaa locations
  Clone ID: LIB3478-046-P1-K1-A10.pep
MASGLELTEHAPCSSLRNLQGFRKIDPDRWEFANEGFLRGQRHLLRLIKRRRPAPPAPYLQASQSQSQGSCLEVGQFGXLDREMDRLRRDTSILLAEVVKLLQEQRSTRSGMRAMEERLQHAXHMQVPMIGFLWLAMLRPAFY

SEQ ID NO: 50183 - protein, 145 aa, Sorghum bicolor
  Clone ID: LIB3478-046-P1-K1-A11.pep
PAQTTPAAGRFPPRTPPPDLRRPILPAWPKPTRPALPLPCRVPAGSPSKHDNPTPPAPPHHRNQPYPNQIGSYPLPLPSPNSLRSAATARWTTTTTCRTPSPRRRPPPPRSPWTGPSPSPLRRQAPPWRSRSRTIRPRRSCTPAP

SEQ ID NO: 50184 - protein, 95 aa, Sorghum bicolor
  Clone ID: LIB3478-046-P1-K1-A3.pep
RPPQRHLLNEMGLICHVEHPPKCISNYLATLEAPTELNQEVWNLANDSGGTTLCVRIKSEVVACGVVYAAARRHRVPRPVEPATRTDRDAYQARI

SEQ ID NO: 50185 - protein, 78 aa, Sorghum bicolor
  Clone ID: LIB3478-046-P1-K1-B10.pep
DRPCKGSRHSAAMILHPPQRNIQSWCSLISGRSAIYGHQTAASFGTCSPSCGIASAVSISPTMEIAIAYRQARRAWSV

SEQ ID NO: 50186 - protein, 52 aa, Sorghum bicolor
  Clone ID: LIB3478-046-P1-K1-B4.pep
IDPYSIRLLERVKKMARILFGLWSMKRLHKSAPAFLLINCFLFFPTSIACNL

SEQ ID NO: 50187 - protein, 84 aa, Sorghum bicolor
  Clone ID: LIB3478-046-P1-K1-C8.pep
CRRLSAPKRTWHPQAAHGSPSAAGEGTPAAGPGSQLRYGSPLSLHHWSAFRVMALRSPRRLVVVGSAGKPSAGVQLQAAFRTRG

SEQ ID NO: 50188 - protein, 99 aa, Sorghum bicolor
  Clone ID: LIB3478-046-P1-K1-D7.pep
SIKQIQRSQDIYDARRAPCTFLNRACLSSSSNRILINFLQKLYRSNKYWNCKDVELSKAQGLETTRIYAGSCCPKCQGETMDYTLNPGEEKVSELYYKI

SEQ ID NO: 50189 - protein, 143 aa, Sorghum bicolor
  unsure (1)..(143): unsure at all Xaa locations
  Clone ID: LIB3478-046-P1-K1-E12.pep
IKRDLDLATRLVRKLDNELGDDYFGVAKIEERVHQLSESGQLQPVVPPKPEANDEMDEGEEEEEGMIEEDEADDEELLTKKKKLDLXVEYLRRVYNFCFLCVFESDSVHELQRKCSGGHLRRPRAYLTTAAKETARASASGEA

SEQ ID NO: 50190 - protein, 103 aa, Sorghum bicolor
  Clone ID: LIB3478-046-P1-K1-E9.pep
SSYMATSLHDDITELQNFLLEDDDVNFGMGSENMALERIHAPEDIGELIHGFDTQEELELGSGPELLEMPPASGPLCHDPTICRSNGKNVLCTCLDATLSEAN

SEQ ID NO: 50191 - protein, 94 aa, Sorghum bicolor
  Clone ID: LIB3478-046-P1-K1-F5.pep
SRCGRSRIIPCLPHQLSYRYDDVVGRLQLHLPLRRDQLHGVGGLRSQPVTAGHGRRAAQRWREALVLAQHGERRRLLARVRCSGRWPLYVVVGA

SEQ ID NO: 50192 - protein, 33 aa, Sorghum bicolor
  Clone ID: LIB3478-046-P1-K1-F8.pep
LIGFIIFRRLHPVWNNNDYIVPLNNRDNKGRLF

SEQ ID NO: 50193 - protein, 101 aa, Sorghum bicolor
  unsure (1)..(101): unsure at all Xaa locations
  Clone ID: LIB3478-046-P1-K1-F9.pep
QGHEAARVRPGVAEGRGGRVRLPQRARQVCDQSLQRCISRRSSRRSLRPYRRARISIPRSFRVARLAQGSRSRPRDSPPPPAACCMSXGEEWCRSPPRRRR

SEQ ID NO: 50194 - protein, 85 aa, Sorghum bicolor
  Clone ID: LIB3478-046-P1-K1-G3.pep
HVSCTLWPCYFLEDQGTGSLRDVLGLLLHRYCRCVRPATVVPVGLEHRSKEQKKEKQSNIYIFGRLIIQVLAIDFWKKDTLKHTV

SEQ ID NO: 50195 - protein, 49 aa, Sorghum bicolor
  Clone ID: LIB3478-046-P1-K1-H10.pep
DRLADSLDCTCDGDMLGDHLDDMEADWAKPIASISLSCRCIFLLVGKTR

SEQ ID NO: 50196 - protein, 74 aa, Sorghum bicolor
  Clone ID: LIB3478-046-P1-K1-H8.pep
QTRPSQVSRVPSSSHPAILSASSAELKPTATAAALLSQPLRRTEATTGVIAGRKQPRRQTLRSPTPPPPGPCRI

SEQ ID NO: 50197 - protein, 127 aa, Sorghum bicolor
  Clone ID: LIB3478-046-P1-K1-H9.pep
FEDLDEVIDRYVDPLVGHLKSMLSYRKFRKGLKNEVDEMLRSEKAENPMRIAYSIGICHEHAGTFILSYIRSTYPHHEYIGLYPTGFRFRMRDFDHIGRLVSYFQKNIDRPPSAAGPSMRSVAALVP

SEQ ID NO: 50198 - protein, 83 aa, Sorghum bicolor
  Clone ID: LIB3478-047-P1-K1-A12.pep
ILCLESTVSAEAKPDRKAQDAEKPEEVLAKRNTSSCRTRNLCQTLRCAKTGRGINLLTRIGSAVRSIVRQRRHRRSSHRAPVR

SEQ ID NO: 50199 - protein, 42 aa, Sorghum bicolor
  Clone ID: LIB3478-047-P1-K1-A9.pep
YTLFNFKKSFAEISLDSIKRVKDHIASETNQNCSTFHVDTVI

SEQ ID NO: 50200 - protein, 135 aa, Sorghum bicolor
  Clone ID: LIB3478-047-P1-K1-B10.pep
IGKYAKYLEMLSIAFAGDSDKGMMDVMNGCKNLRKLEIRDSPFGDVALLGNVAKYETMRSLWMSSCDVTLKGCQVLASKMPMLNVEIMNELDGSSEMEENHTDISKVDKLHVSEMEENHTDLSKGDKLYVYRTTA

SEQ ID NO: 50201 - protein, 72 aa, Sorghum bicolor
  Clone ID: LIB3478-047-P1-K1-B11.pep
STVLLHDAIINVHDIIVKLHLRLALARLEAWLYMHPARDPVGQQAALFSSFFYKIGNVTFLFIFDKYCLIMN

SEQ ID NO: 50202 - protein, 114 aa, Sorghum bicolor
  unsure (1)..(114): unsure at all Xaa locations
  Clone ID: LIB3478-047-P1-K1-B6.pep
AEPLLLLLGQDADVAREAARFSIYIIPSIYAMAINFGASKFLQAQSKVTVPAYIGFGALLINVLLNYLFVYVLGWGLPGAAXXLRRRHWVIALGQMAYIIRWCKDRLKGWFAAV

SEQ ID NO: 50203 - protein, 107 aa, Sorghum bicolor
  unsure (1)..(107): unsure at all Xaa locations
  Clone ID: LIB3478-047-P1-K1-B7.pep
EEAAGALALLMKQATIVHLVGSSETVITSLVGLMRRGTPKGKENAVSALYEICRRGGSTLVQRVARIPXLNTVIQNITLTGTKRAKKEGKLDCQDVPEKAKCHRLWH

SEQ ID NO: 50204 - protein, 118 aa, Sorghum bicolor
  unsure (1)..(118): unsure at all Xaa locations
  Clone ID: LIB3478-047-P1-K1-B8.pep
MKIQCDACEGARGHGGVLDTLGRAERVLVPIDPGDYRDLELKHTGVLEVILVGVRDLNNXDLVAKFXSCVEVYILSLRERNQNIQTLNTDLNHIWNXHYECVVGDISSQYLTVKNYDY

SEQ ID NO: 50205 - protein, 99 aa, Sorghum bicolor
  unsure (1)..(99): unsure at all Xaa locations
  Clone ID: LIB3478-047-P1-K1-B9.pep
MQTIDSLHILVAVHADVYSGARPLLETTMXLLVEGLHNIPLIXIFMENNTKDIRLVDANGMWTLMLLPEYSETVLQTYFSPVAQQAMKSLHELLMDKDS

SEQ ID NO: 50206 - protein, 79 aa, Sorghum bicolor
  Clone ID: LIB3478-047-P1-K1-C1.pep
HGHGHGHGHGGIVVAGDKPEDEEESTKVQLRRNRVVVQVLEMGIIVHSVVIGLGMGASQNVCTIRPLVAAMCFHQLFEG

SEQ ID NO: 50207 - protein, 72 aa, Sorghum bicolor
  unsure (1)..(72): unsure at all Xaa locations
  Clone ID: LIB3478-047-P1-K1-C11.pep
KSMPSICHAYIYIIVVMHDDQVVIENKQHYKVLGKGGDLTTLIXLQVENGKVVKHEDWDVSYYSFRYKYIIT

SEQ ID NO: 50208 - protein, 106 aa, Sorghum bicolor
  unsure (1)..(106): unsure at all Xaa locations
  Clone ID: LIB3478-047-P1-K1-D2.pep
QHYLPEKELVIPDPLLHFVQSHGAVLTIDQNGRVLFSGNGDEMIDLLSVFLEFNMSKRETGGCKAAFLVPYFERKRRSXANSQVSNLKLASTAADVSKSTDVNSKS

SEQ ID NO: 50209 - protein, 97 aa, Sorghum bicolor
  Clone ID: LIB3478-047-P1-K1-D4.pep
SVTHLAASHGGAGPPPSPYHGRRSAAPPAPATPCPAPPPLQPEPKPPLLRRLPPVRVTSEFDGVLKLRLRISHGAGGGGIPCGPSEAGVLARNFFID

SEQ ID NO: 50210 - protein, 51 aa, Sorghum bicolor
  Clone ID: LIB3478-047-P1-K1-E1.pep
SVVSIAAKETRRFSLVRLLLTHSNSSKFCALSSIMRRRCYKSIDTNLFNDK

SEQ ID NO: 50211 - protein, 52 aa, Sorghum bicolor
  Clone ID: LIB3478-047-P1-K1-E2.pep
ISPGMYSYLCSPSVSYIILTASSSWVMIARALYSAPYEPFVRSWTMLSMVCS

SEQ ID NO: 50212 - protein, 62 aa, Sorghum bicolor
  Clone ID: LIB3478-047-P1-K1-F3.pep
MAGRELIPYENPSPTMGIHRIVLVLYQQLGRGTVFAPQVRQNFNLRNFARRFNLCKPVAAMY

SEQ ID NO: 50213 - protein, 83 aa, Sorghum bicolor
  Clone ID: LIB3478-047-P1-K1-F7.pep
RKAEQKKGRRGVLIRLGFVEISRASKSYGRVGFPCKSRGHGHLVVFFQATLWTFLTSIAPYGMSPLAAVLSQQDPGLSPEELL

SEQ ID NO: 50214 - protein, 78 aa, Sorghum bicolor
  Clone ID: LIB3478-047-P1-K1-H10.pep
IKIVTLILVIQGVCGCERFSSSSIGDVFRTIIKRDGYSGLMRGWKPRMLFHAPAAAICWSTYEASKSFFERFNEERRK

SEQ ID NO: 50215 - protein, 68 aa, Sorghum bicolor
  Clone ID: LIB3478-047-P1-K1-H7.pep
IDVQYIPNFQVHNLVVARELSVIFPLGQHERSPCLLGLRCPLGSAYPCARAVHIEPFVSFSIARSRAT

SEQ ID NO: 50216 - protein, 120 aa, Sorghum bicolor
  Clone ID: LIB3478-047-P1-K1-H9.pep
MVGFFGTSAASDHCHLLPKNGSVHHELIRPHHNRSRSVIRCCSAARGRTRDYYYQVLGITVHSTPQEIKEAYRKLQKKHHPDIAGYKGHDYTLLLNEAYKVLMRDNSMHAGGRGRSIDGG

SEQ ID NO: 50217 - protein, 58 aa, Sorghum bicolor
  Clone ID: LIB3478-048-P1-K1-A11.pep
TPPTSSLDHSLTHSLVIITSNPTPTPNNLPKKQTKKLLLMDQGSIKRSCWCFFFLVHS

SEQ ID NO: 50218 - protein, 59 aa, Sorghum bicolor
  Clone ID: LIB3478-048-P1-K1-A2.pep
FRPATRSAFPHTLKRVKQISSSRVGAQKRLAGISGSLEDDEKRARRPVRSLGTGAGLAG

SEQ ID NO: 50219 - protein, 116 aa, Sorghum bicolor
  unsure (1)..(116): unsure at all Xaa locations
  Clone ID: LIB3478-048-P1-K1-A6.pep
LVHELRSPRAWMLLLFCALLARHSLAMFISARRARRQGQAQVQAQLDDDDLLLPPPSPPALPVLGHLHHLVGSLPHVSLRRLARKHXLDVMLLRLGAMPVLVVSSPRAGXAVLRTH

SEQ ID NO: 50220 - protein, 92 aa, Sorghum bicolor
  unsure (1)..(92): unsure at all Xaa locations
  Clone ID: LIB3478-048-P1-K1-C2.pep
DCLVSLISLHSLKFHFSWAYLIHKSYPRIRLAVGGKPVAPESAGASRSGLGAGDRRHGAMHALAIXAHPLALTALPPLTGVARPQTAHSKDN

SEQ ID NO: 50221 - protein, 65 aa, Sorghum bicolor
  Clone ID: LIB3478-048-P1-K1-C7.pep
TTGHSSRSFGHWHSTSHGMSMIFVARVSESTIYMAYYTIAHDLLNVHMNGKEIYPVRSEKMTDEV

SEQ ID NO: 50222 - protein, 133 aa, Sorghum bicolor
  Clone ID: LIB3478-048-P1-K1-D5.pep
HASEASKRLCAYISCKQLREVDTSKILEECLSSNPGQEELAKDLYVPRVEDKNRNMRMLKITTMDDLVKNSMNILEPSPVDATGKDREDVLSSSSPVDLLLLPGQAFDRTGRRLGRGWGYYDTFLMKYQELAK

SEQ ID NO: 50223 - protein, 123 aa, Sorghum bicolor
  Clone ID: LIB3478-048-P1-K1-D8.pep
DAAGWPRTSTGDKARCATWVSSVEPSLSTTGRGSSSYSSRSRPHHASQECCQGMPVGVDSPWYDVNLILYLLIGSMEPSSFLTIKCHSLYGFYIFSIGEDLEHLFKNSYVNFNYWLWVYTWYL

SEQ ID NO: 50224 - protein, 80 aa, Sorghum bicolor
  unsure (1)..(80): unsure at all Xaa locations
  Clone ID: LIB3478-048-P1-K1-E12.pep
FAHDXEGTSVLFXVLSAFAFRDISLTKIESRPHRHRLIRLVDDANVGTDKHFEYMLYVESQASIAEPRAQNALDDDHEYT

SEQ ID NO: 50225 - protein, 66 aa, Sorghum bicolor
  Clone ID: LIB3478-048-P1-K1-E2.pep
SEKRLKFFPNDDLTCWFCCMTKAGNRIHHLVFCKFKKIYRYIIVPIWNTTILIPLEHFLKISIFCN

SEQ ID NO: 50226 - protein, 49 aa, Sorghum bicolor
  Clone ID: LIB3478-048-P1-K1-E4.pep
LEDKVRKHIMTLEECCRAYTPLHKQISLHSSNRTHALPSQSVTSNAFDI

SEQ ID NO: 50227 - protein, 124 aa, Sorghum bicolor
  Clone ID: LIB3478-048-P1-K1-F12.pep
GICEAVAGDFLDAHSLQLLNPYMPNLSASWLFQRAMSVRPHVNVSPTFINELLFANFQSMQKLGDSVLQPFLQDVIQFGPLVKTLGLVMLTRPQILPFIFKQVGLGVILDWSGHFMMLGYYTFL

SEQ ID NO: 50228 - protein, 111 aa, Sorghum bicolor
  Clone ID: LIB3478-048-P1-K1-F4.pep
HTFDRTVVGPSTEDWRGSWTVIHNIIPTGTVAGKAIPKVHADFTGMLSRMSSRDATADESTVDITGRVYYGASYNDIKDALNGASEGPLLDLMGYLEDEVFSTDLLIHRLQ

SEQ ID NO: 50229 - protein, 84 aa, Sorghum bicolor
  unsure (1)..(84): unsure at all Xaa locations
  Clone ID: LIB3478-048-P1-K1-G1.pep
MAPTVEISHLGFTYPGIDGRPPPGAPPLIEDVCFSLDAGQRCLLLGSNGAGKTTILKILGGKHMVDPSMVRVLGRCAXHDTGLT

SEQ ID NO: 50230 - protein, 52 aa, Sorghum bicolor
  Clone ID: LIB3478-048-P1-K1-G12.pep
TCIHGSSLRITALVTEERCRSPSTQSAIRIEVSRATLRIIRGISRLVTRLVD

SEQ ID NO: 50231 - protein, 47 aa, Sorghum bicolor
  Clone ID: LIB3478-048-P1-K1-G4.pep
AVLFFFFFLELYAFVSHHISQSYTGHIHTRYTKVHIEPLLSERYHDV

SEQ ID NO: 50232 - protein, 95 aa, Sorghum bicolor
  unsure (1)..(95): unsure at all Xaa locations
  Clone ID: LIB3478-048-P1-K1-G8.pep
NHFSHTISGLSNYEPGHNNGEAKSLTEVALCNAMRSLYKRELQDHNMVCINXLQHAWDALIDXDYAEDGHKDFGGCTHSMKEAGSALNELLKDDG

SEQ ID NO: 50233 - protein, 167 aa, Sorghum bicolor
  unsure (1)..(167): unsure at all Xaa locations
  Clone ID: LIB3478-048-P1-K1-H4.pep
QIDEYLKRPEGSLFLTDLKQKLLLTQNEANIAGTRYNVPLVNSLVLYVGMQAVQQLQQNKVNASAPAQINQSQMDIFQIETATEMFRNLVMTMDTEGRYLILNAIANQLRYPNSHTHYFSFIILYLFAEATQEIVQEQITRVLLERLIVNRPHSWGLLITFXELIKN

SEQ ID NO: 50234 - protein, 91 aa, Sorghum bicolor
  Clone ID: LIB3478-048-P1-K1-H5.pep
MALRLSAPFLTSRFTPSQASAPRRRTRARCFSPSADARAACFRRPYTSVLIVPTGVGAAVGGFAGDALPVARALCGVGDCSYTPKRVDAGC

SEQ ID NO: 50235 - protein, 103 aa, Sorghum bicolor
  unsure (1)..(103): unsure at all Xaa locations
  Clone ID: LIB3478-048-P1-K1-H7.pep
RTSCLSLEDRRRRRHLEQDEDLAHKIRDEEEIAXARRRALXLQRQADETAAAAIAPAEESATLIEVDGDDLKETYAQNKPAVVDADNILSFDKCVGAGGLAYE

SEQ ID NO: 50236 - protein, 58 aa, Sorghum bicolor
  Clone ID: LIB3478-048-P1-K1-H9.pep
EGGSATRWGWLCCKARAACPALAATPASSWQELGCNSVWQRRPTHARPFCELMAAGGA

SEQ ID NO: 50237 - protein, 35 aa, Sorghum bicolor
  Clone ID: LIB3478-049-P1-K1-A10.pep
GRGGTVGRGGGQTHLNILSHPSYTINASMRVTLHE

SEQ ID NO: 50238 - protein, 37 aa, Sorghum bicolor
  Clone ID: LIB3478-049-P1-K1-B1.pep
AVVEASSPVIVGGGCTCVTVHDWCRSGRHLVAPWRLA

SEQ ID NO: 50239 - protein, 124 aa, Sorghum bicolor
  unsure (1)..(124): unsure at all Xaa locations
  Clone ID: LIB3478-049-P1-K1-B12.pep
EIYKEIRRRGLHVAVAGIPKTIDNDIAVIDKSFGFDTAVEEAQRAINAAHVEASSAENGIGLVKLMGRYSGFIAMYATLASRDVDCCLIPESPFYLEGEGGLFEYIDRRLKVNNHXVFVVAVGA

SEQ ID NO: 50240 - protein, 50 aa, Sorghum bicolor
  Clone ID: LIB3478-049-P1-K1-B9.pep
GQDPSTSDTTPWRCTTSASRRSRSFTPRASRLSTSPVLPRAATVTFYYSS

SEQ ID NO: 50241 - protein, 83 aa, Sorghum bicolor
  unsure (1)..(83): unsure at all Xaa locations
  Clone ID: LIB3478-049-P1-K1-C6.pep
PFCTAYLLSCKPLYGNVTLYIVFIGFRACSLSVMFYYYYLSDKELVSGVYCFLVSYDTVYVAVFPDNVLNPQLLFFYVILXSG

SEQ ID NO: 50242 - protein, 191 aa, Sorghum bicolor
  unsure (1)..(191): unsure at all Xaa locations
  Clone ID: LIB3478-049-P1-K1-D9.pep
PTRPPESDFLLRTIPFLVHNPEIALVQTRWKFVNSDECLLTRFQEMSLDYHFKYEQEAGSSVYSFFGFNGTAGVWRISAIDDAGGWKDRTTVEDMDLAVRAMLQGWKFVYVGDIKVKSELPSTFKAYRFQQHRWSCGPANLFKKMMVEXLENKKVSLWSKIHLWYDFFLXGKVAAHTVTFIFYCFAIPVLF

SEQ ID NO: 50243 - protein, 44 aa, Sorghum bicolor
  Clone ID: LIB3478-049-P1-K1-E3.pep
AECARQPISGELFSGSAACIQTTKVVVVVVVTTGWLLPLYGCVR

SEQ ID NO: 50244 - protein, 49 aa, Sorghum bicolor
  Clone ID: LIB3478-049-P1-K1-E7.pep
VRYDIPLCQVRSMFLMSFLYYDDRKDTTNITLHIIRLDDKLLHKALLPE

SEQ ID NO: 50245 - protein, 88 aa, Sorghum bicolor
  unsure (1)..(88): unsure at all Xaa locations
  Clone ID: LIB3478-049-P1-K1-E8.pep
PVXNRSASLRAHQGTDPGTARGRPCTRYIKSPSISLANSQAHDDKAVTEDVDGGVGDKRAHDHTDGDSHDVAGHIARIIACTVMYMRA

SEQ ID NO: 50246 - protein, 30 aa, Sorghum bicolor
  Clone ID: LIB3478-049-P1-K1-E9.pep
RPSHLLAWRPRQLDSTLPYSLFLSSLIYLP

SEQ ID NO: 50247 - protein, 48 aa, Sorghum bicolor
  Clone ID: LIB3478-049-P1-K1-F3.pep
GVFVAEGDINDGRLLSKLFDVEPFTHVLHVEVQAGVRYTMENLESYVH

SEQ ID NO: 50248 - protein, 54 aa, Sorghum bicolor
  unsure (1)..(54): unsure at all Xaa locations
  Clone ID: LIB3478-049-P1-K1-F6.pep
MVKACPTVSEDYLXADDKAKRKLLGLNSXTNCPTVMLRLAWHSADTFNVATKTG

SEQ ID NO: 50249 - protein, 112 aa, Sorghum bicolor
  Clone ID: LIB3478-049-P1-K1-F8.pep
LEAAMDEVPGRSSSVRATRSIFGESIGGRKPETNRARNVLGQQQNLSPEIKQLAKSTTGKLNERKAAVDRERAGAESELSRARAMANELERQIEQAKARASSKRSEPHAFRA

SEQ ID NO: 50250 - protein, 55 aa, Sorghum bicolor
  Clone ID: LIB3478-049-P1-K1-G10.pep
GIHCYLHLPCAGNAEDPHADTCKLNMLRRLQRLETICCASASGLLLMVRRGYESF

SEQ ID NO: 50251 - protein, 137 aa, Sorghum bicolor
  unsure (1)..(137): unsure at all Xaa locations
  Clone ID: LIB3478-049-P1-K1-G7.pep
HAYEQLDIQHAIEHTIQPYVRPSLGRSSCPPSSLPLSPSLAPSPRRSPGRXAMTVRFTVRAAVGTAAGTVAVSVVFSGLVIGRDMVQDALLGAHGCELIXRPARSATTSAXNINFKNNDSFPYNEDYDHDEVDTSKN

SEQ ID NO: 50252 - protein, 140 aa, Sorghum bicolor
  Clone ID: LIB3478-049-P1-K1-G8.pep
HASAHASAHASAHASAHASAHAFAHASAHASVHASGRRSSRTWRRTPSTCIAPTASPRRTSCLLQIYDIFQLLPSKIQVGVVSATMPPEALEITRKFMNKPVRILVKRDELTTEGVKQFFGNVVKEDWKLDTLCDLFDTL

SEQ ID NO: 50253 - protein, 87 aa, Sorghum bicolor
  Clone ID: LIB3478-049-P1-K1-H10.pep
ELLISHVCQAGKCKSWSVTPQMPLTTAEKIMDSHGVDYLPVVSEDANPQDRGPLIGFVDRECIAIARRATATKEFFSSMYEIKKEER

SEQ ID NO: 50254 - protein, 138 aa, Sorghum bicolor
  Clone ID: LIB3478-049-P1-K1-H11.pep
LPVADHNAQHQQPQSVQLHSQGPCPPQPSKPSHCSVASYAVQGNGQTYSSTYKNPSNCPATVVALLPQPPATASMAYHPLGPQVVHNHPFGNLVETASVVGYPRDQVEILPVVTAAQPVMVDKLNAGSNVTSPREWSA

SEQ ID NO: 50255 - protein, 156 aa, Sorghum bicolor
  Clone ID: LIB3478-049-P1-K1-H2.pep
VPLRILRSKGLLDKIPFTTVITDLSTCHPTWFHKLVTRCYCPSTEVEKRALKAGLKPSQIKVYGLPVRPSFVKPIRPKDELRRDLGMDEDLPAVLLMGGGEGMGPIEATAKALGDSLYDENLREPTGQILVICGRNKKLVNRLQSISWKVPVHVKG

SEQ ID NO: 50256 - protein, 107 aa, Sorghum bicolor
  Clone ID: LIB3478-049-P1-K1-H8.pep
MATATLLSSSFAMPAAAAARRATFSSSSATSLGFATSQLAGLSLFAGAATPTVVALLPKRLQLQPIVVRRVCPISDKNTNRANMVSLLNHKTKKQLFLNLSYKKLWW

SEQ ID NO: 50257 - protein, 43 aa, Sorghum bicolor
  Clone ID: LIB3478-050-P1-K1-A10.pep
ELQDMQGRLLNMSLQYAEVEHQREELVMELKNVNAKTKGGRWF

SEQ ID NO: 50258 - protein, 54 aa, Sorghum bicolor
  Clone ID: LIB3478-050-P1-K1-A5.pep
SRVRAITRARTTPTNHTARLSPNLLDDSLEGEREADHQEVHRQEGAEDAGGDQG

SEQ ID NO: 50259 - protein, 104 aa, Sorghum bicolor
  Clone ID: LIB3478-050-P1-K1-A8.pep
PRVRDPAPRRPPPPPLLASPARRRRHPSSSLLSVTTLLVFLTSHKLRRYPRFDAKACVSPRCGGTGQGEDGCHARAGAGTSDSGERCRTPRLGQSSWIYTQKMC

SEQ ID NO: 50260 - protein, 67 aa, Sorghum bicolor
  Clone ID: LIB3478-050-P1-K1-B8.pep
LMLLISAHLYTSLNNNVGRTQYTRAADTTESLRIIFGYLLLLLLALVATAEARVVRKLIGQNACHET

SEQ ID NO: 50261 - protein, 66 aa, Sorghum bicolor
  Clone ID: LIB3478-050-P1-K1-C12.pep
DGEPSGPFAVFKGMKNLPPGMPQVLIVTGLTWLSWFPFILFDTDWMGREMYHGKPDGSPTEVANYQ

SEQ ID NO: 50262 - protein, 58 aa, Sorghum bicolor
  Clone ID: LIB3478-050-P1-K1-D10.pep
NLIIKVLGVNIYNIKGGQNVGFHLKYPCFLRHTFYFGVSYFKLTRLIFFTLVLKNSFW

SEQ ID NO: 50263 - protein, 41 aa, Sorghum bicolor
  unsure (1)..(41): unsure at all Xaa locations
  Clone ID: LIB3478-050-P1-K1-E12.pep
HGXLCRQHWSRRVQQYRLLIHRYEVVRVVQCCSSVTRPCAM

SEQ ID NO: 50264 - protein, 64 aa, Sorghum bicolor
  Clone ID: LIB3478-050-P1-K1-E2.pep
RHMITLVGHCIASSYQRLLVYEFEPNNTLESHLHRKGVPLIEWSRRLAIALCCARAWLTCTKIY

SEQ ID NO: 50265 - protein, 51 aa, Sorghum bicolor
  Clone ID: LIB3478-050-P1-K1-E7.pep
ASQDSDNYIILWGCCNARPAMLILSFEQFAGVGGDSLIYSLCYSLITSFCL

SEQ ID NO: 50266 - protein, 123 aa, Sorghum bicolor
  Clone ID: LIB3478-050-P1-K1-F10.pep
RVEAAVEQFNGYVLDGRSLRVNSGPPPPRDPSSQRGPRGDANRVYVGNLSWGVDNSALANLFSEQGEVLEARIVYDRESGRSRGFGFVTYGSAEEVENAISNLDGSDLDGRQIRVTVAESKPP

SEQ ID NO: 50267 - protein, 55 aa, Sorghum bicolor
  Clone ID: LIB3478-050-P1-K1-F11.pep
NKHIYGCESYICIIILVLELQNENGILLGQCQLMNMHGCMICGHHLKMLLREQSS

SEQ ID NO: 50268 - protein, 61 aa, Sorghum bicolor
  Clone ID: LIB3478-050-P1-K1-G7.pep
QAPTGELQRGADAVPHRPISRACQAGAMPELPENLLPTRCSHHRYQRTRHHGEFQGQRLEP

SEQ ID NO: 50269 - protein, 49 aa, Sorghum bicolor
  Clone ID: LIB3478-050-P1-K1-G8.pep
ISRNRFMKASRKGGATGTALVEGAPHLAVDLAHVQPQHVRLEELGQRAA

SEQ ID NO: 50270 - protein, 52 aa, Sorghum bicolor
  Clone ID: LIB3478-051-P1-K1-A2.pep
PTVFLVPCKALVVLLLHALLVLNDVICTLFTEILCLGSIYKIMLNPDNHVNE

SEQ ID NO: 50271 - protein, 48 aa, Sorghum bicolor
  Clone ID: LIB3478-051-P1-K1-A4.pep
SIDAVHAGAAIHCWPSPACAVADISRVLRPGEFCASHSYHMLFTRFPV

SEQ ID NO: 50272 - protein, 39 aa, Sorghum bicolor
  Clone ID: LIB3478-051-P1-K1-A6.pep
SLRQECNGSNPAMLGIYCLKHSCFYSIRMIKVDMCRITC

SEQ ID NO: 50273 - protein, 56 aa, Sorghum bicolor
  Clone ID: LIB3478-051-P1-K1-A8.pep
SVSGERATAAHVHRPSNSRPRPLQIHRQPPPPRIKAARARAPVREESWNARQRASG

SEQ ID NO: 50274 - protein, 55 aa, Sorghum bicolor
  Clone ID: LIB3478-051-P1-K1-B1.pep
MQLAFVDDCFNSHYTMVVWCRLPSLMLSLLLSVQTMGAVVWLGVYIRKAYKPASG

SEQ ID NO: 50275 - protein, 32 aa, Sorghum bicolor
  Clone ID: LIB3478-051-P1-K1-B11.pep
SACLIKHMANIDADITSSTAPNYHHQSWRIGA

SEQ ID NO: 50276 - protein, 55 aa, Sorghum bicolor
  Clone ID: LIB3478-051-P1-K1-B3.pep
RRRYLTNREEEKPLDVHGFLSTRLRTLITRRTGCQIEHQRTVTLYMPENKLHPQR

SEQ ID NO: 50277 - protein, 125 aa, Sorghum bicolor
  unsure (1)..(125): unsure at all Xaa locations
  Clone ID: LIB3478-051-P1-K1-B4.pep
ALCPNVTTRGIQLATAQLPCLQLMDCGMSLCTNMKNEKEGPYFGELNGCIRIIPKLSTLKRQPIHQKLIIKHGNLXKLSLWGCSAIDALYVNXAQLNDHNLNCCTXLHAERLLLQCPKLKNVHAF

SEQ ID NO: 50278 - protein, 114 aa, Sorghum bicolor
  Clone ID: LIB3478-051-P1-K1-B8.pep
MVVKHSYLVSVLVLLVAGYCTAALASATATTFIVGDDQGWTMTGVDYVAWVQGKTFAIGDKLVFNYPSEEHTVTEVGKTDYFACAGGNALSNDRSGSTNITLTAPGTRYFICNI

SEQ ID NO: 50279 - protein, 38 aa, Sorghum bicolor
  Clone ID: LIB3478-051-P1-K1-C6.pep
VCAGGPHGADMIHLRGHSGDRASQVGRLLPSAMLSHVR

SEQ ID NO: 50280 - protein, 84 aa, Sorghum bicolor
  Clone ID: LIB3478-051-P1-K1-C9.pep
YTNILRSCISDMRWRHCLNYRSIPCCRYGGMTSSIRSARHKVHVIESGSCHEQSTIISSSMPAGIWMTRVDKRDFQTPSGQFMS

SEQ ID NO: 50281 - protein, 85 aa, Sorghum bicolor
  Clone ID: LIB3478-051-P1-K1-D1.pep
RERRPYFFFFFHHTTLIFRITVTKSCKSLSIQIYTCNQSTIFYCNSNGRHIITKTFFCLEHIKIEIGSNKFNPQTIHVYAHEHQT

SEQ ID NO: 50282 - protein, 35 aa, Sorghum bicolor
  Clone ID: LIB3478-051-P1-K1-D3.pep
GFVRSRSAGCQSCGDVAAQPCGGHGCFLIRSPRGS

SEQ ID NO: 50283 - protein, 95 aa, Sorghum bicolor
  unsure (1)..(95): unsure at all Xaa locations
  Clone ID: LIB3478-051-P1-K1-D9.pep
ALSASHRAAVRMQMLWVAPGIQRAAARIASAQDRNTAGVARGAAVLWSSDHGHRDRTDINSVCLIPGCAXRRTEQSQDKHGSTESRWLHRYPSQI

SEQ ID NO: 50284 - protein, 31 aa, Sorghum bicolor
  unsure (1)..(31): unsure at all Xaa locations
  Clone ID: LIB3478-051-P1-K1-E12.pep
VSLLSHAFQHRYPRCSGGVPLXPERIMCSIT

SEQ ID NO: 50285 - protein, 77 aa, Sorghum bicolor
  Clone ID: LIB3478-051-P1-K1-E5.pep
SALPTDVTPDTAPHHHPALDPSATPSPPSGPTWCDMDAHEEKTATAVTTEEPAPAAEPKPKPATEAHMAGPSALATP

SEQ ID NO: 50286 - protein, 75 aa, Sorghum bicolor
  Clone ID: LIB3478-051-P1-K1-E7.pep
WSNADRRPAIGSILASPYWLYTICSAEIKDTSDAPALAVYNHNHMGALTQNEWSMKGTMILAVTLWILGEAIGVS

SEQ ID NO: 50287 - protein, 88 aa, Sorghum bicolor
  Clone ID: LIB3478-051-P1-K1-E9.pep
LSPQSAGPTEPPQPSPSARAFRAPLLGRPRERRRTCRLPQSSTPTSRRRRQGPRPGGGGCTGGGPSTVVYSWGANKARSEGFPSTLRS

SEQ ID NO: 50288 - protein, 79 aa, Sorghum bicolor
  Clone ID: LIB3478-051-P1-K1-F5.pep
RRVRDYTLAQYKLETFEDLAYYGTIQKLVKDLGYPEELLTGQSDWTYMIRGLLLAKNRGNILKTDRHKYVKVAYHDGKE

SEQ ID NO: 50289 - protein, 121 aa, Sorghum bicolor
  Clone ID: LIB3478-051-P1-K1-G8.pep
ERANHLTRNVSKIISASSNCSLYERMQLINVLERLCLDHLFKEELNVILSEIYKTNDISGSDLQTTALWFYLLRKHGYQVSPDVCAKSKDEQGNFAANIPLDVLSLYNAAYLRTNGENNLV

SEQ ID NO: 50290 - protein, 101 aa, Sorghum bicolor
  Clone ID: LIB3478-051-P1-K1-H9.pep
RMAIVSVLGRKKSTAKETVVPDPDYRLPIAILGIASAFAYADNLLAAAPVGLLGLLLLFQTTRVRFVFDNEALEVKVGDQLQESGENVFVGGKNRWKYSTV

SEQ ID NO: 50291 - protein, 117 aa, Sorghum bicolor
  unsure (1)..(117): unsure at all Xaa locations
  Clone ID: LIB3478-052-P1-K1-A1.pep
HQTTSRPSTSIGFINKNQSVNAATFAMNSEXQKMGGEHTISAGTTAMPAQANIPNRGLDAPRNMFSAFPAAVMENQSIPSSPVAQSWISFGATTENKPTIVSPTFXCNYCGWKMPFA

SEQ ID NO: 50292 - protein, 96 aa, Sorghum bicolor
  Clone ID: LIB3478-052-P1-K1-B12.pep
RAGPVDYSPPAYHSAAAGYAATAASRRLRMIAASNRSAFNASSASHFLPSLGYIYEEYITDAAKSFSRASSVLFSVIMLLLVSFLCFPSLIYLSLL

SEQ ID NO: 50293 - protein, 90 aa, Sorghum bicolor
  Clone ID: LIB3478-052-P1-K1-B7.pep
KCCGRADERKMAATSLSSCSSLPRATAKLAGLPRSSSYYTQLTFCSRHPFEKAAAAAAFQKLPPELLRLSYPARNSKHARTSCRRATDND

SEQ ID NO: 50294 - protein, 150 aa, Sorghum bicolor
  Clone ID: LIB3478-052-P1-K1-B9.pep
SGLSGDDTIKNRVLEALYRRILRAEREKKRFKAIIIIPLLPGFQGGIDDGGAASVRAIMHWQYRTICRGSNSILQNLFDVIGPKAHDYISFYGLRAHGKLYDGGPLVTSQIYVHSKLMIVDDRITLIGSANINDKSLLGSRDSEIAVVIE

SEQ ID NO: 50295 - protein, 62 aa, Sorghum bicolor
  Clone ID: LIB3478-052-P1-K1-D12.pep
LEVSKMYVMCYQLQYMLWFNHICSQDDVCIFMISPLRSFSSHHIVIKESVVYVDRYAVGVDT

SEQ ID NO: 50296 - protein, 63 aa, Sorghum bicolor
  Clone ID: LIB3478-052-P1-K1-E2.pep
FPFIFHYLFSILYYFTLLNYFIFHVHIYFLFFYIFIICYSCFMCFFLSYSSHFYIIFFTISYF

SEQ ID NO: 50297 - protein, 50 aa, Sorghum bicolor
  Clone ID: LIB3478-052-P1-K1-G2.pep
SFYNALNIVPTVITDVWPVICPLCCTRCHQATVVISDVKSDQVCGEVCGD

SEQ ID NO: 50298 - protein, 79 aa, Sorghum bicolor
  Clone ID: LIB3478-052-P1-K1-H11.pep
NQEHADPVPLSSQCTSKRKISHWTQSIISQRSDCDSWSSSETGGRCAAPPPSHQCSTTPMMSSTELIAADSEVCVRVRS

SEQ ID NO: 50299 - protein, 41 aa, Sorghum bicolor
  Clone ID: LIB3478-052-P1-K1-H6.pep
PRSTSASVNDSLGVRNASHFLSETTARPVTCSRSHSLRPCT

SEQ ID NO: 50300 - protein, 126 aa, Sorghum bicolor
  Clone ID: LIB3478-053-Q6-K1-B11.pep
MAYAWGGRCSYWCELLVGSDFTTDALAVLLPPVDREVWDDWLPDLAEGDACLFDLEERHIVPVHGTDQAGRTVIRIVSTFLTDRLWDGERLKKKAIYKLRTELPVATLCMTDMQTTVHPDDNNPGM

SEQ ID NO: 50301 - protein, 169 aa, Sorghum bicolor
  Clone ID: LIB3478-053-Q6-K1-D3.pep
GFIVRLLDLFDSEDPREREYLKTILHRIYGKFMVHRPFIRKAINNIFYRFIFETEKHNGIAELLEILGSIINGFALPLKEEHKLFLVRALIPLHKPKCVAMYHQQLSYCVTQFVEKDCKLADTVIRGLLKYWPITNSSKEVMFLGELEEVLEATQPAEFQRCMVQLFRQ

SEQ ID NO: 50302 - protein, 128 aa, Sorghum bicolor
  Clone ID: LIB3478-053-Q6-K1-D4.pep
YFHLQQQKLIELIRAGKINEALEFAQEELAPRGEENQTFLEEIEKTVALLVFEDVKNCPYGELLDVSQRLKTASEVNAAILTSQSHEKDPKLPSLLKMLKWTQNQLDEKAAYPRINDFTTAALEDPSI

SEQ ID NO: 50303 - protein, 175 aa, Sorghum bicolor
  Clone ID: LIB3478-053-Q6-K1-E6.pep
HASALKTQDLLSEYPNPIPKLEGKETSVNQSGSTSVAHENLATKTCVGAPTSKIDSLQPLKERSCPTDRGSVNQLEHLFEDNVTKRNNEVVNPVSDAEGIAVSDVLESLTEQDCSLQNLMPASAEEEQPQYSSPIALSPWGEPSYYQGEACDSALWGVQDDPGNDMWSMPSPHLV

SEQ ID NO: 50304 - protein, 160 aa, Sorghum bicolor
  Clone ID: LIB3478-053-Q6-K1-E7.pep
MFLNLSASPRFHCSPGLLSKTAGVCMAPTPTSKGRTIASTLGHPLLPVNDHCQQTVDHDSPYDKHLHDHARPASLPDDQIVRARRPHKYCNQHPTTDALKPHDADPKLARCAHPPHANALNVARGTVLHQKAYFRPIKDINKPPPDHCTILAVHTTLLIG

SEQ ID NO: 50305 - protein, 53 aa, Sorghum bicolor
  Clone ID: LIB3478-053-Q6-K1-F4.pep
NKISNSILFFLKYTKKARACLIIKRGRPFIETPIYITPACTHNNSALIQPYFI

SEQ ID NO: 50306 - protein, 180 aa, Sorghum bicolor
  Clone ID: LIB3478-053-Q6-K1-F7.pep
DRLGLSGLIGGKIGSSLVIFLVENYTEDHANGFFDDDKLREGLKWLISSLARQPDVTFVKTHELLLDFLNPQLELLNTHVAPGAGPGDCISVFNNAVNQLAEEILAAARANSSQWPPPEIDLLERTSNERIYAEMFLPSIGWSSPSRIQPLLAAINSCKIPDFSYDLSWLNHGSHMGQQI

SEQ ID NO: 50307 - protein, 72 aa, Sorghum bicolor
  Clone ID: LIB3478-053-Q6-K1-H1.pep
WCFNEWWGREILIINSLLSYMHFYIYLCCPTKIVLIIPLYFLLLVLFFLTRQPFRSCNENKWGHYSQALRHD

SEQ ID NO: 50308 - protein, 81 aa, Sorghum bicolor
  Clone ID: LIB3478-053-Q6-K1-H4.pep
MIAGVRSIWAPCPQQHSNAKQSQTALATVLSSSKPATHLAPLRTCKVGIKGETKTFLSISTHVTSDGKKFLIHSFIYLRTS

SEQ ID NO: 50309 - protein, 123 aa, Sorghum bicolor
  Clone ID: LIB3478-054-Q6-K1-A7.pep
RAAALVEKERSRRLGTSILNQVIREAIAFKPPPRTRGGKRGRVYYTTQAAIGPPTFVLFVNDAKLFPDTYRRYMEKKLRSDAGFPGTPIRLLWRSRRRPDKRGKSADSRTQSPGTPSKMVLAA

SEQ ID NO: 50310 - protein, 150 aa, Sorghum bicolor
  Clone ID: LIB3478-054-Q6-K1-B11.pep
DEKYEAKLADFGIAKLVEGSTLSCFAGTHGYMAPELAYSLKATEKSDVYSFGVVLLELLTGRSPTDQQFDGETDIVSWVSFHLAKQNHAAVLDPKVNNDASDYMIKALNIAIVCTTQLPSERPTMREVVKMLIDIDPSSTARRAKNKNDK

SEQ ID NO: 50311 - protein, 58 aa, Sorghum bicolor
  Clone ID: LIB3478-054-Q6-K1-B4.pep
ILIYTVDRTCDLISPFLQEHLLGIYLYKFPLHNVFQLWGSMSFPVLFLPTRKMMDYRC

SEQ ID NO: 50312 - protein, 161 aa, Sorghum bicolor
  Clone ID: LIB3478-054-Q6-K1-C11.pep
EENELQLLLDRFRRAFENLSELLIASRNLEFFTNGYRYLIQILPAAVVAPMYFSGKIEFGVINQSVSAFNHILSDFSLIVFQFQSISAFSAVIDRLGEFDDLLDGNEPSVSSQRDSIDGINIVFKSSGPSVLSSNGSLTQSDPCMVLEIRNLTLLTPRSGN

SEQ ID NO: 50313 - protein, 160 aa, Sorghum bicolor
  Clone ID: LIB3478-054-Q6-K1-D12.pep
EEGEVALGVVTVIKATTLGQEMVAAGALAREMVAAGALAGETVAGVVTGTGTPLVEMIRQERVMPTTPGARTDHLHLSWVSQAVMLTSADPASTAGRARRAAAVRRGALGAASVDAVPFPAWTSTAARPPTCKCSRRCPVMYLYRVCFMFGCVCLIIFVE

SEQ ID NO: 50314 - protein, 164 aa, Sorghum bicolor
  Clone ID: LIB3478-054-Q6-K1-D5.pep
LATRTHGKESRHIFFWKKDRSNRRQTVEGTSSSQPVNKIVILKPNPRREIDHAVAVSSTQAPKLGATEGSKFSIKEVRRRFRIVTSEATKGRPSVSEDKLQKDQHCFKSSAFTIIKDTRQLAEQTSEGKSSSTVIKDFRSSNSGRQKKRNDGPTEINNSSIITT

SEQ ID NO: 50315 - protein, 163 aa, Sorghum bicolor
  Clone ID: LIB3478-054-Q6-K1-D8.pep
EEEVRATDYNEVAAALESIYKLSPAVEVDEENERHGGHDDDDEGGKKAKKKRKSRVAGRSTVIVKSRRRRRGRRMDLGKRVEMKSAAVSREGDEDDEGEREREFEEMLLREHSVSTDMGSLDWKRMKIPPVLTSSQSARLFKTMQPMKAIFEVQESLREELQR

SEQ ID NO: 50316 - protein, 162 aa, Sorghum bicolor
  Clone ID: LIB3478-054-Q6-K1-F11.pep
QQLSNAFANAYEALMKAFVDHNKFGNLPYGFRANTWLIPPIYVDSATKCPALPVEDESWGGNGGGCGRDGKYDRRRWSKEFSVLARMACKTEEERVIRDRKAFLLHNLFVDTAIFRAASTIRRLIDQSMNSIGPRSGTHGSNVFEERIGDMNITVKKDEADA

SEQ ID NO: 50317 - protein, 136 aa, Sorghum bicolor
  Clone ID: LIB3478-054-Q6-K1-G11.pep
NVQKAMRGLAITDADHYGRLGVTRLASTDEVKAAYEKKCEELNSKELEEEELHKEYDLIKESFTILSTEEERRLYDWSLSRSGQPERYVWPFQVDPLEMAPDPPQEPEDELPTKLVGYFLLAWFILSVALSVTLNK

SEQ ID NO: 50318 - protein, 140 aa, Sorghum bicolor
  Clone ID: LIB3478-054-Q6-K1-G8.pep
VKALDLRDGSGEIPVVGDQVAIHYYGRLAAKQGWRFDSTYDHKDDTGDPMPFVFTLGSGKVIPGMEAAVKSMRVGGLRRVIIPPSQGYQNTSQEPIPPNFFDRQRLFTTIFNPTRLANGEGSTLGTLIFDIELINIRQHS

SEQ ID NO: 50319 - protein, 168 aa, Sorghum bicolor
  unsure (1)..(168): unsure at all Xaa locations
  Clone ID: LIB3478-055-Q6-K1-A1.pep
VREVPEYEIDPAELDFTNGNDLSKGTFRKATWRGIPVAVKKLDDDLIVDESKVQAFRDELDVLQLIRHPNVVQFLGAVTQSNPMMIVMEFMRKGDLRTHLSKKGALPPSYAVKLALDIARKMDYLHEHXTXAIIHCELEPSNILRDDTXHLKVADFDLCKMLKWRKKV

SEQ ID NO: 50320 - protein, 136 aa, Sorghum bicolor
  unsure (1)..(136): unsure at all Xaa locations
  Clone ID: LIB3478-055-Q6-K1-A7.pep
EKVILQTMPVIENAIKEVYTTLVPRTMVIADLGCSSGPNTLLFISNVINIIAGQYNKPGDPVELQIFLNDLPGYTPPLCYISGLPKSYYSRLFPRQSVHLFHSSCCLHWLSQVPEELYARKGAXLNEDNXYITKTT

SEQ ID NO: 50321 - protein, 142 aa, Sorghum bicolor
  Clone ID: LIB3478-055-Q6-K1-C10.pep
MEKHGLFSRLGNSICSAMGNADCISVEEVGEHMNTTAFTSNIDGEVFLKPNRPALVVSSTSWTPDEDFSILLEAALMYDRRVAAALGEDDSMDEEQLWIDIKNGKQFVYPRLLFIITGKGPDRKKYEDQIKRLKLRRVALRT

SEQ ID NO: 50322 - protein, 164 aa, Sorghum bicolor
  unsure (1)..(164): unsure at all Xaa locations
  Clone ID: LIB3478-055-Q6-K1-D7.pep
MANPTPQLFQTQRSGGGGGSEEGDHNSSSTSTLPMREGWWAAAPLFRLHGCWLTARLARSVELVQAEFKPRPDDVLLATFPKSGTTWLKALAFALINRSRHPVIVDDDHHHPLLSSNPHDLVPFLELPDRTLRPVAELEALPSPRLLCTHXPPALLPPGMLTTS

SEQ ID NO: 50323 - protein, 68 aa, Sorghum bicolor
  Clone ID: LIB3478-055-Q6-K1-D8.pep
PAAHRACSCFGSDPEDRRSRPAEQLGTTRLMQDSSHSHPPAPHNKVVCELQAVVSLLETTIVSDQISS

SEQ ID NO: 50324 - protein, 170 aa, Sorghum bicolor
  unsure (1)..(170): unsure at all Xaa locations
  Clone ID: LIB3478-055-Q6-K1-E7.pep
NQLPEKIKQQMLSHFCLQFKTEGLNQQAMLNCLPKGIRSSIAYNLFFTILQQASLFNGVSNIFIADLVMDVQAEYFPPKEXIMVPNEGAADFFLISSRSGDLIXTTINGYETQVLKKLEGDMFREVGALCDIPQTFTCRTTTLXQLLRIRKIRLTEIMQEHREDSNILMN

SEQ ID NO: 50325 - protein, 170 aa, Sorghum bicolor
  Clone ID: LIB3478-055-Q6-K1-F5.pep
KFISNGQPGTAQDVDKSTTLARKVFRLLKWVNDLHALISPPAKGTPLTLVLLGKSKNALLSTFLFLDQFVWLGRTGIIKNKEATDRVARISLYCWMASSVCAGLVELGELKRLSRSMRKLARELRNTDKYENEQYQNKMKQSDERLLALVKAAMDVVVAIGLLQLAPKKV

SEQ ID NO: 50326 - protein, 67 aa, Sorghum bicolor
  unsure (1)..(67): unsure at all Xaa locations
  Clone ID: LIB3478-055-Q6-K1-G3.pep
YIKHVSVPLLVYVDPSSSQKRILRNAVGGGPTMYRGYVPTQGFFGPLXXXQKQNKKYCKKNKXPTRP

SEQ ID NO: 50327 - protein, 170 aa, Sorghum bicolor
  Clone ID: LIB3478-055-Q6-K1-H3.pep
ESPSTSKRLHRTSSIPFDLNLPGDEAEAHDGDDDSSSSHENSSSDLEGYVGNLLRSVDESINFKPFDFGKLCEDIMQEFSSTMSKTIGSRCRLEIDAVAMEQVVAAAWTSDSHEKRPVGTWVEQVFARSLEQLKVRCKNLSSCTLRLVACENEMPVKEDGFGAFLPSTIV

SEQ ID NO: 50328 - protein, 66 aa, Sorghum bicolor
  Clone ID: LIB3478-055-Q6-K1-H6.pep
HRRHGKNPGRPQLKRREENPLFPGWHNTKEARPERPSKQWPSLKGKGNPPCSGAKSAAGGGVTPRG

SEQ ID NO: 50329 - protein, 38 aa, Sorghum bicolor
  unsure (1)..(38): unsure at all Xaa locations
  Clone ID: LIB3478-056-Q6-K1-A12.pep
SIKVNCAVSVRAKVFPSQIGEVXQERSAKLSYNKFSGG

SEQ ID NO: 50330 - protein, 75 aa, Sorghum bicolor
  Clone ID: LIB3478-056-Q6-K1-B11.pep
AILIDQNAFSARLRKNIEQLAALVSSYPLSDPENEQIQDVMEKIRLKFRAITASLGVKLEYEGHPTSSKQDVEDL

SEQ ID NO: 50331 - protein, 135 aa, Sorghum bicolor
  Clone ID: LIB3478-056-Q6-K1-D1.pep
KKKKKKKKKKKKKIYFHPAFFEAKPGHPTSWGGRQPSNHFPWEGGPRPWKGRTCRASPSRTSGSGPFRALGNLPLGFRNLLPLPGLAGVGFKTRKSPTPPTRPTSLKGSKAVQVFVLVLKEELAKLRVFHFVGSG

SEQ ID NO: 50332 - protein, 198 aa, Sorghum bicolor
  Clone ID: LIB3478-056-Q6-K1-D6.pep
DVFRSGAIKSATDFQIYEEVGRLPGLDFAYTDTTSVYHTKNDKMTLLKPGSLQHIGDNMLAFLLHSAASPKFLKDAQQRKQGNTEQDKAVYFDILGKYMVVYPQRLATMFHNSVILQSILIWGTSLLMGGHPALVSFAISCLSIILMLIFSICLPVVVAFALPYICPFPVPYVANPWLIIGLFGSPALLGAFIGQHIG

SEQ ID NO: 50333 - protein, 126 aa, Sorghum bicolor
  unsure (1)..(126): unsure at all Xaa locations
  Clone ID: LIB3478-056-Q6-K1-E7.pep
MAALRLASFTLLPAAAAEAWACYCASRVGPRSGCFKRAGRWLPCLRLGPPRRRGDLCRPHAEDEQVATLRAVKESAKERDAQATIVPPQEXVERPCAGLTLATSCDSTTMCPEEWTALIDIINLLN

SEQ ID NO: 50334 - protein, 110 aa, Sorghum bicolor
  Clone ID: LIB3478-056-Q6-K1-E9.pep
RHPSRRDRHVHLKISRRCMAPPRYRQAWPFVLGRLPSSAHNRSALGRRKGGCAQGRGRAQAPRDGLRDHARRAERARSALPPGDGLSPPSMAPAFRLASVGAVEGGEGGS

SEQ ID NO: 50335 - protein, 68 aa, Sorghum bicolor
  Clone ID: LIB3478-056-Q6-K1-F6.pep
TFPIVLHDNCIMSGRELTYDGGGKAYFIQLFSFYTKQHNRVFRFKIIFFFANNENNERMKKKTCLIFL

SEQ ID NO: 50336 - protein, 163 aa, Sorghum bicolor
  unsure (1)..(163): unsure at all Xaa locations
  Clone ID: LIB3478-056-Q6-K1-G10.pep
SGASAVGLTAVVHKDPVTREWTIEGGALVLADXICLIDEFDKMNDQDRVXIHEAMEQQSISMSKAGICSVITAANPIGGRXLQDIVDPFTDEMLARFVVDSHTRSRPKGANLEDRIPTDVDDDPLASVREANPDVNRTLSTMLRAVLKKNLKMWEECLPHVEF

SEQ ID NO: 50337 - protein, 188 aa, Sorghum bicolor
  Clone ID: LIB3478-056-Q6-K1-H7.pep
MPFSHHSPAATSQLLAPSRRTLLLPLPCPRAGATPAAEAVLLPGGLRAESLPRHVAVVMDGNSRWARARGLPSAAGHEAGRRALEEVVRLSRAWGVRALTAFAFSHENWSRPRVEVEFLMGQFERAIRESVAEFLRDGIRLRVIGDSSRLPVSLQKIAREAEEATRSNSQLDLTLAISYSGRRDIIQA

SEQ ID NO: 50338 - protein, 162 aa, Sorghum bicolor
  unsure (1)..(162): unsure at all Xaa locations
  Clone ID: LIB3478-056-Q6-K1-H9.pep
GRVGQIQVPHQQFVGNNVVHGLNPSAVGHPLDPRILALPFNAEHTFGHPMHPPLINQANNGSLRILPYQNATVMDHSRIYEAGHVIDEHRDMRLDVDNMTYEELVALQEQIGDVNTGLTESYIQENLKSTXYVPGAASIPDQFSELSLENDACIICQEEYEA

SEQ ID NO: 50339 - protein, 84 aa, Sorghum bicolor
  Clone ID: LIB3478-057-Q6-K1-B2.pep
QCWSPPPPSSPPPPRLRAPARRPSSPSASLPSPPPPASGRSPSPSPRVRCTARSMSSQPWRWRRRRAATTGPRSPRRRSTPRTG

SEQ ID NO: 50340 - protein, 125 aa, Sorghum bicolor
  Clone ID: LIB3478-057-Q6-K1-C12.pep
YCCILLRLALFLQLRSQIASATSAIKSVFGQEVQQQDAANKLEQLRERMLKVRELFRDTESTEFIIVTIPTVMAISESSRLHSSLQKESVPVRRLIVNQVLPPSTSDCKFCAIKRKDQTRALDMI

SEQ ID NO: 50341 - protein, 155 aa, Sorghum bicolor
  Clone ID: LIB3478-057-Q6-K1-C6.pep
MGWWESMFGDGGDGGNVGCFRRIGRKHARNSYAFPADPVSEKRRGRSGGPVAEEVITVEVPEVPLRELNEITASFSGEKLIGQGSYAKVYQATLRSGRLAVVKRLEKPSKHASNVVFLRQLGVASRLSHDNFVRLLGYTISGDLRVLVYEFATMG

SEQ ID NO: 50342 - protein, 201 aa, Sorghum bicolor
  unsure (1)..(201): unsure at all Xaa locations
  Clone ID: LIB3478-057-Q6-K1-E5.pep
NFQGSYGCCPQGINFDPVRRQCTSSKRQSVLLGIAVGISSGFGVLLLTLTAIILVKRWRTDTQKKIRRAYFRKNKGLLLEQLISSTESVTHNTRIFSLEELEKATNNFDSTRIIGHGGHGTVYKGILSDQRVVAIKRSKIVEQSEIDQFVNEVAILSQIIHRNVVKLFGCCLESXVPLLVYEFISNGTLHDLLHGNLSAKC

SEQ ID NO: 50343 - protein, 77 aa, Sorghum bicolor
  Clone ID: LIB3478-057-Q6-K1-F1.pep
LCTSSLIYCCSCPAVTGRLMRARGVRGASSLRSLDGIGRFVHIAHLLRLLLAVHLELFPLFARAAVLFLVVFLRTRG

SEQ ID NO: 50344 - protein, 68 aa, Sorghum bicolor
  Clone ID: LIB3478-058-Q6-K1-A9.pep
DKSDVGEGDNYGVHRSPNRLRAPKNIGSAQKKGVRSTHTGHCCSINGPVTSQEIRMLYYPKSRRVDDS

SEQ ID NO: 50345 - protein, 134 aa, Sorghum bicolor
  unsure (1)..(134): unsure at all Xaa locations
  Clone ID: LIB3478-058-Q6-K1-D4.pep
RVXAILDQYNDDHILLGDLAHELGGDVSFQWIHEKRACYYHFNFTTRTKEAGIANLFFAEVSRMQIDGDWVLSCCCMVGPNDNGGCYSCASDDSPDIKHPSHTNSYTGGHVDEYLRFGGDSCSDSDDDEEVHVA

SEQ ID NO: 50346 - protein, 161 aa, Sorghum bicolor
  unsure (1)..(161): unsure at all Xaa locations
  Clone ID: LIB3478-058-Q6-K1-E11.pep
VAAPVEARNKLSVSEGALVXEPGEYRSLAGALQYLTLTRPDLAFAVQQVCXLGSSAVDQLTAYSDADWAGCPDTRRSIYGFCVYLGDNLVSWSSKRQTTVSRSSAEAEYRAVAHVVAECCWLRQLLQELHISIPLATVVYCDNVSTVYMAANPIHHRRTKH

SEQ ID NO: 50347 - protein, 109 aa, Sorghum bicolor
  Clone ID: LIB3478-058-Q6-K1-E12.pep
PEAAVRKHVETVLSAPWHAAGPGVLFLLALSCCWSWWCGAVVVTARPTPSTTTTAGGGGGSGFIASWCAGTDYPALCNATLAPYAAEVGASPARLSLAALTVTLGGARK

SEQ ID NO: 50348 - protein, 169 aa, Sorghum bicolor
  unsure (1)..(169): unsure at all Xaa locations
  Clone ID: LIB3478-058-Q6-K1-H7.pep
XXYVPEISSTDESISLQDNAISAETLLGSSNILXAGVLNSVVQNGSAADAILMETNLEKQDEVPSGGSIEFDLNSSEEQARLFAQVSDSDEDIVLNSQADAQDGTASSATDGVILPLESSAVYESNAALLRDHETLPNDNHDGSTDGAVDDANLLATINGVQAKASFFT

SEQ ID NO: 50349 - protein, 84 aa, Sorghum bicolor
  Clone ID: LIB3478-058-Q6-K1-H8.pep
LHTSMLVSEYQIYASTQVCSSRSATIPLIASVSIIARIYISTQYLFRGSESPLRLCISHSCLGAHTRTGLPPMACPSLILQARV

SEQ ID NO: 50350 - protein, 56 aa, Sorghum bicolor
  Clone ID: LIB3478-059-Q6-K1-H9.pep
DSPCIVSLNSSVVVFTRSRTSSLAIALTPTPFNFFPFFSRHISRLSPSNFKIGSSL

SEQ ID NO: 50351 - protein, 125 aa, Sorghum bicolor
  Clone ID: LIB3480-001-P1-K1-A6.pep
PPSPSASPSLSARRSHHHPTLRVNLFGYDYSGYGRSTGKPTECNTYADIEAAYNCLKEKYGVADEDIILYGQSVGSGPTIDLASRLPDLRAVVLHSAILSGLRVLYPVKLTFWFDIYKNIDKIGL

SEQ ID NO: 50352 - protein, 132 aa, Sorghum bicolor
  unsure (1)..(132): unsure at all Xaa locations
  Clone ID: LIB3480-001-P1-K1-A9.pep
GRYVQHXNRHVGPMAWPVGPLCLARTAPEAPWHCHGDVAVAKPAXMRWLDEKAAAGRAVLYVALGTMVAVPGSKLREVVDGLDRAGLDFLWAVRPVDADLGXGFEERVQGRGMLVREWLDQRAILAHECVKG

SEQ ID NO: 50353 - protein, 81 aa, Sorghum bicolor
  Clone ID: LIB3480-001-P1-K1-B2.pep
PQLMLAWIASMMAMAKWRRSRLDKRRHDLQEKSMAFVPRSLAAMDYHSPPPSNEATARIGTDPSCEGKGTKRRQRCQAVWP

SEQ ID NO: 50354 - protein, 148 aa, Sorghum bicolor
  Clone ID: LIB3480-001-P1-K1-B6.pep
LGGRDRGRTGLAAAAAAGGGGGHRCGDGGGRGSCVGSTAAAARTCFGGRSLGRTPRCCCSPFAGGRPARGAASTTAAPRGGLPRWPASTTTAEGLSSWAPPPGRRGCAAGAAAAPWRPCSRAPCRSRPCTRHRRCPRRRTLAPWVVWP

SEQ ID NO: 50355 - protein, 100 aa, Sorghum bicolor
  Clone ID: LIB3480-001-P1-K1-B7.pep
NVFDNKTAFANELDYGKSKREAQWAIAQRSLHGLQQPEASGLFNTDNSNDFIELSEIAEQAKRRAEIARLRELHTLKGHVESVVKLKGLDIDTIQHNYTV

SEQ ID NO: 50356 - protein, 107 aa, Sorghum bicolor
  Clone ID: LIB3480-001-P1-K1-C7.pep
SSNKNGGNIRDSPDHFGWRTVSDGDGITLFGSTNVWLDHLSLSNCQDGLIDVIVKSTGVTISNCHMTNHNDVMLFSSSDKHPEDQIMQITVAFNHFGRSLGQRMPKG

SEQ ID NO: 50357 - protein, 120 aa, Sorghum bicolor
  Clone ID: LIB3480-001-P1-K1-D2.pep
PKNPPVIMWDDRAATRGKDGKPVGTYGSATVAVESDYFMASGVHFKNAAPLAAPGTEGGQAVAVRVYGNKAAFYDCTFDGGQDTLYDHRGLHYFKSCHIQGTVDFIFGFGRSLYEDCAIT

SEQ ID NO: 50358 - protein, 39 aa, Sorghum bicolor
  Clone ID: LIB3480-001-P1-K1-D7.pep
YIMDLFYVIDDVTFSNLTQNILSLYYVVLKFDLIYLGQR

SEQ ID NO: 50359 - protein, 61 aa, Sorghum bicolor
  Clone ID: LIB3480-001-P1-K1-E1.pep
NLVECLSDDECLDEKQEVSEKDAHAKRLSDERYLHQDPNFRGINRQLDRGWRGSSLFFLSF

SEQ ID NO: 50360 - protein, 143 aa, Sorghum bicolor
  Clone ID: LIB3480-001-P1-K1-F1.pep
ILLGRSDVAGWGAFIKNPVNKNDYLGEYTGELISHKEADKRGKIYDRANSSFLFDLNDQYVLDAYRKGDKLKFANHSSNPNCYAKVMLVAGDHRVGIYAKEHIEASDELFYDYRYGPDQAPAWAKRPEGSKKDEASVSHHRAH

SEQ ID NO: 50361 - protein, 120 aa, Sorghum bicolor
  Clone ID: LIB3480-001-P1-K1-F3.pep
EMVKAKEGVERKLYGSYSLGRDEPSLEPQGSSSLPLYHGKYRSYSFHSSQKESITIFHSSEDSTTSSCSDDSESCSGTSSGEMELDESKLAEEAGPSNTANVEEGVQHELEKQHQHCSAP

SEQ ID NO: 50362 - protein, 146 aa, Sorghum bicolor
  Clone ID: LIB3480-001-P1-K1-F5.pep
GVADGATFWLFFNTWSEINRRSSSGGEGYKLSTPPPVLDRWFLDTCPVPVPLPFGKLEDIVQRPEYSPVQECFFHFSAESIKRLKTKANAEMAGTATATISSLQSLLAHLWRAVCRARGLAPHLETTYKLGIGCRARVKSIPQEYM

SEQ ID NO: 50363 - protein, 76 aa, Sorghum bicolor
  Clone ID: LIB3480-001-P1-K1-G10.pep
CISSPTRSTMTSGSAFFFRATSKIPNIPYMRGSLDTLAAFKEPIWLTDCLRNQRAQAGGVPLPSGLHSHRLGPRCP

SEQ ID NO: 50364 - protein, 134 aa, Sorghum bicolor
  Clone ID: LIB3480-001-P1-K1-G6.pep
NHAYYRNVTFVEGFSKTSVVKHASDVKGTIKVLNCHDSVIYILAPLKYATVYGCSDATVVLGAVGKVVKVEHCERVHIIAAAKRICIANCRECIFYLGVNHQPLVLGDNHKLQVAPFNTCYPQLQDHMTQVGVD

SEQ ID NO: 50365 - protein, 44 aa, Sorghum bicolor
  Clone ID: LIB3480-001-P1-K1-H6.pep
FCQSPRCELTVGDLILDLSISTLARVRLEHVSLPPLVWPHPMCG

SEQ ID NO: 50366 - protein, 127 aa, Sorghum bicolor
  unsure (1)..(127): unsure at all Xaa locations
  Clone ID: LIB3480-001-P1-K1-H9.pep
LKTLAHIGFRLRWRDWISALLGMASTRVLVNGRLGRRILHSRGLRQGDPLSPLLFVIVIWTSTTPSSRRTTDEQCYAPCLGTSSSTXASVYADDPVIFLSPEVDDFVCMRQILDLFAGASGHSFWML

SEQ ID NO: 50367 - protein, 154 aa, Sorghum bicolor
  Clone ID: LIB3480-002-P1-K1-A4.pep
PTRPAARQGYDGLAAYLAEKGLTAHFEAMSLSKDKRSTSRTQSLKQNTMEFENLSEQELCLRESLAAYRNAADAANNIQAALRERTLKLQTKAIQLANPETEAASIVAAMRIQHAFRNYNRKKMMRAAARIQSHFRTWQIRKNFMNMRRQAIKI

SEQ ID NO: 50368 - protein, 79 aa, Sorghum bicolor
  Clone ID: LIB3480-002-P1-K1-D6.pep
LGLTRCSYRINWGTLHLQATILSSCRFMNTLTALLYDMMEVKLSDGDQLERLMYCESVCLDPFMNHEALRWKCCTIMYS

SEQ ID NO: 50369 - protein, 78 aa, Sorghum bicolor
  Clone ID: LIB3480-002-P1-K1-E7.pep
KSISESVRRTVYSVGIWTSSHCASLGIMHLPPHNRKFNRRKNKVFSSIELLSMRKNQTARSGAPSNACKLPYPITSTN

SEQ ID NO: 50370 - protein, 131 aa, Sorghum bicolor
  Clone ID: LIB3480-002-P1-K1-F3.pep
MECLLGLLKVRVVRGVHLAICDPLTHSSDPYVVLRHGQQKVKSSIKYRTCNPEWNEELTLSITNMMNPVKIELFDHDTFTKDDSMGNAEFCILNFVEIAKQDLSDVPDGTVMKSILPEKGGNCLATESHIT

SEQ ID NO: 50371 - protein, 150 aa, Sorghum bicolor
  Clone ID: LIB3480-002-P1-K1-F9.pep
ARAWAKIKHWRVPNPMPCSDNCGVSINWHVMNNYKSGWSARMTIFNWQDYTFKDWFAAVTMGSHFSGYENVYSFNGTRMGAPFNNTIFMQGVPGLAYLDPITDGNTPAEPRLPGKQQSVLSFSRKDAPNIDIPKGEGFPKRVYFDGEECA

SEQ ID NO: 50372 - protein, 77 aa, Sorghum bicolor
  Clone ID: LIB3480-002-P1-K1-G9.pep
RRQWSKVHHHQIKPRAYGDHNFTARSSGPVVVQLSSVLDQIMEPRWSDTRHRCIGPRTAGPVARKHPLLPDQMVSRR

SEQ ID NO: 50373 - protein, 59 aa, Sorghum bicolor
  Clone ID: LIB3480-003-P1-K1-A7.pep
TIKPLYTLALAHLCLVGLACAGAAQMCTPYHLQSAGTIINMLTNKTQLPLTLTHSPSVD

SEQ ID NO: 50374 - protein, 103 aa, Sorghum bicolor
  unsure (1)..(103): unsure at all Xaa locations
  Clone ID: LIB3480-003-P1-K1-B11.pep
QVFVPIDDLLAGAXEGGDSRPVSYQVRRPNSGRAHGVFYLCYKCTDVPAVACVPELEGKQGRHAKYVLESRNTTDNAMVPSTDYSPSAMQLTYQPTAKWAGIP

SEQ ID NO: 50375 - protein, 97 aa, Sorghum bicolor
  Clone ID: LIB3480-003-P1-K1-B12.pep
EIHMEEKNMRYQLTSPAHQTEGCKLYLGIHQFHNILRNGHKEHHDIPKRYKLTHHEYELDTDKWKNHKCAGELGALSCVVNHTLKNLYILLLTNMLQ

SEQ ID NO: 50376 - protein, 40 aa, Sorghum bicolor
  Clone ID: LIB3480-003-P1-K1-C12.pep
NEYAHVHVWCVEVSFISLKCIKNQWLDLPHAQNESTLPNS

SEQ ID NO: 50377 - protein, 76 aa, Sorghum bicolor
  Clone ID: LIB3480-003-P1-K1-C7.pep
GQPNCARKHRGVELFLCWAIMQGFVMMLHNRYQRQRLYTRIALGNAKRMDVVWGETAGVEGQLLLLCPLLIFLQGF

SEQ ID NO: 50378 - protein, 96 aa, Sorghum bicolor
  Clone ID: LIB3480-003-P1-K1-D10.pep
DSQNVLHRRALVEPPREVVHLIFVFIPLVPLTWPYSSKSLHSFSHFRKLSSCLELSSSIAHDCMSAGMGSCISARVPRGLFRCIYRPSILALFSLP

SEQ ID NO: 50379 - protein, 65 aa, Sorghum bicolor
  Clone ID: LIB3480-003-P1-K1-F1.pep
PSAFTEQDLDERIMKQLQEEEERKRQRKEKKKEKKREQAAQHEPEDVDPDIAAMMGFGGFGSSKK

SEQ ID NO: 50380 - protein, 53 aa, Sorghum bicolor
  Clone ID: LIB3480-003-P1-K1-F12.pep
FGNPRVFPITFVFKQLFHYFNFFFSFFFPFSPFFFLFFYFFFFFFFFFFFFFS

SEQ ID NO: 50381 - protein, 132 aa, Sorghum bicolor
  Clone ID: LIB3480-003-P1-K1-F7.pep
HASAHASVQVKAAENFCDLVRSIYHAIKVVSRRRNGTLNSQFHAIWNLKMALLRSSTKENIDQVFNIEEMKLKFDQLWRKWYLWLSLACVLDPRYKIRVLRCFNEAFGSHAKRYISEMRGKLYELFLQYSCH

SEQ ID NO: 50382 - protein, 47 aa, Sorghum bicolor
  Clone ID: LIB3480-003-P1-K1-F8.pep
STHTKTTYKKLKAEKKLMRPWGVDLPCNKSVFKTSQWYLLFTSARNL

SEQ ID NO: 50383 - protein, 68 aa, Sorghum bicolor
  Clone ID: LIB3480-003-P1-K1-G11.pep
MGTLRKTVILRPFQYMSYMKYGKDPEMHNGFPSDVLHIAYIAWDGPGSHNINSHYNAGGAPHSIKDYH

SEQ ID NO: 50384 - protein, 50 aa, Sorghum bicolor
  Clone ID: LIB3480-003-P1-K1-G12.pep
PNTDGIDPDSSTHVKIEDCYIVSGDDCVAVKSGWDEYGIKFNMPSQHIVI

SEQ ID NO: 50385 - protein, 44 aa, Sorghum bicolor
  Clone ID: LIB3480-003-P1-K1-G4.pep
KRNLFNHTVYPWQFFACFLLTPPLLQFPHTKILRPPPPATSSIF

SEQ ID NO: 50386 - protein, 145 aa, Sorghum bicolor
  Clone ID: LIB3480-004-P1-K1-A9.pep
LAWKWSEKEGEDGKKEGGFKRVYLHQEGVPGSRMGSIVSLPGGGDVHEGGEFVHAAALVSQSALFSKDLTEPRMSGAAMINASEVAAKGSSWKDLFEPGVRRALLVGVGIQILQQFAGINGVLYYTPQILEQAGVAVLLSNLGLS

SEQ ID NO: 50387 - protein, 107 aa, Sorghum bicolor
  unsure (1)..(107): unsure at all Xaa locations
  Clone ID: LIB3480-004-P1-K1-B2.pep
YNRLDVAEPSYSVCRPGSSHHKDLGMRDALAGFGARNKRIHYSGPLMPPGGNMEDMLKEHEKXIQHAVRMARVEKEMTNRHLLLNNEENNWHQFGEFFPWSYRPVLS

SEQ ID NO: 50388 - protein, 39 aa, Sorghum bicolor
  Clone ID: LIB3480-004-P1-K1-C1.pep
MYKTIPCIGFSLVFRKLLTPYVRVCNGGYENEVANALDL

SEQ ID NO: 50389 - protein, 65 aa, Sorghum bicolor
  Clone ID: LIB3480-004-P1-K1-C10.pep
LLYYIFFLDCPKNLFCTSNVAYIVAYKNRRARNLLIMWPHCICHVSFPSSLAPSLSSVYSPERKK

SEQ ID NO: 50390 - protein, 101 aa, Sorghum bicolor
  Clone ID: LIB3480-004-P1-K1-D10.pep
RAHWRPSRGMFQNPGESSRAAAAATDTPSLVPAEAPAPASASDTCTVKPSYCGRPGQRIFPWFLLKPALVHLVQVCYLARCLWTHTLQIYKYLFRVCINLI

SEQ ID NO: 50391 - protein, 152 aa, Sorghum bicolor
  Clone ID: LIB3480-004-P1-K1-D3.pep
VQQYKDQPVQQPPPTPPVPQQDRYVLSQAIVYYPQCQAPGIQDTQGQPLQPEVQYLPSRPAAQDVPVHAPSQPPQTGNQTQPQPYPPYQQQWHQQSPQPTPAPVAQTQQTFSQPFPPPAQKPQLSNVQQFSPQPVQQPQSNAQQYPSPVQPQ

SEQ ID NO: 50392 - protein, 93 aa, Sorghum bicolor
  Clone ID: LIB3480-004-P1-K1-D9.pep
AIHTWRWRSRKTKAGAIVYTHKQTMLAGAGVNSPGMDIYISALCRGRRHSDLKVRLRHWHWHSHCHWWPPGTGRTMAALSCGGRCHNVSTDAW

SEQ ID NO: 50393 - protein, 123 aa, Sorghum bicolor
  Clone ID: LIB3480-004-P1-K1-E1.pep
MANHLRPLALLLAVLACALLCRRADATGFEGRGDDGWVGPPASDGGRYHQGAVQNPFLGGDIGHFKDQEDLVMVGTEADYHSWSALHPIFFFNNRDTEVALDHPGTIYFIRGETGHCERGQRM

SEQ ID NO: 50394 - protein, 38 aa, Sorghum bicolor
  Clone ID: LIB3480-004-P1-K1-E3.pep
TRACDCHSFFFSRPLNSFPLAFFVQRLTWVNRGVSQLN

SEQ ID NO: 50395 - protein, 66 aa, Sorghum bicolor
  Clone ID: LIB3480-004-P1-K1-E5.pep
KLKLGRAFLFKPPKPQKGWASFTRTAKKGESRVPLVKGPICYFRSLFIIFFFFFFFFFFFFFFFFF

SEQ ID NO: 50396 - protein, 113 aa, Sorghum bicolor
  Clone ID: LIB3480-004-P1-K1-F11.pep
MAAKEHFVLVHGEGHGAWCWFKLRWLLEGAGYRVTCIDLAGGGVDPTDPNTIRSFKQYDKPLIDLISTLPEGEKVILVGHGAGGLSVIHAMHEFVDRISQSFFVAATMLPFGF

SEQ ID NO: 50397 - protein, 82 aa, Sorghum bicolor
  Clone ID: LIB3480-004-P1-K1-F3.pep
MPGLVNFDSFKRPPLFFFFFFFFFFFFFFFFFFFFFFFFFFFFFFFFFFFFFFFFLAEYEPTKKVLVVASAAVYSTDNNSSR

SEQ ID NO: 50398 - protein, 56 aa, Sorghum bicolor
  Clone ID: LIB3480-004-P1-K1-H1.pep
QYLHLCLWQSVVYWVDYSQTLCCMSWNAVAILFFAFYFNTPKIICNHIMLAENLIY

SEQ ID NO: 50399 - protein, 116 aa, Sorghum bicolor
  Clone ID: LIB3480-004-P1-K1-H12.pep
ASKSNAGTGTPQQAKEHECSSCGAVFASGQALGGHMRRHRPLTTSSSAAAAPESVVTATGTTGDQDSSKLLQEGNINLELDLNLLPAPSTEQEVTSPAKPPCHAPAVQLMHALTRH

SEQ ID NO: 50400 - protein, 92 aa, Sorghum bicolor
  Clone ID: LIB3480-004-P1-K1-H7.pep
GQGHGTVQQALFNPYCDGPKAAGAWHGHRKRWMHSAMAHLNRGAALAHLAGWIDEGEELIDRGCKKQLKLDGKWLSPWSETIRAHVLSIRPT

SEQ ID NO: 50401 - protein, 115 aa, Sorghum bicolor
  Clone ID: LIB3480-005-P1-K1-A1.pep
HKIECLHIISMRNHLFIQQLNCIPGDQDLVFPGSRFPSHIGILTFSAEDNLSHVQRRVIITIAPNQANKGYSHLVSVSSVHQTNNLLFFRIIYPWLELIIMYIVLQPEEKPTHQS

SEQ ID NO: 50402 - protein, 40 aa, Sorghum bicolor
  Clone ID: LIB3480-005-P1-K1-B2.pep
KPKWATTILPYINNIVKGVLIAAQQHVGEHSILYFGEAYL

SEQ ID NO: 50403 - protein, 43 aa, Sorghum bicolor
  Clone ID: LIB3480-005-P1-K1-C2.pep
PVPSSVRSKALLSYQSAGCSGNALRGIVVVSDHHYDLLELDIA

SEQ ID NO: 50404 - protein, 56 aa, Sorghum bicolor
  Clone ID: LIB3480-005-P1-K1-D1.pep
ARSCLNILLFLQLYMIATSSIFLKSFHRWISLLKSIAHAFGVPFLSLVMNYSGSDL

SEQ ID NO: 50405 - protein, 123 aa, Sorghum bicolor
  Clone ID: LIB3480-005-P1-K1-E1.pep
STPARRWHLPRRTREAGQAAAWRPPPSTSTGVVDEPRVLTAAPEQPAAMKPDMNIAVDLDFFLSSVGRRECRSDTVGECLTVAEDLLPRGWWPGAPARRMSRGPLAAGGSQVLRWGGRAGDLR

SEQ ID NO: 50406 - protein, 132 aa, Sorghum bicolor
  Clone ID: LIB3480-005-P1-K1-E3.pep
MRYMAADMEDAGFGNSSSSHDCSRRSDPHSIAVDINKAFPDGTNLALVQKDLATQSAEIEKQRMEIEVEALELAKQRLKWEIFSKKKDRELEKMRLENEQMKMENRRLELEVRDKELELERKLQGSGSHAMT

SEQ ID NO: 50407 - protein, 47 aa, Sorghum bicolor
  Clone ID: LIB3480-005-P1-K1-F10.pep
AHIYYMAHGKLQLALPLEKEQEGSQISVMRTVDSRMRKERDEDRRRI

SEQ ID NO: 50408 - protein, 74 aa, Sorghum bicolor
  Clone ID: LIB3480-005-P1-K1-F12.pep
RPRHLHVLEVPDAPARRQHEQEDQIVPMQCLLHSFDFEESIVNCLCYAAVGVARYLWIRHVTSVIFLFDRNQSF

SEQ ID NO: 50409 - protein, 73 aa, Sorghum bicolor
  Clone ID: LIB3480-005-P1-K1-F2.pep
VEGIIKVSVHYDISYFTPAKLHEEVEMDGRVVEQKGRMTAVTVEIRKKESGELVAIGRQWMTASRPKGSQSKI

SEQ ID NO: 50410 - protein, 150 aa, Sorghum bicolor
  Clone ID: LIB3480-005-P1-K1-F5.pep
HASGKTSFMVKYVGDDGEEQNGLQMTGLNLMDKTMAVRGARIAYSIWDVAGDHQSVDHIPIACKDAVAILYMFDLTSRCTLNNIVDWYERARKWNKTAIPILIGTKFDDFAQLPLEMQWAIGNQARAYARAMKATLFFSSATHNINVNKI

SEQ ID NO: 50411 - protein, 110 aa, Sorghum bicolor
  Clone ID: LIB3480-005-P1-K1-F7.pep
PRVRPRVRARAICIMKHPIPDTKDSHSVQIILPKKQLKRKSDMYVFCCSYAHNVAPKGKFIAFVSTEAETDKPEIELKPGIDLLGPVDETFFDIYDRYELINNPEGDSCS

SEQ ID NO: 50412 - protein, 129 aa, Sorghum bicolor
  unsure (1)..(129): unsure at all Xaa locations
  Clone ID: LIB3480-005-P1-K1-G1.pep
YQISTIRFIIXYIFIRYFIQILEIEAFNDRCVKKTQVYALASYLRHGRCVRVGDLPAIPIIHQPHLICGQQCGATGTLMKPRQSWSRITRPLRFRRRPPRPRRGGGALRPSTPAASLSHVNAPPRRLQD

SEQ ID NO: 50413 - protein, 81 aa, Sorghum bicolor
  unsure (1)..(81): unsure at all Xaa locations
  Clone ID: LIB3480-005-P1-K1-H11.pep
HSILSEYQVXGYTHSERTRYVYRGGRPRTHHACALAYYVITNVPQWLLSRCYSPLTSDPHPPGPVVGVVAAVRCAGRRHGC

SEQ ID NO: 50414 - protein, 81 aa, Sorghum bicolor
  Clone ID: LIB3480-005-P1-K1-H3.pep
HLHSLYCLVPLSFLSSASKDRKLAAMSSVSAPMTLMLLRLKLAASGTMESYQFRAITFGIALGMRRPCRISATAGYPSARV

SEQ ID NO: 50415 - protein, 71 aa, Sorghum bicolor
  Clone ID: LIB3480-006-P1-K1-A10.pep
MSGYHQEVSTNIENSRNSLRRIATNDDTEFSRESIVNLMEKFVKTVNVMDETILVPCRLMDRTVGDATDTV

SEQ ID NO: 50416 - protein, 132 aa, Sorghum bicolor
  unsure (1)..(132): unsure at all Xaa locations
  Clone ID: LIB3480-006-P1-K1-B11.pep
KIYRPWMCPLARALYVLMSLITVLIGFYDLYKNVPMLKATASRLFGPFFDWIETWEMISRLKYLGTMLFLHNFQQAFTWSLKIVGAAKSVLSVLTKPIAGPIVEVLELTMPMWNLCAETAXHLSSVVMVALE

SEQ ID NO: 50417 - protein, 63 aa, Sorghum bicolor
  Clone ID: LIB3480-006-P1-K1-B8.pep
DSLEIASGQSGGATLANSCLRLRSCSIYQPILNSLVSFVLRRAWKHRVAAELNDGDTHRFVGS

SEQ ID NO: 50418 - protein, 154 aa, Sorghum bicolor
  unsure (1)..(154): unsure at all Xaa locations
  Clone ID: LIB3480-006-P1-K1-C5.pep
PVFLFFSVNTSGQLVRLAERLGPVDFKMTMDFWEEDKWNGSFPIKWHIIKDAPNQLFKHIILVNNDNRQATFSRDTQEIGLTQGAQMLKTFKDHPQGTSILDDYDFYXEEKANARRAEKRGNSESTYEARFYDDLKPIENLRPAWRVGFIRHWE

SEQ ID NO: 50419 - protein, 52 aa, Sorghum bicolor
  Clone ID: LIB3480-006-P1-K1-D2.pep
LPRISGKSYSIEMSGNVIDEATGKKLRSLGKLAPTIEKLKRGFGMHVPEEFR

SEQ ID NO: 50420 - protein, 68 aa, Sorghum bicolor
  Clone ID: LIB3480-006-P1-K1-D9.pep
RWMRCDPIKLGCDTVYPLYSGINRRPVNVNLGRPTEEPFFLFACISKLPSPIVSALFFFFFFFFFFFF

SEQ ID NO: 50421 - protein, 154 aa, Sorghum bicolor
  unsure (1)..(154): unsure at all Xaa locations
  Clone ID: LIB3480-006-P1-K1-E12.pep
LRKREQDIIYERKLYKERSKEDHLFGDKDKFVTSAYRKKLEEQQKWLEEERMRQLPEEKEDVTKKKDLSDFYFGLERNVAFGARTHGNTKCADPQKSDNQPEDTNPSSLDAEASEPSPKRKRESSVXSEGTNSMEEPSASRTRDSTAVASTEKN

SEQ ID NO: 50422 - protein, 89 aa, Sorghum bicolor
  Clone ID: LIB3480-006-P1-K1-E5.pep
TNYNYEEEGEWADARDVPHYAQRSGYTVSALMNRPTSDGRPSVAHRGHSELDRASPINSGLGARHFQQQRQQSTTTPAATRPHMCLLCM

SEQ ID NO: 50423 - protein, 45 aa, Sorghum bicolor
  Clone ID: LIB3480-006-P1-K1-E8.pep
LVKEWTTWPMKKAKVVAHYGFIPLVIVIGMNSEPKPSVFQLLSPV

SEQ ID NO: 50424 - protein, 82 aa, Sorghum bicolor
  unsure (1)..(82): unsure at all Xaa locations
  Clone ID: LIB3480-006-P1-K1-F3.pep
ALMSDSLSGMKRPLDSSEPAGQHQQQQPNGGGGPAHQFSLPKTSLEMAAIEKFLQFQDAVPCKIXAKAXCATHPRIIFKRLR

SEQ ID NO: 50425 - protein, 56 aa, Sorghum bicolor
  Clone ID: LIB3480-006-P1-K1-F7.pep
VIAHIQKTSLYISCLLTCLVDFATDKLSYGAPSVEGSSASVVRISRLLAFDVRCKP

SEQ ID NO: 50426 - protein, 88 aa, Sorghum bicolor
  Clone ID: LIB3480-006-P1-K1-F9.pep
VPYASISTNNACCNHVSSSITKENEDRGGALHVGPSTHQVEPLPTGRRQKTLAQISVHKRSSRSQPAWSPAPSTGAVKRCGSRLSKAG

SEQ ID NO: 50427 - protein, 145 aa, Sorghum bicolor
  Clone ID: LIB3480-006-P1-K1-G10.pep
ARSSDSAGKAERDQLPCARTPCRARRRGRAPSPSRRPSSSRRRPARWPAAGTPCRIRGRVGCRARRAERRRRRCRGPGSGAGARARGGSPPPRPGPRSWPPSPPRAPPRSARPARPGGADPRRRGSARPTPATPRSGRSSLSPRR

SEQ ID NO: 50428 - protein, 47 aa, Sorghum bicolor
  Clone ID: LIB3480-006-P1-K1-H3.pep
SPRPSHCVSMELDKRGEEDLDRTSCSGMFWSRRSCHREQQCDAEINA

SEQ ID NO: 50429 - protein, 93 aa, Sorghum bicolor
  Clone ID: LIB3480-006-P1-K1-H4.pep
GGIGELHISTLETHCGVMNMDIYSGNMPDTVHKYTHVHSYITNGHTFPLNESALRFACFSCLSTHGNSLTAMHVERRILAKKEESHLHLYEDD

SEQ ID NO: 50430 - protein, 127 aa, Sorghum bicolor
  unsure (1)..(127): unsure at all Xaa locations
  Clone ID: LIB3480-007-P1-K1-A12.pep
YLEGVDPGALGGRKPSDVLFSKDRSRWYDGRREVHIHPSSGNHNXKAGQYPFLVFLEKVETTKVLLRDTSVIYTYSLFLFGGSMVIQHQTGMAVIDGWVRLSAAAQTGDLFKQLRITHDAFLKELTR

SEQ ID NO: 50431 - protein, 83 aa, Sorghum bicolor
  Clone ID: LIB3480-007-P1-K1-A5.pep
MDYRRKPAVCRALLVLLIVASSAAVSMSTAGYDEKCWKDDDHHPICVSSDCKETCLDHGHVDGRCSWQWSWRPYCQCLLADCQ

SEQ ID NO: 50432 - protein, 128 aa, Sorghum bicolor
  unsure (1)..(128): unsure at all Xaa locations
  Clone ID: LIB3480-007-P1-K1-A7.pep
GHASGRLGDALYRIITDVGFDPDDLVSTVDLTXEHKILDLNDRIEASVIICNRKVHIKDGKSSWGYAVSQENREQFEELAQTLMIIIKHRFPGIPQATLDMAKIQENRDVGFALLESYSRVLESLAFN

SEQ ID NO: 50433 - protein, 51 aa, Sorghum bicolor
  Clone ID: LIB3480-007-P1-K1-B11.pep
MEAEGKLDPLKGPPQLVFFFFYGWAFLFFFFSFFFFFFFFFFFFFFFFFFF

SEQ ID NO: 50434 - protein, 46 aa, Sorghum bicolor
  Clone ID: LIB3480-007-P1-K1-B12.pep
VHGLHGIYHMLRNPFRRTPIELLDDMCHIESRFNLFGDSVSLGARL

SEQ ID NO: 50435 - protein, 143 aa, Sorghum bicolor
  unsure (1)..(143): unsure at all Xaa locations
  Clone ID: LIB3480-007-P1-K1-C1.pep
AKVLGTVVTVAGAMLMTLYKGPLMQLPWTTTRHVHASSPAAEAPAAAEISGRDWFLGSVFVIVATLDWASLFVLQTHTIKQYSGQVSLTTLVCFIGTLEAIAVTFVMERRTSVWTIXFDMNLLAAAYAGIVTSSIEYYVQCTV

SEQ ID NO: 50436 - protein, 88 aa, Sorghum bicolor
  Clone ID: LIB3480-007-P1-K1-D2.pep
VLTTVCTSRSSAACRCSCVLHADMQSPDRSEGICFCHASELGRSTISAVLTRLTVMANSITALTCWDDHSSTRVRPPIHQLQYACSST

SEQ ID NO: 50437 - protein, 108 aa, Sorghum bicolor
  unsure (1)..(108): unsure at all Xaa locations
  Clone ID: LIB3480-007-P1-K1-D5.pep
RKLNSLDGALQHNDWADNAVTQLNXIASHPIFVSWRDIKEDRTDRTAQQKSSLNGEWNAPCTGALNSARGGVTLSATXTLDRAVAYGPFVLFPSFLATLGGSALQAIN

SEQ ID NO: 50438 - protein, 74 aa, Sorghum bicolor
  Clone ID: LIB3480-007-P1-K1-E10.pep
AICMHFVSLSYFTICCSPPALPCMLLSAVSVYLYYPHLSTFPPLISLCYTDPYDEYLSPFPTTPSVLHLFGSNS

SEQ ID NO: 50439 - protein, 66 aa, Sorghum bicolor
  Clone ID: LIB3480-007-P1-K1-E3.pep
KKKKKRSAPFKKEPSLHSLACHELVYSIEEVRYNPMALDLQWAVCQTREQKQIIRLDSNLRIRQQT

SEQ ID NO: 50440 - protein, 127 aa, Sorghum bicolor
  Clone ID: LIB3480-007-P1-K1-F1.pep
DAWASNREPKRHVMAAEGSDPTSPASAPPPPPPPKRRKIEPPRRTRPSQVTPDKDNSVASSNSSPIPGSLPARVDLNKVREAKRFAVLQAQHEGCLGSYKSFDSLFGNYLVPVVPTNDFFDQVGTKP

SEQ ID NO: 50441 - protein, 44 aa, Sorghum bicolor
  Clone ID: LIB3480-007-P1-K1-F2.pep
KGPPLCIFFFFFFFFFFFFFFFFFFFFFFFFFFFFFFFFFFFFF

SEQ ID NO: 50442 - protein, 60 aa, Sorghum bicolor
  Clone ID: LIB3480-007-P1-K1-G12.pep
LLIHCMLGFNNIVPLVLRQRCCKKKRILYDGRIKSFGIYVLHNYLYRIISSLLCMLNYVC

SEQ ID NO: 50443 - protein, 147 aa, Sorghum bicolor
  Clone ID: LIB3480-007-P1-K1-G7.pep
VGLPHPSSSSKERPENPNRGRAPPPPWSRVRQARVGAGGPQAVGAQVFLATSAGPGAARRPRRRAGEQAALASFAGGLGGWRTTTEEVTDADPEEIHVIHDPENPKIVKGELFPDIVSFRKSIRHHAVKKGFVLTGIKTDKTWFLAK

SEQ ID NO: 50444 - protein, 43 aa, Sorghum bicolor
  Clone ID: LIB3480-007-P1-K1-G9.pep
TKAHLKPATSAIISAMSLPDRLRLGVPQLTELPPLRSKQNDNS

SEQ ID NO: 50445 - protein, 43 aa, Sorghum bicolor
  Clone ID: LIB3480-007-P1-K1-H5.pep
PPTVHPKESKFPSPPYQGITSVLGGPNSIQLPVVYHLVNGKTL

SEQ ID NO: 50446 - protein, 84 aa, Sorghum bicolor
  Clone ID: LIB3480-008-P1-K1-A10.pep
HDDIRPHAGWSITYIACQTEFSMPLPTTSRLACPWRLLLLVRCNISALPEPEPYLICLLLELFQALESCVRLPRGPSLACIKPG

SEQ ID NO: 50447 - protein, 31 aa, Sorghum bicolor
  Clone ID: LIB3480-008-P1-K1-A12.pep
ALINARRTGSNPRGMHMSRVANYHHHRLLST

SEQ ID NO: 50448 - protein, 66 aa, Sorghum bicolor
  Clone ID: LIB3480-008-P1-K1-B7.pep
LWGIQLLVLNSFVLPNIASMHLLCFLTPNWWCYLHHSCEVQHTHVPFVWPLSYATSALLYPSSFCR

SEQ ID NO: 50449 - protein, 58 aa, Sorghum bicolor
  Clone ID: LIB3480-008-P1-K1-C4.pep
YKLLDRISNSELQGREAHNEFSDTLENMLHRIAARPSFLTGLFPGNDVRDTSTSALKL

SEQ ID NO: 50450 - protein, 67 aa, Sorghum bicolor
  Clone ID: LIB3480-008-P1-K1-D11.pep
QMRSKLILVLSECRFIYFVSSWLQGTNKISAVPHIQCPLTVDCWKFSLWYSAFHRSSSSLKHHPIES

SEQ ID NO: 50451 - protein, 130 aa, Sorghum bicolor
  Clone ID: LIB3480-008-P1-K1-E3.pep
KKTHLQSKLTEEVKENTVLHANLERRKEALHERRVALEKEVENLRDQLQKERNLRASLESGLMNMRRGQVSLPSTIDTKTKADLEEVAAAEADIMNLKQKVSDLRGQLNNQVPLSSTSLCESCNSKRSIN

SEQ ID NO: 50452 - protein, 124 aa, Sorghum bicolor
  Clone ID: LIB3480-008-P1-K1-E9.pep
IFICMACSHLFEQQYYNCEGKCIILSISLYKMSSLQIRGEEKECIQGELANPTKESPILLVKNISVSKSHYFWCYEASFDEFIDNTTSRVLPEMTLFSSPCCGFAWGFTLSLWLLYATTPAMAM

SEQ ID NO: 50453 - protein, 158 aa, Sorghum bicolor
  Clone ID: LIB3480-008-P1-K1-F11.pep
FWALSPCRTSLFALCHYIRHVNESRVSREFGSAQTTCARHEFWTLTPCRTAGFALCHYIRHVNESRVSREFGSAQTTCARHEFWALTPCRTAVFDPGHYIRHVNESRVSREFGSAHTTCACNEFWPLSPCRTSLFALCHYIRHVNESRVSWDLAIFGH

SEQ ID NO: 50454 - protein, 56 aa, Sorghum bicolor
  Clone ID: LIB3480-008-P1-K1-F5.pep
STLTHTMHDNEDTLLHIRANPWPMHWREAQQHLRLGKPWQELSKSHRITSALRQML

SEQ ID NO: 50455 - protein, 40 aa, Sorghum bicolor
  Clone ID: LIB3480-008-P1-K1-F8.pep
KSSPLFIFFFFFLFSFFFSFLFFFFFFFFFFFFFFFFFFF

SEQ ID NO: 50456 - protein, 67 aa, Sorghum bicolor
  Clone ID: LIB3480-008-P1-K1-H2.pep
PTRPKKKKKKKNKKNKKKKNKKRGVKRNRRAGHIIYKRGGGARTLSLVRRPKLPSLAVGKHMGGRVF

SEQ ID NO: 50457 - protein, 115 aa, Sorghum bicolor
  Clone ID: LIB3480-009-P1-K1-B8.pep
KKLCLGVTLLLFLLLVSAAHGARLPDAKDVAAAAAAAGDGERITVRTGHGHGYSSHSGGHPNGGTPEQGGAGVVDPRNNNARSHHRNGAASRALGYSSWLICTLGGRSCYDASCM

SEQ ID NO: 50458 - protein, 91 aa, Sorghum bicolor
  Clone ID: LIB3480-009-P1-K1-B9.pep
EQDTLLAQNYQLLPPLKPPPQYEETEDENEESNPSLTPNPANSNPTFSQDQRNNEQQHTPQHGQRVSFQLNAVAAAAAKRPRMTIDQLNMG

SEQ ID NO: 50459 - protein, 132 aa, Sorghum bicolor
  Clone ID: LIB3480-009-P1-K1-C3.pep
PCHLLFTPPDAHRRGVLGFRAAGRAAPSTRARNLAPPAAEYRGDGVPELTGLLLVVYPYGLLHLQALTLRICLWATCRDDKPCNVQRCTNCSNYLPLAAWRHHMNTTSSFLYIFPFLFRPPYCPWIKSFYIT

SEQ ID NO: 50460 - protein, 112 aa, Sorghum bicolor
  unsure (1)..(112): unsure at all Xaa locations
  Clone ID: LIB3480-009-P1-K1-D1.pep
LLLPLRFGLDRIRQVLRGFRIVGELKRWRELDVEYRCFIGGLVWNTDDNPLXSVLKHYRVVLECKIIQDRETHTSQHLRSLIIETDTPCRGALKALNVKDTHRXTITLYRAL

SEQ ID NO: 50461 - protein, 131 aa, Sorghum bicolor
  Clone ID: LIB3480-009-P1-K1-D11.pep
MMSTESVFGLQVAPSSDFTGFFLAHPELMDIATPPRSSSAFADADADAKAAPVISPPFESIPELPESAMKGNYSFAFPNLIEDKRNYSKKQSQREHQPEPATPTEVAKPAPAAPAKAEAKAEAQPETSSKP

SEQ ID NO: 50462 - protein, 148 aa, Sorghum bicolor
  Clone ID: LIB3480-009-P1-K1-F12.pep
MDIHVVDFNLGDGIQWPSLMSDLARLGGKSFHLTAIITDAGYSDDTHQAAARRLSEFAESLNLPFQYSSLCIRHEEDLEDFSRNCGGSVVVSCDTTNLCYRSGSKLQMLLLGCVRKLQPKSVVVIEEELVRIVERGLLSQAFFCGFFF

SEQ ID NO: 50463 - protein, 39 aa, Sorghum bicolor
  Clone ID: LIB3480-009-P1-K1-G4.pep
TTKVSTHCFAWYYESSCSMRSWYSGFAKLSWVSKYFPSL

SEQ ID NO: 50464 - protein, 43 aa, Sorghum bicolor
  Clone ID: LIB3480-009-P1-K1-H4.pep
LVLPLSMGTSGLRIVRSEAHQKMPLTRIAQVLPRVSASIPPTP

SEQ ID NO: 50465 - protein, 112 aa, Sorghum bicolor
  unsure (1)..(112): unsure at all Xaa locations
  Clone ID: LIB3480-009-P1-K1-H6.pep
DTRTEMYTEDLXDLQRKRESLLQQMGDPSAIRHVPYVELSLADVAAHIESVTEKIIMEEEKMKKWKMENLRRKHNYAPFLFNFLKNFEEKQQLKPLIEKAKARQKSHGPSPR

SEQ ID NO: 50466 - protein, 104 aa, Sorghum bicolor
  Clone ID: LIB3480-009-P1-K1-H8.pep
MPRGGKPAASSKPNPFDSDSDSESNNKPAAKKSGAYQAPADAKKRYKDGFRDAGGLENQSVEELQHYAAYKAEETTDALEGWLRIGEDINEDAFDTLVTLHKQG

SEQ ID NO: 50467 - protein, 139 aa, Sorghum bicolor
  unsure (1)..(139): unsure at all Xaa locations
  Clone ID: LIB3480-010-P1-K1-A1.pep
NRNRHYINKKEKGRNILGKYKPKKTGTQKKVEAMEESEMVDVWLXVEAQDHEAAARPILWHCIINKLXASYRDQGLKDESCAKPGDCAPCVXARLSXSRYLVNDRMGLSDLTHXYSVHYFMERDSSFLVLIYPHVEGVF

SEQ ID NO: 50468 - protein, 121 aa, Sorghum bicolor
  unsure (1)..(121): unsure at all Xaa locations
  Clone ID: LIB3480-010-P1-K1-A4.pep
MATTPAEELAPGLPTTTPDEKPAPAPALPTTTPAEEPAPALPSTTTTPSEEPARGLPLPPPKGLGDEPQPRRRRPCVLLSFAAARDRFLRGRFLSAGLRPFSVRLPSLAGTXTVVHLWAPP

SEQ ID NO: 50469 - protein, 69 aa, Sorghum bicolor
  unsure (1)..(69): unsure at all Xaa locations
  Clone ID: LIB3480-010-P1-K1-C12.pep
MALSQSTQLGLATALFGVLSFVLAVLAELKKPPYGTPIKGRDVVVCRFPPDPTVALGALXALAAACNAG

SEQ ID NO: 50470 - protein, 73 aa, Sorghum bicolor
  Clone ID: LIB3480-010-P1-K1-C9.pep
LSLLYLLLKKTSIGGRRQRRRGRAWASSPLQRAWEGARPPSTRGHGYSQPGLATVHGSGRGAAPGCCPAGQRL

SEQ ID NO: 50471 - protein, 63 aa, Sorghum bicolor
  Clone ID: LIB3480-010-P1-K1-D12.pep
SLRMFHVLHLVFLSRMRGCSTHSFFWRCKFISISIHGVWFSNSLGSLSPCACSTEYHLHNQNQ

SEQ ID NO: 50472 - protein, 68 aa, Sorghum bicolor
  Clone ID: LIB3480-010-P1-K1-E5.pep
RGRRFLKSDKLQYLFDFIDIGRTFKPGTYRLVRSYPRRAFTEGESQMSLSDLGLTSKQEALFLEKLSA

SEQ ID NO: 50473 - protein, 50 aa, Sorghum bicolor
  Clone ID: LIB3480-010-P1-K1-F12.pep
RGLRVVVTGGDWFVGSHLVDRLLERGDRVVVVDNFFTGRKENLAHQAWNP

SEQ ID NO: 50474 - protein, 123 aa, Sorghum bicolor
  Clone ID: LIB3480-010-P1-K1-F5.pep
LEAAVLVVLGQYAVVQAAAVLPVVVRVHVVVLLVALHPAVDVPVDHVVHRPNVLAACVLGGHECVLELRQQVHLHLPVLHVLCVVMFVLLAGALNVSMYAFRSELYTAVASSQVSAYASGPPV

SEQ ID NO: 50475 - protein, 66 aa, Sorghum bicolor
  Clone ID: LIB3480-010-P1-K1-G10.pep
DLLDPGCVARVFRRVKFYPGAVLLEVAFGVQVLDVYVCGRHTRRAFPARRSRSGRYGRGHSCRRCG

SEQ ID NO: 50476 - protein, 83 aa, Sorghum bicolor
  Clone ID: LIB3480-010-P1-K1-G6.pep
FIIIEHLGSSKCQIHIPLDRTTCLKKKKKKKKKKKKKKKKKKKKKKKKKKKKKKKKKKKKRKKKKKRKKKKKKKCTNKKGGGV

SEQ ID NO: 50477 - protein, 120 aa, Sorghum bicolor
  Clone ID: LIB3480-010-P1-K1-H10.pep
GGGGEAEAEAEAEVEFFAVYDGHGGPRVADTCRERLHVVLAEEVARLHLQLGKGGGGDDGGGVLRRWREAMEACFARVDGEVVVVEREVNKNKNNAGDTVGCGSTAVVAVVGPRHIVVAN

SEQ ID NO: 50478 - protein, 123 aa, Sorghum bicolor
  unsure (1)..(123): unsure at all Xaa locations
  Clone ID: LIB3480-010-P1-K1-H11.pep
QEFPDATALMSATPAVAXREAACNITRPKKRASKCCVSFSAYYNDSVVPCNTCACGCGNDTCTCDPDRHAMLLPAEALLVPFDNLSAKARAWAKIKHWRVPNPMPCRDNCGDSINWHVMNNYK

SEQ ID NO: 50479 - protein, 83 aa, Sorghum bicolor
  Clone ID: LIB3480-010-P1-K1-H3.pep
IVVCQEFGQNCLSMFHILYNFNTKNLFLFPLVNLTKHAMLSFTTLTYKPRVSVFDKNYVFNHTKYQTSTICIKAIFIKLLIDS

SEQ ID NO: 50480 - protein, 127 aa, Sorghum bicolor
  Clone ID: LIB3480-011-P1-K1-A11.pep
DEKFVDVELSEETLVDTVGLANLEHYSSNFRDFEVYGSMSYPTEAWELLGRFTAENAKHAQRFVLPEPRWTRYLQLRLVSHYGSGFYCILSYLEVYGVHAVERMLQDFIAGNGAGACTEDSPCKDRA

SEQ ID NO: 50481 - protein, 136 aa, Sorghum bicolor
  unsure (1)..(136): unsure at all Xaa locations
  Clone ID: LIB3480-011-P1-K1-A2.pep
IVLFICTRKCAPRMSARSSGRREVTLFQDIGVPITYETVVRATGSFNASNCIGSGGFGATYKAEIAPGVLVAIKRLSVGRFQGAQQFDAEIKTLGRLRHPNLVTLVGYHLGESEMFLIYNYLSGGNLERXIQERSK

SEQ ID NO: 50482 - protein, 70 aa, Sorghum bicolor
  Clone ID: LIB3480-011-P1-K1-A4.pep
ESKAKELNVMFIETSAKAGFNIKPLFRKIAAALPGMETLSAKSEDMVDVNLKPTSSQSNSQQQAGSGCAC

SEQ ID NO: 50483 - protein, 97 aa, Sorghum bicolor
  Clone ID: LIB3480-011-P1-K1-A5.pep
PMGLTHHVENAIERGAFQEILDPTVTDWPVEEALEFAKLALRCGELRKKDRPDLGKEILPELTRLRNLGHDYETSQVSSASTNCSSSAPYSFNNDDI

SEQ ID NO: 50484 - protein, 103 aa, Sorghum bicolor
  Clone ID: LIB3480-011-P1-K1-B2.pep
KNGGLLIQFIDLHSYKKQIAASIYKYRYIYFPAPLNKVASRKSRDTVQKCQYTNIHATPSGRTHRQPAAAAVPGLFSTRSRRVFQIGKQQRAADSVPLAIAPH

SEQ ID NO: 50485 - protein, 70 aa, Sorghum bicolor
  Clone ID: LIB3480-011-P1-K1-B7.pep
NPAREFDFGGPIKKLLPCNEGGEKFGPLKRPPPFFYFFFFLFFFFFFFFFPFFFFFFFFFFFFFFFFFFF

SEQ ID NO: 50486 - protein, 141 aa, Sorghum bicolor
  unsure (1)..(141): unsure at all Xaa locations
  Clone ID: LIB3480-011-P1-K1-B8.pep
TKRCWHGDPAQRPAFASICRVLRYVKRFVVMNPAPAEQPDATPPPPPVPPVDYLDVEASLQRRFPAWQSGNAAPRVSDVPFQMFAYRVMEKERNRAAILHIGGGGRDXRAXDSSSEGNSLCGDESGSATLSDADALSVLSR

SEQ ID NO: 50487 - protein, 143 aa, Sorghum bicolor
  Clone ID: LIB3480-011-P1-K1-C3.pep
RQTKVLSLMKQRGISSRYIPHMASSGRIIHPGTCNKPNSNGNCDHPWCSTPILVTSPVGQTVSNLIRNGLFGVEEALRCCHDCLSSLAAAASAGVRHSDIRPENVIRVSNGSGDPYFVLIGWGHAILEDRERPVMNLFFSSTF

SEQ ID NO: 50488 - protein, 77 aa, Sorghum bicolor
  Clone ID: LIB3480-011-P1-K1-D12.pep
GATWIQGIDGSPVYALARDAGALACDRDAPPYERMDGSPDRVLTVAEGGEVVDPDRVARPVEELYRGMMEAARAGES

SEQ ID NO: 50489 - protein, 57 aa, Sorghum bicolor
  Clone ID: LIB3480-011-P1-K1-D4.pep
GMQALLDLLFAVEGSISDAAKILGLSTGALSRLILPDDSLRTAANELRASKGLKPLR

SEQ ID NO: 50490 - protein, 77 aa, Sorghum bicolor
  Clone ID: LIB3480-011-P1-K1-D7.pep
NLPTLDYLYSNTVETCKTLPAPTLNTLADILLFPALVVDNRHAQDALHNTSEVSMAERKRALISIKPGRVVVPQRSD

SEQ ID NO: 50491 - protein, 143 aa, Sorghum bicolor
  unsure (1)..(143): unsure at all Xaa locations
  Clone ID: LIB3480-011-P1-K1-E1.pep
DDVRKLWSVXLGDRHVVAAPEYCHANFTKYFTDAFWSDEELSAAFRGRRPCYFNTGVMVMDVARWRRGGYTRRVEEWMAVHKRKRIYHLGSLPPFLLVLAGDIRPVDHRWNQHGLGGDNVEGRCRSLHPGPINLLHWSGKGKP

SEQ ID NO: 50492 - protein, 44 aa, Sorghum bicolor
  Clone ID: LIB3480-011-P1-K1-F1.pep
CNGLSTVLQTTIGYIGSIVHLTFQTLDMHCTLYLIFASRSFREM

SEQ ID NO: 50493 - protein, 96 aa, Sorghum bicolor
  Clone ID: LIB3480-011-P1-K1-F9.pep
MEIKGKVSALTKVEQDVTKVTNLNAFDIISLSEGFNLSGLFDDSEKRKETRFTSSQPASTIISKLEDVATCSKLTVKKKEGGVLKMEGENEGRKGV

SEQ ID NO: 50494 - protein, 111 aa, Sorghum bicolor
  Clone ID: LIB3480-011-P1-K1-G2.pep
VGGSGKADADATAGGEAEARKSSSSSASGDAGGNEGGETDADATTSSGGEAGGSGKGDVDATAGAGGEAKASKSSSISASGDVGGDAGGKTDADATTSSDVKAGGNGKSYV

SEQ ID NO: 50495 - protein, 103 aa, Sorghum bicolor
  Clone ID: LIB3480-011-P1-K1-G3.pep
VTQRCRISGSVSCTAFFPVTLCFLPSSSRRMRSSTVPPSMARVYPYHQQRRAYEPLSLVLGPGPTSRQQAALPSWPGGGAQDRQEDDADEGGGWGTDGTGGPA

SEQ ID NO: 50496 - protein, 95 aa, Sorghum bicolor
  Clone ID: LIB3480-011-P1-K1-G7.pep
MMEWPPPSTSPSPSLVVRSPRQTVSLIRNRRPHRDWAPSSRSPSFAARDHGPKPSEVYGFVGSITTVIATAVYLAWAYTPEPVLRSLCITYYPSK

SEQ ID NO: 50497 - protein, 88 aa, Sorghum bicolor
  Clone ID: LIB3480-011-P1-K1-H10.pep
LIGYCVEDEHRLLVYEFMRRGSLENHLFRRGSYFQPLSWNLRMKVALGAAKGLAYLHSAEAKVIYRDFKTSNILLDTDYSAKLSDFGL

SEQ ID NO: 50498 - protein, 68 aa, Sorghum bicolor
  unsure (1)..(68): unsure at all Xaa locations
  Clone ID: LIB3480-012-P1-K1-A3.pep
MEKEACAEKKYGGIAPKKPLISKDHXRAYFDSGDWVLGMQAANSSTRAAVESLKPKLKRTPHHQLPPR

SEQ ID NO: 50499 - protein, 84 aa, Sorghum bicolor
  Clone ID: LIB3480-012-P1-K1-A8.pep
GEFVHKRLCRTDQQGSFAEHRYYKVLYRRYAFLLLLDGGDHDENELAILECIHLLAETMDRHLSYGCELDIMGHLEEVHLMWVE

SEQ ID NO: 50500 - protein, 158 aa, Sorghum bicolor
  unsure (1)..(158): unsure at all Xaa locations
  Clone ID: LIB3480-012-P1-K1-B11.pep
NGPASFPSPAPSASNGNMMPAAQHSSQMNXPTMSSNPPPMQTPTSRLQEPEPNESQSSVQRILQDLMMQSHINGVGPVGSDMRRANTITPGLNGVNSLVGNPMTNNPGINGMGFGAMGGLGQQMRTAMGTNALAMNGKTGMNHSAHDLTQLSHQQQQR

SEQ ID NO: 50501 - protein, 98 aa, Sorghum bicolor
  Clone ID: LIB3480-012-P1-K1-B7.pep
VGFSSSCVADYERSGLCAAHTTLMASKLEHDPGHARSMVGPSHFSGIVSGSSAADSNMDHAISSSGHGAWSDCVDSSGDMQSAGRLLIPHQVLVPGSL

SEQ ID NO: 50502 - protein, 38 aa, Sorghum bicolor
  Clone ID: LIB3480-012-P1-K1-C12.pep
MVLDQIYIIWSVERTTKDQKIEQSIICHFSPHCLITYK

SEQ ID NO: 50503 - protein, 53 aa, Sorghum bicolor
  Clone ID: LIB3480-012-P1-K1-C9.pep
ISINAFQIQLGSMCKTAHNNVESSSKLAQNSPSPKKNPKLTIFHVNYSIYKYC

SEQ ID NO: 50504 - protein, 80 aa, Sorghum bicolor
  Clone ID: LIB3480-012-P1-K1-D7.pep
MSFTGTHDKCITCDKTVHFIDLLTADGVSYHKTCFKCSHCKGTLSISSYSSMDGVLYCKTHFEQLFKETGTFSKKFQGGA

SEQ ID NO: 50505 - protein, 49 aa, Sorghum bicolor
  Clone ID: LIB3480-012-P1-K1-E10.pep
KGALFESASYRVLAGAAALVCVEAQVSAFNGAVTGSVPVASQSAVLMER

SEQ ID NO: 50506 - protein, 148 aa, Sorghum bicolor
  Clone ID: LIB3480-012-P1-K1-E11.pep
SSVVVSMIGLSILLLLGVLNWEDCLNEKSAWDTLAWFAILVGLAGQLTKLGIVSWISSSVAKILRSFSLSWPAAFGVLQASFFFIHYIFASQTAHVGALYSAFLAMHLAADVPSVMSTLALAYNANLFGSLTHYSSGQSAVYFGAGTL

SEQ ID NO: 50507 - protein, 72 aa, Sorghum bicolor
  Clone ID: LIB3480-012-P1-K1-G7.pep
RLNDSGFAAKQYPCNILSCDCRMSRDSKHQAFAIKNVCTEGPRFASWSFPHAEEKSSNPIYAKEPPPSWCRT

SEQ ID NO: 50508 - protein, 98 aa, Sorghum bicolor
  unsure (1)..(98): unsure at all Xaa locations
  Clone ID: LIB3480-012-P1-K1-G8.pep
MIKCTKPAECSGXEAAAVHITDMNYDQIANYHFDLTGTAFGAMAMKDVEEKLRKAGMIDMQLRRVKRKSGVKVTFHVEKGCNPTYLALPVKYVDGDRD

SEQ ID NO: 50509 - protein, 85 aa, Sorghum bicolor
  Clone ID: LIB3480-012-P1-K1-H10.pep
RTRGFFFFFFFFFFFFFFFLVGVFNTKNASNSQIACCGGQRKLQMLSKRLSLAPATHYLIDYLSIIKNRKTSDPFQNYPLSTGYG

SEQ ID NO: 50510 - protein, 40 aa, Sorghum bicolor
  unsure (1)..(40): unsure at all Xaa locations
  Clone ID: LIB3480-012-P1-K1-H6.pep
WHIILFSTYLPPLPVDTVXKGRAXSREIETRLTSKCDALA

SEQ ID NO: 50511 - protein, 57 aa, Sorghum bicolor
  Clone ID: LIB3480-012-P1-K1-H8.pep
FSFSSNCPCQTRTAHPNIYIFFCLLDAKSILNIVTSDIRATRSILVHSDTTNPSPSI

SEQ ID NO: 50512 - protein, 67 aa, Sorghum bicolor
  Clone ID: LIB3480-012-P1-K1-H9.pep
LIYNEDLRELPCAHVFHMECIDKWLQINALCPLCKAEIGGSTTSNPESGSVGPDNANRVSNDVESQR

SEQ ID NO: 50513 - protein, 87 aa, Sorghum bicolor
  Clone ID: LIB3480-013-P1-K1-B4.pep
HHASMPKIEIVSHWIISVASTLVLSSDTPISVGGYYMSAYTINYISNVRWSLELNQYKDSPCLYCTRMLLYIDRCCHCQKRKQTILI

SEQ ID NO: 50514 - protein, 66 aa, Sorghum bicolor
  Clone ID: LIB3480-013-P1-K1-B6.pep
DCALALAAAFEALCPEPNPPPKPGPPKPAPPRPAPPRPAPPRPGPTRPGPTRPGPPRPRPAPPRPS

SEQ ID NO: 50515 - protein, 55 aa, Sorghum bicolor
  Clone ID: LIB3480-013-P1-K1-B7.pep
SWGKEKKDIKGLSRGTKGWFPEKGAAKLWSFQFNLGVYIRLVKLLLCKCSSPRLF

SEQ ID NO: 50516 - protein, 85 aa, Sorghum bicolor
  Clone ID: LIB3480-013-P1-K1-B9.pep
ALLLPTCGKPVSVQAFLGCMHRAFLKCLALPLGFKRPVFLQFNRCVLLEVPAHVVEESHERRPLVRFSSSSMLYSFRARASSTGS

SEQ ID NO: 50517 - protein, 93 aa, Sorghum bicolor
  Clone ID: LIB3480-013-P1-K1-C1.pep
AVLAGVALRAPHAAGGEAVNVGELLGRHAWRLLEEHGLAVGVQRSVLPAVHQLVLVEVPAHEVEERHRRRRLVQLLQLLLGVQLPRRGQLRRL

SEQ ID NO: 50518 - protein, 73 aa, Sorghum bicolor
  Clone ID: LIB3480-013-P1-K1-D5.pep
HASAIFERHQDLNGTMKIPKEEMFRFSHQVPFYRMSGEEAPNVPKDSYELDPAAISKELLQGTTETVEANGTS

SEQ ID NO: 50519 - protein, 132 aa, Sorghum bicolor
  Clone ID: LIB3480-013-P1-K1-D9.pep
AGSFVSLPNQMSMIGTVGPPVPNIDVRLESVPEMDYDALASTPRGEICIRGETLFSGYYKREDLTKEVLIDGWFHTGDIGEWQPDGCMKIIDRKKNIFKLSQGEYVAVENLENVYGLVSASDSIWVYGNSFE

SEQ ID NO: 50520 - protein, 128 aa, Sorghum bicolor
  Clone ID: LIB3480-013-P1-K1-E1.pep
RDGGGGDDAVEKRAQIQTFPGIVRARVDVFQEKINAKTKKLAKKASPPPPPESAGRVVVYLTSLRGIRQTYEDCWSTSAILRGYGVRVDERDLSMHAGFKDELRAAALGDEGRLPMLPQVFADGRHLG

SEQ ID NO: 50521 - protein, 53 aa, Sorghum bicolor
  Clone ID: LIB3480-013-P1-K1-E10.pep
KKKKKKKKKKKKKKKKKKKKKKEKKKKKKKKKKKKKKKKKKKKKKKKKRGRPF

SEQ ID NO: 50522 - protein, 69 aa, Sorghum bicolor
  Clone ID: LIB3480-013-P1-K1-E5.pep
DLHPHHRGWRLGYGWCPPLQRQPRGGRVGRRGRRRRGNGEGCGVAAHRAERGRGLADVGLGGGGARGMR

SEQ ID NO: 50523 - protein, 75 aa, Sorghum bicolor
  Clone ID: LIB3480-013-P1-K1-E8.pep
IKKSIDYILKTHRTEKKITKRRSRSMRQWRGKNKAFLPVTQYPEKSLLFTPDSTGLYQCIKAFKEVNQHNTLILD

SEQ ID NO: 50524 - protein, 123 aa, Sorghum bicolor
  Clone ID: LIB3480-013-P1-K1-F10.pep
RPKKKKKKKKKRAAALFFFFFFLCGFSLFLSCFFCSVSCCLSCFFFFVFFKTKQKRGGALLREQMLPPRRGQNKSFLRGPQKQNGGRGVNKRGAGKTPGVPKKNPLTQNPLLAKGEKKKRAPP

SEQ ID NO: 50525 - protein, 144 aa, Sorghum bicolor
  Clone ID: LIB3480-013-P1-K1-F12.pep
HEHLILNSHSILEAQEEFRAEQANIFAALDKLYILHNAILAESRFIKAFFFYCCIVFLIYMLTSAKQTFGIRGQLYFGLCITLLLEIGLIKIGADDFDKQFWVMSKVFLVRMVFLGASTVQILHSIYTYRDYEVLNHGLLQTLV

SEQ ID NO: 50526 - protein, 142 aa, Sorghum bicolor
  unsure (1)..(142): unsure at all Xaa locations
  Clone ID: LIB3480-013-P1-K1-G10.pep
VMELLHSNLEAKSRLYKDPSLSNIFLMNNGRYMLQKIRGSSETNAMLGEAWARKQSTNLRQYHKNYQREAWSRVLGLLRDDGVLTVKGHVXEAYRSFLGRFAQHFSAGRQTEKYVKLSAEDVETIIDELFDGNATSMTRRRT

SEQ ID NO: 50527 - protein, 143 aa, Sorghum bicolor
  Clone ID: LIB3480-014-P1-K1-A12.pep
LGNRDSPVVAAFSSRGPSKQNQGILKPDITGPGVNIIAGVPKPAGLMTPPNPLAAKFDVLSGTSMATPHLSGVAAVLKKAHPTWTPAAIKSAIITTADPKDRSGKPIAAHDGSPASLLTLGAGFVDPMKAMNPGAVYNLTALD

SEQ ID NO: 50528 - protein, 94 aa, Sorghum bicolor
  Clone ID: LIB3480-014-P1-K1-A7.pep
MREDTEFVPSFPYHTEVPKVLLFGLLGFTLAVLAPLILPFLLVYFCLGYVGYRNQLLNVYRTRYDTGGLYWPIACNTVIFSLVLTQIICLGVLD

SEQ ID NO: 50529 - protein, 89 aa, Sorghum bicolor
  Clone ID: LIB3480-014-P1-K1-B4.pep
TLGAAGTRARRGRRGCRAPRTPSTAARRPSLAQIGGLALADAQVLNVVVPVAPVPNRISNLLGAGRREAPSDDERREGEGAEGRARALV

SEQ ID NO: 50530 - protein, 130 aa, Sorghum bicolor
  Clone ID: LIB3480-014-P1-K1-B6.pep
RNESRSFQLPSIFNTEQERFMQHFDLLLKARVPEHISFYSFKESSSRAGISDLVKYNFFKEIQKIAPSLRGSFASESEKLAEVRRIEQVAEHNRIALNIINQVGAGDPSLRVSFEFTHHPHFAVAVVKRS

SEQ ID NO: 50531 - protein, 147 aa, Sorghum bicolor
  unsure (1)..(147): unsure at all Xaa locations
  Clone ID: LIB3480-014-P1-K1-C11.pep
MASPPPVAAAAGPHSVFVYGTLIAEEVVRVLLGRAPPSSPAILADHRRFSIRGRVYPAILPARGHAVSGKVLKELTDRELHVFDMFEDEEYVKTTVEVSLADAQEKSIACAYIWGNERDPDLYGEWDFEEWREVHLKDYLEMTXEFM

SEQ ID NO: 50532 - protein, 75 aa, Sorghum bicolor
  Clone ID: LIB3480-014-P1-K1-D1.pep
ELGPEFKKVGCFLSRFKSIPSIVELDSLKVSGDVWFGSGIVLKGKVTITAKSGVKLEIPDGAVLENKDINGPEDL

SEQ ID NO: 50533 - protein, 134 aa, Sorghum bicolor
  Clone ID: LIB3480-014-P1-K1-D6.pep
MVDRFHAEVRLLRSLSHDHIIGFHKVWLDRDAGVLNFITEVCTSGSLREYRHRHRHVSVKALKKWARQILEGLNHLHTHDPCIIHRDLNCSNVFINGNNGQVKIGDLGLAAIVDKTHVAHTILGTAEFMAPELY

SEQ ID NO: 50534 - protein, 73 aa, Sorghum bicolor
  Clone ID: LIB3480-014-P1-K1-D7.pep
RCSCRLISLLASTAPRGPSTGRSFRATVCSSRCWRAPRRTTRWTGRSTTWLLLLLLLLVLVVVDHQRAARTRA

SEQ ID NO: 50535 - protein, 135 aa, Sorghum bicolor
  Clone ID: LIB3480-014-P1-K1-E1.pep
GSYARVYFGVLKDGTNSAVKKLDSSKQPDQEFLVQVSAVSRLKHENVVQLVGYCAEGITRVLAYEYATRGSLHDILHGKKGVKGAQPGPVLSWMQRARIAVSAARGLEFLHEKADSRVVHRDIKSSNILLFDNDV

SEQ ID NO: 50536 - protein, 50 aa, Sorghum bicolor
  Clone ID: LIB3480-014-P1-K1-E3.pep
KKKKKKKIKKKQKKKKQTKKKKKKKKKKRERKKKKKKKKQQKNKKKGGPL

SEQ ID NO: 50537 - protein, 113 aa, Sorghum bicolor
  Clone ID: LIB3480-014-P1-K1-E5.pep
WVMSYMIAMMLVMAVVRCALGSTSEVATCGQNSSGHSGCSGSTSFITALMYASEYVFESVSDSLGPSIRLSLLCTLSCTFCCSSRPYQHTVEQHAHGVRAWVDDRSDHCAHAC

SEQ ID NO: 50538 - protein, 103 aa, Sorghum bicolor
  Clone ID: LIB3480-014-P1-K1-E7.pep
RSPADQRETDRERGADLPVAMAMPTKPGDPSQRSPGRSPNLNLPCPLPPVPGGAPAPPAQHQSGAGLPPTRVGHHRRARSEVAFRFPDDLAGAGAGGFDEIGF

SEQ ID NO: 50539 - protein, 40 aa, Sorghum bicolor
  Clone ID: LIB3480-014-P1-K1-F10.pep
LTCESLTFRVMTGDHRKATSWHVLPEDWKFGVTYQASKNF

SEQ ID NO: 50540 - protein, 112 aa, Sorghum bicolor
  unsure (1)..(112): unsure at all Xaa locations
  Clone ID: LIB3480-014-P1-K1-F4.pep
HNQREALRSLWNILYGTGLNQKQILKLAAKQGLTVEGCPLPSSSPDVTTPPSFSPHRRXPSFMSFPSPQSESYSPSACFFQHGFSTMSLLKNQHETPTICRQEHLSSYYMMS

SEQ ID NO: 50541 - protein, 49 aa, Sorghum bicolor
  unsure (1)..(49): unsure at all Xaa locations
  Clone ID: LIB3480-014-P1-K1-G11.pep
FSSEPSVLRLKAPGAIFVDEHGQLARLXRLYHEYGAPXTECDIAYIAYL

SEQ ID NO: 50542 - protein, 110 aa, Sorghum bicolor
  Clone ID: LIB3480-014-P1-K1-G12.pep
STFLLSLMHTPEKENLLHLLPILYHGRPFFPLQNPLNSLHQRAAAICFTAAPFILKRKHVDCVVVILFYIELMGYNQGIIFTVPGECLLPTSKSKINPSPTLDLAATSPS

SEQ ID NO: 50543 - protein, 113 aa, Sorghum bicolor
  Clone ID: LIB3480-014-P1-K1-G7.pep
FSSEPSVLRLKAPVKIFGDLHGQFGDLMRLFDEYGAPSTAGDIAYIDYLFLGDYVDRGQHSLETITLLLALKVEYPQNVHLIRGNHEAADINALFGFRIECIERMGERDGIWT

SEQ ID NO: 50544 - protein, 38 aa, Sorghum bicolor
  Clone ID: LIB3480-014-P1-K1-H2.pep
EGDYYILCQLDKVECAASLFSWVTSGFFKSLCCIATFS

SEQ ID NO: 50545 - protein, 90 aa, Sorghum bicolor
  unsure (1)..(90): unsure at all Xaa locations
  Clone ID: LIB3480-014-P1-K1-H5.pep
PTRSAVASVXXAAGRHAPAGLTRSGLRRGRRXRRAHGGRRLAADPAADGCSGHRYRGGAXFTCGGGPRALVPDLPPWPRLLLVGGAIFRG

SEQ ID NO: 50546 - protein, 38 aa, Sorghum bicolor
  Clone ID: LIB3480-014-P1-K1-H6.pep
TDLKACFMGFPHETVNGKGISFLPHWGLTTSLPPYSGF

SEQ ID NO: 50547 - protein, 41 aa, Sorghum bicolor
  Clone ID: LIB3480-015-P1-K1-A3.pep
EAFIPLRRRPITLDKLEPPPQNPYTFEMRPLALSSIFLSLA

SEQ ID NO: 50548 - protein, 116 aa, Sorghum bicolor
  Clone ID: LIB3480-015-P1-K1-A4.pep
ERLTLEAACLVPPISVCVLPPCMEVVAVYCMVVAAVVLDNNGADTVFSTTIRIVTVSIEEREEINGDVPTITSCARNEFELFTTAASYKSPITRKKRGAFALFMAMFLSFGRSDSI

SEQ ID NO: 50549 - protein, 143 aa, Sorghum bicolor
  Clone ID: LIB3480-015-P1-K1-B4.pep
MKNTRRQALHDAQAANGQRRPLPQKVGQRRPKKPPPRSSPPPRGWTPSPQRDASPNPDPPPRRPPPAWPARRSKLAQPSRRPPPAWPARRSRLAPPPRRPPPAWPERRSRPDPQPRRRPLAWPARQSRPRLLPPAASGGPALR

SEQ ID NO: 50550 - protein, 73 aa, Sorghum bicolor
  Clone ID: LIB3480-015-P1-K1-C11.pep
KQTSESARELREQGSHFHIPKSLSPKIMKFNQRSENSISYNFVITNICRKNINICKNACRTANYLYLIFLYHT

SEQ ID NO: 50551 - protein, 69 aa, Sorghum bicolor
  Clone ID: LIB3480-015-P1-K1-C7.pep
AHDPDNQFKVGDVVELRPSRPISKTKHFLAIPLPPRDTRRKSQLLPPLQSQSQAGDDDDQAPPPSPSSE

SEQ ID NO: 50552 - protein, 144 aa, Sorghum bicolor
  Clone ID: LIB3480-015-P1-K1-D11.pep
GAAGAGRPFTRQENTVVTTCAVACYSLALCGFGSFILGLNKRTYEAAGVDTPGNVPGSVKEPGFGWITGFLVASSFGGLLTLIPLRKALVIDYKLTYPSGTATAVLINGFHTPQGDKNAECVWRSSLLFINGYITARMKPIIRQ

SEQ ID NO: 50553 - protein, 149 aa, Sorghum bicolor
  Clone ID: LIB3480-015-P1-K1-D12.pep
ENFTPKLSDFGLAELGKAGGSMPVASPMMGSFGCCAPEYDRTGQGTMKSDVYSFGVVLVQLISGRRAVDTSKPVDEQNVVTWAMPMFKDQKRYHELVDPLIKKEYAAKALNQVVAMAAMCLQEEDSVRPLMADVVMTLGFLTAMPPDPP

SEQ ID NO: 50554 - protein, 79 aa, Sorghum bicolor
  Clone ID: LIB3480-015-P1-K1-D2.pep
AAQLCYVSRARLLFPASFVTMQERYSCICVSFQPSCQVMHEHPVVYSGLLWNVYVLCRYSPAPIFSPLAHVCSRTAHVQ

SEQ ID NO: 50555 - protein, 131 aa, Sorghum bicolor
  unsure (1)..(131): unsure at all Xaa locations
  Clone ID: LIB3480-015-P1-K1-D5.pep
SASTTPGTLAAAMSLARQVEMMEAERLPPTPXRAXPRGTPPAPAPRPALPAPPPILQLPAPPVASQPGRGEGTQRRLSPEEMAERRRQNLCFNCNERYSRGHNRFCKRIFFVDGVEIDDKPEGEAAVTAIS

SEQ ID NO: 50556 - protein, 139 aa, Sorghum bicolor
  Clone ID: LIB3480-015-P1-K1-D8.pep
ARFLLTSTSEVYGDPLQHPQVETYWGNVNPIGVRSCYDEGKRTAETLTMDYHRAANLEVRIARIFNTYGPRMCIDDGRVVSNFVAQALRKDPLTVYGDGKQTRSFQYVSDLVEGLMMLMEKEHVGPFNLGNPGEFTMLE

SEQ ID NO: 50557 - protein, 96 aa, Sorghum bicolor
  Clone ID: LIB3480-015-P1-K1-E11.pep
AMSVASMSAGTGSFASSLLVTVVMTFTCRGGRLGWIPQDLNKGTRVMWTGSSTSMQRLMLWISLSFVVSAERYRPAPVIIHGLGLRAAGGELKKNE

SEQ ID NO: 50558 - protein, 92 aa, Sorghum bicolor
  Clone ID: LIB3480-015-P1-K1-E3.pep
APPPHAFYSSSLGCWCFCLPAPVRYSCWRLTHRPFISLLQALLHSVTSLANKLHPVVDAADGSPAALEDAGGRQLCRSSRGCWRAIPMHRLH

SEQ ID NO: 50559 - protein, 142 aa, Sorghum bicolor
  Clone ID: LIB3480-015-P1-K1-E4.pep
GGGFQNTALEGPQKLPGFQGWEKKREVFFPPAQPGEGNFPGKPGGAPQKVPPVGERQGKSGEMPLKGPREILDPMGKGPVHTKGGKAGVPLGRKKGGPFFFFLLFFNFYYLYIIFLNMHYIFFFYIYFFILFFFFFFLSEST

SEQ ID NO: 50560 - protein, 91 aa, Sorghum bicolor
  Clone ID: LIB3480-015-P1-K1-E7.pep
DCQEESLPNKYLEYLSCISKDIETFCWCKQPMGKVDIDTSRMEEYSHSYTEPLMLTGDTKRGCTRDTFSSYKLQVLTVLKTIAINCNSLTC

SEQ ID NO: 50561 - protein, 51 aa, Sorghum bicolor
  Clone ID: LIB3480-015-P1-K1-E8.pep
SCKRRDSSTIASPESNYCTLLYNIHAWDISILKHLNPHDAHSLYMRLGTNK

SEQ ID NO: 50562 - protein, 35 aa, Sorghum bicolor
  Clone ID: LIB3480-015-P1-K1-F2.pep
AHTTLSSSILIPKYNILASVLQLIDWKNPPITHLN

SEQ ID NO: 50563 - protein, 140 aa, Sorghum bicolor
  unsure (1)..(140): unsure at all Xaa locations
  Clone ID: LIB3480-015-P1-K1-F8.pep
DSCSMTLLTLPGRNLQHDNHDGCDHLQSAAXCAGGLESLNVGICPRLSSLRIEDPNMPILLLNGYGDLSEGYMTSPRLTSIDAFVXRQVADDSLTQMAXACALIEHLILXXCLFIGTDGLSXLRCLPELALLDLSYTFLI

SEQ ID NO: 50564 - protein, 52 aa, Sorghum bicolor
  Clone ID: LIB3480-015-P1-K1-G9.pep
RSLWESQRDPTSTPTRRRTRGPALYDHKVRSMCRPHCNFLIRAPKLNSLGAP

SEQ ID NO: 50565 - protein, 106 aa, Sorghum bicolor
  unsure (1)..(106): unsure at all Xaa locations
  Clone ID: LIB3480-016-P1-K1-A4.pep
INDHQKSRFVKCVVSSMFNTVAGKKIAVLGFAFKKDTGDTRETPAIDVCNGLLGDKAVISIYDPQVTXEQVSRDLAMNKFDWDHPRHLQPLSATDLAKQVAVAPDA

SEQ ID NO: 50566 - protein, 159 aa, Sorghum bicolor
  unsure (1)..(159): unsure at all Xaa locations
  Clone ID: LIB3480-016-P1-K1-A7.pep
TCRQRQLNAPRTGGPEGRRRWGSQSRGQRRLDLIGPXCRVSRPLDLCLAELLVFRGVEEGEHATDLRLPLTLVRPPPHGQGVGMLVLPPQGPAARGDRGGRGVGRWRPETPRRAQSRGKGDGSARICTTWHSWWLGGRAPPPLSRSRGRGRQIRHHRCR

SEQ ID NO: 50567 - protein, 132 aa, Sorghum bicolor
  Clone ID: LIB3480-016-P1-K1-C11.pep
SKEFSITSMKGGYRRVFQRPIGFEWELMTYTDDSSSLAETDLDVLSRTKPKEANELSNQESQDKLEKAPDTSVPTNRSSSQENKLIGCPDTSPEKLALKLAFTLPASCYATMAIRELLKTSTSVAYQKTLSC

SEQ ID NO: 50568 - protein, 51 aa, Sorghum bicolor
  Clone ID: LIB3480-016-P1-K1-C8.pep
YLFFFFFFNAHANFLNLVFRSPLEPASQPKTIDRQRTTLTNRKARDKESTP

SEQ ID NO: 50569 - protein, 78 aa, Sorghum bicolor
  Clone ID: LIB3480-016-P1-K1-D10.pep
QFAAAYKTWVDLLDLIDAKSGNINMENFMVDNTVSSAVLSYLVTRPLSAAATDGPNTISGILNGVIEQKLRIIPNNIT

SEQ ID NO: 50570 - protein, 56 aa, Sorghum bicolor
  Clone ID: LIB3480-016-P1-K1-E10.pep
VCCTSKKTTTTNLSGITCGLTVYKDRLRVERERQGRVQYSSTSTGLTTCTYRMILQ

SEQ ID NO: 50571 - protein, 103 aa, Sorghum bicolor
  Clone ID: LIB3480-016-P1-K1-E7.pep
HASGNLHLWSWKAGPHGIAEWVQGRVVKLRMLFPILNPLASLNVIGFQEGTDTIFISIDMDVFAVMLRSEQVKKVGKTGSKYAMAPYVSFYTPDLAKGRLLSP

SEQ ID NO: 50572 - protein, 59 aa, Sorghum bicolor
  Clone ID: LIB3480-016-P1-K1-F11.pep
APPAGRRRKTGQRKRRVIKTSSSRSTTTDPYVSSDPIDPHEAAIAMQPLTRSIHPAFYI

SEQ ID NO: 50573 - protein, 87 aa, Sorghum bicolor
  Clone ID: LIB3480-016-P1-K1-F8.pep
MASEMSYAAVGVVILSVLVVVAAASADPTAAPTAAPSSSKLSLEEACKQTAGHHDLCVATLSADPSSKTVDTVGLARLAIQAALFFA

SEQ ID NO: 50574 - protein, 96 aa, Sorghum bicolor
  Clone ID: LIB3480-016-P1-K1-G9.pep
NKWGAPFLKDQFFLPLSTIFFLFFWAPQNKLPGLFFKNFGMEKPLFFPILYPCNKIPFTTFCKIKKSPPLFSYKNYSPSLLQLCPPLFAANLSQVF

SEQ ID NO: 50575 - protein, 41 aa, Sorghum bicolor
  Clone ID: LIB3480-017-P1-K1-A10.pep
TMCGKSTQPALFYVCNTEVQPPVSSVSDHVGVTIPYAATRP

SEQ ID NO: 50576 - protein, 167 aa, Sorghum bicolor
  unsure (1)..(167): unsure at all Xaa locations
  Clone ID: LIB3480-017-P1-K1-A11.pep
MGVVSAAADALVAVFSLTIAVAAPLIDAQSVLPHTLYPAPLLELKRWYAAEFGDYLVAQPPAFFRGLVCLELSFQWPLAVATLYGILTRRRWAXTXTSSLAGVATLTSMSAVLGEILGSGKATPKLLQMYAPFAVFAVIAILRGLCSCSGRTTAGSSLGPSARKKRV

SEQ ID NO: 50577 - protein, 65 aa, Sorghum bicolor
  Clone ID: LIB3480-017-P1-K1-A3.pep
TSCINNWVHALLRPVRMDGQIDWSIACEDSNDDIRTNHLKIHSWILDLVLDMIPEKITGELRAVT

SEQ ID NO: 50578 - protein, 76 aa, Sorghum bicolor
  Clone ID: LIB3480-017-P1-K1-B9.pep
KKKKKKKKKKKKKKKKKKKKKKKKKKGGKKKLTKNKKKKKKGKKKKKKKKGENFKPNPKKKKKKKKKKKKKRGRPF

SEQ ID NO: 50579 - protein, 202 aa, Sorghum bicolor
  unsure (1)..(202): unsure at all Xaa locations
  Clone ID: LIB3480-017-P1-K1-C2.pep
YDDVDDSSSCQDRTPKGHRSKRTGPGIQNDIAENIVTGGSNVRRIARCSSDVSQSHLYNTKIADLIRRNTTLEDQLSTALASKDQLEKSLSSVIHSREQLEKMLANKDKEAEMLKEKIACLELAXEESNSLSNTVHADNVRLEREVAFLKAVTDETQKELHSTRRVXAGEQSRAFQLQVEVFHLKQRLQILEGRSGTPTKQP

SEQ ID NO: 50580 - protein, 80 aa, Sorghum bicolor
  Clone ID: LIB3480-017-P1-K1-C4.pep
VHEEKGLRVARLDDSWLCISLGNLFLANCLHITTHCLRLPRWDVANRCALCSKKIHSLLWFLGASPIVNSYGGCSLAYAL

SEQ ID NO: 50581 - protein, 82 aa, Sorghum bicolor
  Clone ID: LIB3480-017-P1-K1-D10.pep
TSSRSRSRTRFFFFFFFLFLFFFFLVVFFFLYYTDIPTGGPKGTNPRCPRIRRHKACIRLHKGKVRDQRLKRQNRENPAEPN

SEQ ID NO: 50582 - protein, 63 aa, Sorghum bicolor
  Clone ID: LIB3480-017-P1-K1-D8.pep
SGQLLGAPACSSLFGICPASERCMSSQNNQLGHVTVFTVHTLSFHVRSSVFRPPNTRHTTSHA

SEQ ID NO: 50583 - protein, 164 aa, Sorghum bicolor
  Clone ID: LIB3480-017-P1-K1-E11.pep
EIRRRARLPEPEDDDAAVLLLDAIDSDAERAVILERLEVQISEAKDLEFSRKDVLEKMDRWQAALEEESWLEEYSRNENRYNVGKGTHLVLKRAEKARSLVSKMPAMAEALMAKVVAWEKERGAKFEYDGEVLLDMLEDYGNTRKEKEQERKRQRDQRRLLQQV

SEQ ID NO: 50584 - protein, 104 aa, Sorghum bicolor
  Clone ID: LIB3480-017-P1-K1-E3.pep
CIRGIVRACLGSPLAIRVLSRHVLTSRACSAWRVDRFWCPSSSSDDVTGRRSLCLGPSPVYRALPSVQLRHQVSQSSMMIRVVTRLYRAWTISAIAAACRVHCI

SEQ ID NO: 50585 - protein, 107 aa, Sorghum bicolor
  Clone ID: LIB3480-017-P1-K1-F4.pep
RRLQTMLKKSLHILQTLKVVEAESRQAALGESLFGTASAGSGSSDSCSYTSIFSLLSFSLTDKRGAPGAKKIEFLWLLFLCATVQLQCKREISFIPLPFEQNYKFRF

SEQ ID NO: 50586 - protein, 86 aa, Sorghum bicolor
  Clone ID: LIB3480-017-P1-K1-G10.pep
LLVPAVSIDMCVGSLILYMWNRADREDAQVFAPVFASGLICGDGLFSIPYALLARYDVTPPICVRFIGRVQNKMLDSYMEKAAASR

SEQ ID NO: 50587 - protein, 116 aa, Sorghum bicolor
  Clone ID: LIB3480-017-P1-K1-H10.pep
GEVHSVLHIVYPDWPDHGVPTNTDAVRQIWKRLHHIPTEHPIVIHCSAGIGRTGAYITIHTTIERILLGDKSSYDLVETVKNFRSQRTGMVQTEEQYKFCYQAIADELKDLLNSDH

SEQ ID NO: 50588 - protein, 178 aa, Sorghum bicolor
  unsure (1)..(178): unsure at all Xaa locations
  Clone ID: LIB3480-018-P1-K1-A10.pep
MNQSYNSSPVGGNIGGNGRGNDRNSERNMDRNNDRMGDLMGGGGAPGGYRHNPNRERNNMGNHNHNHYNNHNRYNKHNNNSPHPHNNYNNNAVKQLPPRFKQSVISPQTNQQSPETFDTFRPPINSLLYKATNSNRQTAQLPMSQQPRPXSASSVETTGSTGTTYSTNVNSPNSNYQS

SEQ ID NO: 50589 - protein, 149 aa, Sorghum bicolor
  Clone ID: LIB3480-018-P1-K1-A6.pep
TPEAAPNVRSLGHSSSSLDVHGTRTQGHLVYTSFRRRPCEAPTWPKLGVVAGEGHTAGGAAFHHGHPGAGTAALWLAVAAVNAAARGRQDLGLGRAEHQQQRQRDDGGDHLASRRRTCDRSSAGCLSFTSRRDPVNRLRGLFWNLDACA

SEQ ID NO: 50590 - protein, 155 aa, Sorghum bicolor
  Clone ID: LIB3480-018-P1-K1-A8.pep
AVEKEFNVPGFAKMVITASNDLNEETIDALNKQGHEVDAFGIGTYLVTCYSQAALGCVFKLVEINNRPRIKLSEDVAKVSIPCKKRCFRLYGKEGYPLVDIMIRESEPSPKAGERILCRHPFIESKRAYVVPQHVEELLQCYWPGTSDKPRAELP

SEQ ID NO: 50591 - protein, 58 aa, Sorghum bicolor
  Clone ID: LIB3480-018-P1-K1-B10.pep
YNVLSEFICNNRTDHYSVKALRNREHGMQIHLNNCHMETIIFYSMKDRLLTMDLLFRV

SEQ ID NO: 50592 - protein, 117 aa, Sorghum bicolor
  unsure (1)..(117): unsure at all Xaa locations
  Clone ID: LIB3480-018-P1-K1-B11.pep
VVHHSPKDDHGEQQQQQLFDYFYYDATASDDASSKPTIDINLDNMQQFDFDDSCAAADDDKVDLTAPAGPDEEIRHHQQHLDVNCGQIDDHKDYFEIKAASLVXAFDMRQELQPVVA

SEQ ID NO: 50593 - protein, 59 aa, Sorghum bicolor
  unsure (1)..(59): unsure at all Xaa locations
  Clone ID: LIB3480-018-P1-K1-B2.pep
EXGHNGKFVAKNWRWEERSPXNFQGAQCIQNARQRPKFFQRTHFCSGCLFFLLLFFLSY

SEQ ID NO: 50594 - protein, 137 aa, Sorghum bicolor
  Clone ID: LIB3480-018-P1-K1-B3.pep
ERASEVFLEASPRHNTPVPSPTAHQEQPYFKVSSRFESEMKEANEMLMESKKLRVNTGKPKTVTFAPTIERELGNEKSGWKDRELPEPASQVFRNAFATVYQMVLKMIAKIHEAMVAYNIDRRHMLRKLISVNRYLM

SEQ ID NO: 50595 - protein, 148 aa, Sorghum bicolor
  unsure (1)..(148): unsure at all Xaa locations
  Clone ID: LIB3480-018-P1-K1-B9.pep
MTQSFRGAPQGVNLSLINGSMVTGVETLRQVEAKYPALLFKQQLTAYVEKIYGMIRDNLKKEISPLLGLCIQAPRTSRASLMKGSSRSNTNTAAQQXLIAHWQGIVKSLGNFVNILKANNVPPFLVRKVFTQIFSFINVQLXNSLLLR

SEQ ID NO: 50596 - protein, 92 aa, Sorghum bicolor
  Clone ID: LIB3480-018-P1-K1-C1.pep
VVDSKMVHADQRAVVSMDYDARGSVSSLCKSCSVDSVVQMHLVALIRDVWVVMFLLPGCKCPQCSMRDSRSISSSVRSRSCGYSRSVCAHAS

SEQ ID NO: 50597 - protein, 67 aa, Sorghum bicolor
  Clone ID: LIB3480-018-P1-K1-C3.pep
MGKIEYAVVARGAVVLAEHYGASAAGGNAGAVARQVLERLPAGGAGGDDCNVSYTQDLHVFHVKRTD

SEQ ID NO: 50598 - protein, 142 aa, Sorghum bicolor
  unsure (1)..(142): unsure at all Xaa locations
  Clone ID: LIB3480-018-P1-K1-D4.pep
QTSSSGAELYDGPPAMHYLFHPDPRVGNLFRNRLQHFVPIGAGSTRENGQNRAESLSSGRRQFSSSAAANDDWVTPGRISVPTDASKRRVRASGSHSGSGHWFTDDSGRKXYVSQNGXELTGRNAYRQYQKESGRGFGRYKK

SEQ ID NO: 50599 - protein, 76 aa, Sorghum bicolor
  Clone ID: LIB3480-018-P1-K1-D7.pep
HPFPPLKYKNTPKKQQKYPGCFALKITKKKCPLAIYHPPAEPLFIRLHSFCSILCFFLLLNYKLFLSSFCSFGRVG

SEQ ID NO: 50600 - protein, 63 aa, Sorghum bicolor
  Clone ID: LIB3480-018-P1-K1-D9.pep
VLYLELPLYINQSYLRLHSTSYLSYSITGVQFSCRGGTTPLLSNPLLYPTKSPCRTSLFLHLS

SEQ ID NO: 50601 - protein, 155 aa, Sorghum bicolor
  Clone ID: LIB3480-018-P1-K1-E1.pep
RTRGFVAWEKCVEEAEAAGASVDVVERCQDVTAALRKCMDAHADYYEPILRAERAMAADLEAFQAEEAASASAASASEEGQKKEAAAEAAAPPSDGGQNKQVAEAAVSEESKKFCSLIGRRGSGIFKIFCEGFEDMNTSSFEHQLTCCDTRDWCD

SEQ ID NO: 50602 - protein, 118 aa, Sorghum bicolor
  unsure (1)..(118): unsure at all Xaa locations
  Clone ID: LIB3480-018-P1-K1-F1.pep
SLARCWPTLGTIPVRIALYRALSYVINEGLLTERSVWIPSLAGPTTIALDKKASXISCAFPCTDGYPXVGWSDTLAYLVIPDLLGISHYISTQVTQAPQSTDTSQHGADAVTEPLPLL

SEQ ID NO: 50603 - protein, 63 aa, Sorghum bicolor
  Clone ID: LIB3480-018-P1-K1-F12.pep
QVIVGECDVPQHRSVASRPGRTNRCDATSSLVKAIHLTPEKRSILRATVAFARAQQTPSSRSI

SEQ ID NO: 50604 - protein, 96 aa, Sorghum bicolor
  Clone ID: LIB3480-018-P1-K1-G8.pep
RTRGLPDSIANLTGMKTIYLSGNNLSGPIPDLSSMHTLTAVRLDSNHFSGTIKPSMEKLVNLKELYLNYNNLTGKIPDGLKNKAGLDLRTEGNKFE

SEQ ID NO: 50605 - protein, 62 aa, Sorghum bicolor
  Clone ID: LIB3480-018-P1-K1-H3.pep
LQLRQNRLRLRLLQTRLRLRILQKLLRILQRLHQLLQNLLRLHLLRSSSFSEGGHTFLKTVN

SEQ ID NO: 50606 - protein, 150 aa, Sorghum bicolor
  unsure (1)..(150): unsure at all Xaa locations
  Clone ID: LIB3480-018-P1-K1-H4.pep
TADMAVMILRYFNVIGSDPEGRLGEAPRPELREHGRISGACFDAALGVIPGLKVKGTDYPTADGTCIRDYIDVTDLVDAHVKALNKAEPRKVGIYNVGTGRGRSVNEFVDACKKATXVNIKIEYLSRRPGDYAEYTATNKDNKGSTGSSI

SEQ ID NO: 50607 - protein, 190 aa, Sorghum bicolor
  unsure (1)..(190): unsure at all Xaa locations
  Clone ID: LIB3480-018-P1-K1-H5.pep
ASVLHHAVCAGSCKVTEFLLSKGIPVDIDCGRGTPLFHAANNEQDKTLKILLDHHANPNTIVGGGMGTPLMSALIYRSLKCMKLLIKAGAEVNGEGSVMPPLVFATGHGGYTNFIQLLLKAGANPNIPDDLGXVPIELAALRECKEEVEMLLPLTSPIPNVKKLSVDGVISHAKFENTKPLDKMRINRRR

SEQ ID NO: 50608 - protein, 188 aa, Sorghum bicolor
  unsure (1)..(188): unsure at all Xaa locations
  Clone ID: LIB3480-018-P1-K1-H8.pep
VNYAKVFDLAQTHLSHREIWRCATWLTLIVPTSMTAYLYLYSHGEVSLAASQPVLLYAILLMILLSPFDMFYLSSRFYFLRTVWRIILPLQAITFPDFFLADIFTSMSKVFSDLERSVCRMVNRQVATIAWFEADSVCGGHSVAIPLVLVFPYLWRFFQCLXQYXDTKEKTCLLNALKXSTAIPVIFF

SEQ ID NO: 50609 - protein, 39 aa, Sorghum bicolor
  Clone ID: LIB3480-019-P1-K1-B11.pep
GIKARRRSHATDYTMSDVAAEIHVLAPPAARATPAHTVR

SEQ ID NO: 50610 - protein, 58 aa, Sorghum bicolor
  Clone ID: LIB3480-019-P1-K1-D9.pep
IKIQSGGGVLLEVPLFLPLTFNLFHSYLVSQNYNSQTPVSPQLNRKTSLATTFISHDK

SEQ ID NO: 50611 - protein, 152 aa, Sorghum bicolor
  unsure (1)..(152): unsure at all Xaa locations
  Clone ID: LIB3480-019-P1-K1-E11.pep
PRVRNKALTLSVVCSTGNDGNGHVFEVCDDSVNVVNIDTWECTCRRWHVSGIPCSHAIAVFDRTEQCPLDYCSKYFXTTECXRLTYAMSINPIPDVFVPTAAGDPSQGTTLLSSPILTRRQVGRPKEKPADPRIAIKRAVRCSRCKGYGHNK

SEQ ID NO: 50612 - protein, 67 aa, Sorghum bicolor
  unsure (1)..(67): unsure at all Xaa locations
  Clone ID: LIB3480-019-P1-K1-E7.pep
RLLSHRCRTTDPARAAAFFVPFYAGLAVGRHLWAANATGAXRDRDCVRCCRAHASVSTTTVDLTAAL

SEQ ID NO: 50613 - protein, 81 aa, Sorghum bicolor
  Clone ID: LIB3480-019-P1-K1-F12.pep
GQLDGDLGGDLELGDEDRLHLHGAWWWWWPDRIVACCSCCWMKEIKGKPTSPRLALEEMLLVSVYWVELGDTARSTAGVPE

SEQ ID NO: 50614 - protein, 41 aa, Sorghum bicolor
  Clone ID: LIB3480-019-P1-K1-F7.pep
PTRPETGNNITDSVDHAYTLSYQPQALSDKVIISSQAGTAY

SEQ ID NO: 50615 - protein, 78 aa, Sorghum bicolor
  Clone ID: LIB3480-019-P1-K1-G1.pep
SRSRAAARDLELVWHPTLHVLAFLKICTDFELLNVHSVVSSCPWTFYRLYSLHGRWRLFTVTDSILIVVCMTSSMMIC

SEQ ID NO: 50616 - protein, 95 aa, Sorghum bicolor
  unsure (1)..(95): unsure at all Xaa locations
  Clone ID: LIB3480-019-P1-K1-G2.pep
RNRADVLYSPDTILYIRDTSALFRGFLKWLKPXGKTLISDILNEFGKTXSKNHAAYITQRGYDLDHVNSYAQMLTDATLHDAIHXDRTEQWLHAL

SEQ ID NO: 50617 - protein, 79 aa, Sorghum bicolor
  Clone ID: LIB3480-019-P1-K1-G6.pep
TSHAKNIITIVVCALIPIRLISHTARTNFLYYESDHLIMLVRLIVSSAHAFPSTRTPDCISPLYIMYECGCIVGDPSIT

SEQ ID NO: 50618 - protein, 101 aa, Sorghum bicolor
  Clone ID: LIB3480-020-P1-K1-A11.pep
DAWADAWDGAKFTLQFSTPGQAVVQDDVKVTLYAPPFTTHGYSMNQRLLVLSVTTFTADGQRHTVTVDAPGKPELAPPGYYMLYVIAKGVPSKAAWVKVHK

SEQ ID NO: 50619 - protein, 142 aa, Sorghum bicolor
  Clone ID: LIB3480-020-P1-K1-A2.pep
PIDSEKKQKEIIELWHECNVSIVHRTYFFLLFKGDKADNIYLEVEHRRLSFIRSSFNAGCEPSGTVISSLRNLRHERDMLYKQMLRRVNLLERESLYSKWGIDLNSKQRRLQLSRRIWTQTDMEHVRESATLVTKLVEHLEK

SEQ ID NO: 50620 - protein, 140 aa, Sorghum bicolor
  Clone ID: LIB3480-020-P1-K1-A5.pep
VRKGKMEVYLFGLFDEDMKSIAPGNFERHWGIFTYDGKPKFPIDLTGQGHDKLLSPVTDVKYLPSQWCVFDDGAKDKSKLPGNLQYACASGDCTALGYGCSCNGLDEKSNISYAFNMYFQMQDQDVRACEFDGLAKITDK

SEQ ID NO: 50621 - protein, 91 aa, Sorghum bicolor
  unsure (1)..(91): unsure at all Xaa locations
  Clone ID: LIB3480-020-P1-K1-A6.pep
XDNYKKKKKKKKKKRNKNKKKKKLRSPALGRAGFCLLASQPLSFCLVFPKFKSVKSIPCPILCPFLTITFLDLPELHPGPPTFLFTKGAQA

SEQ ID NO: 50622 - protein, 139 aa, Sorghum bicolor
  Clone ID: LIB3480-020-P1-K1-B4.pep
KHKKHKSDDGDLDSTSPKKHKKEKSIDSDASSYLQKEEEKSGGDSDEATSLKKHKKEKKNKKKKEKSGEDADEDNAAPVDVSMDGQYVSPSSKEEKSDEDDAMPVDVSTTTGQYVSSPKSKGGERQVSTPTDAYTSPDE

SEQ ID NO: 50623 - protein, 48 aa, Sorghum bicolor
  Clone ID: LIB3480-020-P1-K1-C12.pep
GRVGFSFFFFLILFFLFLFYYFILILKVGGHTTAYTVNTIFLPWITSR

SEQ ID NO: 50624 - protein, 59 aa, Sorghum bicolor
  Clone ID: LIB3480-020-P1-K1-C9.pep
DSMACPVKNEYFLRRSLQPPALVVVLPVATASSGATATHGRPALATADADAGRKRAHAS

SEQ ID NO: 50625 - protein, 131 aa, Sorghum bicolor
  Clone ID: LIB3480-020-P1-K1-D4.pep
PTRPVIFNVLWEMVVSSGTCLKINAAALLRALVPYTDVKVASTHILPALVTLGSDQNLKVKYASIDAFGAVAQHFKNDMVVDKIRIQMDAFLEDGSHEASISVIRALAIAVPHSTDRLREYLLTKIFNMSS

SEQ ID NO: 50626 - protein, 85 aa, Sorghum bicolor
  Clone ID: LIB3480-020-P1-K1-D5.pep
SQAKSPPPVVKGSERVYEENENLRLQLALKTTELKQEENRRLQLELIIKSKETESLQKQIEDLKAENEQLRKNVKPQRVERKCRY

SEQ ID NO: 50627 - protein, 113 aa, Sorghum bicolor
  Clone ID: LIB3480-020-P1-K1-E9.pep
APDYCNIYVVAKGKSVNVRLAKCGVPAMHSGADTIPSDTDSQSGLYVRRGSRGHLPPVMPDATRRSVDGRTLPELNTRPAFRERSLPSSATKNVVVVVPGKDFSETFSRSARH

SEQ ID NO: 50628 - protein, 156 aa, Sorghum bicolor
  unsure (1)..(156): unsure at all Xaa locations
  Clone ID: LIB3480-020-P1-K1-F5.pep
GQKKKKPRSEPSAPAFRSSYFNWFHFSMSWGYAIATAGLSYVQDNAGWTVGFGACWTALALCLAVFLLGTRIYRAKQRPVDGGTFAEAVRALGARVFRRKDTTAPTDERLLLSPQHEEDGLIAKLLPIWLTSLVFXVRPSTSQVSTLFTKPASTLD

SEQ ID NO: 50629 - protein, 110 aa, Sorghum bicolor
  Clone ID: LIB3480-020-P1-K1-H10.pep
GILEVKWSGIELEDWWRNEQFWLISGTSAHLYAVVQGLLKVMAGIEISFTLTAKAAAEDNEDIYADLYVVKWSSLLIPPITIGMINLIAIAFAFARTVYSDNPRWGKFIG

SEQ ID NO: 50630 - protein, 58 aa, Sorghum bicolor
  Clone ID: LIB3480-020-P1-K1-H11.pep
KKKKKKEEGTKTRQKKKNPRMKKNKIQMGSPIICGPPLPWLHADVPLHPTFSIYFCRP

SEQ ID NO: 50631 - protein, 61 aa, Sorghum bicolor
  Clone ID: LIB3480-021-P1-K1-A11.pep
FATKVPEHGAINKGRNSSVNKPGSVVFLQRTHIAGTLFIIRCFHHQIFRSSLRPSTAPGAL

SEQ ID NO: 50632 - protein, 47 aa, Sorghum bicolor
  Clone ID: LIB3480-021-P1-K1-A12.pep
RSFRDCMIIPALVSKSYDMVHVLYCLRDNICWTLQYHWNSQMAQELR

SEQ ID NO: 50633 - protein, 103 aa, Sorghum bicolor
  Clone ID: LIB3480-021-P1-K1-A3.pep
AGLRTKHLGFHKALCVLMGWNSHVAPDTCKAHHSIPSEEVNAMRGDLMLWPPVVVIQNSSTGKEAKDTGAKVVSIKEIEGVLADIGVPPEKARVSHGRPDNQS

SEQ ID NO: 50634 - protein, 99 aa, Sorghum bicolor
  unsure (1)..(99): unsure at all Xaa locations
  Clone ID: LIB3480-021-P1-K1-A5.pep
GRVGRDLYFPTKYSQSSFTQCMACIWKQNMSYWRNPPYNTARFIFTTITALIFGTMFWNLGSKIDKSQDLFNALXSMYXSVIFLGCTNSISVQPSVAVE

SEQ ID NO: 50635 - protein, 51 aa, Sorghum bicolor
  Clone ID: LIB3480-021-P1-K1-B11.pep
CKTIMLGRERVLAVRRLYSDGHSIPSSCRNRHGMMWRAGVGLDLIPRSSDR

SEQ ID NO: 50636 - protein, 67 aa, Sorghum bicolor
  Clone ID: LIB3480-021-P1-K1-C3.pep
VNYKTGGSHWVIDSGCTQHMTGDPRMFTSLDEDVDNQEKITFGDNSKGKVKGLGKVAISNDYSITNV

SEQ ID NO: 50637 - protein, 149 aa, Sorghum bicolor
  unsure (1)..(149): unsure at all Xaa locations
  Clone ID: LIB3480-021-P1-K1-D1.pep
HASVPIPLQPYIVAKSQQPGLSLNLDGIVRAPLHQLPSFSIPGPSPNELSVPGGIPLPTCRIAPPNLLALXKQAXYQQGSIGGLPGHGHQQPSFSIPGPXPNELSTPGGIPLPICRTTFPDLLALLKQPWYQPESIAGLPGHDVFSYFE

SEQ ID NO: 50638 - protein, 114 aa, Sorghum bicolor
  Clone ID: LIB3480-021-P1-K1-D11.pep
PTRPRSYTSSPSERRSTFHSSTSYTKSRGTPPIHSTSSTSCSCPSSPADGHLTFPSPYLPKIGAPLHPSKPHLALSSPAKPATLTTLSPSILYPPSRPHFLFTPTDRAPPPFKL

SEQ ID NO: 50639 - protein, 83 aa, Sorghum bicolor
  unsure (1)..(83): unsure at all Xaa locations
  Clone ID: LIB3480-021-P1-K1-D12.pep
GFVYNSLLLNSLPFLSEYTEITPKKWDGGSCVEVPRXFMLLQELERVEKGIGDGPLSYGIYDADDIYIRSWTGTIIGPHNTVH

SEQ ID NO: 50640 - protein, 76 aa, Sorghum bicolor
  Clone ID: LIB3480-021-P1-K1-F5.pep
TSTRKVCPPSGSTKDGMASRVPICMNYGLCIRFVMMKLLPRAGLHRAIKQEEKCLRSVIFSVCGADTCTPSTLSQY

SEQ ID NO: 50641 - protein, 44 aa, Sorghum bicolor
  Clone ID: LIB3480-021-P1-K1-F8.pep
ADGLEASGQRLLWVVRAPISDDSGKMIAMHSAPDLNALIPKTLL

SEQ ID NO: 50642 - protein, 99 aa, Sorghum bicolor
  Clone ID: LIB3480-021-P1-K1-G1.pep
QDQQTSAMPTQSMYHHQYQYSVPPSVAANTFGDPFSDLAPMECSWKTEQLILFSELVLHCLIIQLSRAANLYRTSLLADWMCCILTNFCNIQILKSHMN

SEQ ID NO: 50643 - protein, 76 aa, Sorghum bicolor
  Clone ID: LIB3480-021-P1-K1-G5.pep
LFIDLLLVLREGHDYAHICHYDPSGWRHLFSFGVISKRSSNKSLPECCYVLHDQSSLSMLYFKIFLNYFFRERLLC

SEQ ID NO: 50644 - protein, 49 aa, Sorghum bicolor
  unsure (1)..(49): unsure at all Xaa locations
  Clone ID: LIB3480-021-P1-K1-G8.pep
KMTYYGTAPRVIHQPHXAATSTFIAREVAXGLLKYQPDVIISVHSVMQH

SEQ ID NO: 50645 - protein, 71 aa, Sorghum bicolor
  unsure (1)..(71): unsure at all Xaa locations
  Clone ID: LIB3480-021-P1-K1-H1.pep
STNLLHEKIPTVVGAIAISGFWVXACSLPFDYLYKQIHNMQPDANGKYLYSGNLDCVMKTFNSEKSFKFYT

SEQ ID NO: 50646 - protein, 63 aa, Sorghum bicolor
  Clone ID: LIB3480-021-P1-K1-H3.pep
RLFRIMRRSCCIKRRELLPREVQVMQTAEFLLTELQIAKVCTSIQLLSKTRSERQHLPSVELD

SEQ ID NO: 50647 - protein, 63 aa, Sorghum bicolor
  Clone ID: LIB3480-021-P1-K1-H7.pep
EDIDEVIELTDAPTKVAERPVSSRRDRSSRGCTTCIVDGTEMTRAHSECMNCNIHHHSIVPSY

SEQ ID NO: 50648 - protein, 66 aa, Sorghum bicolor
  Clone ID: LIB3480-022-P1-K1-B1.pep
VVHFIAFQCGLYHDDPGLVAQLPEAKLFIPTGLFIESRHGCIIYIKGWYYMCTVVPDEGGGEERDH

SEQ ID NO: 50649 - protein, 45 aa, Sorghum bicolor
  Clone ID: LIB3480-022-P1-K1-C7.pep
IISSLSLFTIFLSVVTNFLGPTSGPKGGSISLGGYLHLLVFLTYH

SEQ ID NO: 50650 - protein, 44 aa, Sorghum bicolor
  Clone ID: LIB3480-022-P1-K1-D2.pep
KSYLVAMQEISNPGTLKESAHVACACYVSVDLVDRELFFFFLST

SEQ ID NO: 50651 - protein, 48 aa, Sorghum bicolor
  Clone ID: LIB3480-022-P1-K1-D4.pep
LSTAIFLSVRCLSTAGQLIVFSSLYKISISLHACVSLVLSYRPLALYL

SEQ ID NO: 50652 - protein, 49 aa, Sorghum bicolor
  Clone ID: LIB3480-022-P1-K1-D5.pep
CSEESQARKLVSVERTDAVGGDVNQVGHRLLERPGQDQDLLHEAGRPRA

SEQ ID NO: 50653 - protein, 55 aa, Sorghum bicolor
  Clone ID: LIB3480-022-P1-K1-E11.pep
GPKKLFYKTSSKTGSITLWRIFIAQFCFPIIKENYMYFTSLREKKKKKKKKKKKK

SEQ ID NO: 50654 - protein, 52 aa, Sorghum bicolor
  Clone ID: LIB3480-022-P1-K1-F1.pep
GPGANTAGRVNWPGFKKVISKADASKFTVENFLHAQPWIDPTGTPVKYDLFT

SEQ ID NO: 50655 - protein, 137 aa, Sorghum bicolor
  unsure (1)..(137): unsure at all Xaa locations
  Clone ID: LIB3480-022-P1-K1-F2.pep
TLIVRMELSDLSACLAAIVCSSLQPPLRPLGSPAGDWASVIIKSVLDRATVLLTDQHVASNYSMQNRALWQASFDAFFGLLTQYCMSKFDSVVHTAQLQPAAAAVITXEMPVELLRASLPHTNEDQRXQXLXFAQRT

SEQ ID NO: 50656 - protein, 61 aa, Sorghum bicolor
  Clone ID: LIB3480-022-P1-K1-F4.pep
CLSDPDNLNMSLSGPANQYVSPRSPYLGCSFQVWYLILGTPEWFLCVRCCLLSYMDMIRAG

SEQ ID NO: 50657 - protein, 75 aa, Sorghum bicolor
  Clone ID: LIB3480-022-P1-K1-F9.pep
MATTTRAAAAAGVLLLVLSALALVARAEDPYLFFEWKVTYGTKSLLGVPQKVILINGEFPGPTSTATPKLVLDCE

SEQ ID NO: 50658 - protein, 150 aa, Sorghum bicolor
  Clone ID: LIB3480-022-P1-K1-G6.pep
TTTTTCSSIRGMKTSAIASIGAHQLRRVIVGDEAPNNKQKQQAPMTVFYNGAVATFDGVSQDKAEAIMKMAMEVTTSNGGRVVRGDAFAGNLTKDMPLTRTKSLQQFLQKRKERLSGLGPYQLGIMGSGGTSRVGAATTNKSFHVKEEAA

SEQ ID NO: 50659 - protein, 67 aa, Sorghum bicolor
  Clone ID: LIB3480-022-P1-K1-H1.pep
AGDHAELTSETQPDNKHSGQGDDSGATAGQGETEAARSASDEHTTIGKAAHLGDSTNNEGGTTRKGR

SEQ ID NO: 50660 - protein, 96 aa, Sorghum bicolor
  Clone ID: LIB3480-022-P1-K1-H12.pep
LQREEGKVSDKSSSAWASEAVATMEMTHSKLFPFFMTGLLPQEAMQYLDLVCRCTKNTRHLVSMLRSLAERLEDANPSIIHNNPTKLYEHLLVKSP

SEQ ID NO: 50661 - protein, 130 aa, Sorghum bicolor
  Clone ID: LIB3480-022-P1-K1-H8.pep
QIIELSAGLVHMWRNMYECHQVQNHIAQQVSLLGNIPGSEPTSDTHCQATSQLEIEVSGWHNAFCNLITLQREYISILNQWIGLTDCLPDDGGLMRSSSGIRSLSEELQRALDRLPEKIAAEAIMTFMSI

SEQ ID NO: 50662 - protein, 128 aa, Sorghum bicolor
  Clone ID: LIB3480-023-P1-K1-B8.pep
PLEKVPLLERFVNGDDAFRNSRFKLIPYISKGSWIVKQSVGKKACLVGQALEINYFRGNNYLELGVDIGSSTVARGVVSLVLGYLNNLVIEMAFLVQGNTYEELPEFLLGTCRLNYLDASKAVSIDEC

SEQ ID NO: 50663 - protein, 85 aa, Sorghum bicolor
  Clone ID: LIB3480-023-P1-K1-C3.pep
CFRRCWAHPCSGTPCRSSQRWLISQYSRIESSQKQLNLSIWFQSSMSRNMEIPVPVWSTVYPQQPASQLSALVEARFAHCFLDIL

SEQ ID NO: 50664 - protein, 135 aa, Sorghum bicolor
  Clone ID: LIB3480-023-P1-K1-D1.pep
LEKLRGVVLHSGILSGIRVLYPVKVTLWFDIFKNIDKIKQVACPVLVIHGTADDIVDFTHGKRLWELAKEKYEPLWIKGGGHCNLETYPEYIRHLRKFINAMEKLAKDSKAAQAPPSSSLAAEARHSKCLRFGKR

SEQ ID NO: 50665 - protein, 103 aa, Sorghum bicolor
  Clone ID: LIB3480-023-P1-K1-E11.pep
LVTSACSVIRNLGTIMPCNKFCPMWMLDTIATCVTTLVVLIPTHHIINFPIYLMTSTKTRMIKIMDRADTHGLHIISTFSQLQKNRIKFKLCKIQAFLSLIII

SEQ ID NO: 50666 - protein, 176 aa, Sorghum bicolor
  Clone ID: LIB3480-023-P1-K1-F1.pep
MNPVLKRNYTVREDAYGEIRRVRPKINGNSWENSKFKQVDIIRNNPAANSREEPTARNPSASRDGKKLLNDILGANNLRYPNFISKVETADEILDVPDKPSAVTPQQYDSSFPQAGREQKGFGATTLNQCSNEDLKKGFALKVEPLNAFLPFEQQMMDLSHRKQEHAACDDSCSLS

SEQ ID NO: 50667 - protein, 49 aa, Sorghum bicolor
  Clone ID: LIB3480-023-P1-K1-G1.pep
MSLVHSRRLKRSITHSRSLSYPDRIVRVLHLGAIRPVLLISGHFQSNAG
